United States Patent 7,745,391 (HUMAN THROMBOSPONDIN POLYPEPTIDE) - sequence listing, part 264

SEQ ID NO: 744303 - protein, 173 aa, Homo sapiens
PEVEDSGVAMAASLGQVLALVLVAALWGGTQPLLKRASAGLQRVHEPTWAQQLLQEMKTLFLNTEYLMPFLLNQCGSLLYYLTLASTDLTLAVPICNSLAIIFTLIVGKALGEDIGGKRAVAGMVLTVIGISLCITSSVPWTAELQLHGKGQLQTLSQKCKREASGTQSERFG

SEQ ID NO: 744304 - protein, 105 aa, Homo sapiens
PEVEDSGVAMAASLGQVLALVLVAALWGGTQPLLKRASAGLQRVHEPTWAQQLLQEMKTLFLNTEYLMPFLLNQCGSLLYYLTLASTGWSQTSEFRSSCWNPGKH

SEQ ID NO: 744305 - protein, 105 aa, Homo sapiens; identical to SEQ ID NO: 744304

SEQ ID NO: 744306 - protein, 117 aa, Homo sapiens
MKTLFLNTEYLMPFLLNQCGSLLYYLTLASTDLTLAVPICNSLAIIFTLIVGKALGEDIGGKRAVAGMVLTVIGISLCITSSVPWTAELQLHGKGQLQTLSQKCKREASGTQSERFG

SEQ ID NO: 744307 - protein, 843 aa, Homo sapiens
GAGRHRTPARLRCGSGPRSGPTRSVTAGSGAHLPAAAPGPCGGPRGGRRPRASRSPGGPGLHRGGLGAMEPPYSLTAHYDEFQEVKYVSRCGAGGARGASLPPGFPLGAARSATGARSGLPRWNRREVCLLSGLVFAAGLCAILAAMLALKYLGPVAAGGGACPEGCPERKAFARAARFLAANLDASIDPCQDFYSFACGGWLRRHAIPDDKLTYGTIAAIGEQNEERLRRLLARPGGGPGGAAQRKVRAFFRSCLDMREIERLGPRPMLEVIEDCGGWDLGGAEERPGVAARWDLNRLLYKAQGVYSAAALFSLTVSLDDRNSSRYVIRIDQDGLTLPERTLYLAQDEDSEKILAAYRVFMERVLSLLGADAVEQKAQEILQVEQQLANITVSEYDDLRRDVSSMYNKVTLGQLQKITPHLRWKWLLDQIFQEDFSEEEEVVLLATDYMQQVSQLIRSTPHRVLHNYLVWRVVVVLSEHLSPPFREALHELAQEMEGSDKPQELARVCLGQANRHFGMALGALFVHEHFSAASKAKVQQLVEDIKYILGQRLEELDWMDAETRAAARAKLQYMMVMVGYPDFLLKPDAVDKEYEFEVHEKTYFKNILNSIRFSIQLSVKKIRQEVDKSTWLLPPQALNAYYLPNKNQMVFPAGILQPTLYDPDFPQSLNYGGIGTIIGHELTHGYDDWGGQYDRSGNLLHWWTEASYSRFLRKAECIVRLYDNFTVYNQRVNGKHTLGENIADMGGLKLAYHAYQKWVREHGPEHPLPRLKYTHDQLFFIAFAQNWCIKRRSQSIYLQVLTDKHAPEHYRVLGSVSQFEEFGRAFHCPKDSPMNPAHKCSVW

SEQ ID NO: 744308 - protein, 272 aa, Homo sapiens
SGGHPDNSSMIFYANDTGAQQFEKWWDKSRTVPFYLVGLLLPLLNFKSPSFFSKFNILGTVSVLYLIFLVTFKAVRLGFHLEFHWFIPTEFFVPEIRFQFPQLTGVLTLAFFIHNCIITLLKNNKKQENNVRDLCIAYMLVTLTYLYIGVLVFASFPSPPLSKDCIEQNFLDNFPSSDTLSFIARIFLLFQMMTVYPLLGYLARVQLLGHIFGDIYPRYSGAACGLAFVFIYPSLIYIISLHQEERLTWPKLIFHVFIIILGVANLIVQFFM

SEQ ID NO: 744309 - protein, 302 aa, Homo sapiens
SGGHPDNSSMIFYANDTGAQQFEKWWDKSRTVPFYLVGLLLPLLNFKSPSFFSKFNILGTVSVLYLIFLVTFKAVRLGFHLEFHWFIPTEFFVPEIRFQFPQLTGVLTLAFFIHNCIITLLKNNKKQENNVRDLCIAYMLVTLTYLYIGVLVFASFPSPPLSKDCIEQNFLDNFPSSDTLSFIARIFLLFQMMTVYPLLGYLARVQLLGHIFGDIYPSIFHVLILNLIIVGAGVIMACFYPNIGGIIRYSGAACGLAFVFIYPSLIYIISLHQEERLTWPKLIFHVFIIILGVANLIVQFFM

SEQ ID NO: 744310 - protein, 344 aa, Homo sapiens
EPPAASPARHPCSMAWNTNLRWRLPLTCLLLQVIMVILFGVFVRYDFEADAHWWSERTHKNLSDMENEFYYRYPSFQDVHVMVFVGFGFLMTFLQRYGFSAVGFNFLLAAFGIQWALLMQGWFHFLQDRYIVVGVENLINADFCVASVCVAFGAVLGKVSPIQLLIMTFFQVTLFAVNEFILLNLLKVKDAGGSMTIHTFGAYFGLTVTRILYRRNLEQSKERQNSVYQSDLFAMIGTLFLWMYWPSFNSAISYHGDSQHRAAINTYCSLAACVLTSVAISSALHKKGKLDMVHIQNATLAGGVAVGTAAEMMLMPYGALIIGFVCGIISTLGFVYLTAASWVL

SEQ ID NO: 744311 - protein, 492 aa, Homo sapiens
EPPAASPARHPCSMAWNTNLRWRLPLTCLLLQVIMVILFGVFVRYDFEADAHWWSERTHKNLSDMENEFYYRYPSFQDVHVMVFVGFGFLMTFLQRYGFSAVGFNFLLAAFGIQWALLMQGWFHFLQDRYIVVGVENLINADFCVASVCVAFGAVLGKVSPIQLLIMTFFQVTLFAVNEFILLNLLKVKDAGGSMTIHTFGAYFGLTVTRILYRRNLEQSKERQNSVYQSDLFAMIGTLFLWMYWPSFNSAISYHGDSQHRAAINTYCSLAACVLTSVAISSALHKKGKLDMVHIQNATLAGGVAVGTAAEMMLMPYGALIIGFVCGIISTLGFVYLTPFLESRLHIQDTCGINNLHGIPGIIGGIVGAVTAASASLEVYGKEGLVHSFDFQGFNGDWTARTQGKFQIYGLLVTLAMALMGGIIVGLILRLPFWGQPSDENCFEDAVYWEMPEGNSTVYIPEDPTFKPSGPSVPSVPMVSPLPMASSVPLVP

SEQ ID NO: 744312 - protein, 492 aa, Homo sapiens; identical to SEQ ID NO: 744311

SEQ ID NO: 744313 - protein, 250 aa, Homo sapiens
MYWPSFNSAISYHGDSQHRAAINTYCSLAACVLTSVAISSALHKKGKLDMVHIQNATLAGGVAVGTAAEMMLMPYGALIIGFVCGIISTLGFVYLTPFLESRLHIQDTCGINNLHGIPGIIGGIVGAVTAASASLEVYGKEGLVHSFDFQGFNGDWTARTQGKFQIYGLLVTLAMALMGGIIVGLILRLPFWGQPSDENCFEDAVYWEMPEGNSTVYIPEDPTFKPSGPSVPSVPMVSPLPMASSVPLVP

SEQ ID NO: 744314 - protein, 34 aa, Homo sapiens
SEVGGELGECVERGECGKEGHGENWPFPVVLKEE

SEQ ID NO: 744315 - protein, 179 aa, Homo sapiens
KHLRPTEGFPHTQVSLQLASGAFLLNEAFCEATHIPMEKLKWTSPFTCHRVSLTTRPSESKTPSPQLCTSSPPRHPSCDSFSLEPLAKGKLGLEPRAVVEHTGKLWATVVGLAWLEHSSASYFTEWELVAAKANSWLEQQEVPEGRTQGTLKAAARQLFVLLRHWDENLEFNMLCYNPN

SEQ ID NO: 744316 - protein, 153 aa, Homo sapiens
GQSGLFTQYNIQKKAMTVGEYRRLANSEKYCTPRHQDFDDLERKYWKNLTFVSPIYGADISGSLYDDDVAQWNIGSLRTILDMVERECGTIIEGVNTPYLYFGMWKTTFAWHTEDMDLYSINYLPPGEATPGGPRSTEFVHPSSQAQPDVLFA

SEQ ID NO: 744317 - protein, 104 aa, Homo sapiens
GALGSRWLRVGCVAPRPHPELVLGCLFTRYCTPRHQDFDDLERKYWKNLTFVSPIYGADISGSLYDDVSMRLRGRTGTSFLVGGGGRALNGTLPWQMKLPGRQG

SEQ ID NO: 744318 - protein, 77 aa, Homo sapiens
RIARLRGASHGVRAWPRQGWGDAVRAARDRNPHSGAAERAVLLFSGSLASDVGKKRRAQERQLESGLARPRFLQLLP

SEQ ID NO: 744319 - protein, 104 aa, Homo sapiens
VETRSHYVAQAGLELLCSSDPPGSASQSGGITGVSHHTWPKSSLDHTQPSPATTLFVCFSLAQNSLKVICTCCFQFFSFHFSEIPLNQAFICLTPRNCSCQGPP

SEQ ID NO: 744320 - protein, 107 aa, Homo sapiens [sequence omitted]

SEQ ID NO: 744321 - protein, 103 aa, Homo sapiens
MEGPGETAPVAEGFTGPARSTQVRSPVEVMLRSPESLIIFKTWSSLFPVLLSFQKCLRCILPFSFLHMKTSLTIFSGLLSNTEHQVLQRSWCPGAESYLCGHL

SEQ ID NO: 744322 - protein, 253 aa, Homo sapiens
TLALFRGASEVFSCFKMKLNISFPATGCQKLIEVDDERKLRTFYEKRMATEVAADALGEEWKGYVVRISGGNNKQGFPLKQGVLTHGRVHLLLSKGHSYYRPRRTGERKRTKSQSGGCALVAYRNILDAVSQSVVYCVQPNTGREGHIPGNVTWILQWPTPLWGPQNDASRIRKLFSLSKENDVCQYVVKKPLNKEGKKPRTKAPKIQRLVTPHVLQHKQRRIALKQPHIKKNKEEAAEYAKLLAKRMKEAKK

SEQ ID NO: 744323 - protein, 141 aa, Homo sapiens
TLALFRGASEVFSCFKMKLNISFPATGCQKLIEVDDERKLRTFYEKRMATEVAADALGEEWKGYVVRISGGNNKQGFPLKQGVLTHGRVHLLLSKGHSYYRPRRTGERKRRSVHGCIVDANLSVLNLVIVKKRREGYSWTD

SEQ ID NO: 744324 - protein, 91 aa, Homo sapiens
AQRGPGKAGLTGGRERLERGARAARTDQHQRIQEEERDLTGSGDISPPQHPSRHSLHLLVLQAAQAIVESPPGVQNGASASCHSGPLKSPM

SEQ ID NO: 744325 - protein, 129 aa, Homo sapiens
GCYFGGGGGGSVSREGQHPLFAAFPGRAARERKREASEIPEWIDRCYVIGAASSTPQEARSWGERGSPAAGATRTVSPPHRSLELGIQEEAASFVFWCHRRWPPMAFGLLTWGGWVLHHPPTLLPPCGR

SEQ ID NO: 744326 - protein, 84 aa, Homo sapiens
GLSEFGFREAWSWASKKKQPHLFSGVIVGGHLWLLGFSPGAGGFCTTLPPSFLRVDDRATSSTTDSSRATKKKNVLHLVGLDSL

SEQ ID NO: 744327 - protein, 129 aa, Homo sapiens; identical to SEQ ID NO: 744325

SEQ ID NO: 744328 - protein, 187 aa, Homo sapiens
AQRGPGKAGLTGGRERLERGARAARTDQHQRIQEEERDLTGSGDISPPQHPSRHSFSPGAGGFCTTLPPSFLRVDDRATSSTTDSSRAPSSPRPPGSTSHCGISTRCTERCLCVLPLRTSQVPDVMAPQHDQEKFHDLAYSCLGKSFSMSNQDLYGYSTSSLALGLAWLSWETKKKNVLHLVGLDSL

SEQ ID NO: 744329 - protein, 121 aa, Homo sapiens
MGVLCYVATEEQPRLMPLKFEYTQINTPVRRGTSCVLVAMINHARCMNLYSIVIASSHGGPDMKAANPLYYSPLEAEGLTAAGHIGKEAGACSVSGQGYANQKEECTSSGWAGFPLISLPS

SEQ ID NO: 744330 - protein, 166 aa, Homo sapiens
KNFQFYSLDTATSTIFTGNQIVSWFLYSFLSSAPHFNTLLLNSRSRKPKAIFSQIFDPSVALSATPSLLDKFSSHPIPGMERVLLISSYSHRNHPSQQAVGETEIETANLTKPRSMFGCFHLSSTQISEPQFRYLYNQDKKPLGLLCAENEEFYIKDRILCYDTHG

SEQ ID NO: 744331 - protein, 177 aa, Homo sapiens
MELGREDGERRKEGETMNGGPQKRCKVEHRSRGGREASALGLVPRLLRGLWVIRKVLEESEWGNISMRRERVRCGQAVSSASLRVSLGPVKGDCVLEVMLHLLSSAQHSGETASSQRPLTAPSTKTTGPSQAQSSLTCMENVMPFSQSFPLAFCSSVTSMIICSWFHSFSPPDGPVP

SEQ ID NO: 744332 - protein, 156 aa, Homo sapiens
MFLTEDLITFNLRNFLLFQLWESSFSPGAGGFCTTLPPSFLRVDDRATSSTTDSSRAPSSPRPPGSTSHCGISTRCTERCLCVLPLRTSQVPDVMAPQHDQEKFHDLAYSCLGKSFSMSNQDLYGYSTSSLALGLAWLSWETKKKNVLHLVGLDSL

SEQ ID NO: 744333 - protein, 127 aa, Homo sapiens
MIRSERNSDLFRSVSPRTRGTLSRTVFCLQAVIPCYTSKSQEEEWFWHHPPQTAMGPLGLEGRTQAAAGIWRLSPGHGASASPGWGCLLLGLSIWHQLASQHRPHNQPDSSFCCCHGNWLPYCTSEH

SEQ ID NO: 744334 - protein, 127 aa, Homo sapiens; identical to SEQ ID NO: 744333

SEQ ID NO: 744335 - protein, 127 aa, Homo sapiens; identical to SEQ ID NO: 744333

SEQ ID NO: 744336 - protein, 67 aa, Homo sapiens
GLWLLSALRAAPPAAVAPCLLLIVTAKQVNVIILVILCWWGWAPWLGLLWSEGGEHLAEAVSRGTRC

SEQ ID NO: 744337 - protein, 127 aa, Homo sapiens; identical to SEQ ID NO: 744333

SEQ ID NO: 744338 - protein, 127 aa, Homo sapiens; identical to SEQ ID NO: 744333

SEQ ID NO: 744339 - protein, 119 aa, Homo sapiens
MVEWVGEEKENWPCLTYVFSCSLYPSTPLPVSSSFRPLILVYSNCRKTYIVNDRPPCFQFCDREERHWGYRELFPLLQWAPEGKVGGQLTLGEMIGWRREQRYLYLGDRGEKEEEHGVW

SEQ ID NO: 744340 - protein, 410 aa, Homo sapiens
KCSPDPPLCSAAHRGKMALEVGDMEDGQLSDSDSDMTVAPSDRPLQLPKVLGGDSAMRAFQNTATACAPVSHYRAVESVDSSEESFSDSDDDSCLWKRKRQKCFNPPPKPEPFQFGQSSQKPPVAGGKKINNIWGAVLQEQNQDAVATELGILGMEGTIDRSRQSETYNYLLAKKLRKESQEHTKDLDKELDEYMHGGKKMGSKEEENGQGHLKRKRPVKDRLGNRPEMNYKGRYEITAEDSQEKVADEISFRLQEPKKDLIARVVRIIGNKKAIELLMETAEVEQNGGLFIMNGSRRRTPGGVFLNLLKNTPSISEEQIKDIFYIENQKEYENKKAARKRRTQVLGKKMKQAIKSLNFQEDDDTSRETFASDTNEALASLDESQEGHAEAKLEAEEAIEVDHSHDLDIF

SEQ ID NO: 744341 - protein, 410 aa, Homo sapiens; identical to SEQ ID NO: 744340

SEQ ID NO: 744342 - protein, 410 aa, Homo sapiens; identical to SEQ ID NO: 744340

SEQ ID NO: 744343 - protein, 410 aa, Homo sapiens; identical to SEQ ID NO: 744340

SEQ ID NO: 744344 - protein, 410 aa, Homo sapiens; identical to SEQ ID NO: 744340

SEQ ID NO: 744345 - protein, 410 aa, Homo sapiens; identical to SEQ ID NO: 744340

SEQ ID NO: 744346 - protein, 410 aa, Homo sapiens; identical to SEQ ID NO: 744340

SEQ ID NO: 744347 - protein, 410 aa, Homo sapiens; identical to SEQ ID NO: 744340

SEQ ID NO: 744348 - protein, 407 aa, Homo sapiens
GYFKSPGTWRLKFVNDMASWFDQFDNSDSDSDMTVAPSDRPLQLPKVLGGDSAMRAFQNTATACAPVSHYRAVESVDSSEESFSDSDDDSCLWKRKRQKCFNPPPKPEPFQFGQSSQKPPVAGGKKINNIWGAVLQEQNQDAVATELGILGMEGTIDRSRQSETYNYLLAKKLRKESQEHTKDLDKELDEYMHGGKKMGSKEEENGQGHLKRKRPVKDRLGNRPEMNYKGRYEITAEDSQEKVADEISFRLQEPKKDLIARVVRIIGNKKAIELLMETAEVEQNGGLFIMNGSRRRTPGGVFLNLLKNTPSISEEQIKDIFYIENQKEYENKKAARKRRTQVLGKKMKQAIKSLNFQEDDDTSRETFASDTNEALASLDESQEGHAEAKLEAEEAIEVDHSHDLDIF

SEQ ID NO: 744349 - protein, 213 aa, Homo sapiens
KCSPDPPLCSAAHRGKMALEVGDMEDGQLSDSDSDMTVAPSDRPLQLPKVLGGDSAMRAFQNTATACAPVSHYRAVESVDSSEESFSDSDDDSCLWKRKRQKCFNPPPKPEPFQFGQSSQKPPVAGGKKINNIWGAVLQEQNQDAVATELGILGMEGTIDRSRQSETYNYLLAKKLRKESQEHTKDLDKELDEYMHGGKKMGSKEEENGQGHL

SEQ ID NO: 744350 - protein, 221 aa, Homo sapiens
AEVISEDPPGLFPSKEEENGQGHLKRKRPVKDRLGNRPEMNYKGRYEITAEDSQEKVADEISFRLQEPKKDLIARVVRIIGNKKAIELLMETAEVEQNGGLFIMNGSRRRTPGGVFLNLLKNTPSISEEQIKDIFYIENQKEYENKKAARKRRTQVLGKKMKQAIKSLNFQEDDDTSRETFASDTNEALASLDESQEGHAEAKLEAEEAIEVDHSHDLDIF

SEQ ID NO: 744351 - protein, 157 aa, Homo sapiens
MALSGSVEELLFLQNALGRNVRKALVSGPDLLPQDWLLRPSALSGRTARGSSRTWGSILQNSSWLFQDLGLHLAEQLVALPGPGAPSCRTARGSSRTWGSILQNSSWLFQDLGLPSCRTARGSSRTWGSILQNKSWLFQDLGLHLANSSWLFQDLGS

SEQ ID NO: 744352 - protein, 48 aa, Homo sapiens
MQQAKSHLEELRIRSKSLNTESASGFSGCSVACVLGAPGEVSEAAGTC

SEQ ID NO: 744353 - protein, 718 aa, Homo sapiens
MSVSGKKEFDVKQILRLRWRWFSHPFQGSTNTGSCLQQEGYEHRGTPVQGRLKSHSRDRNGLKKSNSPVHHNILAPVPGPAPAHQRAVQNLQQHNLIVHFQANEDTPKSVPEKNLFKEACEKRAQDLEMMADDNIEDSTARLDTQHSEDMNATRSEEQFHVINHAEQTLRKMENYLKEKQLCDVLLIAGHLRIPAHRLVLSAVSDYFAAMFTNDVLEAKQEEVRMEGVDPNALNSLVQYAYTGVLQLKEDTIESLLAAACLLQLTQVIDVCSNFLIKQLHPSNCLGIRSFGDAQGCTELLNVAHKYTMEHFIEVIKNQEFLLLPANEISKLLCSDDINVPDEETIFHALMQWVGHDVQNRQGELGMLLSYIRLPLLPPQLLADLETSSMFTGDLECQKLLMEAMKYHLLPERRSMMQSPRTKPRKSTVGALYAVGGMDAMKGTTTIEKYDLRTNSWLHIGTMNGRRLQFGVAVIDNKLYVVGGRDGLKTLNTVECFNPVGKIWTVMPPMSTHRHGLGVATLEGPMYAVGGHDGWSYLNTVERWDPEGRQWNYVASMSTPRSTVGVVALNNKLYAIGGRDGSSCLKSMEYFDPHTNKWSLCAPMSKRRGGVGVATYNGFLYVVGGHDAPASNHCSRLSDCVERYDPKGDSWSTVAPLSVPRDAVAVCPLGDKLYVVGGYDGHTYLNTVESYDAQRNEWKEEVPVNIGRAGACVVVVKLP

SEQ ID NO: 744354 - protein, 720 aa, Homo sapiens
MSVSGKKEFDVKQILRLRWRWFSHPFQGSTNTGSCLQQEGYEHRGTPVQGRLKSHSRDRNGLKKSNSPVHHNILAPVPGPAPAHQRAVQNLQQHNLIVHFQANEDTPKSVPEKNLFKEACEKRAQDLEMMADDNIEDSTARLDTQHSEDMNATRSEEQFHVINHAEQTLRKMENYLKEKQLCDVLLIAGHLRIPAHRLVLSAVSDYFAAMFTNDVLEAKQEEVRMEGVDPNALNSLVQYAYTGVLQLKEDTIESLLAAACLLQLTQVIDVCSNFLIKQLHPSNCLGIRSFGDAQGCTELLNVAHKYTMEHFIEVIKNQEFLLLPANEISKLLCSDDINVPDEETIFHALMQWVGHDVQNRQGELGMLLSYIRLPLLPPQLLADLETSSMFTGDLECQKLLMEAMKYHLLPERRSMMQSPRTKPRKSTVGALYAVGGMDAMKGTTTIEKYDLRTNSWLHIGTMNGRRLQFGVAVIDNKLYVVGGRDGLKTLNTVECFNPVGKIWTVMPPMSTHRHGLGVATLEGPMYAVGGHDGWSYLNTVERWDPEGRQWNYVASMSTPRSTVGVVALNNKLYAIGGRDGSSCLKSMEYFDPHTNKWSLCAPMSKRRGGVGVATYNGFLYVVGGHDAPASNHCSRLSDCVERYDPKGDSWSTVAPLSVPRDAVAVCPLGDKLYVVGGYDGHTYLNTVESYDAQRNEWKESMQELLQNFYTTQKLKETLGH

SEQ ID NO: 744355 - protein, 30 aa, Homo sapiens
MGMQAQTQTQKHWQTLWGHSRAESCTYRET

SEQ ID NO: 744356 - protein, 133 aa, Homo sapiens
DWGAGNRGLGEKDGEADGVLVGSGHSGVPFSEFPKARVPRPLPPGGGSLPEAPPALPLPGWLQTTPPLRPPRIVLQSRPGRPDWGLPGAPIPNLRVERRSQERRVAGKVGQGVRQKREQLGGNGKDEPGELDL

SEQ ID NO: 744357 - protein, 1430 aa, Homo sapiens
MFRFPMGLLLGSVLLVASAPATLEPPGCSNKEQQVTVSHTYKIDVPKSALVQVDADPQPLSDDGASLLALGEAREEQNIIFRHNIRLQTPQKDCELAGSVQDLLARVKKLEEEMVEMKEQCSAQRCCQGVTDLSRHCSGHGTFSLETCSCHCEEGREGPACERLACPGACSGHGRCVDGRCLCHEPYVGADCGYPACPENCSGHGECVRGVCQCHEDFMSEDCSEKRCPGDCSGHGFCDTGECYCEEGFTGLDCAQVVTPQGLQLLKNTEDSLLVSWEPSSQVDHYLLSYYPLGKELSGKQIQVPKEQHSYEILGLLPGTKYIVTLRNVKNEVSSSPQHLLATTDLAVLGTAWVTDETENSLDVEWENPSTEVDYYKLRYGPMTGQEVAEVTVPKSSDPKSRYDITGLHPGTEYKITVVPMRGELEGKPILLNGRTEIDSPTNVVTDRVTEDTATVSWDPVQAVIDKYVVRYTSADGDTKEMAVHKDESSTVLTGLKPGEAYKVYVWAERGNQGSKKADTNALTEIDSPANLVTDRVTENTATISWDPVQATIDKYVVRYTSADDQETREVLVGKEQSSTVLTGLRPGVEYTVHVWAQKGDRESKKADTNAPTDIDSPKNLVTDRVTENMATVSWDPVQAAIDKYVVRYTSAGGETREVPVGKEQSSTVLTGLRPGMEYMVHVWAQKGDQESKKADTKAQTDIDSPQNLVTDRVTENMATVSWDPVRATIDRYVVRYTSAKDGETREVPVGKEQSSTVLTGLRPGVEYTVHVWAQKGAQESKKADTKAQTDIDSPQNLVTDWVTENTATVSWDPVQATIDRYVVHYTSANGETREVPVGKEQSSTVLTGLRPGMEYTVHVWAQKGNQESKKADTKAQTEIDGPKNLVTDWVTENMATVSWDPVQATIDKYMVRYTSADGETREVPVGKEHSSTVLTGLRPGMEYMVHVWAQKGAQESKKADTKAQTELDPPRNLRPSAVTQSGGILTWTPPSAQIHGYILTYQFPDGTVKEMQLGREDQRFALQGLEQGATYPVSLVAFKGGRRSRNVSTTLSTVGARFPHPSDCSQVQQNSNAASGLYTIYLHGDASRPLQVYCDMETDGGGWIVFQRRNTGQLDFFKRWRSYVEGFGDPMKEFWLGLDKLHNLTTGTPARYEVRVDLQTANESAYAIYDFFQVASSKERYKLTVGKYRGTAGDALTYHNGWKFTTFDRDNDIALSNCALTHHGGWWYKNCHLANPNGRYGETKHSEGVNWEPWKGHEFSIPYVELKIRPHGYSREPVLGRKKRTLRGRLLNVLMARVSSPRRRHHQLWQLGAGWVVVTAVWECSDSPQNKSCHQASSHGGSFPLTCIFARLYEGLENQNSSCTVCVGKTVLERQGFSAYLQQHIYWIRAREGITQHFTSWKSLEIYIYVFKVLLMQIFSLERSTEEEF

SEQ ID NO: 744358 - protein, 397 aa, Homo sapiens
LKRSGKWLKTWKKKYVTLCSNGVLTYYSSLGDYMKNIHKKEIDLRTSTIKVPGKWPSLATSACAPISSSKSNGLSKDMDTGLGDSICFSPSISSTTSPKLNPPPSPHANKKKHLKKKSTNNFMIVSATGQTWHFEATTYEERDAWVQAIQSQILASLQSCESSKSKSQLTSQSEAMALQSIQNMRGNAHCVDYETQNPKWASLNLGVLMCIECSGIHRSLGTRLSRVRSLELDDWPVELRKVMSSIGNDLANSIWEGSSQGQTKPSVKSTREEKERWIRSKYEEKLFLAPLPCTELSLGQHLLRATADEDLQTAILLLAHGSREEVNETCGEGDGCTALHLACRKGNVVLAQLLIWYGVDVMARDAHGNTALTYARQASSQECINVLLQYGCPDECV

SEQ ID NO: 744359 - protein, 49 aa, Homo sapiens
HHGSKVSECVQSKRLNPTDARWPCRIEISSPKHRHGRKHPGSWLECWFP

SEQ ID NO: 744360 - protein, 158 aa, Homo sapiens
MAFMVKTMVGGQLKNLTGSLGGGEDKGDGDKSAAEAQGMSREEYEEYQKQLVEEKMERDAQFTQRKAERATLRSHFRDKYRLPKNETDESQIQMAGGDVELPRELAKMIEEDTEEEEEKASVLGQLASLPGLNLGSLKDKAQATLGDLKQSAEKCHVM

SEQ ID NO: 744361 - protein, 158 aa, Homo sapiens; identical to SEQ ID NO: 744360

SEQ ID NO: 744362 - protein, 217 aa, Homo sapiens
CGLSCYTGTTGTRHMPNFIFCRDRLWLCWPGWSQVIFPPQPPKNTGITGTSQHSGSCWCTWAAMVHRRYELGGRICSWTSTQACTQTDPWATGNRCGENAAKQSGLVSDGDPGRMERDAQFTQRKAERATLRSHFRDKYRLPKNETDESQIQMAGGDVELPRELAKMIEEDTEEEEEKASVLGQLASLPGLNLGSLKDKAQATLGDLKQSAEKCHVM

SEQ ID NO: 744363 - protein, 158 aa, Homo sapiens; identical to SEQ ID NO: 744360

SEQ ID NO: 744364 - protein, 924 aa, Homo sapiens
TTFRAKPGCCCSGGEDRGTAMAESSESFTMASSPAQRRRGNDPLTSSPGRSSRRTDALTSSPGRDLPPFEDESEGLLGTEGPLEEEEDGEELIGDGMERDYRAIPELDAYEAEGLALDDEDVEELTASQREAAERAMRQRDREAGRGLGRMRRGLLYDSDEEDEERPARKRRQVERATEDGEEDEEMIESIENLEDLKGHSVREWVSMAGPRLEIHHRFKNFLRTHVDSHGHNVFKERISDMCKENRESLVVNYEDLAAREHVLAYFLPEAPAELLQIFDEAALEVVLAMYPKYDRITNHIHVRISHLPLVEELRSLRQLHLNQLIRTSGVVTSCTGVLPQLSMVKYNCNKCNFVLGPFCQSQNQEVKPGSCPECQSAGPFEVNMEETIYQNYQRIRIQESPGKVAAGRLPRSKDAILLADLVDSCKPGDEIELTGIYHNNYDGSLNTANGFPVFATVILANHVAKKDNKVAVGELTDEDVKMITSLSKDQQIGEKIFASIAPSIYGHEDIKRGLALALFGGEPKNPGGKHKVRGDINVLLCGDPGTAKSQFLKYIEKVSSRAIFTTGQGASAVGLTAYVQRHPVSREWTLEAGALVLADRGVCLIDEFDKMNDQDRTSIHEAMEQQSISISKAGIVTSLQARCTVIAAANPIGGRYDPSLTFSENVDLTEPIISRFDILCVVRDTVDPVQDEMLARFVVGSHVRHHPSNKEEEGLANGSAAEPAMPNTYGVEPLPQEVLKKYIIYAKERVHPKLNQMDQDKVAKMYSDLRKESMATGSIPITVRHIESMIRMAEAHARIHLRDYVIEDDVNMAIRVMLESFIDTQKFSVMRSMRKTFARYLSFRRDNNELLLFILKQLVAEQVTYQRNRFGAQQDTIEVPEKDLVDKARQINIHNLSAFYDSELFRMNKFSHDLKRKMILQQF

SEQ ID NO: 744365 - protein, 908 aa, Homo sapiens
MWYAMAESSESFTMASSPAQRRRGNDPLTSSPGRSSRRTDALTSSPGRDLPPFEDESEGLLGTEGPLEEEEDGEELIGDGMERDYRAIPELDAYEAEGLALDDEDVEELTASQREAAERAMRQRDREAGRGLGRMRRGLLYDSDEEDEERPARKRRQVERATEDGEEDEEMIESIENLEDLKGHSVREWVSMAGPRLEIHHRFKNFLRTHVDSHGHNVFKERISDMCKENRESLVVNYEDLAAREHVLAYFLPEAPAELLQIFDEAALEVVLAMYPKYDRITNHIHVRISHLPLVEELRSLRQLHLNQLIRTSGVVTSCTGVLPQLSMVKYNCNKCNFVLGPFCQSQNQEVKPGSCPECQSAGPFEVNMEETIYQNYQRIRIQESPGKVAAGRLPRSKDAILLADLVDSCKPGDEIELTGIYHNNYDGSLNTANGFPVFATVILANHVAKKDNKVAVGELTDEDVKMITSLSKDQQIGEKIFASIAPSIYGHEDIKRGLALALFGGEPKNPGGKHKVRGDINVLLCGDPGTAKSQFLKYIEKVSSRAIFTTGQGASAVGLTAYVQRHPVSREWTLEAGALVLADRGVCLIDEFDKMNDQDRTSIHEAMEQQSISISKAGIVTSLQARCTVIAAANPIGGRYDPSLTFSENVDLTEPIISRFDILCVVRDTVDPVQDEMLARFVVGSHVRHHPSNKEEEGLANGSAAEPAMPNTYGVEPLPQEVLKKYIIYAKERVHPKLNQMDQDKVAKMYSDLRKESMATGSIPITVRHIESMIRMAEAHARIHLRDYVIEDDVNMAIRVMLESFIDTQKFSVMRSMRKTFARYLSFRRDNNELLLFILKQLVAEQVTYQRNRFGAQQDTIEVPEKDLVDKARQINIHNLSAFYDSELFRMNKFSHDLKRKMILQQF

SEQ ID NO: 744366 - protein, 895 aa, Homo sapiens
MASSPAQRRRGNDPLTSSPGRSSRRTDALTSSPGRDLPPFEDESEGLLGTEGPLEEEEDGEELIGDGMERDYRAIPELDAYEAEGLALDDEDVEELTASQREAAERAMRQRDREAGRGLGRMRRGLLYDSDEEDEERPARKRRQVERATEDGEEDEEMIESIENLEDLKGHSVREWVSMAGPRLEIHHRFKNFLRTHVDSHGHNVFKERISDMCKENRESLVVNYEDLAAREHVLAYFLPEAPAELLQIFDEAALEVVLAMYPKYDRITNHIHVRISHLPLVEELRSLRQLHLNQLIRTSGVVTSCTGVLPQLSMVKYNCNKCNFVLGPFCQSQNQEVKPGSCPECQSAGPFEVNMEETIYQNYQRIRIQESPGKVAAGRLPRSKDAILLADLVDSCKPGDEIELTGIYHNNYDGSLNTANGFPVFATVILANHVAKKDNKVAVGELTDEDVKMITSLSKDQQIGEKIFASIAPSIYGHEDIKRGLALALFGGEPKNPGGKHKVRGDINVLLCGDPGTAKSQFLKYIEKVSSRAIFTTGQGASAVGLTAYVQRHPVSREWTLEAGALVLADRGVCLIDEFDKMNDQDRTSIHEAMEQQSISISKAGIVTSLQARCTVIAAANPIGGRYDPSLTFSENVDLTEPIISRFDILCVVRDTVDPVQDEMLARFVVGSHVRHHPSNKEEEGLANGSAAEPAMPNTYGVEPLPQEVLKKYIIYAKERVHPKLNQMDQDKVAKMYSDLRKESMATGSIPITVRHIESMIRMAEAHARIHLRDYVIEDDVNMAIRVMLESFIDTQKFSVMRSMRKTFARYLSFRRDNNELLLFILKQLVAEQVTYQRNRFGAQQDTIEVPEKDLVDKARQINIHNLSAFYDSELFRMNKFSHDLKRKMILQQF

SEQ ID NO: 744367 - protein, 911 aa, Homo sapiens
GNHGCCIMSESSESFTMASSPAQRRRGNDPLTSSPGRSSRRTDALTSSPGRDLPPFEDESEGLLGTEGPLEEEEDGEELIGDGMERDYRAIPELDAYEAEGLALDDEDVEELTASQREAAERAMRQRDREAGRGLGRMRRGLLYDSDEEDEERPARKRRQVERATEDGEEDEEMIESIENLEDLKGHSVREWVSMAGPRLEIHHRFKNFLRTHVDSHGHNVFKERISDMCKENRESLVVNYEDLAAREHVLAYFLPEAPAELLQIFDEAALEVVLAMYPKYDRITNHIHVRISHLPLVEELRSLRQLHLNQLIRTSGVVTSCTGVLPQLSMVKYNCNKCNFVLGPFCQSQNQEVKPGSCPECQSAGPFEVNMEETIYQNYQRIRIQESPGKVAAGRLPRSKDAILLADLVDSCKPGDEIELTGIYHNNYDGSLNTANGFPVFATVILANHVAKKDNKVAVGELTDEDVKMITSLSKDQQIGEKIFASIAPSIYGHEDIKRGLALALFGGEPKNPGGKHKVRGDINVLLCGDPGTAKSQFLKYIEKVSSRAIFTTGQGASAVGLTAYVQRHPVSREWTLEAGALVLADRGVCLIDEFDKMNDQDRTSIHEAMEQQSISISKAGIVTSLQARCTVIAAANPIGGRYDPSLTFSENVDLTEPIISRFDILCVVRDTVDPVQDEMLARFVVGSHVRHHPSNKEEEGLANGSAAEPAMPNTYGVEPLPQEVLKKYIIYAKERVHPKLNQMDQDKVAKMYSDLRKESMATGSIPITVRHIESMIRMAEAHARIHLRDYVIEDDVNMAIRVMLESFIDTQKFSVMRSMRKTFARYLSFRRDNNELLLFILKQLVAEQVTYQRNRFGAQQDTIEVPEKDLVDKARQINIHNLSAFYDSELFRMNKFSHDLKRKMILQQF

SEQ ID NO: 744368 - protein, 916 aa, Homo sapiens
MRVLRGEDRGTAMAESSESFTMASSPAQRRRGNDPLTSSPGRSSRRTDALTSSPGRDLPPFEDESEGLLGTEGPLEEEEDGEELIGDGMERDYRAIPELDAYEAEGLALDDEDVEELTASQREAAERAMRQRDREAGRGLGRMRRGLLYDSDEEDEERPARKRRQVERATEDGEEDEEMIESIENLEDLKGHSVREWVSMAGPRLEIHHRFKNFLRTHVDSHGHNVFKERISDMCKENRESLVVNYEDLAAREHVLAYFLPEAPAELLQIFDEAALEVVLAMYPKYDRITNHIHVRISHLPLVEELRSLRQLHLNQLIRTSGVVTSCTGVLPQLSMVKYNCNKCNFVLGPFCQSQNQEVKPGSCPECQSAGPFEVNMEETIYQNYQRIRIQESPGKVAAGRLPRSKDAILLADLVDSCKPGDEIELTGIYHNNYDGSLNTANGFPVFATVILANHVAKKDNKVAVGELTDEDVKMITSLSKDQQIGEKIFASIAPSIYGHEDIKRGLALALFGGEPKNPGGKHKVRGDINVLLCGDPGTAKSQFLKYIEKVSSRAIFTTGQGASAVGLTAYVQRHPVSREWTLEAGALVLADRGVCLIDEFDKMNDQDRTSIHEAMEQQSISISKAGIVTSLQARCTVIAAANPIGGRYDPSLTFSENVDLTEPIISRFDILCVVRDTVDPVQDEMLARFVVGSHVRHHPSNKEEEGLANGSAAEPAMPNTYGVEPLPQEVLKKYIIYAKERVHPKLNQMDQDKVAKMYSDLRKESMATGSIPITVRHIESMIRMAEAHARIHLRDYVIEDDVNMAIRVMLESFIDTQKFSVMRSMRKTFARYLSFRRDNNELLLFILKQLVAEQVTYQRNRFGAQQDTIEVPEKDLVDKARQINIHNLSAFYDSELFRMNKFSHDLKRKMILQQF

SEQ ID NO: 744369 - protein, 697 aa, Homo sapiens
MCKSLRYCFSHCLYLAMTRLEEVNREVNMHSSVRYLGYLARINLLVAICLGLYVRWEKTANSLILVIFILGLFVLGIASILYYYFSMEAASLSLSNLWFGFLLGLLCFLDNSSFKNDVKEESTKYLLLTSIVLRILCSLVERISGYVRHRPTLLTTVEFLELVGFAIASTTMLVEKSLSVILLVVALAMLIIDLRMKSFLAIPNLVIFAVLLFFSSLETPKNPIAFACFFICLITDPFLDIYFSGLSVTERWKPFLYRGRICRRLSVVFAGMIELTFFILSAFKLRDTHLWYFVIPGFSIFGIFWMICHIIFLLTLWGFHTKLNDCHKVYFTPRTDYNSLDRIMASKGMRHFCLISEQLVFFSLLATAILGAVSWQPTNGIFLSMFLIVLPLESMAHGLFHELGNCLGGTSVGYAIVIPTNFCSPDGQPTLLPPEHVQELNLRSTGMLNAIQRFFAYHMIETYGCDYSTSGLSFDTLHSKLKAFLELRTVDGPRHDTYILYYSGHTHGTGEWALAGGDTLRLDTLIEWWREKNGSFCSRLIIVLDSENSTPWVKEVRKINDQYIAVQGAELIKTVDIEEADPPQLGDFTKDWVEYNCNSSNNICWTEKGRTVKAVYGVSKRWSDYTLHLPTGSDVAKHWMLHFPRITYPLVHLANWLCGLNLFWICKTCFRCLKRLKMSWFLPTVLDTGQGFKLVKS

SEQ ID NO: 744370 - protein, 697 aa, Homo sapiens; identical to SEQ ID NO: 744369

SEQ ID NO: 744371 - protein, 697 aa, Homo sapiens; identical to SEQ ID NO: 744369

SEQ ID NO: 744372 - protein, 313 aa, Homo sapiens
MFLIVLPLESMAHGLFHELGNCLGGTSVGYAIVIPTNFCSPDGQPTLLPPEHVQELNLRSTGMLNAIQRFFAYHMIETYGCDYSTSGLSFDTLHSKLKAFLELRTVDGPRHDTYILYYSGHTHGTGEWALAGGDTLRLDTLIEWWREKNGSFCSRLIIVLDSENSTPWVKEVRKINDQYIAVQGAELIKTVDIEEADPPQLGDFTKDWVEYNCNSSNNICWTEKGRTVKAVYGVSKRWSDYTLHLPTGSDVAKHWMLHFPRITYPLVHLANWLCGLNLFWICKTCFRCLKRLKMSWFLPTVLDTGQGFKLVKS

SEQ ID NO: 744373 - protein, 697 aa, Homo sapiens; identical to SEQ ID NO: 744369

SEQ ID NO: 744374 - protein, 697 aa, Homo sapiens; identical to SEQ ID NO: 744369

SEQ ID NO: 744375 - protein, 430 aa, Homo sapiens
MCKSLRYCFSHCLYLAMTRLEEVNREVNMHSSVRYLGYLARINLLVAICLGLYVRWEKTANSLILVIFILGLFVLGIASILYYYFSMEAASLSLSNLWFGFLLGLLCFLDNSSFKNDVKEESTKYLLLTSIVLRILCSLVERISGYVRHRPTLLTTVEFLELVGFAIASTTMLVEKSLSVILLVVALAMLIIDLRMKSFLAIPNLVIFAVLLFFSSLETPKNPIAFACFFICLITDPFLDIYFSGLSVTERWKPFLYRGRICRRLSVVFAGMIELTFFILSAFKLRDTHLWYFVIPGFSIFGIFWMICHIIFLLTLWGFHTKLNDCHKVYFTPRTDYNSLDRIMASKGMRHFCLISEQLVFFSLLATAILGAVSWQPTNGIFLSMFLIVLPLESMAHGLFHELGNCLGGTSVGYAIVIPTNFCRWRYTTP

SEQ ID NO: 744376 - protein, 128 aa, Homo sapiens
VTATDLPDVLGNLQYNLLKNTLQCTAHLPEVKELVWGEDLDKNFPKSAFYYDYVLASDVVYHHYFLDKLLTTMVYLSQPGTVLLWANKFRFSTDYEFLDKFKQVFDTTLLAEYPESSVKLFKGILKWD

SEQ ID NO: 744377 - protein, 138 aa, Homo sapiens
QRGDRNPLREYLSRGLMVSLSTDDPLQFHFTKEPLMEEYSIATQVWKLSSCDMCELARNSVLMSGFSHKVKSHWLGPNYTKEGPEGNDIRRTNVPDIRVGYRYETLCQELALITQAVQSEMLETIPEEAGITMSPGPQ

SEQ ID NO: 744378 - protein, 107 aa, Homo sapiens
RFSNRFFPLSIHSAGQSSLDLSELTDTMKLSGMFLLLSLALFCFLTGVFSQGGQVDCGEFQDTKVYCTRESNPHCGSDGQTYGNKCAFCKAIVKSGGKISLKHPGKC

SEQ ID NO: 744379 - protein, 1075 aa, Homo sapiens
GGIGQTDKERGAAALPGEEGDPTRGRSLGRASWESGSPRRPRSPFSSFLPRPICLSLEARPCSIEDRRNWSLIGRPGAPASGLNRSSGLWLGPDRCRPRSRCSCRVMENPSPAAALGKALCALLLATLGAAGQPLGGESICSARAPAKYSITFTGKWSQTAFPKQYPLFRPPAQWSSLLGAAHSSDYSMWRKNQYVSNGLRDFAERGEAWALMKEIEAAGEALQSVHEVFSAPAVPSGTGQTSAELEVQRRHSLVSFVVRIVPSPDWFVGVDSLDLCDGDRWREQAALDLYPYDAGTDSGFTFSSPNFATIPQDTVTEVSGHPACARAAMAPAVGTGLGPGCTLASQPRTAACGFCVEEALLLAPAVSKGVQPSHTLPTRGHSTAGRTAGRASRGGCPFLASVSSPCSVGWLRGVHGTLSPTVVQRARWTLGSGPSEAIRIPEGGLLGPQANPLLPPQITSSSPSHPANSFYYPRLKALPPIARVTLVRLRQSPRAFIPPAPVLPSRDNEIVDSASGNGHTGHMGHTAAPNPATGRPPNPNQGSEKFQVGIRSAYCKMVPRRFRILLIHTLKMDSCTLFAVESILQGHSPEERMKGGSRQYLRDSVLSDTHPQVTCVSQLTRKLARMALCGHRVTAMLQGTCGGLGTQPPHSSGLCSQAPWPGAGQVLMSILLALPGTCWTGQAGNAGAEWQFPPYSAGWQPLASRSACGLERIAGSWVRACWLWVSGSHLIWVWDSQCRPQTTADFRLSRGGTGAHQPGHGPRRPPPSMLLAGVEAGTGPPHTCPPSHVVGTDVVLRSSSNYKLTVSRPWKQGPGQVRQEAAWLAGTTPQTETVPSPGSLLIWDELGLPVPASVLPLPSAGLGSSLICPRGCPIPSRCPRATYPTGRRASTVRGVQLVWREEPLVGRGSREVRFAPHLGALGHSGQGSTWPVPWARRGIKSAVAKQKQYCRGRVGRDCAMSSEQEAGHGEKGGRRTEPAVPAEGPEWAVGTEHRPPPTRVSPVTSGFPRAEAGMGMWRLAPRRLRQVHAKPAWLSSGFLLTRWMPVPRPPDRALQHWRGLWWGPRCRTGTASAH

SEQ ID NO: 744380 - protein, 437 aa, Homo sapiens
GGIGQTDKERGAAALPGEEGDPTRGRSLGRASWESGSPRRPRSPFSSFLPRPICLSLEARPCSIEDRRNWSLIGRPGAPASGLNRSSGLWLGPDRCRPRSRCSCRVMENPSPAAALGKALCALLLATLGAAGQPLGGESICSARAPAKYSITFTGKWSQTAFPKQYPLFRPPAQWSSLLGAAHSSDYSMWRKNQYVSNGLRDFAERGEAWALMKEIEAAGEALQSVHEVFSAPAVPSGTGQTSAELEVQRRHSLVSFVVRIVPSPDWFVGVDSLDLCDGDRWREQAALDLYPYDAGTDSGFTFSSPNFATIPQDTVTEITSSSPSHPANSFYYPRLKALPPIARVTLVRLRQSPRAFIPPAPVLPSRDNEIVDSASVPETPLDCEVSLWSSWGLCGGHCGRLGTKSRTRYVRVQPANNGSPCPELEEEAECVPDNCV

SEQ ID NO: 744381 - protein, 935 aa, Homo sapiens
GGIGQTDKERGAAALPGEEGDPTRGRSLGRASWESGSPRRPRSPFSSFLPRPICLSLEARPCSIEDRRNWSLIGRPGAPASGLNRSSGLWLGPDRCRPRSRCSCRVMENPSPAAALGKALCALLLATLGAAGQPLGGESICSARAPAKYSITFTGKWSQTAFPKQYPLFRPPAQWSSLLGAAHSSDYSMWRKNQYVSNGLRDFAERGEAWALMKEIEAAGEALQSVHEVFSAPAVPSGTGQTSAELEVQRRHSLVSFVVRIVPSPDWFVGVDSLDLCDGDRWREQAALDLYPYDAGTDSGFTFSSPNFATIPQDTVTEITSSSPSHPANSFYYPRLKALPPIARVTLVRLRQSPRAFIPPAPVLPSRDNEIVDSASGNGHTGHMGHTAAPNPATGRPPNPNQGSEKFQVGIRSAYCKMVPRRFRILLIHTLKMDSCTLFAVESILQGHSPEERMKGGSRQYLRDSVLSDTHPQVTCVSQLTRKLARMALCGHRVTAMLQGTCGGLGTQPPHSSGLCSQAPWPGAGQVLMSILLALPGTCWTGQAGNAGAEWQFPPYSAGWQPLASRSACGLERIAGSWVRACWLWVSGSHLIWVWDSQCRPQTTADFRLSRGGTGAHQPGHGPRRPPPSMLLAGVEAGTGPPHTCPPSHVVGTDVVLRSSSNYKLTVSRPWKQGPGQVRQEAAWLAGTTPQTETVPSPGSLLIWDELGLPVPASVLPLPSAGLGSSLICPRGCPIPSRCPRATYPTGRRASTVRGVQLVWREEPLVGRGSREVRFAPHLGALGHSGQGSTWPVPWARRGIKSAVAKQKQYCRGRVGRDCAMSSEQEAGHGEKGGRRTEPAVPAEGPEWAVGTEHRPPPTRVSPVTSGFPRAEAGMGMWRLAPRRLRQVHAKPAWLSSGFLLTRWMPVPRPPDRALQHWRGLWWGPRCRTGTASAH

SEQ ID NO: 744382 - protein, 168 aa, Homo sapiens [sequence omitted]

SEQ ID NO: 744383 - protein, 437 aa, Homo sapiens; identical to SEQ ID NO: 744380

SEQ ID NO: 744384 - protein, 1100 aa, Homo sapiens
GCSPLCSQVMENPSPAAALGKALCALLLATLGAAGQPLGGESICSARAPAKYSITFTGKWSQTAFPKQYPLFRPPAQWSSLLGKYSPLLASCSTRRAAAPEPPAQLHGGASQSGALLTSGDSNTRMFAERLRCAVPGMRWGQGALTGRAQVGRGRGSHRVSRSDVTGGHGSLRAAGRDFLGRPLESKPDRSVRPWSAARPGGPAGAAHSSDYSMWRKNQYVSNGLRDFAERGEAWALMKEIEAAGEALQSVHEVFSAPAVPSGTGQTSAELEVQRRHSLVSFVVRIVPSPDWFVGVDSLDLCDGDRWREQAALDLYPYDAGTDSGFTFSSPNFATIPQDTVTEVSGHPACARAAMAPAVGTGLGPGCTLASQPRTAACGFCVEEALLLAPAVSKGVQPSHTLPTRGHSTAGRTAGRASRGGCPFLASVSSPCSVGWLRGVHGTLSPTVVQRARWTLGSGPSEAIRIPEGGLLGPQANPLLPPQITSSSPSHPANSFYYPRLKALPPIARVTLVRLRQSPRAFIPPAPVLPSRDNEIVDSASGNGHTGHMGHTAAPNPATGRPPNPNQGSEKFQVGIRSAYCKMVPRRFRILLIHTLKMDSCTLFAVESILQGHSPEERMKGGSRQYLRDSVLSDTHPQVTCVSQLTRKLARMALCGHRVTAMLQGTCGGLGTQPPHSSGLCSQAPWPGAGQVLMSILLALPGTCWTGQAGNAGAEWQFPPYSAGWQPLASRSACGLERIAGSWVRACWLWVSGSHLIWVWDSQCRPQTTADFRLSRGGTGAHQPGHGPRRPPPSMLLAGVEAGTGPPHTCPPSHVVGTDVVLRSSSNYKLTVSRPWKQGPGQVRQEAAWLAGTTPQTETVPSPGSLLIWDELGLPVPASVLPLPSAGLGSSLICPRGCPIPSRCPRATYPTGRRASTVRGVQLVWREEPLVGRGSREVRFAPHLGALGHSGQGSTWPVPWARRGIKSAVAKQKQYCRGRVGRDCAMSSEQEAGHGEKGGRRTEPAVPAEGPEWAVGTEHRPPPTRVSPVTSGFPRAEAGMGMWRLAPRRLRQVHAKPAWLSSGFLLTRWMPVPRPPDRALQHWRGLWWGPRCRTGTASAH

SEQ ID NO: 744385 - protein, 437 aa, Homo sapiens; identical to SEQ ID NO: 744380

SEQ ID NO: 744386 - protein, 356 aa, Homo sapiens
MHHQWLLLAACFWVIFMFMVASKFITLTFKDPDVYSAKQEFLFLTTMPEVRKLPEEKHIPEELKPTGKELPDSQLVQPLVYMERLELIRNVCRDDALKNLSHTPVSKFVLDRIFVCDKHKILFCQTPKVGNTQWKKVLIVLNGAFSSIEEIPENVVHDHEKNGLPRLSSFSDAEIQKRLKTYFKFFIVRDPFERLISAFKDKFVHNPRFEPWYRHEIAPGIIRKYRRNRTETRGIQFEDFVRYLGDPNHRWLDLQFGDHIIHWVTYVELCAPCEIMYSVIGHHETLEDDAPYILKEAGIDHLVSYPTIPPGITVYNRTKVEHYFLGISKRDIRRLYARFEGDFKLFGYQKPDFLLN

SEQ ID NO: 744387 - protein, 356 aa, Homo sapiens; identical to SEQ ID NO: 744386

SEQ ID NO: 744388 - protein, 356 aa, Homo sapiens; identical to SEQ ID NO: 744386

SEQ ID NO: 744389 - protein, 109 aa, Homo sapiens
MHHQWLLLAACFWVIFMFMVASKFITLTFKDPDVYSAKQEFLFLTTMPEVRKLPEEKHIPEELKVGTAGRGPCPLEHGTLVAGSWPSPVAGSACHHVCVRAFSCVTSPC

SEQ ID NO: 744390 - protein, 356 aa, Homo sapiens; identical to SEQ ID NO: 744386

SEQ ID NO: 744391 - protein, 319 aa, Homo sapiens
TSRSGSAWPGPASFNGPWASSALCHLQPTGKELPDSQLVQPLVYMERLELIRNVCRDDALKNLSHTPVSKFVLDRIFVCDKHKILFCQTPKVGNTQWKKVLIVLNGAFSSIEEIPENVVHDHEKNGLPRLSSFSDAEIQKRLKTYFKFFIVRDPFERLISAFKDKFVHNPRFEPWYRHEIAPGIIRKYRRNRTETRGIQFEDFVRYLGDPNHRWLDLQFGDHIIHWVTYVELCAPCEIMYSVIGHHETLEDDAPYILKEAGIDHLVSYPTIPPGITVYNRTKVEHYFLGISKRDIRRLYARFEGDFKLFGYQKPDFLLN

SEQ ID NO: 744392 - protein, 356 aa, Homo sapiens; identical to SEQ ID NO: 744386

SEQ ID NO: 744393 - protein, 292 aa, Homo sapiens
MADLHRQLQEYLAQGKAGGPAAAEPLLAAEKAEEPGDRPAEEWLGRAGLRWTWARSPAESAAAGLTCLPSVTRGQRLAAGGGCLLLAALCFGLAALYAPVLLLRARKFALLWSLGSALALAGSALLRGGAACGRLLRCEEAPSRPALLYMAALGATLFAALGLRSTLLTVLGAGAQVAALLAALVGLLPWGGGTALRLALGRLGRGAGLAKCCPCEDLAPSPLGKYAEPAPSETAPAELRTARRCAEARGEGPALTACESNPGAAAASGGDSSVGSSSMSAFCAGLGTRSEN

SEQ ID NO: 744394 - protein, 543 aa, Homo sapiens
MEQVNELKEKGNKALSVGNIDDALQCYSEAIKLDPHNHVLYSNRSAAYAKKGDYQKAYEDGCKTVDLKPDWGKGYSRKAAALEFLNRFEEAKRTYEEGLKHEANNPQLKEGLQNMEARLAERKFMNPFNMPNLYQKLESDPRTRTLLSDPTYRELIEQLRNKPSDLGTKLQDPRIMTTLSVLLGVDLGSMDEEEEIATPPPPPPPKKETKPEPMEEDLPENKKQALKEKELGNDAYKKKDFDTALKHYDKAKELDPTNMTYITNQAAVYFEKGDYNKCRELCEKAIEVGRENREDYRQIAKAYARIGNSYFKEEKYKDAIHFYNKSLAEHRTPDVLKKCQQAEKILKEQERLAYINPDLALEEKNKGNECFQKGDYPQAMKHYTEAIKRNPKDAKLYSNRAACYTKLLEFQLALKDCEECIQLEPTFIKGYTRKAAALEAMKDYTKAMDVYQKALDLDSSCKEAADGYQRCMMAQYNRHDSPEDVKRRAMADPEVQQIMSDPAMRLILEQMQKDPQALSEHLKNPVIAQKIQKLMDVGLIAIR

SEQ ID NO: 744395 - protein, 543 aa, Homo sapiens; identical to SEQ ID NO: 744394

SEQ ID NO: 744396 - protein, 227 aa, Homo sapiens
MEQVNELKEKGNKALSVGNIDDALQCYSEAIKLDPHNHVLYSNRSAAYAKKGDYQKAYEDGCKTVDLKPDWGKGYSRKAAALEFLNRFEEAKRTYEEGLKHEANNPQLKEGLQNMEARLAERKFMNPFNMPNLYQKLESDPRTRTLLSDPTYRELIEQLRNKPSDLGTKLQDPRIMTTLSVLLGVDLGSMDEEEEIATPPPPPPPKKETKPEPMECVPEGARPGLQL

SEQ ID NO: 744397 - protein, 516 aa, Homo sapiens
KLRLVRGLVLNRPRSNRSAAYAKKGDYQKAYEDGCKTVDLKPDWGKGYSRKAAALEFLNRFEEAKRTYEEGLKHEANNPQLKEGLQNMEARLAERKFMNPFNMPNLYQKLESDPRTRTLLSDPTYRELIEQLRNKPSDLGTKLQDPRIMTTLSVLLGVDLGSMDEEEEIATPPPPPPPKKETKPEPMEEDLPENKKQALKEKELGNDAYKKKDFDTALKHYDKAKELDPTNMTYITNQAAVYFEKGDYNKCRELCEKAIEVGRENREDYRQIAKAYARIGNSYFKEEKYKDAIHFYNKSLAEHRTPDVLKKCQQAEKILKEQERLAYINPDLALEEKNKGNECFQKGDYPQAMKHYTEAIKRNPKDAKLYSNRAACYTKLLEFQLALKDCEECIQLEPTFIKGYTRKAAALEAMKDYTKAMDVYQKALDLDSSCKEAADGYQRCMMAQYNRHDSPEDVKRRAMADPEVQQIMSDPAMRLILEQMQKDPQALSEHLKNPVIAQKIQKLMDVGLIAIR

SEQ ID NO: 744398 - protein, 458 aa, Homo sapiens
LGEGGVDIGRGEGLKHEANNPQLKEGLQNMEARLAERKFMNPFNMPNLYQKLESDPRTRTLLSDPTYRELIEQLRNKPSDLGTKLQDPRIMTTLSVLLGVDLGSMDEEEEIATPPPPPPPKKETKPEPMEEDLPENKKQALKEKELGNDAYKKKDFDTALKHYDKAKELDPTNMTYITNQAAVYFEKGDYNKCRELCEKAIEVGRENREDYRQIAKAYARIGNSYFKEEKYKDAIHFYNKSLAEHRTPDVLKKCQQAEKILKEQERLAYINPDLALEEKNKGNECFQKGDYPQAMKHYTEAIKRNPKDAKLYSNRAACYTKLLEFQLALKDCEECIQLEPTFIKGYTRKAAALEAMKDYTKAMDVYQKALDLDSSCKEAADGYQRCMMAQYNRHDSPEDVKRRAMADPEVQQIMSDPAMRLILEQMQKDPQALSEHLKNPVIAQKIQKLMDVGLIAIR

SEQ ID NO: 744399 - protein, 152 aa, Homo sapiens
MEQVNELKEKGNKALSVGNIDDALQCYSEAIKLDPHNHVLYSNRSAAYAKKGDYQKAYEDGCKTVDLKPDWGKGYSRKAAALEFYNRHDSPEDVKRRAMADPEVQQIMSDPAMRLILEQMQKDPQALSEHLKNPVIAQKIQKLMDVGLIAIR

SEQ ID NO: 744400 - protein, 254 aa, Homo sapiens
RIFSTSALTDCQAYARIGNSYFKEEKYKDAIHFYNKSLAEHRTPDVLKKCQQAEKILKEQERLAYINPDLALEEKNKGNECFQKGDYPQAMKHYTEAIKRNPKDAKLYSNRAACYTKLLEFQLALKDCEECIQLEPTFIKGYTRKAAALEAMKDYTKAMDVYQKALDLDSSCKEAADGYQRCMMAQYNRHDSPEDVKRRAMADPEVQQIMSDPAMRLILEQMQKDPQALSEHLKNPVIAQKIQKLMDVGLIAIR

SEQ ID NO: 744401 - protein, 292 aa, Homo sapiens
MEQVNELKEKGNKALSVGNIDDALQCYSEAIKLDPHNHVLYSNRSAAYAKKGDYQKAYEDGCKTVDLKPDWGKGYSRKAAALEFLNRFEEAKRTYEEGLKHEANNPQLKEGLQNMEARLAERKFMNPFNMPNLYQKLESDPRTRTLLSDPTYRELIEQLRNKPSDLGTKLQDPRIMTTLSVLLGVDLGSMDEEEEIATPPPPPPPKKETKPEPMEEDLPENKKQALKEKELGNDAYKKKDFDTALKHYDKAKELDPTNMTYITNQAGVPGRGAHSAGLGRHEGGDAEKGMQV

SEQ ID NO: 744402 - protein, 543 aa, Homo sapiens; identical to SEQ ID NO: 744394

SEQ ID NO: 744403 - protein, 269 aa, Homo sapiens
MEQVNELKEKGNKALSVGNIDDALQCYSEAIKLDPHNHVLYSNRSAAYAKKGDYQKAYEDGCKTVDLKPDWGKGYSRKAAALEFLNRFEEAKRTYEEGLKHEANNPQLKEGLQNMEARLAERKFMNPFNMPNLYQKLESDPRTRTLLSDPTYRELIEQLRNKPSDLGTKLQDPRIMTTLSVLLGVDLGSMDEEEEIATPPPPPPPKKETKPEPMEEDLPENKKQALKEKELGNDAYKKKDFDTALKHYDKAKELDPYLITYHPRLKGDS

SEQ ID NO: 744404 - protein, 260 aa, Homo sapiens
MEQVNELKEKGNKALSVGNIDDALQCYSEAIKLDPHNHVLYSNRSAAYAKKGDYQKAYEDGCKTVDLKPDWGKGYSRKAAALEFLNRFEEAKRTYEEGLKHEANNPQLKEGLQNMEARLAERKFMNPFNMPNLYQKLESDPRTRTLLSDPTYRELIEQLRNKPSDLGTKLQDPRIMTTLSVLLGVDLGSMDEEEEIATPPPPLPSSSMSLSPAPSCCLGCSPIVGFFFIWGSGHVMGRGGGSSSLRSQLSHVVYSAVPFS

SEQ ID NO: 744405 - protein, 340 aa, Homo sapiens
YVGQPLLFLQDFLCLLAFLEHALKEKELGNDAYKKKDFDTALKHYDKAKELDPTNMTYITNQAAVYFEKGDYNKCRELCEKAIEVGRENREDYRQIAKAYARIGNSYFKEEKYKDAIHFYNKSLAEHRTPDVLKKCQQAEKILKEQERLAYINPDLALEEKNKGNECFQKGDYPQAMKHYTEAIKRNPKDAKLYSNRAACYTKLLEFQLALKDCEECIQLEPTFIKGYTRKAAALEAMKDYTKAMDVYQKALDLDSSCKEAADGYQRCMMAQYNRHDSPEDVKRRAMADPEVQQIMSDPAMRLILEQMQKDPQALSEHLKNPVIAQKIQKLMDVGLIAIR

SEQ ID NO: 744406 - protein, 93 aa, Homo sapiens
MEQVNELKEKGNKALSVGNIDDALQCYSEAIKLDPHNHVLYSNRSAAYAKKGDYQKAYEDGCKTVDLKPDWGKVSCGQWRERGPSDPSRNAFW

SEQ ID NO: 744407 - protein, 464 aa, Homo sapiens
MARRDPKPGAKRLVRAQTLQKQRRAPVGPRAPPPDEEDPRLKCKNCEAFGHTARSTRCPMKCWKAALVPPNFGEKEGKENLKPWKPQVEANPGPLNKDKGEKEERPRPQDPQRKALLHIFSGKPPEKPLPNQKGSTESSDYLRVASGPMPVHTTSKRPRVDPVLSDRSATEMSDRGSVLASLSPLRKASLSSSSSLGPKERQTGAAADIPQTAVRHQGPEPLLVVKPTHSSPAGGCREVPQAASKTHGLLQAVSPQAQDKRPAVTSQPCPPAATHSLGLGSNLSFGPGAKRSAPAPIQACLNFPKKPRLGPFQIPESAIQGGELGAPENLQPPPAATELGPRTVSPQIGTRTPAQVLSGDRQPPHSRPCLPTAQACTMSHHPAASHDGAQPLRVLFRRLENGRWSSSLLTAPSFHSPEKPGAFLAQSPHVSEKSEGPCVRVPPSVLYEDLQVPSSSEDSDSDLE

SEQ ID NO: 744408 - protein, 464 aa, Homo sapiens; identical to SEQ ID NO: 744407

SEQ ID NO: 744409 - protein, 181 aa, Homo sapiens
AWSRQEGEMRPDWMPHSTTQAGSPLRGRVPNHCSHRIWLQRVSLSLSHLSNHPGLLLRLPLRPWPPRGSGVCPQQTLPGLPGSALHLPPGCVCPSSTRCALVLPLLPSRDPPEARSLPGDTATALATSWRLVLVWGLRPLETPGSQVELRELRPGAGGWPSRHCPHLAWTSLTVPWSTPRR

SEQ ID NO: 744410 - protein, 481 aa, Homo sapiens
MKVLSEGQLKLCVVQPVHLTSWLLIFFILKSISCLKPARLPIYQRKPFIAAWNAPTDQCLIKYNLRLNLKMFPVIGSPLAKARGQNVTIFYVNRLGYYPWYTSQGVPINGGLPQNISLQVHLEKADQDINYYIPAEDFSGLAVIDWEYWRPQWARNWNSKDVYRQKSRKLISDMGKNVSATDIEYLAKVTFEESAKAFMKETIKLGIKSRPKGLWGYYLYPDCHNYNVYAPNYSGSCPEDEVLRNNELSWLWNSSAALYPSICVWKSLGDSENILRFSKFRVHESMRISTMTSHDYALPVFVYTRLGYRDEPLFFLSKQDLVSTIGESAALGAAGIVIWGDMNLTASKANCTKVKQFVSSDLGSYIANVTRAAEVCSLHLCRNNGRCIRKMWNAPSYLHLNPASYHIEASEDGEFTVKGKASDTDLAVMADTFSCHCYQGYEGADCREIKTADGCSGVSPSPGSLMTLCLLLLASYRSIQL

SEQ ID NO: 744411 - protein, 155 aa, Homo sapiens
TLFSLLRPLLQSRFFPRLLFLVLYMLSALFPGPSLSFLLSLSLVLLSRALVPFVLLLPQPSLKSLLWHLGLCSLHSSEPTSPNGGGLKPRKWTEKPQPLFCIFFVITNPKKPSMNCPLPSIPAAYCLEICFLSQSPVAAGLLFPSEMMSPQRRLG

SEQ ID NO: 744412 - protein, 173 aa, Homo sapiens
LFVTWKTGRDKRLRGCIGTFSAMNLHSGLREYTLTSALKDSRFPPLTREELPKLFCSVSLLTNFEDASDYLDWEVGVHGIRIEFINEKGVKRTATYLPEVAKEQDWDQIQTIDSLLRKGGFKAPITSEFRKTIKLTRYRSEKVTISYAEYIASRQHCFQNGTLHAPPLYNHYS

SEQ ID NO: 744413 - protein, 218 aa, Homo sapiens
LFVTWKTGRDKRLRGCIGTFSAMNLHSGLREYTLTSALKDSRFPPLTREELPKLFCSVSLLTNFEDASDYLDWEVGVHGIRIEFINEKGVKRTATYLPEVAKEQDNYTGVTSDRKDAGAGSLGTAIMACVGLSSHVSESPRDWQTDWAPDWDQIQTIDSLLRKGGFKAPITSEFRKTIKLTRYRSEKVTISYAEYIASRQHCFQNGTLHAPPLYNHYS

SEQ ID NO: 744414 - protein, 218 aa, Homo sapiens; identical to SEQ ID NO: 744413

SEQ ID NO: 744415 - protein, 218 aa, Homo sapiens; identical to SEQ ID NO: 744413

SEQ ID NO: 744416 - protein, 138 aa, Homo sapiens
LFVTWKTGRDKRLRGCIGTFSAMNLHSGLREYTLTSALKDSRFPPLTREELPKLFCSVSLLTNFEDASDYLDWEVGVHGIRIEFINEKGVKRTATYLPEVAKEQGELDEWDFNDKYHSQWCQLKGKKVKCVILQPNCS

SEQ ID NO: 744417 - protein, 257 aa, Homo sapiens
VQTKLTAAPVQPSELSWGLSLQPVLSDPPMAAQGGGVHCATCWVPPSADSQSRRWTNRGQGAAGQAAPGSPSSELCYANKNAPVWGGMAVGGIAGRVVEGLEISVVVWGSPCFSPSEYAWIVRSVTMAREPGQHELLSLKFRGLLGFPELRADVPRTQHQETPVPPAAAATQEGWATLAASHQLPLLAHSLLSLPSPRSFCPNHAGGSCSASWRDVHRASCAHPCSKQLDSFPSTPTLVSPWGPEKDGVPAPSQLHL

SEQ ID NO: 744418 - protein, 159 aa, Homo sapiens
RKGKSRRAEPAPGLGKASFLPRTLSLRNSISRIMSEAGSGTLEDEWQAISEIASTCNTILESLSREGQPIPESGDPKGTPKSDAEPEPGNLSEKVSHLESMLRKLQEDLQKEKADRAALEEEVRSLRHNNRRLQAESESAATRLLLASKQLGSPTADLA

SEQ ID NO: 744419 - protein, 111 aa, Homo sapiens
EAAGAITAHTGDLAEERTEFLHSQNSLSPRSSLSDEAPVLPNTTPDLLLATTAKPSVPSADSETPLTQDRPGSPSGSEDKGNPAPELRASFLPRTLSLRNSISRSESGPRR

SEQ ID NO: 744420 - protein, 1092 aa, Homo sapiens
RESGSGTPARAAAAGREPQRAGTAATTSGWAPNTRARQCGPAPGESGPQSMPMWAGGVGSPRRGMAPASTDDLFARKLRQPARPPLTPHTFEPRPVRGPLLRSGSDAGEARPPTPASPRARAHSHEEASRPAATSTRLFTDPLALLGLPAEEPEPAFPPVLEPRWFAHYDVQSLLFDWAPRSQGMGSHSEASSGTLASAEDQAASSDLLHGAPGFVCELGGEGELGLGGPASPPVPPALPNAAVSILEEPQNRTSAYSLEHADLGAGYYRKYFYGKEHQNFFGMDESLGPVAVSLRREEKEGSGGGTLHSYRVIVRTTQLRTLRGTISEDALPPGPPRGLSPRKLLEHVAPQLSPSCLRLGSASPKVPRTLLTLDEQVLSFQRKVGILYCRAGQGSEEEMYNNQEAGPAFMQFLTLLGDVVRLKGFESYRAQLDTKTDSTGTHSLYTTYQDHEIMFHVSTMLPYTPNNQQQLLRKRHIGNDIVTIVFQEPGSKPFCPTTIRSHFQHVFLVVRAHTPCTPHTTYRVAVSRTQDTPAFGPALPAGGGPFAANADFRAFLLAKALNGEQAAGHARQFHAMATRTRQQYLQDLATNEVTTTSLDSASRFGLPSLGGRRRAAPRGPGAELQAAGSLVWGVRAAPGARVAAGAQASGPEGIEVPCLLGISAEALVLVAPRDGRVVFNCACRDVLAWTFSEQQLDLYHGRGEAITLRFDGSPGQAVGEVVARLQLVSRGCETRELALPRDGQGRLGFEVDAEGFVTHVERFTFAETAGLRPGARLLRVCGQTLPSLRPEAAAQLLRSAPKVCVTVLPPDESGRPRRSFSELYTLSLQEPSRRGAPDPVQDEVQGVTLLPTTKQLLHLCLQDGGSPPGPGDLAEERTEFLHSQNSLSPRSSLSDEAPVLPNTTPDLLLATTAKPSVPSADSETPLTQDRPGSPSGSEDKGNPAPELRASFLPRTLSLRNSISRIMSEAGSGTLEDEWQAISEIASTCNTILESLSREGQPIPESGDPKGTPKSDAEPEPGNLSEKVSHLESMLRKLQEDLQKEKADRAALEEEVRSLRHNNRRLQAESESAATRLLLASKQLGSPTADLA

SEQ ID NO: 744421 - protein, 1092 aa, Homo sapiens; identical to SEQ ID NO: 744420

SEQ ID NO: 744422 - protein, 1042 aa, Homo sapiens
MPMWAGGVGSPRRGMAPASTDDLFARKLRQPARPPLTPHTFEPRPVRGPLLRSGSDAGEARPPTPASPRARAHSHEEASRPAATSTRLFTDPLALLGLPAEEPEPAFPPVLEPRWFAHYDVQSLLFDWAPRSQGMGSHSEASSGTLASAEDQAASSDLLHGAPGFVCELGGEGELGLGGPASPPVPPALPNAAVSILEEPQNRTSAYSLEHADLGAGYYRKYFYGKEHQNFFGMDESLGPVAVSLRREEKEGSGGGTLHSYRVIVRTTQLRTLRGTISEDALPPGPPRGLSPRKLLEHVAPQLSPSCLRLGSASPKVPRTLLTLDEQVLSFQRKVGILYCRAGQGSEEEMYNNQEAGPAFMQFLTLLGDVVRLKGFESYRAQLDTKTDSTGTHSLYTTYQDHEIMFHVSTMLPYTPNNQQQLLRKRHIGNDIVTIVFQEPGSKPFCPTTIRSHFQHVFLVVRAHTPCTPHTTYRVAVSRTQDTPAFGPALPAGGGPFAANADFRAFLLAKALNGEQAAGHARQFHAMATRTRQQYLQDLATNEVTTTSLDSASRFGLPSLGGRRRAAPRGPGAELQAAGSLVWGVRAAPGARVAAGAQASGPEGIEVPCLLGISAEALVLVAPRDGRVVFNCACRDVLAWTFSEQQLDLYHGRGEAITLRFDGSPGQAVGEVVARLQLVSRGCETRELALPRDGQGRLGFEVDAEGFVTHVERFTFAETAGLRPGARLLRVCGQTLPSLRPEAAAQLLRSAPKVCVTVLPPDESGRPRRSFSELYTLSLQEPSRRGAPDPVQDEVQGVTLLPTTKQLLHLCLQDGGSPPGPGDLAEERTEFLHSQNSLSPRSSLSDEAPVLPNTTPDLLLATTAKPSVPSADSETPLTQDRPGSPSGSEDKGNPAPELRASFLPRTLSLRNSISRIMSEAGSGTLEDEWQAISEIASTCNTILESLSREGQPIPESGDPKGTPKSDAEPEPGNLSEKVSHLESMLRKLQEDLQKEKADRAALEEEVRSLRHNNRRLQAESESAATRLLLASKQLGSPTADLA

SEQ ID NO: 744423 - protein, 1042 aa, Homo sapiens; identical to SEQ ID NO: 744422

SEQ ID NO: 744424 - protein, 809 aa, Homo sapiens
MDESLGPVAVSLRREEKEGSGGGTLHSYRVIVRTTQLRTLRGTISEDALPPGPPRGLSPRKLLEHVAPQLSPSCLRLGSASPKVPRTLLTLDEQVLSFQRKVGILYCRAGQGSEEEMYNNQEAGPAFMQFLTLLGDVVRLKGFESYRAQLDTKTDSTGTHSLYTTYQDHEIMFHVSTMLPYTPNNQQQLLRKRHIGNDIVTIVFQEPGSKPFCPTTIRSHFQHVFLVVRAHTPCTPHTTYRVAVSRTQDTPAFGPALPAGGGPFAANADFRAFLLAKALNGEQAAGHARQFHAMATRTRQQYLQDLATNEVTTTSLDSASRFGLPSLGGRRRAAPRGPGAELQAAGSLVWGVRAAPGARVAAGAQASGPEGIEVPCLLGISAEALVLVAPRDGRVVFNCACRDVLAWTFSEQQLDLYHGRGEAITLRFDGSPGQAVGEVVARLQLVSRGCETRELALPRDGQGRLGFEVDAEGFVTHVERFTFAETAGLRPGARLLRVCGQTLPSLRPEAAAQLLRSAPKVCVTVLPPDESGRPRRSFSELYTLSLQEPSRRGAPDPVQDEVQGVTLLPTTKQLLHLCLQDGGSPPGPGDLAEERTEFLHSQNSLSPRSSLSDEAPVLPNTTPDLLLATTAKPSVPSADSETPLTQDRPGSPSGSEDKGNPAPELRASFLPRTLSLRNSISRIMSEAGSGTLEDEWQAISEIASTCNTILESLSREGQPIPESGDPKGTPKSDAEPEPGNLSEKVSHLESMLRKLQEDLQKEKADRAALEEEVRSLRHNNRRLQAESESAATRLLLASKQLGSPTADLA

SEQ ID NO: 744425 - protein, 1004 aa, Homo sapiens
RESGSGTPARAAAAGREPQRAGTAATTSGWAPNTRARQCGPAPGESGPQSMPMWAGGVGSPRRGMAPASTDDLFARKLRQPARPPLTPHTFEPRPVRGPLLRSGSDAGEARPPTPASPRARAHSHEEASRPAATSTRLFTDPLALLGLPAEEPEPAFPPVLEPRWFAHYDVQSLLFDWAPRSQGMGSHSEASSGTLASAEDQAASSDLLHGAPGFVCELGGEGELGLGGPASPPVPPALPNAAVSILEEPQNRTSAYSLEHADLGAGYYRKYFYGKEHQNFFGMDESLGPVAVSLRREEKEGSGGGTLHSYRVIVRTTQLRTLRGTISEDALPPGPPRGLSPRKLLEHVAPQLSPSCLRLGSASPKVPRTLLTLDEQVLSFQRKVGILYCRAGQGSEEEMYNNQEAGPAFMQFLTLLGDVVRLKGFESYRAQLDTKTDSTGTHSLYTTYQDHEIMFHVSTMLPYTPNNQQQLLRKRHIGNDIVTIVFQEPGSKPFCPTTIRSHFQHVFLVVRAHTPCTPHTTYRVAVSRTQDTPAFGPALPAGGGPFAANADFRAFLLAKALNGEQAAGHARQFHAMATRTRQQYLQDLATVQLRLSRRAGLDLLRAAAGPVPRPRGGDHAALRRVPRPSRGRGGGAPAAGEPWLRDPRAGAAPRRSRPPGLRGGRRGIRHARGALHIRRDGGLRPGARLLRVCGQTLPSLRPEAAAQLLRSAPKVCVTVLPPDESGRPRRSFSELYTLSLQEPSRRGAPDPVQDEVQGVTLLPTTKQLLHLCLQDGGSPPGPGDLAEERTEFLHSQNSLSPRSSLSDEAPVLPNTTPDLLLATTAKPSVPSADSETPLTQDRPGSPSGSEDKGNPAPELRASFLPRTLSLRNSISRIMSEAGSGTLEDEWQAISEIASTCNTILESLSREGQPIPESGDPKGTPKSDAEPEPGNLSEKVSHLESMLRKLQEDLQKEKADRAALEEEVRSLRHNNRRLQAESESAATRLLLASKQLGSPTADLA

SEQ ID NO: 744426 - protein, 1035 aa, Homo sapiens
RESGSGTPARAAAAGREPQRAGTAATTSGWAPNTRARQCGPAPGESGPQSMPMWAGGVGSPRRGMAPASTDDLFARKLRQPARPPLTPHTFEPRPVRGPLLRSGSDAGEARPPTPASPRARAHSHEEASRPAATSTRLFTDPLALLGLPAEEPEPAFPPVLEPRWFAHYDVQSLLFDWAPRSQGMGSHSEASSGTLASAEDQAASSDLLHGAPGFVCELGGEGELGLGGPASPPVPPALPNAAVSILEEPQNRTSAYSLEHADLGAGYYRKYFYGKEHQNFFGMDESLGPVAVSLRREEKEGSGGGTLHSYRVIVRTTQLRTLRGTISEDALPPGPPRGLSPRKLLEHVAPQLSPSCLRLGSASPKVPRTLLTLDEQVLSFQRKVGILYCRAGQGSEEEMYNNQEAGPAFMQFLTLLGDVVRLKGFESYRAQLDTKTDSTGTHSLYTTYQDHEIMFHVSTMLPYTPNNQQQLLRKRHIGNDIVTIVFQEPGSKPFCPTTIRSHFQHVFLVVRAHTPCTPHTTYRVAVSRTQDTPAFGPALPAGGGPFAANADFRAFLLAKALNGEQAAGHARQFHAMATRTRQQYLQDLATNEVTTTSLDSASRFGLPSLGGRRRAAPRGPGAELQAAGSLVWGVRAAPGARVAAGAQASGPEGIEVPCLLGISAEALVLVAPRDGRVVFNCACRDVLAWTFSEQQLDLYHGRGEAITLRFDGSPGQAVGEVVARLQLVSRGCETRELALPRDGQGRLGFEVDAEGFVTHVERFTFAETAGLRPGARLLRVCGQTLPSLRPEAAAQLLRSAPKVCVTVLPPDESGRPRRPLGKRLPFLSHPCSPSSLSDEAPVLPNTTPDLLLATTAKPSVPSADSETPLTQDRPGSPSGSEDKGNPAPELRASFLPRTLSLRNSISRIMSEAGSGTLEDEWQAISEIASTCNTILESLSREGQPIPESGDPKGTPKSDAEPEPGNLSEKVSHLESMLRKLQEDLQKEKADRAALEEEVRSLRHNNRRLQAESESAATRLLLASKQLGSPTADLA

SEQ ID NO: 744427 - protein, 829 aa, Homo sapiens
RESGSGTPARAAAAGREPQRAGTAATTSGWAPNTRARQCGPAPGESGPQSMPMWAGGVGSPRRGMAPASTDDLFARKLRQPARPPLTPHTFEPRPVRGPLLRSGSDAGEARPPTPASPRARAHSHEEASRPAATSTRLFTDPLALLGLPAEEPEPAFPPVLEPRWFAHYDVQSLLFDWAPRSQGMGSHSEASSGTLASAEDQAASSDLLHGAPGFVCELGGEGELGLGGPASPPVPPALPNAAVSILEEPQNRTSAYSLEHADLGAGYYRKYFYGKEHQNFFGMDESLGPVAVSLRREEKEGSGGGTLHSYRVIVRTTQLRTLRGTISEDALPPGPPRGLSPRKLLEHVAPQLSPSCLRLGSASPKVPRTLLTLDEQVLSFQRKVGILYCRAGQGSEEEMYNNQEAGPAFMQFLTLLGDVVRLKGFESYRAQLDTKTDSTGTHSLYTTYQDHEIMFHVSTMLPYTPNNQQQLLRKRHIGNDIVTIVFQEPGSKPFCPTTIRSHFQHVFLVVRAHTPCTPHTTYRVAVSRTQDTPAFGPALPAGGGPFAANADFRAFLLAKALNGEQAAGHARQFHAMATRTRQQYLQDLATKQLLHLCLQDGGSPPGPGDLAEERTEFLHSQNSLSPRSSLSDEAPVLPNTTPDLLLATTAKPSVPSADSETPLTQDRPGSPSGSEDKGNPAPELRASFLPRTLSLRNSISRIMSEAGSGTLEDEWQAISEIASTCNTILESLSREGQPIPESGDPKGTPKSDAEPEPGNLSEKVSHLESMLRKLQEDLQKEKADRAALEEEVRSLRHNNRRLQAESESAATRLLLASKQLGSPTADLA

SEQ ID NO: 744428 - protein, 1018 aa, Homo sapiens
RESGSGTPARAAAAGREPQRAGTAATTSGWAPNTRARQCGPAPGESGPQSMPMWAGGVGSPRRGMAPASTDDLFARKLRQPARPPLTPHTFEPRPVRGPLLRSGSDAGEARPPTPASPRARAHSHEEASRPAATSTRLFTDPLALLGLPAEEPEPAFPPVLEPRWFAHYDVQSLLFDWAPRSQGMGSHSEASSGTLASAEDQAASSDLLHGAPGFVCELGGEGELGLGGPASPPVPPALPNAAVSILEEPQNRTSAYSLEHADLGAGYYRKYFYGKEHQNFFGMDESLGPVAVSLRREEKEGSGGGTLHSYRVIVRTTQLRTLRGTISEDALPPGPPRGLSPRKLLEHVAPQLSPSCLRLGSASPKVPRTLLTLDEQVLSFQRKVGILYCRAGQGSEEEMYNNQEAGPAFMQFLTLLGDVVRLKGFESYRAQLDTKTDSTGTHSLYTTYQDHEIMFHVSTMLPYTPNNQQQLLRKRHIGNDIVTIVFQEPGSKPFCPTTIRSHFQHVFLVVRAHTPCTPHTTYRVAVSRTQDTPAFGPALPAGGGPFAANADFRAFLLAKALNGEQAAGHARQFHAMATRTRQQYLQDLATNEVTTTSLDSASRFGLPSLGGRRRAAPRGPGAELQAAGSLVWGVRAAPGARVAAGAQASGPEGIEVPCLLGISAEALVLVAPRDGRVVFNCACRDVLAWTFSEQQLDLYHGRGEAITLRFDGSPGQAVGEVVARLQLVSRGCETRELALPRDGQGRLGFEVDAEGFVTHVERFTFAETAGLRPGARLLRVCGQTLPSLRPEAAAQLLRSAPKVCVTVLPPDESGRPRRSFSELYTLSLQEPSRRGAPDPVQDEVQGVTLLPTTKQLLHLCLQDGGSPPGPGDLAEERTEFLHSQNSLSPRSSLSDEAPVLPNTTPDLLLATTAKPSVPSADSETPLTQDRPGSPSGSEDKGNPAPELRASFLPRTLSLRNSISRIMSEAGSGTLEDEWQAISEIASTCNTILESLSREGQPIPESGDPKGTPKSDAE

SEQ ID NO: 744429 - protein, 231 aa, Homo sapiens
EAAGAITAHTGDLAEERTEFLHSQNSLSPRSSLSDEAPVLPNTTPDLLLATTAKPSVPSADSETPLTQDRPGSPSGSEDKGNPAPELRASFLPRTLSLRNSISRIMSEAGSGTLEDEWQAISEIASTCNTILESLSREGQPIPESGDPKGTPKSDAEPEPGNLSEKVSHLESMLRKLQEDLQKEKADRAALEEEVRSLRHNNRRLQAESESAATRLLLASKQLGSPTADLA

SEQ ID NO: 744430 - protein, 285 aa, Homo sapiens
ASGSCCGGGNMADVINVSVNLEAFSQAISAIQALRSSVSRVFDCLKDGMRNKETLEGREKAFIAHFQDNLHSVNRDLNELERLSNLVGKPSENHPLHNSGLLSLDPVQDKTPLYSQLLQAYKWSNKLQYHAGLASGLLNQQSLKRSANQMGVSAKRRPKAQPTTLVLPPQYVDDVISRIDRMFPEMSIHLSRPNGTSAMLLLDIWSKSNYQVFQKVTDHATTALLHYQLPQMPDVVVRSFMTWLRSYIKLFQAPCQRCGKFLQDGLPPTWRDFRTLEAFHDTCRQ

SEQ ID NO: 744431 - protein, 156 aa, Homo sapiens
KFAVASTWSNKLQYHAGLASGLLNQQSLKRSANQMGVSAKRRPKAQPTTLVLPPQYVDDVISRIDRMFPEMSIHLSRPNGTSAMLLVTLGKVLKVIVVMRSLFIDRTIVKGYNENVYTEDGKLDIWSKSNYQVFQKACFFQVLDAEQKNNFVVEKC

SEQ ID NO: 744432 - protein, 321 aa, Homo sapiens
ASGSCCGGGNMADVINVSVNLEAFSQAISAIQALRSSVSRVFDCLKDGMRNKETLEGREKAFIAHFQDNLHSVNRDLNELERLSNLVGKPSENHPLHNSGLLSLDPVQDKTPLYSQLLQAYKWSNKLQYHAGLASGLLNQQSLKRSANQMGVSAKRRPKAQPTTLVLPPQYVDDVISRIDRMFPEMSIHLSRPNGTSAMLLVTLGKVLKVIVVMRSLFIDRTIVKGYNENVYTEDGKLDIWSKSNYQVFQKVTDHATTALLHYQLPQMPDVVVRSFMTWLRSYIKLFQAPCQRCGKFLQDGLPPTWRDFRTLEAFHDTCRQ

SEQ ID NO: 744433 - protein, 321 aa, Homo sapiens; identical to SEQ ID NO: 744432

SEQ ID NO: 744434 - protein, 317 aa, Homo sapiens
TARYEAWVAVINVSVNLEAFSQAISAIQALRSSVSRVFDCLKDGMRNKETLEGREKAFIAHFQDNLHSVNRDLNELERLSNLVGKPSENHPLHNSGLLSLDPVQDKTPLYSQLLQAYKWSNKLQYHAGLASGLLNQQSLKRSANQMGVSAKRRPKAQPTTLVLPPQYVDDVISRIDRMFPEMSIHLSRPNGTSAMLLVTLGKVLKVIVVMRSLFIDRTIVKGYNENVYTEDGKLDIWSKSNYQVFQKVTDHATTALLHYQLPQMPDVVVRSFMTWLRSYIKLFQAPCQRCGKFLQDGLPPTWRDFRTLEAFHDTCRQ

SEQ ID NO: 744435 - protein, 321 aa, Homo sapiens; identical to SEQ ID NO: 744432

SEQ ID NO: 744436 - protein, 321 aa, Homo sapiens; identical to SEQ ID NO: 744432

SEQ ID NO: 744437 - protein, 172 aa, Homo sapiens
MGVSAKRRPKAQPTTLVLPPQYVDDVISRIDRMFPEMSIHLSRPNGTSAMLLVTLGKVLKVIVVMRSLFIDRTIVKGYNENVYTEDGKLDIWSKSNYQVFQKVTDHATTALLHYQLPQMPDVVVRSFMTWLRSYIKLFQAPCQRCGKFLQDGLPPTWRDFRTLEAFHDTCRQ

SEQ ID NO: 744438 - protein, 214 aa, Homo sapiens
RHYSTHTLYPNNPTLYIFILQYHAGLASGLLNQQSLKRSANQMGVSAKRRPKAQPTTLVLPPQYVDDVISRIDRMFPEMSIHLSRPNGTSAMLLVTLGKVLKVIVVMRSLFIDRTIVKGYNENVYTEDGKLDIWSKSNYQVFQKVTDHATTALLHYQLPQMPDVVVRSFMTWLRSYIKLFQAPCQRCGKFLQDGLPPTWRDFRTLEAFHDTCRQ

SEQ ID NO: 744439 - protein, 263 aa, Homo sapiens
ASGSCCGGGNMADVINVSVNLEAFSQAISAIQALRSSVSRVFDCLKDGMRNKETLEGREKAFIAHFQDNLHSVNRDLNELERLSNLVGKPSENHPLHNSGLLSLDPVQDKTPLYSQLLQAYKWSNKLQYHAGLASGLLNQQSLKRSANQMGVSAKRRPKAQPTTLVLPPQYVDDVISRIDRMFPEMSIHLSRPNGTSAMLLVTLGKVLKVIVVMRSLFIDRTIVKGYNENVYTEDGKLDIWSKSNYQVFQKVSFTFCFLLKRH

SEQ ID NO: 744440 - protein, 266 aa, Homo sapiens
ASGSCCGGGNMADVINVSVNLEAFSQAISAIQALRSSVSRVFDCLKDGMRNKETLEGREKAFIAHFQDNLHSVNRDLNELERLSNLVGKPSENHPLHNSGLLSLDPVQDKTPLYSQLLQAYKWSNKLQYHAGLASGLLNQQSLKRSANQMGVSAKRRPKAQPTTLVLPPQYVDDVISRIDRMFPEMSIHLSRPNGTSAMLLVTLGKVLKVIVVMRSLFIDRTIVKGYNENVYTEDGKFFLCVKRSFDVLVFALRTDVSVLKQLVIC

SEQ ID NO: 744441 - protein, 207 aa, Homo sapiens
ASGSCCGGGNMADVINVSVNLEAFSQAISAIQALRSSVSRVFDCLKDGMRNKETLEGREKAFIAHFQDNLHSVNRDLNELERLSNLVGKPSENHPLHNSGLLSLDPVQDKTPLYSQLLQAYKWSNKLQYHAGLASGLLNQQSLKRSANQMGVSAKRRPKAQPTTLVLPPQYVDDVISRIDRMFPEMSIHLFRGKKLNNRVDRRTKAK

SEQ ID NO: 744442 - protein, 164 aa, Homo sapiens
ASGSCCGGGNMADVINVSVNLEAFSQAISAIQALRSSVSRVFDCLKDGMRNKETLEGREKAFIAHFQDNLHSVNRDLNELERLSNLVGKPSENHPLHNSGLLSLDPVQDKTPLYSQLLQAYKWSNKPRWARLVGLWQSRPPCPGSHGMQLAAAKLSASPTTSTF

SEQ ID NO: 744443 - protein, 160 aa, Homo sapiens
LKVKNSSIDGLMLSLLFLPLEMNICNKPSNKTAPEKSVWTAPAQPSGPSPELQGQRSRRNGWSWPPHPLQIVAWLLYLFFAVIGFGILVPLLPHHWVPAGYAVSLGKRRAGVWKWGGKGWLAQRRPKAGLRALGSTVRRVEQGGPSPGDLLLPSLSPAST

SEQ ID NO: 744444 - protein, 482 aa, Homo sapiens
MNICNKPSNKTAPEKSVWTAPAQPSGPSPELQGQRSRRNGWSWPPHPLQIVAWLLYLFFAVIGFGILVPLLPHHWVPAGYACMGAIFAGHLVVHLTAVSIDPADANVRDKSYAGPLPIFNRSQHAHVIEDLHCNLCNVDVSARSKHCSACNKCVCGFDHHCKWLNNCVGERNYRLFLHSVASALLGVLLLVLVATYVFVEFFVNPMRLRTNRHFEVLKNHTDVWFVFLPAAPVETQAPAILALAALLILLGLLSTALLGHLLCFHIYLMWHKLTTYEYIVQHRPPQEAKGVHRELESCPPKMRPIQEMEFYMRTFRHMRPEPPGQAGPAAVNAKHSRPASPDPTPGRRDCAGPPVQVEWDRKKPLPWRSPLLLLAMWGPQAPPCLCRKRGRGACIKCERLRPRIRRRGLGPPAAAPARRRIPRTPALCTPLALPAPTTRRRQSPWTRFQWRRRAWAAPLWPPRGAGADSPRWRGRRVRPPFS

SEQ ID NO: 744445 - protein, 208 aa, Homo sapiens
MEFYMRTFRHMRPEPPGQAGPAAVNANPSQFLATRGQAEPPPPSSPDTLALPPRIRPQKKRKRRVYKVRTSETSDPASGERLSLSGSCSGNSREGKAEPQASRSHWAHVPFPCAGPRAPSRRSSSSTDSADASPVHAAGPAGAYHSASAESVDEIPVAQTRLGSAALAAPRGRGRQPTLARQARAPAVFVSPSSGEPRAPGGREAGLA

SEQ ID NO: 744446 - protein, 130 aa, Homo sapiens
ESASLWEAQAPGPGCCPRCTAFQVCLRSGGSGGSLLRTCVVLPETKFRLWLAHEAAAFCPLPWDTHPERARAVVWGRLDGREETGKGQHPCFALLPPDSLPGVLWQQLETPRGFHGAGCVCAGLCLPVYH

SEQ ID NO: 744447 - protein, 126 aa, Homo sapiens
PHTHWLNAWEVVGLVPGPLIQNLMPHPMLQHIPALIPCAGGAQPPCYPPPKYPTYILPWHSTRSPNSASSWSQWHTMSVEDSRKGPSGRGLLPLGIHPSTFNPVPHHQCHMLHPIHWEQPPANMGT

SEQ ID NO: 744448 - protein, 199 aa, Homo sapiens
MLLELSEEHKEHLAFLPQVDSAVVAEFGRIAVEFLRRGANPKIYEGAARKLNVSSDTVQHGVEGLTYLLTESSKLMISELDFQDSVFVLGFSEELNKLLLQLYLDNRKEIRTILSELAPSLPSYHNLEWRLDVQLASRSLRQQIKPAVTIKLHLNQNGDHNTKVLQTDPATLLHLVQQLEQALEEMKTNHCRRVVRNIK

SEQ ID NO: 744449 - protein, 199 aa, Homo sapiens; identical to SEQ ID NO: 744448

SEQ ID NO: 744450 - protein, 229 aa, Homo sapiens
MLLELSEEHKEHLAFLPQVDSAGQRAWGRCSVGWGGGQRQRLALNSLLTFIAVVAEFGRIAVEFLRRGANPKIYEGAARKLNVSSDTVQHGVEGLTYLLTESSKLMISELDFQDSVFVLGFSEELNKLLLQLYLDNRKEIRTILSELAPSLPSYHNLEWRLDVQLASRSLRQQIKPAVTIKLHLNQNGDHNTKVLQTDPATLLHLVQQLEQALEEMKTNHCRRVVRNIK

SEQ ID NO: 744451 - protein, 111 aa, Homo sapiens
LCGRCQQKLANSLRFLCVVFPPSSSTPCGARPQREEMREERAASPLSPAWEEPAGVSGGPGPLPACTTRGQQSVVAAASAGEGAGAVEGHLGVAGSMPVHFLIKLFFELES

SEQ ID NO: 744452 - protein, 75 aa, Homo sapiens
MREERAASPLSPAWEEPAGVSGGPGPLPACTTRGQQSVVAAASAGEGAGAVEGHLGVAGSMPVHFLIKLFFEPLS

SEQ ID NO: 744453 - protein, 117 aa, Homo sapiens
MVWSSLTGAGLAAIPALCVVQPDCLLKDGLSKRQTVVEQPRAWKSDLLVHANSLGDETGLEETEAQDTAGSAWECTMVGVQSQRCGPQRGVPLLLTRVQIHTQVNSSRAPVWRLLQP

SEQ ID NO: 744454 - protein, 165 aa, Homo sapiens
MVWSSLTGAGLAAIPALCVVQPDCLLKDGLSKRQTVVEQPRAWKSDLLVHANSLGDETGLEETEAQDTAGSAWECTMWSPAGCAPPADEGTDPYPGQFLPGPCLEAATALSSLEREDTPVECHLQSRAGKRPLHTRALGKQHQVLGSHPAGTGTFLPCTLHAALP

SEQ ID NO: 744455 - protein, 270 aa, Homo sapiens
HLYDKWIKDADPRVEDWLLMSSPLPQTILLGFYVYFVTSLGPKLMENRKPFELKKAMITYNFFIVLFSVYMCYEFVMSGWGIGYSFRCDIVDYSRSPTALRMARTCWLYYFSKFIELLDTIFFVLRKKNSQVTFLHVFHHTIMPWTWWFGVKFAAGGLGTFHALLNTAVHVVMYSYYGLSALGPAYQKYLWWKKYLTSLQLVQFVIVAIHISQFFFMEDCKYQFPVFACIIMSYSFMFLLLFLHFWYRAYTKGQRLPKTVKNGTCKNKDN

SEQ ID NO: 744456 - protein, 270 aa, Homo sapiens; identical to SEQ ID NO: 744455

SEQ ID NO: 744457 - protein, 270 aa, Homo sapiens; identical to SEQ ID NO: 744455

SEQ ID NO: 744458 - protein, 118 aa, Homo sapiens
VPRSTGGLRGGGGLLSLPLPLFLLVRLELRQVAPEEPADAMALCLWSRGPGSMAVSHSALRLELCDSGHEPLTGMQVDPACLQDSLVRVLQVLKQKHRVPSDPPVLLLSLYISRRCIG

SEQ ID NO: 744459 - protein, 110 aa, Homo sapiens
MIIAHCSLNLLGLNYFPLSTSQVAGTTDTCHHAWLQHPFLNSFSPLIWDFTLSWNLSETRLLEVSYCWRMVSLGKAHSQTQECRIHLSAAFLSSLLVWGTTLLNRILYFS

SEQ ID NO: 744460 - protein, 150 aa, Homo sapiens
FGPFPSSSATAACNATNRIISHFSQDDLTALVQMTEKEHGDRVFFGKNLAFSFDMHDLDHFDELPINGETQKTISLDYKKFLNEHLQEACTPELKPVEKTNGSFLWCEVEKYLNSTLKEMTEVPRVEDLCCTLYDMLASIKSGDELQDEV

SEQ ID NO: 744461 - protein, 107 aa, Homo sapiens
MQCQGYVALLGSDDQSWGWNLVDNNLLHNGEVNGSFPQCNNAPKYQIGERIRVILDMEDKTLAFERGYEFLGVAFRGLPKVCLYPAVSAVYGNTEVTLVYLGKPLDG

SEQ ID NO: 744462 - protein, 410 aa, Homo sapiens
TVTSGAERNRERAGRAPLLRALNPHGGAAGAPRRGRASRAVSAPALSRGGGAEDAPAAGASALSEAGRAADAPGQGREWWRRRRLALTGAVSEPLRSPGEAWPSEQRRREAAAAAAALGPAGEAMAAPAPGAGAASGGAGCSGGGAGAGAGSGSGAAGAGGRLPSRVLELVFSYLELSELRSCALVCKHWYRCLHGDENSEVWRSLCARSLAEEALRTDILCNLPSYKAKIRAFQHAFSTNDCSRNVYIKKNGFTLHRNPIAQSTDGARTKIGFSEGRHAWEVWWEGPLGTVAVIGIATKRAPMQCQGYVALLGSDDQSWGWNLVDNNLLHNGEVNGSFPQCNNAPKYQIGERIRVILDMEDKTLAFERGYEFLGVAFRGLPKVCLYPAVSAVYGNTEVTLVYLGKPLDG

SEQ ID NO: 744463 - protein, 410 aa, Homo sapiens; identical to SEQ ID NO: 744462

SEQ ID NO: 744464 - protein, 410 aa, Homo sapiens; identical to SEQ ID NO: 744462

SEQ ID NO: 744465 - protein, 250 aa, Homo sapiens
MVAGSDAGRALGVLSVVCLLHCFGFISCFSQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHRYALIPIPLAVITTCIVLYMNGILKCDRKPDRTNSN

SEQ ID NO: 744466 - protein, 240 aa, Homo sapiens
MVAGSDAGRALGVLSVVCLLHCFGFISCFSQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHRYALIPIPLAVITTCIVLYMNGMYAF

SEQ ID NO: 744467 - protein, 250 aa, Homo sapiens; identical to SEQ ID NO: 744465

SEQ ID NO: 744468 - protein, 162 aa, Homo sapiens
MVAGSDAGRALGVLSVVCLLHCFGFISCFSQQIYGVVYGNVTFHVPSNVPLKEVLWKKQKDKVAELENSEFRAFSSFKNRVYLDTVSGSLTIYNLTSSDEDEYEMESPNITDTMKFFLYVLGHSRHRYALIPIPLAVITTCIVLYMNGILKCDRKPDRTNSN

SEQ ID NO: 744469 - protein, 237 aa, Homo sapiens
MVAGSDAGRALGVLSVVCLLHCFGFISCFSQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHRYALIPIPLAVITTCIVLYMNVL

SEQ ID NO: 744470 - protein, 240 aa, Homo sapiens; identical to SEQ ID NO: 744466

SEQ ID NO: 744471 - protein, 1464 aa, Homo sapiens
MSGMGENTSDPSRAETRKRKECPDQLGPSPKRNTEKRNREQENKYIEELAELIFANFNDIDNFNFKPDKCAILKETVKQIRQIKEQEKAAAANIDEVQKSDVSSTGQGVIDKDALGPMMLEALDGFFFVVNLEGNVVFVSENVTQYLRYNQEELMNKSVYSILHVGDHTEFVKNLLPKSIVNGGSWSGEPPRRNSHTFNCRMLVKPLPDSEEEGHDNQEAHQKYETMQCFAVSQPKSIKEEGEDLQSCLICVARRVPMKERPVLPSSESFTTRQDLQGKITSLDTSTMRAAMKPGWEDLVRRCIQKFHAQHEGESVSYAKRHHHEVLRQGLAFSQIYRFSLSDGTLVAAQTKSKLIRSQTTNEPQLVISLHMLHREQNVCVMNPDLTGQTMGKPLNPISSNSPAHQALCSGNPGQDMTLSSNINFPINGPKEQMGMPMGRFGGSGGMNHVSGMQATTPQGSNYALKMNSPSQSSPGMNPGQPTSMLSPRHRMSPGVAGSPRIPPSQFSPAGSLHSPVGVCSSTGNSHSYTNSSLNALQALSEGHGVSLGSSLASPDLKMGNLQNSPVNMNPPPLSKMGSLDSKDCFGLYGEPSEGTTGQAESSCHPGEQKETNDPNLPPAVSSERADGQSRLHDSKGQTKLLQLLTTKSDQMEPSPLASSLSDTNKDSTGSLPGSGSTHGTSLKEKHKILHRLLQDSSSPVDLAKLTAEATGKDLSQESSSTAPGSEVTIKQEPVSPKKKENALLRYLLDKDDTKDIGLPEITPKLERLDSKTDPASNTKLIAMKTEKEEMSFEPGDQPGSELDNLEEILDDLQNSQLPQLFPDTRPGAPAGSVDKQAIINDLMQLTAENSPVTPVGAQKTALRISQSTFNNPRPGQLGRLLPNQNLPLDITLQSPTGAGPFPPIRNSSPYSVIPQPGMMGNQGMIGNQGNLGNSSTGMIGNSASRPTMPSGEWAPQSSAVRVTCAATTSAMNRPVQGGMIRNPAASIPMRPSSQPGQRQTLQSQVMNIGPSELEMNMGGPQYSQQQAPPNQTAPWPESILPIDQASFASQNRQPFGSSPDDLLCPHPAAESPSDEGALLDQLYLALRNFDGLEEIDRALGIPELVSQSQAVDPEQFSSQDSNIMLEQKAPVFPQQYASQAQMAQGSYSPMQDPNFHTMGQRPSYATLRMQPRPGLRPTGLVQNQPNQLRLQLQHRLQAQQNRQPLMNQISNVSNVNLTLRPGVPTQAPINAQMLAQRQREILNQHLRQRQMHQQQQVQQRTLMMRGQGLNMTPSMVAPSGMPATMSNPRIPQANAQQFPFPPNYGISQQPDPGFTGATTPQSPLMSPRMAHTQSPMMQQSQANPAYQAPSDINGWAQGNMGGNSMFSQQSPPHFGQQANTSMYSNNMNINVSMATNTGGMSSMNQMTGQISMTSVTSVPTSGLSSMGPEQVNDPALRGGNLFPNQLPGMDMIKQEGDTTRKYC

SEQ ID NO: 744472 - protein, 1464 aa, Homo sapiens; identical to SEQ ID NO: 744471

SEQ ID NO: 744473 - protein, 1464 aa, Homo sapiens; identical to SEQ ID NO: 744471

SEQ ID NO: 744474 - protein, 1070 aa, Homo sapiens
MSGMGENTSDPSRAETRKRKECPDQLGPSPKRNTEKRNREQENKYIEELAELIFANFNDIDNFNFKPDKCAILKETVKQIRQIKEQEKAAAANIDEVQKSDVSSTGQGVIDKDALGPMMLEALDGFFFVVNLEGNVVFVSENVTQYLRYNQEELMNKSVYSILHVGDHTEFVKNLLPKSIVNGGSWSGEPPRRNSHTFNCRMLVKPLPDSEEEGHDNQEAHQKYETMQCFAVSQPKSIKEEGEDLQSCLICVARRVPMKERPVLPSSESFTTRQDLQGKITSLDTSTMRAAMKPGWEDLVRRCIQKFHAQHEGESVSYAKRHHHEVLRQGLAFSQIYRFSLSDGTLVAAQTKSKLIRSQTTNEPQLVISLHMLHREQNVCVMNPDLTGQTMGKPLNPISSNSPAHQALCSGNPGQDMTLSSNINFPINGPKEQMGMPMGRFGGSGGMNHVSGMQATTPQGSNYALKMNSPSQSSPGMNPGQPTSMLSPRHRMSPGVAGSPRIPPSQFSPAGSLHSPVGVCSSTGNSHSYTNSSLNALQALSEGHGVSLGSSLASPDLKMGNLQNSPVNMNPPPLSKMGSLDSKDCFGLYGEPSEGTTGQAESSCHPGEQKETNDPNLPPAVSSERADGQSRLHDSKGQTKLLQLLTTKSDQMEPSPLASSLSDTNKDSTGSLPGSGSTHGTSLKEKHKILHRLLQDSSSPVDLAKLTAEATGKDLSQESSSTAPGSEVTIKQEPVSPKKKENALLRYLLDKDDTKDIGLPEITPKLERLDSKTDPASNTKLIAMKTEKEEMSFEPGDQPGSELDNLEEILDDLQNSQLPQLFPDTRPGAPAGSVDKQAIINDLMQLTAENSPVTPVGAQKTALRISQSRMIGNSASRPTMPSGEWAPQSSAVRVTCAATTSAMNRPVQGGMIRNPAASIPMRPSSQPGQRQTLQSQVMNIGPSELEMNMGGPQYSQQQAPPNQTAPWPESILPIDQASFASQNRQPFGSSPDDLLCPHPAAESPSDEGALLDQLYLALRNFDGLEEIDRALGIPELVSQVCAEGQQVGAKRSHGRRGVHFLFTGTPRSAF

SEQ ID NO: 744475 - protein, 1464 aa, Homo sapiens; identical to SEQ ID NO: 744471

SEQ ID NO: 744476 - protein, 1464 aa, Homo sapiens; identical to SEQ ID NO: 744471

SEQ ID NO: 744477 - protein, 1395 aa, Homo sapiens
MSGMGENTSDPSRAETRKRKECPDQLGPSPKRNTEKRNREQENKYIEELAELIFANFNDIDNFNFKPDKCAILKETVKQIRQIKEQEKAAAANIDEVQKSDVSSTGQGVIDKDALGPMMLEALDGFFFVVNLEGNVVFVSENVTQYLRYNQEELMNKSVYSILHVGDHTEFVKNLLPKSIVNGGSWSGEPPRRNSHTFNCRMLVKPLPDSEEEGHDNQEAHQKYETMQCFAVSQPKSIKEEGEDLQSCLICVARRVPMKERPVLPSSESFTTRQDLQGKITSLDTSTMRAAMKPGWEDLVRRCIQKFHAQHEGESVSYAKRHHHEVLRQGLAFSQIYRFSLSDGTLVAAQTKSKLIRSQTTNEPQLVISLHMLHREQNVCVMNPDLTGQTMGKPLNPISSNSPAHQALCSGNPGQDMTLSSNINFPINGPKEQMGMPMGRFGGSGGMNHVSGMQATTPQGSNYALKMNSPSQSSPGMNPGQPTSMLSPRHRMSPGVAGSPRIPPSQFSPAGSLHSPVGVCSSTGNSHSYTNSSLNALQALSEGHGVSLGSSLASPDLKMGNLQNSPVNMNPPPLSKMGSLDSKDCFGLYGEPSEGTTGQAESSCHPGEQKETNDPNLPPAVSSERADGQSRLHDSKGQTKLLQLLTTKSDQMEPSPLASSLSDTNKDSTGSLPGSGSTHGTSLKEKHKILHRLLQDSSSPVDLAKLTAEATGKDLSQESSSTAPGSEVTIKQEPVSPKKKENALLRYLLDKDDTKDIGLPEITPKLERLDSKTDPASNTKLIAMKTEKEEMSFEPGDQPGSELDNLEEILDDLQNSQLPQLFPDTRPGAPAGSVDKQAIINDLMQLTAENSPVTPVGAQKTALRISQSRMIGNSASRPTMPSGEWAPQSSAVRVTCAATTSAMNRPVQGGMIRNPAASIPMRPSSQPGQRQTLQSQVMNIGPSELEMNMGGPQYSQQQAPPNQTAPWPESILPIDQASFASQNRQPFGSSPDDLLCPHPAAESPSDEGALLDQLYLALRNFDGLEEIDRALGIPELVSQSQAVDPEQFSSQDSNIMLEQKAPVFPQQYASQAQMAQGSYSPMQDPNFHTMGQRPSYATLRMQPRPGLRPTGLVQNQPNQLRLQLQHRLQAQQNRQPLMNQISNVSNVNLTLRPGVPTQAPINAQMLAQRQREILNQHLRQRQMHQQQQVQQRTLMMRGQGLNMTPSMVAPSGMPATMSNPRIPQANAQQFPFPPNYGISQQPDPGFTGATTPQSPLMSPRMAHTQSPMMQQSQANPAYQAPSDINGWAQGNMGGNSMFSQQSPPHFGQQANTSMYSNNMNINVSMATNTGGMSSMNQMTGQISMTSVTSVPTSGLSSMGPEQVNDPALRGGNLFPNQLPGMDMIKQEGDTTRKYC

SEQ ID NO: 744478 - protein, 1053 aa, Homo sapiens
MSGMGENTSDPSRAETRKRKECPDQLGPSPKRNTEKRNREQENKYIEELAELIFANFNDIDNFNFKPDKCAILKETVKQIRQIKEQEKAAAANIDEVQKSDVSSTGQGVIDKDALGPMMLEALDGFFFVVNLEGNVVFVSENVTQYLRYNQEELMNKSVYSILHVGDHTEFVKNLLPKSIVNGGSWSGEPPRRNSHTFNCRMLVKPLPDSEEEGHDNQEAHQKYETMQCFAVSQPKSIKEEGEDLQSCLICVARRVPMKERPVLPSSESFTTRQDLQGKITSLDTSTMRAAMKPGWEDLVRRCIQKFHAQHEGESVSYAKRHHHEVLRQGLAFSQIYRFSLSDGTLVAAQTKSKLIRSQTTNEPQLVISLHMLHREQNVCVMNPDLTGQTMGKPLNPISSNSPAHQALCSGNPGQDMTLSSNINFPINGPKEQMGMPMGRFGGSGGMNHVSGMQATTPQGSNYALKMNSPSQSSPGMNPGQPTSMLSPRHRMSPGVAGSPRIPPSQFSPAGSLHSPVGVCSSTGNSHSYTNSSLNALQALSEGHGVSLGSSLASPDLKMGNLQNSPVNMNPPPLSKMGSLDSKDCFGLYGEPSEGTTGQAESSCHPGEQKETNDPNLPPAVSSERADGQSRLHDSKGQTKLLQLLTTKSDQMEPSPLASSLSDTNKDSTGSLPGSGSTHGTSLKEKHKILHRLLQDSSSPVDLAKLTAEATGKDLSQESSSTAPGSEVTIKQEPVSPKKKENALLRYLLDKDDTKDIGLPEITPKLERLDSKTDPASNTKLIAMKTEKEEMSFEPGDQPGSELDNLEEILDDLQNSQLPQLFPDTRPGAPAGSVDKQAIINDLMQLTAENSPVTPVGAQKTALRISQSTFNNPRPGQLGRLLPNQNLPLDITLQSPTGAGPFPPIRNSSPYSVIPQPGMMGNQGMIGNQGNLGNSSTGMIGNSASRPTMPSGEWAPQSSAVRVTCAATTSAMNRPVQGGMIRNPAASIPMRPSSQPGQRQTLQSQVMNIGPSELEMNMGGPQYSQQQAPPNQTAPWPESILPIDQASFASQNR

SEQ ID NO: 744479 - protein, 158 aa, Homo sapiens
MPLKTGCLFHPVPSQLLAWPADAPEAVTVVTIAPDFHGVHHGHITNLKKFTAYFTSVLCFTTPGDGPPSTPQLVWTQEDKPGAVGHLSFTEILDTSLKVSWQEPLEKNGIITGYQISWEVYGRNDSRLTHTLNSTTHEYKIQGLSSLTTYTIDVAAVT

SEQ ID NO: 744480 - protein, 111 aa, Homo sapiens
MREGDDISRVLKAKKSFQLRILYPATSFFKHKKEIKTFPGKQKLKNVTNTRTIKGILQFKRKGFSSNKKSSEGIKVTGKTLFTTAKTWKQPECPSTDRIKKMWVRHGCLCL

SEQ ID NO: 744481 - protein, 170 aa, Homo sapiens
MAVLWRLSAVCGALGGRALLLRTPVVRPAHISAFLQDRPIPEWCGVQHIHLSPSHHSGSKAASLHWTSERVVSVLLLGLLPAAYLNPCSAMDYSLAAALTLHGHWGLGQVVTDYVHGDALQKAAKAGLLALSALTFAGLCYFNYHDVGICKGCCHAVEALTFCDFILVKN

SEQ ID NO: 744482 - protein, 170 aa, Homo sapiens; identical to SEQ ID NO: 744481

SEQ ID NO: 744483 - protein, 206 aa, Homo sapiens
MAVLWRLSAVCGALGGRALLLRTPVVRPAHISAFLQDRPIPEWCGVQHIHLSPSHHSGSKAASLHWTSERVVSVLLLGLLPAAYLNPCSAMDYSLAAALTLHGHWGLGQVVTDYVHGDALQKEEKAAKGRGLFGGHLFSPRPFFFLKKNPPPFFFFGGGRPPLFWGGEGKKRERQPHIIFLFTQSEDGGGAEPPLSLIKKQAVFFI

SEQ ID NO: 744484 - protein, 170 aa, Homo sapiens; identical to SEQ ID NO: 744481

SEQ ID NO: 744485 - protein, 170 aa, Homo sapiens; identical to SEQ ID NO: 744481

SEQ ID NO: 744486 - protein, 170 aa, Homo sapiens; identical to SEQ ID NO: 744481

SEQ ID NO: 744487 - protein, 201 aa, Homo sapiens
MRSERGGQVRYGEPVVHYAVSLSESRWSLYLGVYGFTLAYSKLRCLVWRTRLAVVTATFSRMRCSLRVAYLVSIDATESKRTDVVRTIETMYCSSQLKQERVVSVLLLGLLPAAYLNPCSAMDYSLAAALTLHGHWGLGQVVTDYVHGDALQKAAKAGLLALSALTFAGLCYFNYHDVGICKGCCHAVEALTFCDFILVKN

SEQ ID NO: 744488 - protein, 130 aa, Homo sapiens
MTLSPQERDGGSLEAECRLRCPRRPSSVASNSSGQTCSYLSISSGPTYPRMVWSAAHTLVTEPPLGLGQVVTDYVHGDALQKAAKAGLLALSALTFAGLCYFNYHDVGICKGCCHAVEALTFCDFILVKN

SEQ ID NO: 744489 - protein, 170 aa, Homo sapiens; identical to SEQ ID NO: 744481

SEQ ID NO: 744490 - protein, 170 aa, Homo sapiens; identical to SEQ ID NO: 744481

SEQ ID NO: 744491 - protein, 170 aa, Homo sapiens; identical to SEQ ID NO: 744481

SEQ ID NO: 744492 - protein, 170 aa, Homo sapiens; identical to SEQ ID NO: 744481

SEQ ID NO: 744493 - protein, 182 aa, Homo sapiens
MHVPAMEILYDDYAGVLEHLDDSPRGSYRMQSLDLTVHHNASPKKVMLGVSTQYEHVSTRARNFWITDAGSKAASLHWTSERVVSVLLLGLLPAAYLNPCSAMDYSLAAALTLHGHWGLGQVVTDYVHGDALQKAAKAGLLALSALTFAGLCYFNYHDVGICKGCCHAVEALTFCDFILVKN

SEQ ID NO: 744494 - protein, 213 aa, Homo sapiens
MAVLWRLSAVCGALGGRALLLRTPVVRPAHISAFLQDRPIPEWCGVQHIHLSPSHHSGSKAASLHWTSERVVSVLLLGLLPAAYLNPCSAMDYSLAAALTLHGHWLECNGAILARHDLGSARSRLTATSAFRVQAILLPQLPSSWHYRGLGQVVTDYVHGDALQKAAKAGLLALSALTFAGLCYFNYHDVGICKGCCHAVEALTFCDFILVKN

SEQ ID NO: 744495 - protein, 170 aa, Homo sapiens; identical to SEQ ID NO: 744481

SEQ ID NO: 744496 - protein, 668 aa, Homo sapiens
MLGTQGWTKQRKPCPQNASSYSAEMTEPKSVCVSVDEVVSSNMEATETDLLNGHLKKVDNNLTEAQRFSSLPRRAAVNIEFRDLSYSVPEGPWWRKKGYKTLLKGISGKFNSGELVAIMGPSGAGKSTLMNILAGYRETGMKGAVLINGLPRDLRCFRKVSCYIMQDDMLLPHLTVQEAMMVSAHLKLQEKDEGRREMVKEILTALGLLSCANTRTGSLSGGQRKRLAIALELVNNPPVMFFDEPTSGLDSASCFQVVSLMKGLAQGGRSIICTIHQPSAKLFELFDQLYVLSQGQCVYRGKVCNLVPYLRDLGLNCPTYHNPADFVMEVASGEYGDQNSRLVRAVREGMCDSDHKRDLGGDAEVNPFLWHRPSEEDSSSMEGCHSFSASCLTQFCILFKRTFLSIMRDSVLTHLRITSHIGIGLLIGLLYLGIGNEAKKVLSNSGFLFFSMLFLMFAALMPTVLTFPLEMGVFLREHLNYWYSLKAYYLAKTMADVPFQIMFPVAYCSIVYWMTSQPSDAVRFVLFAALGTMTSLVAQSLGLLIGAASTSLQVATFVGPVTAIPVLLFSGFFVSFDTIPTYLQWMSYISYVRYGFEGVILSIYGLDREDLHCDIDETCHFQKSEAILRELDVENAKLYLDFIVLGIFFISLRLIAYLVLRYKIRAER

SEQ ID NO: 744497 - protein, 727 aa, Homo sapiens
ACDCTPGDTLSRTHSGRRRRRPGETREGQARIPAGRLSARAGERDAVGTGMRISLPRAPERDGGVSASSLLDTVTNASSYSAEMTEPKSVCVSVDEVVSSNMEATETDLLNGHLKKVDNNLTEAQRFSSLPRRAAVNIEFRDLSYSVPEGPWWRKKGYKTLLKGISGKFNSGELVAIMGPSGAGKSTLMNILAGYRETGMKGAVLINGLPRDLRCFRKVSCYIMQDDMLLPHLTVQEAMMVSAHLKLQEKDEGRREMVKEILTALGLLSCANTRTGSLSGGQRKRLAIALELVNNPPVMFFDEPTSGLDSASCFQVVSLMKGLAQGGRSIICTIHQPSAKLFELFDQLYVLSQGQCVYRGKVCNLVPYLRDLGLNCPTYHNPADFVMEVASGEYGDQNSRLVRAVREGMCDSDHKRDLGGDAEVNPFLWHRPSEEDSSSMEGCHSFSASCLTQFCILFKRTFLSIMRDSVLTHLRITSHIGIGLLIGLLYLGIGNEAKKVLSNSGFLFFSMLFLMFAALMPTVLTFPLEMGVFLREHLNYWYSLKAYYLAKTMADVPFQIMFPVAYCSIVYWMTSQPSDAVRFVLFAALGTMTSLVAQSLGLLIGAASTSLQVATFVGPVTAIPVLLFSGFFVSFDTIPTYLQWMSYISYVRYGFEGVILSIYGLDREDLHCDIDETCHFQKSEAILRELDVENAKLYLDFIVLGIFFISLRLIAYLVLRYKIRAER

SEQ ID NO: 744498 - protein, 666 aa, Homo sapiens
MACLMAAFSVGTAMNASSYSAEMTEPKSVCVSVDEVVSSNMEATETDLLNGHLKKVDNNLTEAQRFSSLPRRAAVNIEFRDLSYSVPEGPWWRKKGYKTLLKGISGKFNSGELVAIMGPSGAGKSTLMNILAGYRETGMKGAVLINGLPRDLRCFRKVSCYIMQDDMLLPHLTVQEAMMVSAHLKLQEKDEGRREMVKEILTALGLLSCANTRTGSLSGGQRKRLAIALELVNNPPVMFFDEPTSGLDSASCFQVVSLMKGLAQGGRSIICTIHQPSAKLFELFDQLYVLSQGQCVYRGKVCNLVPYLRDLGLNCPTYHNPADFVMEVASGEYGDQNSRLVRAVREGMCDSDHKRDLGGDAEVNPFLWHRPSEEDSSSMEGCHSFSASCLTQFCILFKRTFLSIMRDSVLTHLRITSHIGIGLLIGLLYLGIGNEAKKVLSNSGFLFFSMLFLMFAALMPTVLTFPLEMGVFLREHLNYWYSLKAYYLAKTMADVPFQIMFPVAYCSIVYWMTSQPSDAVRFVLFAALGTMTSLVAQSLGLLIGAASTSLQVATFVGPVTAIPVLLFSGFFVSFDTIPTYLQWMSYISYVRYGFEGVILSIYGLDREDLHCDIDETCHFQKSEAILRELDVENAKLYLDFIVLGIFFISLRLIAYLVLRYKIRAER

SEQ ID NO: 744499 - protein, 689 aa, Homo sapiens
LYKGEFPCTSSLSCLPPCETCLSPSAMIMRLPQPHGTNASSYSAEMTEPKSVCVSVDEVVSSNMEATETDLLNGHLKKVDNNLTEAQRFSSLPRRAAVNIEFRDLSYSVPEGPWWRKKGYKTLLKGISGKFNSGELVAIMGPSGAGKSTLMNILAGYRETGMKGAVLINGLPRDLRCFRKVSCYIMQDDMLLPHLTVQEAMMVSAHLKLQEKDEGRREMVKEILTALGLLSCANTRTGSLSGGQRKRLAIALELVNNPPVMFFDEPTSGLDSASCFQVVSLMKGLAQGGRSIICTIHQPSAKLFELFDQLYVLSQGQCVYRGKVCNLVPYLRDLGLNCPTYHNPADFVMEVASGEYGDQNSRLVRAVREGMCDSDHKRDLGGDAEVNPFLWHRPSEEDSSSMEGCHSFSASCLTQFCILFKRTFLSIMRDSVLTHLRITSHIGIGLLIGLLYLGIGNEAKKVLSNSGFLFFSMLFLMFAALMPTVLTFPLEMGVFLREHLNYWYSLKAYYLAKTMADVPFQIMFPVAYCSIVYWMTSQPSDAVRFVLFAALGTMTSLVAQSLGLLIGAASTSLQVATFVGPVTAIPVLLFSGFFVSFDTIPTYLQWMSYISYVRYGFEGVILSIYGLDREDLHCDIDETCHFQKSEAILRELDVENAKLYLDFIVLGIFFISLRLIAYLVLRYKIRAER

SEQ ID NO: 744500 - protein, 231 aa, Homo sapiens
GIVASCTVGSCTVASGTVASCILASCTVACSAGMRLTLQWPSVLLPHCCPCPLQVSAHLKLQEKDEGRREMVKEILTALGLLSCANTRTGSLSGGQRKRLAIALELVNNPPVMFFDEPTSGLDSASCFQVVSLMKGLAQGGRSIICTIHQPSAKLFELFDQLYVLSQGQCVYRGKVCNLVPYLRDLGLNCPTYHNPADFGKRSPEQLGGQKGDFPPLWVSLLADAPNSETT

SEQ ID NO: 744501 - protein, 638 aa, Homo sapiens
MEATETDLLNGHLKKVDNNLTEAQRFSSLPRRAAVNIEFRDLSYSVPEGPWWRKKGYKTLLKGISGKFNSGELVAIMGPSGAGKSTLMNILAGYRETGMKGAVLINGLPRDLRCFRKVSCYIMQDDMLLPHLTVQEAMMVSAHLKLQEKDEGRREMVKEILTALGLLSCANTRTGSLSGGQRKRLAIALELVNNPPVMFFDEPTSGLDSASCFQVVSLMKGLAQGGRSIICTIHQPSAKLFELFDQLYVLSQGQCVYRGKVCNLVPYLRDLGLNCPTYHNPADFVMEVASGEYGDQNSRLVRAVREGMCDSDHKRDLGGDAEVNPFLWHRPSEEVKQTKRLKGLRKDSSSMEGCHSFSASCLTQFCILFKRTFLSIMRDSVLTHLRITSHIGIGLLIGLLYLGIGNEAKKVLSNSGFLFFSMLFLMFAALMPTVLTFPLEMGVFLREHLNYWYSLKAYYLAKTMADVPFQIMFPVAYCSIVYWMTSQPSDAVRFVLFAALGTMTSLVAQSLGLLIGAASTSLQVATFVGPVTAIPVLLFSGFFVSFDTIPTYLQWMSYISYVRYGFEGVILSIYGLDREDLHCDIDETCHFQKSEAILRELDVENAKLYLDFIVLGIFFISLRLIAYLVLRYKIRAER

SEQ ID NO: 744502 - protein, 638 aa, Homo sapiens; identical to SEQ ID NO: 744501

SEQ ID NO: 744503 - protein, 107 aa, Homo sapiens
MPSCTWTSSYSGFSSSPSASLPIWSSGTKSGQRGKTPECQETGRLDTVAEGTSRIEEASLCPTDDTETLLIQPLEPRWVCGCLVLSHSAQLGWIFSPFPFLALTRKM

SEQ ID NO: 744504 - protein, 105 aa, Homo sapiens
MCVDEVVSSNMEATETDLLNGHLKKVDNNLTEAQRFSSLPRRAAVNIEFRDLSYSVPEGPWWRKKGYKTLLKGISGKFNSGELVAIMGPSGAGKSTLMNILAGYR

SEQ ID NO: 744505 - protein, 69 aa, Homo sapiens
RGKLAWASLLCRRPGCRFCYICPVCPQLQVATFVGPVTAIPVLLFSGFFVSFDTIPTYLQWMSYISYVR

SEQ ID NO: 744506 - protein, 684 aa, Homo sapiens
EFRFLPKKCLMAAFSVGTAMNASSYSAEMTEPKSVCVSVDEVVSSNMEATETDLLNGHLKKVDNNLTEAQRFSSLPRRAAVNIEFRDLSYSVPEGPWWRKKGYKTLLKGISGKFNSGELVAIMGPSGAGKSTLMNILAGYRETGMKGAVLINGLPRDLRCFRKVSCYIMQDDMLLPHLTVQEAMMVSAHLKLQEKDEGRREMVKEILTALGLLSCANTRTGSLSGGQRKRLAIALELVNNPPVMFFDEPTSGLDSASCFQVVSLMKGLAQGGRSIICTIHQPSAKLFELFDQLYVLSQGQCVYRGKVCNLVPYLRDLGLNCPTYHNPADFVMEVASGEYGDQNSRLVRAVREGMCDSDHKRDLGGDAEVNPFLWHRPSEEVKQTKRLKGLRKDSSSMEGCHSFSASCLTQFCILFKRTFLSIMRDSVLTHLRITSHIGIGLLIGLLYLGIGNEAKKVLSNSGFLFFSMLFLMFAALMPTVLTFPLEMGVFLREHLNYWYSLKAYYLAKTMADVPFQIMFPVAYCSIVYWMTSQPSDAVRFVLFAALGTMTSLVAQSLGLLIGAASTSLQVATFVGPVTAIPVLLFSGFFVSFDTIPTYLQWMSYISYVRYGFEGVILSIYGLDREDLHCDIDETCHFQKSEAILRELDVENAKLYLDFIVLGIFFISLRLIAYLVLRYKIRAER

SEQ ID NO: 744507 - protein, 644 aa, Homo sapiens
MTEPKSVCVSVDEVVSSNMEATETDLLNGHLKKVDNNLTEAQRFSSLPRRAAVNIEFRDLSYSVPEGPWWRKKGYKTLLKGISGKFNSGELVAIMGPSGAGKSTLMNILAGYRETGMKGAVLINGLPRDLRCFRKVSCYIMQDDMLLPHLTVQEAMMVSAHLKLQEKDEGRREMVKEILTALGLLSCANTRTGSLSGGQRKRLAIALELVNNPPVMFFDEPTSGLDSASCFQVVSLMKGLAQGGRSIICTIHQPSAKLFELFDQLYVLSQGQCVYRGKVCNLVPYLRDLGLNCPTYHNPADFVMEVASGEYGDQNSRLVRAVREGMCDSDHKRDLGGDAEVNPFLWHRPSEEDSSSMEGCHSFSASCLTQFCILFKRTFLSIMRDSVLTHLRITSHIGIGLLIGLLYLGIGNEAKKVLSNSGFLFFSMLFLMFAALMPTVLTFPLEMGVFLREHLNYWYSLKAYYLAKTMADVPFQIMFPVAYCSIVYWMTSQPSDAVRFVLFAALGTMTSLVAQSLGLLIGAASTSLQVATFVGPVTAIPVLLFSGFFVSFDTIPTYLQWMSYISYVRYGFEGVILSIYGLDREDLHCDIDETCHFQKSEAILRELDVENAKLYLDFIVLGIFFISLRLIAYLVLRYKIRAER

SEQ ID NO: 744508 - protein, 672 aa, Homo sapiens
EFRFLPKKCLMAAFSVGTAMNASSYSAEMTEPKSVCVSVDEVVSSNMEATETDLLNGHLKKVDNNLTEAQRFSSLPRRAAVNIEFRDLSYSVPEGPWWRKKGYKTLLKGISGKFNSGELVAIMGPSGAGKSTLMNILAGYRETGMKGAVLINGLPRDLRCFRKVSCYIMQDDMLLPHLTVQEAMMVSAHLKLQEKDEGRREMVKEILTALGLLSCANTRTGSLSGGQRKRLAIALELVNNPPVMFFDEPTSGLDSASCFQVVSLMKGLAQGGRSIICTIHQPSAKLFELFDQLYVLSQGQCVYRGKVCNLVPYLRDLGLNCPTYHNPADFVMEVASGEYGDQNSRLVRAVREGMCDSDHKRDLGGDAEVNPFLWHRPSEEDSSSMEGCHSFSASCLTQFCILFKRTFLSIMRDSVLTHLRITSHIGIGLLIGLLYLGIGNEAKKVLSNSGFLFFSMLFLMFAALMPTVLTFPLEMGVFLREHLNYWYSLKAYYLAKTMADVPFQIMFPVAYCSIVYWMTSQPSDAVRFVLFAALGTMTSLVAQSLGLLIGAASTSLQVATFVGPVTAIPVLLFSGFFVSFDTIPTYLQWMSYISYVRYGFEGVILSIYGLDREDLHCDIDETCHFQKSEAILRELDVENAKLYLDFIVLGIFFISLRLIAYLVLRYKIRAER

SEQ ID NO: 744509 - protein, 93 aa, Homo sapiens
ACDCTPGDTLSRTHSGRRRRRPGETREGQARIPAGRLSARAGERDAVGTGMRISLPRAPERDGGVSASSLLDTVTVSAVSRGGQESPFLVFWH

SEQ ID NO: 744510 - protein, 638 aa, Homo sapiens; identical to SEQ ID NO: 744501

SEQ ID NO: 744511 - protein, 638 aa, Homo sapiens; identical to SEQ ID NO: 744501

SEQ ID NO: 744512 - protein, 353 aa, Homo sapiens
MEVASGEYGDQNSRLVRAVREGMCDSDHKRDLGGDAEVNPFLWHRPSEEVKQTKRLKGLRKDSSSMEGCHSFSASCLTQFCILFKRTFLSIMRDSVLTHLRITSHIGIGLLIGLLYLGIGNEAKKVLSNSGFLFFSMLFLMFAALMPTVLTFPLEMGVFLREHLNYWYSLKAYYLAKTMADVPFQIMFPVAYCSIVYWMTSQPSDAVRFVLFAALGTMTSLVAQSLGLLIGAASTSLQVATFVGPVTAIPVLLFSGFFVSFDTIPTYLQWMSYISYVRYGFEGVILSIYGLDREDLHCDIDETCHFQKSEAILRELDVENAKLYLDFIVLGIFFISLRLIAYLVLRYKIRAER

SEQ ID NO: 744513 - protein, 116 aa, Homo sapiens
EFRFLPKKCLMAAFSVGTAMNASSYSAEMTEPKSVCVSVDEVVSSNMEATETDLLNGHLKKVDNNLTEAQRFSSLPRRAAVNIEFRDLSYSVPEGPWWRKKGREGGCFVYQAGRSL

SEQ ID NO: 744514 - protein, 725 aa, Homo sapiens
MRGTRYHPSEAPTPRRPGRLPTPPQAAPAGDFPSRGRGGDPERKVRRRPAGVVRLPVAASGAVPRARRGAARPRGPGKAGPDSGLPRDAMRGGRGAPFWLWPLPKLALLPLLWVLFQRTRPQGSAGPLQCYGVGPLGDLNCSWEPLGDLGAPSELHLQSQKYRSNKTQTVAVAAGRSWVAIPREQLTMSDKLLVWGTKAGQPLWPPVFVNLETQMKPNAPRLGPDVDFSEDDPLEATVHWAPPTWPSHKVLICQFHYRRCQEAAWTLLEPELKTIPLTPVEIQDLELATGYKVYGRCRMEKEEDLWGEWSPILSFQTPPSAPKDVWVSGNLCGTPGGEEPLLLWKAPGPCVQVSYKVWFWVGGRELSPEGITCCCSLIPSGAEWARVSAVNATSWEPLTNLSLVCLDSASAPRSVAVSSIAGSTELLVTWQPGPGEPLEHVVDWARDGDPLEKLNWVRLPPGNLSALLPGNFTVGVPYRITVTAVSASGLASASSVWGFREELAPLVGPTLWRLQDAPPGTPAIAWGEVPRHQLRGHLTHYTLCAQSGTSPSVCMNVSGNTQSVTLPDLPWGPCELWVTASTIAGQGPPGPILRLHLPDNTLRWKVLPGILFLWGLFLLGCGLSLATSGRCYHLRHKVLPRWVWEKVPDPANSSSGQPHMEQVPEAQPLGDLPILEVEEMEPPPVMESSQPAQATAPLDSGYEKHFLPTPEELGLLGPPRPQVLA

SEQ ID NO: 744515 - protein, 725 aa, Homo sapiens; identical to SEQ ID NO: 744514

SEQ ID NO: 744516 - protein, 725 aa, Homo sapiens; identical to SEQ ID NO: 744514

SEQ ID NO: 744517 - protein, 421 aa, Homo sapiens
MRGTRYHPSEAPTPRRPGRLPTPPQAAPAGDFPSRGRGGDPERKVRRRPAGVVRLPVAASGAVPRARRGAARPRGPGKAGPDSGLPRDAMRGGRGAPFWLWPLPKLALLPLLWVLFQRTRPQGSAGPLQCYGVGPLGDLNCSWEPLGDLGAPSELHLQSQKYRSNKTQTVAVAAGRSWVAIPREQLTMSDKLLVWGTKAGQPLWPPVFVNLETQMKPNAPRLGPDVDFSEDDPLEATVHWAPPTWPSHKVLICQFHYRRCQEAAWTLLEPELKTIPLTPVEIQDLELATGYKVYGRCRMEKEEDLWGEWSPILSFQTPPSAPKDVWVSGNLCGTPGGEEPLLLWKAPGPCVQVSYKVWFWVGGRELSPEGITCCCSLIPSGAEWARVSAVNATSWEPLTNLSLVCLDSASAPRSSRRSGDL

SEQ ID NO: 744518 - protein, 725 aa, Homo sapiens; identical to SEQ ID NO: 744514

SEQ ID NO: 744519 - protein, 136 aa, Homo sapiens
KNDLFPTLPDNTLRWKVLPGILFLWGLFLLGCGLSLATSGRCYHLRHKVLPRWVWEKVPDPANSSSGQPHMEQVPEAQPLGDLPILEVEEMEPPPVMESSQPAQATAPLDSGYEKHFLPTPEELGLLGPPRPQVLA

SEQ ID NO: 744520 - protein, 54 aa, Homo sapiens
MGVSRWRGFGASVEINTPTPAVATGGPAAETIASCSAPVQNTELHTACSGLESP

SEQ ID NO: 744521 - protein, 109 aa, Homo sapiens
RPGIPMCAQLAHSIIVPRKLLQFIKSSGLGISLNSKRRKEETFPTRCGCDASQGPQGHCPRAHRPPLTATGAWIRSYIVQSFRPLPWSTRTRARISGRAHTHSYTRTQT

SEQ ID NO: 744522 - protein, 46 aa, Homo sapiens
MHKGESATHFQTTRSCENSLTVMRTVRGSPPHDSVMSHQAPPPTCG

SEQ ID NO: 744523 - protein, 123 aa, Homo sapiens
AAAAGLGLQREAAEGKWSAWRMTEETRIVYWIKDRQLTNRDSTILELQKVLKTCCAQSMKIFCCLWNFVYKQLEDAAQGLTMGGDVEEHEDLTADSTIFKFVEAYVSWIGKFPTYNVGSSICF

SEQ ID NO: 744524 - protein, 112 aa, Homo sapiens
AAAAGLGLQREAAEGKWSAWRMTEETRIVYWIKDRQLTNRDSTILELQKVLKTCCAQSMKIFCCLWNFVYKQLEDAAQGLTMGGDVEEHGEFDCGWWQRSLCVSGICKAAQS

SEQ ID NO: 744525 - protein, 203 aa, Homo sapiens
MTVKWKQLSAPASGAEIQRFPVPAVEPVPAPGADSPPGTALELEEAPEPSCRCPGTAQDQPSEELPDFMAPPVEPPASALELKVWLELEVAERGGQHSSSQQLPHCSQSWAQWKLWRQRPGFAIWAPLPHWRGTSLIQQSSSPAAEGPAATAAGAVCLPAGGAGEQEKEPVSRGSSRSSCSQRRPPPPGMEVCPQLGIWAICP

SEQ ID NO: 744526 - protein, 203 aa, Homo sapiens; identical to SEQ ID NO: 744525

SEQ ID NO: 744527 - protein, 374 aa, Homo sapiens
HLGWEGGLGAEAAVQGRLVQQPVSAAVPPVPPWRLRSRPRTGAINSPELGSRTLVARPRAQTWRQLAPDPLHGSPVSSLPTRLLQPRLPRTRSGGDDCVCAHLGVKRTQPVYLTHEMEETVPQKQRVHCSIDYSKSGTHMELSCDFCASGPNTHAFQEDTCVRGCMFVRPESGEQGPETLAPASGAEIQRFPVPAVEPVPAPGADSPPGTALELEEAPEPSCRCPGTAQDQPSEELPDFMAPPVEPPASALELKVWLELEVAERGGQHSSSQQLPHCSQSWAQWKLWRQRPGFAIWAPLPHWRGTSLIQQSSSPAAEGPAATAAGAVCLPAGGAGEQEKEPVSRGSSRSSCSQRRPPPPGMEVCPQLGIWAICP

SEQ ID NO: 744528 - protein, 330 aa, Homo sapiens
CFLGSSETADANRVFCGQLGAVYVFSEALNPAQIFAIHQLGPRYKSTFKFKSESDIHLAEHHKQVLYDGKLASSITFTYTAKATDAQLCLESSPKENASIFVHSQHALMLQIQVLFPLFPQLDNRQLNDSQVETTVCSCFRCRNTAISSASFEPVPAPGADSPPGTALELEEAPEPSCRCPGTAQDQPSEELPDFMAPPVEPPASALELKVWLELEVAERGGQHSSSQQLPHCSQSWAQWKLWRQRPGFAIWAPLPHWRGTSLIQQSSSPAAEGPAATAAGAVCLPAGGAGEQEKEPVSRGSSRSSCSQRRPPPPGMEVCPQLGIWAICP

SEQ ID NO: 744529 - protein, 102 aa, Homo sapiens
LSRCSQLTTFYFGRNCMSTDTLKDLLRHTSGLSKLSLETYPAPEESLNSLVRVDWEIFAPLWAELMCTLREVRQPKRIFTGPTPCPSCGSSPSEELELHLCC

SEQ ID NO: 744530 - protein, 124 aa, Homo sapiens
GVTDIVDPRRSLGFSRLLSSGCTDFAHALTGDADTRDPGRRPGGAAMLAESPSVPRLGSGTRGAGMELGCPWAPSWAGAHPGRVVTGKKPRASPRRGGRGKDRTLPKSRTRPGGTRAGVAATPS

SEQ ID NO: 744531 - protein, 212 aa, Homo sapiens
PAAPAQVCSERSCSNGAGLGSPGAWSLSGAPTWFASWAWSWASLASCRLAAPTLPTPSRETQTLGTRGGARAGPPCWQRVPASRASVPEPAARGWSWAALGRRPGLVPTLAAWSPARSPGPHPGVGAGGRTGPSRSRGPGRAAPGLGWLLPRAKLAAPHLTVPGARALRLDRRRARRPIGRLDPQSPRHRRVGAFRPGSQPSNSVTLEVSLR

SEQ ID NO: 744532 - protein, 394 aa, Homo sapiens
ASDKPESHFQSQVDFVPTIGGVAPPLHGRGQTSSSAPLLMEPHLLGLLLGLLLGGTRVLAGYPIWWSLALGQQYTSLGSQPLLCGSIPGLVPKQLRFCRNYIEIMPSVAEGVKLGIQECQHQFRGRRWNCTTIDDSLAIFGPVLDKATRESAFVHAIASAGVAFAVTRSCAEGTSTICGCDSHHKGPPGEGWKWGGCSEDADFGVLVSREFADARENRPDARSAMNKHNNEAGRTTILDHMHLKCKCHGLSGSCEVKTCWWAQPDFRAIGDFLKDKYDSASEMVVEKHRESRGWVETLRAKYSLFKPPTERDLVYYENSPNFCEPNPETGSFGTRDRTCNVTSHGIDGCDLLCCGRGHNTRTEKRKEKCHCIFHWCCYVSCQECIRIYDVHTCK

SEQ ID NO: 744533 - protein, 329 aa, Homo sapiens
MRLFSYPTLFTLSSLPGGLCGNKMAAPIPQGFSCLSRFLGWWFRQPVLVTQSAAIVPVRTKKRFTPPIYQPKFKTEKEFMQHARKAGLVIPPEKSDRSIHLACTAGIFDAYVPPEGDARISSLSKEGLIERTERMKKTMASQVSIRRIKDYDANFKIKDFPEKAKDIFIEAHLCLNNSDHDRLHTLVTEHCFPDMTWDIKYKTVRWSFVESLEPSHVVQVRCSSMMNQGNVYGQITVRMHTRQTLAIYDRFGRLMYGQEDVPKDVLEYVVFEKQLTNPYGSWRMHTKIVPPWAPPKQPILKTVMIPGPQLKPEEEYEEAQGEAQKPQLA

SEQ ID NO: 744534 - protein, 127 aa, Homo sapiens
MRLFSYPTLFTLSSLPGGLCGNKMAAPIPQGFSCLSRFLGWWFRQPVLVTQSAAIVPVRTKKRFTSPIYQPKFKTEKEFMQHARKAGLVIPPEKSDRSIHLACTAGIFDAYVPPEGDARISSLSKER

SEQ ID NO: 744535 - protein, 127 aa, Homo sapiens; identical to SEQ ID NO: 744534

SEQ ID NO: 744536 - protein, 127 aa, Homo sapiens; identical to SEQ ID NO: 744534

SEQ ID NO: 744537 - protein, 127 aa, Homo sapiens; identical to SEQ ID NO: 744534

SEQ ID NO: 744538 - protein, 213 aa, Homo sapiens
VSTQSAHYGRGLIERTERMKKTMASQVSIRRIKDYDANFKIKDFPEKAKDIFIEAHLCLNNSDHDRLHTLVTEHCFPDMTWDIKYKTVRWSFVESLEPSHVVQVRCSSMMNQGNVYGQITVRMHTRQTLAIYDRFGRLMYGQEDVPKDVLEYVVFEKQLTNPYGSWRMHTKIVPPWAPPKQPILKTVMIPGPQLKPEEEYEEAQGEAQKPQLA

SEQ ID NO: 744539 - protein, 279 aa, Homo sapiens
MRLFSYPTLFTLSSLPGGLCGNKMAAPIPQGFSCLSRFLGWWFRQPVLVTQSAAIVPVRTKKRFTPPIYQPKFKTEKEFMQHARKAGLVIPPEKSDRSIHLACTAGIFDAYVPPEGDARISSLSKEGLIERTERMKKTMASQVSIRRIKDYDANFKIKDFPEKAKDIFIEAHLCLNNSDHDRLHTLVTEHCFPTLAIYDRFGRLMYGQEDVPKDVLEYVVFEKQLTNPYGSWRMHTKIVPPWAPPKQPILKTVMIPGPQLKPEEEYEEAQGEAQKPQLA

SEQ ID NO: 744540 - protein, 202 aa, Homo sapiens
VLWMGARAAFPPPCHFAIRRIKDYDANFKIKDFPEKAKDIFIEAHLCLNNSDHDRLHTLVTEHCFPDMTWDIKYKTVRWSFVESLEPSHVVQVRCSSMMNQGNVYGQITVRMHTRQTLAIYDRFGRLMYGQEDVPKDVLEYVVFEKQLTNPYGSWRMHTKIVPPWAPPKQPILKTVMIPGPQLKPEEEYEEAQGEAQKPQLA

SEQ ID NO: 744541 - protein, 201 aa, Homo sapiens
IKLNFGPPFKNFSISGIRRIKDYDANFKIKDFPEKAKDIFIEAHLCLNNSDHDRLHTLVTEHCFPDMTWDIKYKTVRWSFVESLEPSHVVQVRCSSMMNQGNVYGQITVRMHTRQTLAIYDRFGRLMYGQEDVPKDVLEYVVFEKQLTNPYGSWRMHTKIVPPWAPPKQPILKTVMIPGPQLKPEEEYEEAQGEAQKPQLA

SEQ ID NO: 744542 - protein, 177 aa, Homo sapiens
MRLFSYPTLFTLSSLPGGLCGNKMAAPIPQGFSCLSRFLGWWFRQPVLVTQSAAIVPVRTKKRFTPPIYQPKFKTEKEFMQHARKAGLVIPPEKSDRSIHLACTAGIFDAYVPPEGDARISSLSKEGLIERTERMKKTMASQVSIRRIKDYDANFKIKDFPEKAKDIFIEAHLCLNK

SEQ ID NO: 744543 - protein, 135 aa, Homo sapiens
MTWDIKYKTVRWSFVESLEPSHVVQVRCSSMMNQGNVYGQITVRMHTRQTLAIYDRFGRLMYGQEDVPKDVLEYVVFEKQLTNPYGSWRMHTKIVPPWAPPKQPILKTVMIPGPQLKPEEEYEEAQGEAQKPQLA

SEQ ID NO: 744544 - protein, 135 aa, Homo sapiens; identical to SEQ ID NO: 744543

SEQ ID NO: 744545 - protein, 296 aa, Homo sapiens
MRLFSYPTLFTLSSLPGGLCGNKMAAPIPQGFSCLSRFLGWWFRQPVLVTQSAAIVPVRTKKRFTPPIYQPKFKTEKEFMQHARKAGLVIPPEKSDRSIHLACTAGIFDAYVPPEGDARISSLSKEGLIERTERMKKTMASQVSSDHDRLHTLVTEHCFPDMTWDIKYKTVRWSFVESLEPSHVVQVRCSSMMNQGNVYGQITVRMHTRQTLAIYDRFGRLMYGQEDVPKDVLEYVVFEKQLTNPYGSWRMHTKIVPPWAPPKQPILKTVMIPGPQLKPEEEYEEAQGEAQKPQLA

SEQ ID NO: 744546 - protein, 152 aa, Homo sapiens
MRFLGWWFRQPVLVTQSAAIVPVRTKKRFTPPIYQPKFKTEKEFMQHARKAGLVIPPEKSDRSIHLACTAGIFDAYVPPEGDARISSLSKEGLIERTERMKKTMASQVSIRRIKDYDANFKIKDFPEKAKDIFIEAHLCLNKLWPSMTGLAG

SEQ ID NO: 744547 - protein, 448 aa, Homo sapiens
PGRFPQCLAAVMAAPSWRGARLVQSVLRVWQVGPHVARERVIPFSSLLGFQRRCVSCVAGSAFSGPRLASASRSNGQGSALDHFLGFSQPDSSVTPCVPAVSMNRDEQDVLLVHHPDMPENSRVLRVVLLGAPNAGKSTLSNQLLGRKVFPVSRKVHTTRCQALGVITEKETQVILLDTPGIISPGKQKRHHLELSLLEDPWKSMESADLVVVLVDVSDKWTRNQLSPQLLRCLTKYSQIPSVLVMNKVDCLKQKSVLLELTAALTEGVVNGKKLKMRQAFHSHPGTHCPSPAVKDPNTQSVGNPQRIGWPHFKEIFMLSALSQEDVKTLKQYLLTQAQPGPWEYHSAVLTSQTPEEICANIIREKLLEHLPQEVPYNVQQKTAVWEEGPGGELVIQQKLLVPKESYVKLLIGPKGHVISQIAQEAGHDLMDIFLCDVDIRLSVKLLK

SEQ ID NO: 744548 - protein, 437 aa, Homo sapiens
MAAPSWRGARLVQSVLRVWQVGPHVARERVIPFSSLLGFQRRCVSCVAGSAFSGPRLASASRSNGQGSALDHFLGFSQPDSSVTPCVPAVSMNRDEQDVLLVHHPDMPENSRVLRVVLLGAPNAGKSTLSNQLLGRKVFPVSRKVHTTRCQALGVITEKETQVILLDTPGIISPGKQKRHHLELSLLEDPWKSMESADLVVVLVDVSDKWTRNQLSPQLLRCLTKYSQIPSVLVMNKVDCLKQKSVLLELTAALTEGVVNGKKLKMRQAFHSHPGTHCPSPAVKDPNTQSVGNPQRIGWPHFKEIFMLSALSQEDVKTLKQYLLTQAQPGPWEYHSAVLTSQTPEEICANIIREKLLEHLPQEVPYNVQQKTAVWEEGPGGELVIQQKLLVPKESYVKLLIGPKGHVISQIAQEAGHDLMDIFLCDVDIRLSVKLLK

SEQ ID NO: 744549 - protein, 434 aa, Homo sapiens
PGRFPQCLAAVMAAPSWRGARLVQSVLRVWQVGPHVARERVIPFSSLLGFQRRCVSCVAGSAFSGPRLASASRSNGQGSALDHFLGFSQPDSSVTPCVPAVSMNRDEQDVLLVHHPDMPENSRVLRVVLLGAPNAGKSTLSNQLLGRKVFPVSRKVHTTRCQALGVITEKETQVILLDTPGIISPGKQKRHHLELSLLEDPWKSMESADLVVVLVDVSDKWTRNQLSPQLLRCLTKYSQIPSVLVMNKVDCLKQKSVLLELTAALTEGVVNGKKLKMRQAFHSHPGTHCPSPAVKDPNTQSVGNPQRIGWPHFKEIFMLSALSQEDVKTLKHSAVLTSQTPEEICANIIREKLLEHLPQEVPYNVQQKTAVWEEGPGGELVIQQKLLVPKESYVKLLIGPKGHVISQIAQEAGHDLMDIFLCDVDIRLSVKLLK

SEQ ID NO: 744550 - protein, 435 aa, Homo sapiens
RLVQAGGNRPRERELVWQVGPHVARERVIPFSSLLGFQRRCVSCVAGSAFSGPRLASASRSNGQGSALDHFLGFSQPDSSVTPCVPAVSMNRDEQDVLLVHHPDMPENSRVLRVVLLGAPNAGKSTLSNQLLGRKVFPVSRKVHTTRCQALGVITEKETQVILLDTPGIISPGKQKRHHLELSLLEDPWKSMESADLVVVLVDVSDKWTRNQLSPQLLRCLTKYSQIPSVLVMNKVDCLKQKSVLLELTAALTEGVVNGKKLKMRQAFHSHPGTHCPSPAVKDPNTQSVGNPQRIGWPHFKEIFMLSALSQEDVKTLKQYLLTQAQPGPWEYHSAVLTSQTPEEICANIIREKLLEHLPQEVPYNVQQKTAVWEEGPGGELVIQQKLLVPKESYVKLLIGPKGHVISQIAQEAGHDLMDIFLCDVDIRLSVKLLK

SEQ ID NO: 744551 - protein, 483 aa, Homo sapiens
PGRFPQCLAAVMAAPSWRGARLVQSVLRVWQVGPHVARERVIPFSSLLGFQRRCVSCVAGSAFSGPRLASASRSNGQGSALDHFLGFSQPDSSVTPCVPAVSMNRDEQDVLLVHHPDMPENSRVLRVVLLGAPNAGKSTLSNQLLGRKVFPVSRKVHTTRCQALGVITEKETQVGGYLQRESLKQAEGEAKRVSLTISLEENDGHIHLCILLDTPGIISPGKQKRHHLELSLLEDPWKSMESADLVVVLVDVSDKWTRNQLSPQLLRCLTKYSQIPSVLVMNKVDCLKQKSVLLELTAALTEGVVNGKKLKMRQAFHSHPGTHCPSPAVKDPNTQSVGNPQRIGWPHFKEIFMLSALSQEDVKTLKQYLLTQAQPGPWEYHSAVLTSQTPEEICANIIREKLLEHLPQEVPYNVQQKTAVWEEGPGGELVIQQKLLVPKESYVKLLIGPKGHVISQIAQEAGHDLMDIFLCDVDIRLSVKLLK

SEQ ID NO: 744552 - protein, 295 aa, Homo sapiens
ADLGPQKCLFYIYITEKETQVILLDTPGIISPGKQKRHHLELSLLEDPWKSMESADLVVVLVDVSDKWTRNQLSPQLLRCLTKYSQIPSVLVMNKVDCLKQKSVLLELTAALTEGVVNGKKLKMRQAFHSHPGTHCPSPAVKDPNTQSVGNPQRIGWPHFKEIFMLSALSQEDVKTLKQYLLTQAQPGPWEYHSAVLTSQTPEEICANIIREKLLEHLPQEVPYNVQQKTAVWEEGPGGELVIQQKLLVPKESYVKLLIGPKGHVISQIAQEAGHDLMDIFLCDVDIRLSVKLLK

SEQ ID NO: 744553 - protein, 365 aa, Homo sapiens
PGRFPQCLAAVMAAPSWRGARLVQSVLRVWQVGPHVARERVIPFSSLLGFQRRCVSCVAGSAFSGPRLASASRSNGQGSALDHFLGFSQPDSSVTPCVPAVSMNRDEQDVLLVHHPDMPENSRVLRVVLLGAPNAGKSTLSNQLLGRKVFPVSRKVHTTRCQALGVITEKETQVILLDTPGIISPGKQKRHHLELSLLEDPWKSMESADLVVVLVDVSDKWTRNQLSPQLLRCLTKYSQIPSVLVMNKQYLLTQAQPGPWEYHSAVLTSQTPEEICANIIREKLLEHLPQEVPYNVQQKTAVWEEGPGGELVIQQKLLVPKESYVKLLIGPKGHVISQIAQEAGHDLMDIFLCDVDIRLSVKLLK

SEQ ID NO: 744554 - protein, 453 aa, Homo sapiens
QEFSRLTTIAVMSGRGKQGGKARAKAKSRSSRAGLQFPVGLSASLAALIAQLRGASGGRRALSTWLLVLEYLTCRDPGAGGLLLARDNKKTRIIPRQLQLAIRNDEELNKLLGNESAICPGVGVFAYTSRPYCSLKNDRRCHHNGKRASEADVRPKWAQPGPRLARGTCELKKALFSSHPRFRIKELLMLAKASPGSYIHKVGKILERAWNLLNLVVVLVDVSDKWTRNQLSPQLLRCLTKYSQIPSVLVMNKVDCLKQKSVLLELTAALTEGVVNGKKLKMRQAFHSHPGTHCPSPAVKDPNTQSVGNPQRIGWPHFKEIFMLSALSQEDVKTLKQYLLTQAQPGPWEYHSAVLTSQTPEEICANIIREKLLEHLPQEVPYNVQQKTAVWEEGPGGELVIQQKLLVPKESYVKLLIGPKGHVISQIAQEAGHDLMDIFLCDVDIRLSVKLLK

SEQ ID NO: 744555 - protein, 335 aa, Homo sapiens
PGRFPQCLAAVMAAPSWRGARLVQSVLRVWQVGPHVARERVIPFSSLLGFQRRCVSCVAGSAFSGPRLASASRSNGQGSALDHFLGFSQPDSSVTPCVPAVSMNRDEQDVLLVHHPDMPENSRVLRVVLLGAPNAGKSTLSNQLLGRKVFPVSRKVHTTRCQALGVITEKETQVILLDTPGIISPGKQKRHHLELSLLEDPWKSMESADLVVVLVDVSDKWTRNQLSPQLLRCLTKYSQIPSVLVMNKVDCLKQKSVLLELTAALTEGVVNGKKLKMRQAFHSHLGHGPPELGPTNWGTQDGAPQGIRVGYAGGTKNLRPGREPGSRANGSANRE

SEQ ID NO: 744556 - protein, 188 aa, Homo sapiens
PGRFPQCLAAVMAAPSWRGARLVQSVLRVWQVGPHVARERVIPFSSLLGFQRRCVSCVAGSAFSGPRLASASRSNGQGSALDHFLGFSQPDSSVTPCVPAVSMNRDEQDVLLVHHPDMPENSRVLRVVLLGAPNAGKSTLSNQLLGRKVFPVSRKVHTTRCQALGVITEKETQVGGYLQRESLKQDRG

SEQ ID NO: 744557 - protein, 437 aa, Homo sapiens; identical to SEQ ID NO: 744548

SEQ ID NO: 744558 - protein, 495 aa, Homo sapiens
PGRFPQCLAAVMAAPSWRGARLVQSVLRVWQVGPHVARERVIPFSSLLGFQRRCVSCVAGSAFSGPRLASASRSNGQGSALDHFLGFSQPDSSVTPCVPAVSMNRDEQDVLLVHHPDMPENSRVLRVVLLGAPNAGKSTLSNQLLGRKVFPVSRKVHTTRCQALGVITEKETQVILLDTPGIISPGKQKRHHLELSLLEDPWKSMESADLVVVLVDVSDKWTRNQLSPQLLRCLTKYSQIPSVLVMNKVDCLKQKSVLLELTAALTEGVVNGKKLKMRQAFHSHPGTHCPSPAVKDPNTQSVGNPQRIGWPHFKEIFMLSALSQEDVKTLKRSVSLGHSLALGFYHMKTALKFPPGSKSEEKSPGWDEDAHLFPLFPQQYLLTQAQPGPWEYHSAVLTSQTPEEICANIIREKLLEHLPQEVPYNVQQKTAVWEEGPGGELVIQQKLLVPKESYVKLLIGPKGHVISQIAQEAGHDLMDIFLCDVDIRLSVKLLK

SEQ ID NO: 744559 - protein, 287 aa, Homo sapiens
PGRFPQCLAAVMAAPSWRGARLVQSVLRVWQVGPHVARERVIPFSSLLGFQRRCVSCVAGSAFSGPRLASASRSNGQGSALDHFLGFSQPDSSVTPCVPAVSMNRDEQDVLLVHHPDMPENSRVLRVVLLGAPNAGKSTLSNQLLGRKVFPVSRKVHTTRCQALGVITEKETQVILLDTPGIISPGKQKRHHLELSLLEDPWKSMESADLVVVLVDVSDKWTRNQLSPQLLRCLTKYSQIPSVLVMNKVDCLKQKSVLLELTAALTEAIPSDTGPARALGVPQCSPH

SEQ ID NO: 744560 - protein, 472 aa, Homo sapiens
MAAPSWRGARLVQSVLRVWQVGPHVARERVIPFSSLLGFQRRCVSCVAGSAFSGPRLASASRSNGQGSALDHFLGFSQPDSSVTPCVPAVSMNRDEQDVLLVHHPDMPENSRVLRVVLLGAPNAGKSTLSNQLLGRKVFPVSRKVHTTRCQALGVITEKETQVGGYLQRESLKQAEGEAKRVSLTISLEENDGHIHLCILLDTPGIISPGKQKRHHLELSLLEDPWKSMESADLVVVLVDVSDKWTRNQLSPQLLRCLTKYSQIPSVLVMNKVDCLKQKSVLLELTAALTEGVVNGKKLKMRQAFHSHPGTHCPSPAVKDPNTQSVGNPQRIGWPHFKEIFMLSALSQEDVKTLKQYLLTQAQPGPWEYHSAVLTSQTPEEICANIIREKLLEHLPQEVPYNVQQKTAVWEEGPGGELVIQQKLLVPKESYVKLLIGPKGHVISQIAQEAGHDLMDIFLCDVDIRLSVKLLK

SEQ ID NO: 744561 - protein, 301 aa, Homo sapiens
GGTERGWGDSIIGAGKPLYHTTSLIRNALVIRPFLTDVCLSLRHHLELSLLEDPWKSMESADLVVVLVDVSDKWTRNQLSPQLLRCLTKYSQIPSVLVMNKVDCLKQKSVLLELTAALTEGVVNGKKLKMRQAFHSHPGTHCPSPAVKDPNTQSVGNPQRIGWPHFKEIFMLSALSQEDVKTLKQYLLTQAQPGPWEYHSAVLTSQTPEEICANIIREKLLEHLPQEVPYNVQQKTAVWEEGPGGELVIQQKLLVPKESYVKLLIGPKGHVISQIAQEAGHDLMDIFLCDVDIRLSVKLLK

SEQ ID NO: 744562 - protein, 320 aa, Homo sapiens
MYVCPSGITWSSLCWKIHGRAWNLLILVRFRMGTLSPVYRGHGLSFLGSLGGKSQAHTMEVFVRAGGRVTISFSFFLPCHLLVVVLVDVSDKWTRNQLSPQLLRCLTKYSQIPSVLVMNKVDCLKQKSVLLELTAALTEGVVNGKKLKMRQAFHSHPGTHCPSPAVKDPNTQSVGNPQRIGWPHFKEIFMLSALSQEDVKTLKQYLLTQAQPGPWEYHSAVLTSQTPEEICANIIREKLLEHLPQEVPYNVQQKTAVWEEGPGGELVIQQKLLVPKESYVKLLIGPKGHVISQIAQEAGHDLMDIFLCDVDIRLSVKLLK

SEQ ID NO: 744563 - protein, 152 aa, Homo sapiens
GTSSTETLRIMIGWPHFKEIFMLSALSQEDVKTLKQYLLTQAQPGPWEYHSAVLTSQTPEEICANIIREKLLEHLPQEVPYNVQQKTAVWEEGPGGELVIQQKLLVPKESYVKLLIGPKGHVISQIAQEAGHDLMDIFLCDVDIRLSVKLLK

SEQ ID NO: 744564 - protein, 226 aa, Homo sapiens
PGRFPQCLAAVMAAPSWRGARLVQSVLRVWQVGPHVARERVIPFSSLLGFQRRCVSCVAGSAFSGPRLASASRSNGQGSALDHFLGFSQPDSSVTPCVPAVSMNRDEQDVLLVHHPDMPENSRVLRVVLLGAPNAGKSTLSNQLLGRKVFPVSRKVHTTRCQALGVITEKETQVLILLGTPGTISPGPTRHHLEPSSAARPTGRAGNLLPLLRPSRTAAPWSIAPV

SEQ ID NO: 744565 - protein, 68 aa, Homo sapiens
MSATNNIAQARKLVEQLRIEAGIERIKVSKAASDLMSYCEQHARNDPLLVGVPASENPFKDKKPCIIL

SEQ ID NO: 744566 - protein, 70 aa, Homo sapiens
SSVSPCLVWLGYAAGVWSRRPNSAPPLSPACALQSPEASRRLPQSSPVPPGRFPCSALPVLMVALRRRLV

SEQ ID NO: 744567 - protein, 91 aa, Homo sapiens
VKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 744568 - protein, 481 aa, Homo sapiens
NSRRPALRAAAAGARPAGGPGSQPPEQHLGGHILQSLDGFVFALNQEGKFLYISETVSIYLGLSQVEMTGSSVFDYIHPGDHSEVLEQLGLRTPTPGPPTPPSVSSSSSSSSSLADTPEIEASLTKVPPSSLVQERSFFVRMKSTLTKRGLHVKASGYKVIHVTGRLRAHALGLVALGHTLPPAPLAELPLHGHMIVFRLSLGLTILACESRVSDHMDLGPSELVGRSCYQFVHGQDATRIRQSHVDLLDKGQVMTGYYRWLQRAGGFVWLQSVATVAGSGKSPGEHHVLWVSHVLSQAEGGQTPLDAFQLPASVACEEASSPGPEPTEPEPPTEGKQAAPAENEAPQTQGKRIKVEPGPRETKGSEDSGDEDPSSHPATPRPEFTSVIRAGVLKQDPVRPWGLAPPGDPPPTLLHAGFLPPVVRGLCTPGTIRYGPAELGLVYPHLQRLGPGPALPEAFYPPLGLPYPGPAGTRLPRKGD

SEQ ID NO: 744569 - protein, 161 aa, Homo sapiens
MKSTLTKRGLHVKASGYKVIHVTGRLRAHALGLVALGHTLPPAPLAELPLHGHMIVFRLSLGLTILACESRVSDHMDLGPSELVGRSCYQFVHGQDATRIRQSHVDCETHLQPPSLPTTPQTRASHSLVPGSPSSGLPTVPPAAPTAPGTPFSIGRAARRL

SEQ ID NO: 744570 - protein, 590 aa, Homo sapiens
MAAPYPGSGGGSEVKCVGGRGASVPWDFLPGLMVKAPSGPCLQAQRKEKSRNAARSRRGKENLEFFELAKLLPLPGAISSQLDKASIVRLSVTYLRLRRFAALGAPPWGLRAAGPPAGLAPGRRGPAALVSEVFEQHLGGHILQSLDGFVFALNQEGKFLYISETVSIYLGLSQVEMTGSSVFDYIHPGDHSEVLEQLGLRTPTPGPPTPPSVSSSSSSSSSLADTPEIEASLTKVPPSSLVQERSFFVRMKSTLTKRGLHVKASGYKVIHVTGRLRAHALGLVALGHTLPPAPLAELPLHGHMIVFRLSLGLTILACESRVSDHMDLGPSELVGRSCYQFVHGQDATRIRQSHVDLLDKGQVMTGYYRWLQRAGGFVWLQSVATVAGSGKSPGEHHVLWVSHVLSQAEGGQTPLDAFQLPASVACEEASSPGPEPTEPEPPTEGKQAAPAENEAPQTQGKRIKVEPGPRETKGSEDSGDEDPSSHPATPRPEFTSVIRAGVLKQDPVRPWGLAPPGDPPPTLLHAGFLPPVVRGLCTPGTIRYGPAELGLVYPHLQRLGPGPALPEAFYPPLGLPYPGPAGTRLPRKGD

SEQ ID NO: 744571 - protein, 591 aa, Homo sapiens
VSKSARPRWAPRAGRHSPRVPLRPARPGVYGAAPPRRPAGPTPRPEPALRPSNRTGGPAGDSGLGARLSEPPGDGGPLSRQWRRKRGQMRGRPRRQRPLGLSTRADGQGAVRTVPAGAAQGEVPERGALAAREGEPGVLRAGQASPAARRHLQPAGQGFHRAPQRHLPPPAPVRRAGGAALGAESRGAASWPRPRPPRPRSAGLRSLRAAPGRSHLAVPGWLCVRLEPGRKIPLHLRDSLHLSGSLTGGDDGQQRLRLHSPWGPLRGAGATGAADADARPPNPALRLLFLLLFLFACRYPRDRVSDHMDLGPSELVGRSCYQFVHGQDATRIRQSHVDLLDKGQVMTGYYRWLQRAGGFVWLQSVATVAGSGKSPGEHHVLWVSHVLSQAEGGQTPLDAFQLPASVACEEASSPGPEPTDGKTEGWGHTQALSIFLFQEPEPPTEGKQAAPAENEAPQTQGKRIKVEPGPRETKGSEDSGDEDPSSHPATPRPEFTSVIRAGVLKQDPVRPWGLAPPGDPPPTLLHAGFLPPVVRGLCTPGTIRYGPAELGLVYPHLQRLGPGPALPEAFYPPLGLPYPGPAGTRLPRKGD

SEQ ID NO: 744572 - protein, 414 aa, Homo sapiens
MTGSSVFDYIHPGDHSEVLEQLGLRTPTPGPPTPPSVSSSSSSSSSLADTPEIEASLTKVPPSSLVQERSFFVRMKSTLTKRGLHVKASGYKVIHVTGRLRAHALGLVALGHTLPPAPLAELPLHGHMIVFRLSLGLTILACESRVSDHMDLGPSELVGRSCYQFVHGQDATRIRQSHVDLLDKGQVMTGYYRWLQRAGGFVWLQSVATVAGSGKSPGEHHVLWVSHVLSQAEGGQTPLDAFQLPASVACEEASSPGPEPTEPEPPTEGKQAAPAENEAPQTQGKRIKVEPGPRETKGSEDSGDEDPSSHPATPRPEFTSVIRAGVLKQDPVRPWGLAPPGDPPPTLLHAGFLPPVVRGLCTPGTIRYGPAELGLVYPHLQRLGPGPALPEAFYPPLGLPYPGPAGTRLPRKGD

SEQ ID NO: 744573 - protein, 214 aa, Homo sapiens
SLLGYLSVSLTLPLCAFTFFSSPHRLPAHSPALTPPVSSCLPGSLSCPCPHPTPFPGPEPTEPEPPTEGKQAAPAENEAPQTQGKRIKVEPGPRETKGSEDSGDEDPSSHPATPRPEFTSVIRAGVLKQDPVRPWGLAPPGDPPPTLLHAGFLPPVVRGLCTPGTIRYGPAELGLVYPHLQRLGPGPALPEAFYPPLGLPYPGPAGTRLPRKGD

SEQ ID NO: 744574 - protein, 116 aa, Homo sapiens
AASSASIYCGGYLDWEGECSRSLHSLPLPRTTEAPSPPKQSTSGGDPGFRTSYHLAAGQRDTGSSPSPSLSLPALVPGWLCVRLEPGRKIPLHLRDSLHLSGSLTGKGPPVDLDWL

SEQ ID NO: 744575 - protein, 590 aa, Homo sapiens; identical to SEQ ID NO: 744570

SEQ ID NO: 744576 - protein, 259 aa, Homo sapiens
VSKSARPRWAPRAGRHSPRVPLRPARPGVYGAAPPRRPAGPTPRPEPALRPSNRTGGPAAPGRRGPAALVSEVFEQHLGGHILQSLDGFVFALNQEGKFLYISETVSIYLGLSQVEMTGSSVFDYIHPGDHSEVLEQLGLRTPTPGPPTPPSVSSSSSSSSSLADTPEIESATTWTWGPQSWWAAAATSLSTDKTPRGSARATWTVRPTSSHKPAYHPPDPSIHSLVPGSPSSGLPTVPPAAPTAPGTPFSIGRAARRL

SEQ ID NO: 744577 - protein, 572 aa, Homo sapiens
VSKSARPRWAPRAGRHSPRVPLRPARPGVYGAAPPRRPAGPTPRPEPALRPSNRTGGPAGDSGLGARLSEPPGDGGPLSRQWRRKRGQMRGRPRRQRPLGLSTRADGQGAVRTVPAGAAQGEVPERGALAAREGEPGVLRAGQASPAARRHLQPAGQGFHRAPQRHLPPPAPVRRAGGAALGAESRGAASWPRPRPPRPRSAGLRSLRAAPGRSHLAVPGWLCVRLEPGRKIPLHLRDSLHLSGSLTGGDDGQQRLRLHSPWGPLRGAGATGAADADARPPNPALRLLFLLLFLFACRYPRDRVSDHMDLGPSELVGRSCYQFVHGQDATRIRQSHVDLLDKGQVMTGYYRWLQRAGGFVWLQSVATVAGSGKSPGEHHVLWVSHVLSQAEGGQTPLDAFQLPASVACEEASSPGPEPTEPEPPTEGKQAAPAENEAPQTQGKRIKVEPGPRETKGSEDSGDEDPSSHPATPRPEFTSVIRAGVLKQDPVRPWGLAPPGDPPPTLLHAGFLPPVVRGLCTPGTIRYGPAELGLVYPHLQRLGPGPALPEAFYPPLGLPYPGPAGTRLPRKGD

SEQ ID NO: 744578 - protein, 487 aa, Homo sapiens
MPMGRTVACSTRPLGLSTRADGQGAVRTVPAGAAQGEVPERGALAAREGEPGVLRAGQASPAARRHLQPAGQGFHRAPQRHLPPPAPVRRAGGAALGAESRGAASWPRPRPPRPRSAGLRSLRAAPGRSHLAVPGWLCVRLEPGRKIPLHLRDSLHLSGSLTGGDDGQQRLRLHSPWGPLRGAGATGAADADARPPNPALRLLFLLLFLFACRYPRDRVSDHMDLGPSELVGRSCYQFVHGQDATRIRQSHVDLLDKGQVMTGYYRWLQRAGGFVWLQSVATVAGSGKSPGEHHVLWVSHVLSQAEGGQTPLDAFQLPASVACEEASSPGPEPTEPEPPTEGKQAAPAENEAPQTQGKRIKVEPGPRETKGSEDSGDEDPSSHPATPRPEFTSVIRAGVLKQDPVRPWGLAPPGDPPPTLLHAGFLPPVVRGLCTPGTIRYGPAELGLVYPHLQRLGPGPALPEAFYPPLGLPYPGPAGTRLPRKGD

SEQ ID NO: 744579 - protein, 235 aa, Homo sapiens
MAAPYPGSGGGSEVKCVGGRGASVPWDFLPGLMVKAPSGPCLQAQRKEKSRNAARSRRGKENLEFFELAKLLPLPGAISSQLDKASIVRLSVTYLRLRRFAALGAPPWGLRAAGPPAGLAPGRRGPAALVSEVFEQHLGGHILQSLDGFVFALNQEGKFLYISETVSIYLGLSQVEMTGSSVFDYIHPGDHSEVLEQLGLRTPTPGPPTPPSVSSSSSSSSSLADTPEIGNSKGS

SEQ ID NO: 744580 - protein, 127 aa, Homo sapiens
MILISAGCPGGLWPIVVLVGLFIWICFAVRVWDVRPFAPKERCVKIFQGNVHNFEKNLLRCSWSPDGSKIAAGSADRFVYVWDTTSRRILYKLPGHAGSINEVAFHPDEPIIISASSDKRLYMGEIQ

SEQ ID NO: 744581 - protein, 390 aa, Homo sapiens
AGSCGGRTNLEPIAWRLRAAARSVAALKRPVAAMIEQQKRKGPELPLVPVKRQRHELLLGAGSGPGAGQQQATPGALLQAGPPRCSSLQAPIMLLSGHEGEVYCCKFHPNGSTLASAGFDRLILLWNVYGDCDNYATLKGHSGAVMELHYNTDGSMLFSASTDKTVAVWDSETGERVKRLKGHTSFVNSCYPARRGPQLVCTGSDDGTVKLWDIRKKAAIQTFQNTYQVLAVTFNDTSDQIISGGIDNDIKVWDLRQNKLTYTMRGHADSVTGLSLSSEGSYLLSNAMDNTVRVWDVRPFAPKERCVKIFQGNVHNFEKNLLRCSWSPDGSKIAAGSADRFVYVWDTTSRRILYKLPGHAGSINEVAFHPDEPIIISASSDKRLYMGEIQ

SEQ ID NO: 744582 - protein, 390 aa, Homo sapiens; identical to SEQ ID NO: 744581

SEQ ID NO: 744583 - protein, 390 aa, Homo sapiens; identical to SEQ ID NO: 744581

SEQ ID NO: 744584 - protein, 187 aa, Homo sapiens
AGSCGGRTNLEPIAWRLRAAARSVAALKRPVAAMIEQQKRKGPELPLVPVKRQRHELLLGAGSGPGAGQQQATPGALLQAGPPRCSSLQAPIMLLSGHEGEVYCCKFHPNGSTLASAGFDRLILLWNVYGDCDNYATLKGHSGAVMELHYNTDGSMLFLAQINRGWIVKQLKGGKGLLWSCIHRGLL

SEQ ID NO: 744585 - protein, 390 aa, Homo sapiens; identical to SEQ ID NO: 744581

SEQ ID NO: 744586 - protein, 107 aa, Homo sapiens
MQPTIHLLVMEETKLGSSLVPEASFWSSVFYGSSPFHAAIMTYISSPDTSPSVGTPPSDAMEHIKATHWNHGPSESARAALQLCGITSKPYAHDKQQHFWEQASETT

SEQ ID NO: 744587 - protein, 59 aa, Homo sapiens
MAAQGQPQVQFKLVLVGDGGTGKTTFVKHHLTGEFEKKYVATLGVEVHPLVFHTNRGPV

SEQ ID NO: 744588 - protein, 2032 aa, Homo sapiens [sequence omitted]

SEQ ID NO: 744589 - protein, 1972 aa, Homo sapiens
MGDDSEWLKLPVDQKCEHKLWKARLSGYEEALKIFQKIKDEKSPEWSKFLGLIKKFVTDSNAVVQLKGLEAALVYVENAHVAGKTTGEVVSGVVSKVFNQPKAKAKELGIEICLMYIEIEKGEAVQEELLKGLDNKNPKIIVACIETLRKALSEFGSKIILLKPIIKVLPKLFESREKAVRDEAKLIAVEIYRWIRDALRPPLQNINSVQLKELEEEWVKLPTSAPRPTRFLRSQQELEAKLEQQQSAGGDAEGGGDDGDEVPQIDAYELLEAVEILSKLPKDFYDKIEAKKWQERKEALESVEVLIKNPKLEAGDYADLVKALKKVVGKDTNVMLVALAAKCLTGLAVGLRKKFGQYAGHVVPTILEKFKEKKPQVVQALQEAIDAIFLTTTLQNISEDVLAVMDNKNPTIKQQTSLFIARSFRHCTASTLPKSLLKPFCAALLKHINDSAPEVRDAAFEALGTALKVVGEKAVKPFLADVDKLKLDKIKECSEKVELIHGKKAGLAADKKEFKPLPGRTAASGAAGDKDTKDISAPKPGPLKKAPAAKAGGPPKKGKPAAPGGAGNTGTKNKKGLETKEIVEPELSIEVCEEKASAVLPPTCIQLLDSSNWKERLACMEEFQKAVELMDRTEMPCQALVRMLAKKPGWKETNFQVMQMKLHIVALIAQKGNFSKTSAQVVLDGLVDKIGDVKCGNNAKEAMTAIAEACMLPWTAEQVVSMAFSQKNPKNQSETLNWLSNAIKEFGFSGLNVKAFISNVKTALAATNPAVRTAAITLLGVMYLYVGPSLRMFFEDEKPALLSQIDAEFEKMQGQSPPAPTRGISKHSTSGTDEGEDGDEPDDGSNDVVDLLPRTEISDKITSELVSKIGDKNWKIRKEGLDEVAGIINDAKFIQPNIGELPTALKGRLNDSNKILVQQTLNILQQLAVAMGPNIKQHVKNLGIPIITVLGDSKNNVRAAALATVNAWAEQTGMKEWLEGEDLSEELKKENPFLRQELLGWLAEKLPTLRSTPTDLILCVPHLYSCLEDRNGDVRKKAQDALPFFMMHLGYEKMAKATGKLKPTSKDQVLAMLEKAKVNMPAKPAPPTKATSKPMGGSAPAKFQPASAPAEDCISSSTEPKPDPKKAKAPGLSSKAKSAQGKKMPSKTSLKEDEDKSGPIFIVVPNGKEQRMKDEKGLKVLKWNFTTPRDEYIEQLKTQMSSCVAKWLQDEMFHSDFQHHNKALAVMVDHLESEKEGVIGCLDLILKWLTLRFFDTNTSVLMKALEYLKLLFTLLSEEEYHLTENEASSFIPYLVVKVGEPKDVIRKDVRAILNRMCLVYPASKMFPFIMEGTKSKNSKQRAECLEELGCLVESYGMNVCQPTPGKALKEIAVHIGDRDNAVRNAALNTIVTVYNVHGDQVFKLIGNLSEKDMSMLEERIKRSAKRPSAAPIKQVEEKPQRAQNISSNANMLRKGPAEDMSSKLNQARSMSGHPEAAQMVRREFQLDLDEIENDNGTVRCEMPELVQHKLDDIFEPVLIPEPKIRAVSPHFDDMHSNTASTINFIISQVASGDINTSIQALTQLFQIESLAREASTGVLKDLMHGLITLMLDSRIEDLEEGQQVIRSVNLLVVKVLEKSDQTNILSALLVLLQDSLLATASSPKFSELVMKCLWRMVRLLPDTINSINLDRILLDIHIFMKVFPKEKLKQCKSEFPIRTLKTLLHTLCKLKGPKILDHLTMIDNKNESELEAHLCRMMKHSMDQTGSKSDKETEKGASRIDEKSSKAKVNDFLAEIFKKIGSKENTKEGLAELYEYKKKYSDADIEPFLKNSSQFFQSYVERGLRVIEMEREGKGRISTSTGISPQMEVTCVPTPTSTVSSIGNTNGEEVGPSVYLERLKILRQRCGLDNTKQDDRPPLTSLLSKPAVPTVASSTDMLHSKLSQLRESREQHQHSDLDSNQTHSSGTVTSSSSTANIDDLKKRLERIKSSRK

SEQ ID NO: 744590 - protein, 574 aa, Homo sapiens
MDSRVSGTTSNGETKPVYPKMEFVLSVAGEIIGLGNVWRFPYLCYKNGGGAFFIPYLVFLFTCGIPVFLLETALGQYTSQGGVTAWRKICPIFEGIGYASQMIVILLNVYYIIVLAWALFYLFSSFTIDLPWGGCYHEWNTEHCMEFQKTNGSLNGTSENATSPVIEFWERRVLKISDGIQHLGALRWELALCLLLAWVICYFCIWKGVKSTGKVVYFTATFPYLMLVVLLIRGVTLPGAAQGIQFYLYPNLTRLWDPQVWMDAGTQIFFSFAICLGCLTALGSYNKYHNNCYSGTSFVAGFAIFSILGFMSQEQGVPISEVAESGPGLAFIAYPRAVVMLPFSPLWACCFFFMVVLLGLDSQFVCVESLVTALVDMYPHVFRKKNRREVLILGVSVVSFLVGLIMLTEGGMYVFQLFDYYAASGMCLLFVAIFESLCVAWVYGAKRFYDNIEDMIGYRPWPLIKYCWLFLTPAVCTATFLFSLIKYTPLTYNKKYTYPWWGDALGWLLALSSMVCIPAWSLYRLGTLKGPFRERIRQLMCPAEDLPQRNPAGPSAPATPRTSLLRLTELESHC

SEQ ID NO: 744591 - protein, 625 aa, Homo sapiens
MDSRVSGTTSNGETKPVYPVMEKKEEDGTLERGHWNNKMEFVLSVAGEIIGLGNVWRFPYLCYKNGGGAFFIPYLVFLFTCGIPVFLLETALGQYTSQGGVTAWRKICPIFEGIGYASQMIVILLNVYYIIVLAWALFYLFSSFTIDLPWGGCYHEWNTEHCMEFQKTNGSLNGTSENATSPVIEFWERRVLKISDGIQHLGALRWELALCLLLAWVICYFCIWKGVKSTGKVVYFTATFPYLMLVVLLIRGVTLPGAAQGIQFYLYPNLTRLWDPQVWMDAGTQIFFSFAICLGCLTALGSYNKYHNNCYSGTSFVAGFAIFSILGFMSQEQGVPISEVAESGPGLAFIAYPRAVVMLPFSPLWACCFFFMVVLLGLDSQFVCVESLVTALVDMYPHVFRKKNRREVLILGVSVVSFLVGLIMLTEERQSRQVPPLAFGLDHPPPGMGEEPFGSTVSEEGGMYVFQLFDYYAASGMCLLFVAIFESLCVAWVYGAKRFYDNIEDMIGYRPWPLIKYCWLFLTPAVCTATFLFSLIKYTPLTYNKKYTYPWWGDALGWLLALSSMVCIPAWSLYRLGTLKGPFRERIRQLMCPAEDLPQRNPAGPSAPATPRTSLLRLTELESHC

SEQ ID NO: 744592 - protein, 297 aa, Homo sapiens
MSQEQGVPISEVAESGPGLAFIAYPRAVVMLPFSPLWACCFFFMVVLLGLDSQFVCVESLVTALVDMYPHVFRKKNRREVLILGVSVVSFLVGLIMLTEERQSRQVPPLAFGMDHPPPGMGEEPFGSTVSEEGGMYVFQLFDYYAASGMCLLFVAIFESLCVAWVYGAKRFYDNIEDMIGYRPWPLIKYCWLFLTPAVCTATFLFSLIKYTPLTYNKKYTYPWWGDALGWLLALSSMVCIPAWSLYRLGTLKGPFRERIRQLMCPAEDLPQRNPAGPSAPATPRTSLLRLTELESHC

SEQ ID NO: 744593 - protein, 257 aa, Homo sapiens
MDSRVSGTTSNGETKPVYPVMEKKEEDGTLERGHWNNKMEFVLSVAGEIIGLGNVWRFPYLCYKNGGGAFFIPYLVFLFTCGIPVFLLETALGQYTSQGGVTAWRKICPIFEGIGYASQMIVILLNVYYIIVLAWALFYLFSSFTIDLPWGGCYHEWNTEHCMEFQKTNGSLNGTSENATSPVIEFWERRVLKISDGIQHLGALRWELALCLLLAWVICYFCIWKGVKSTGKVRVGSSCPSHSRTPALTGGCHPGVL

SEQ ID NO: 744594 - protein, 78 aa, Homo sapiens
LWPHAGKPWVTHSLELARALARVPLLLVVGPGLAFIAYPRAVVMLPFSPLWACCFFFMVVLLGLDSQVSRGSHSEAER

SEQ ID NO: 744595 - protein, 182 aa, Homo sapiens
GAMQAEGRGTGGSTGDADGPGGPGIPDGPGGNAGGPGEAGATGGRGPRGAGAARASGPGGGAPRGPHGGAASGLNGCCRCGARGPESRLLEFYLAMPFATPMEAELARRSLAQDAPPLPVPGVLLKEFTVSGNILTIRLTAADHRQLQLSISSCLQQLSLLMWITQCFLPVFLAQPPSGQRR

SEQ ID NO: 744596 - protein, 164 aa, Homo sapiens
DSVSSPIHRQKGRKLESSSGEQQLGGHIWKWKATSPSSSTSSSSSSFSSSHPGSLPKPVGLQPLPRPEVSFLTEYLRKLKACEGGGVEIAAASFPRIYLMGMCSRQDRIQKDIDVVIQKSRAEDCLFAVLFHQMEMGHGQFLLSHADHAPELKLQNVLKHHSTS

SEQ ID NO: 744597 - protein, 164 aa, Homo sapiens; identical to SEQ ID NO: 744596

SEQ ID NO: 744598 - protein, 131 aa, Homo sapiens
DSVSSPIHRQKGRKLESSSGEQQLGGHIWKWKATSPSSSTSSSSSSFSSSHPGSLPKPVGLQPLPRPEVSFLTEYLRKLKACEGGGVEIAAASFPRIYLMGMCSRQDRIQKDIDVVIQKSRAEDCLFAAYL

SEQ ID NO: 744599 - protein, 155 aa, Homo sapiens
DSVSSPIHRQKGRKLESSSGEQQLGGHIWKWKATSPSSSTSSSSSSFSSSHPGSLPKPVGLQPLPRPEVSFLTEYLRKLKACEGGGVEIAAASFPRIYLMGMCSRQDRIQKDIDVVIQKSRAEDCLFADTVQDNLLFIFSVNFKDDWDFLPPLPP

SEQ ID NO: 744600 - protein, 155 aa, Homo sapiens; identical to SEQ ID NO: 744599

SEQ ID NO: 744601 - protein, 164 aa, Homo sapiens; identical to SEQ ID NO: 744596

SEQ ID NO: 744602 - protein, 107 aa, Homo sapiens
FETESRSVAQTGVQWRNLGSLQAPPPGFTPFSCLSLLSSWDYRCLPPRPANFFFCIFSRDGVSPGSRSSDLVIRPPRPPKVLGLQARATAPSQISLFIDKLMQSKEI

SEQ ID NO: 744603 - protein, 150 aa, Homo sapiens
SGALTWTKKFSLDYLALDFNSASPAPMQQARAFVFQVISSPGPRQEKQPPSEVCWPPGRGKREIAESQNTSFSLGLEHVTSFLLLLFCFLESRSHSVTQAGVQWHGHSSLQPRSPGLKLSSHLSLPSSWYYSCTSSPTAVFYFLIKNDLD

SEQ ID NO: 744604 - protein, 121 aa, Homo sapiens
RESKFQADCYSVSWEPANSLFEATMSTGEKESTHFVTRLFSNSSLSHEGLTFLHFGLWNSASLGTAGDQLLQGSKQGGPAAGLTAAGASEIMPQPGSHVPQIPGRLLLSENEAMTGMVPVL

SEQ ID NO: 744605 - protein, 150 aa, Homo sapiens
ALGHRRGGTQSGHTGSGEGAPGEAERGCSLVCFAIRDCLEMSLEKVFLACWEGSVFSSRCPAASMGTLPSWGLDPSRREGDHRPPPGHCGGQERPRGEGGSSSWGSGGFPPQGGRFPAPVLCLRQTLSCPPALSLSHDGNKWKWFPHTNA

SEQ ID NO: 744606 - protein, 103 aa, Homo sapiens
RALQPGEMAPGGAVCACPVMTVVGAGPSVAALQSGQWVGSSSVLCRVATGPSHLAGVTFGRATRSEKGGNCGPQQSSDRPDIPCSAIFPSAACRRKGLSVSQG

SEQ ID NO: 744607 - protein, 128 aa, Homo sapiens
MSIGRTMQASGVAKEQHIQGDPGRLGPTLYASLYNGDRQGDPGRLGPDPLRLPLQRRQAGRPWQAGPRPSTPPSTTETGRETLAGWAPTLYASLYNGDRQEARRRGPLIARPGPSKSLHFSGLLKIQA

SEQ ID NO: 744608 - protein, 131 aa, Homo sapiens
AARARQSHNGSQIQVRPFVCPRGSSRAGIPRRGWWWQAFQKGSTPGSALLASRRRRQRKLQPDELPGCGDICLLLPLTTSALVPPSKNPHSVLSPHSLPSRVSHICPSLAQGHSSALFSRRRHQQLFLRGK

SEQ ID NO: 744609 - protein, 131 aa, Homo sapiens; identical to SEQ ID NO: 744608

SEQ ID NO: 744610 - protein, 131 aa, Homo sapiens; identical to SEQ ID NO: 744608

SEQ ID NO: 744611 - protein, 113 aa, Homo sapiens
MADVEDGEETCALASHSGSSGSKSGGDKMFSLKKWNAVAMWSWDVECDTCAICRVQVMDACLRCQAENKQEDCVVVWGECNHSFHNCCMSLWVKQNNRCPLCQQDWVVQRIGK

SEQ ID NO: 744612 - protein, 159 aa, Homo sapiens
GQPGSRHHGGWRPAGGAVARRAAPQSRPSLPPSPSQRLRRRLRGAAMADVEDGEETCALASHSGSSGSKSGGDKMFSLKKWNAVAMWSWDVECDTCAICRVQVMDACLRCQAENKQEDCVVVWGECNHSFHNCCMSLWVKQNNRCPLCQQDWVVQRIGK

SEQ ID NO: 744613 - protein, 159 aa, Homo sapiens; identical to SEQ ID NO: 744612

SEQ ID NO: 744614 - protein, 154 aa, Homo sapiens
GQPGSRHHGGWRPAGGAVARRAAPQSRPSLPPSPSQRLRRRLRGAAMADVEDGEETCALASHSGSSGSKSGGDKMFSLKKWNAVAMWSWDVECDTCAICRVQVMDEGIGVRNWSEALNLINASEMGFDCRSGSTALAVPSVSLASHQPCLDDHR

SEQ ID NO: 744615 - protein, 159 aa, Homo sapiens; identical to SEQ ID NO: 744612

SEQ ID NO: 744616 - protein, 159 aa, Homo sapiens; identical to SEQ ID NO: 744612

SEQ ID NO: 744617 - protein, 163 aa, Homo sapiens
GQPGSRHHGGWRPAGGAVARRAAPQSRPSLPPSPSQRLRRRLRGAAMADVEDGEETCALASHSGSSGSKSGGDKMFSLKKWNAVAMWSWDVECDTCAICRVQVMGKRCTRVQGRPAASGSRPRGWEGTGVRQKPRKVPCLGEWVEVALPRRRRNAEPRSCCGS

SEQ ID NO: 744618 - protein, 159 aa, Homo sapiens; identical to SEQ ID NO: 744612

SEQ ID NO: 744619 - protein, 101 aa, Homo sapiens
GRWPLGPGWFRCRPAQWSFKGHLLAAFDLSPLISDVAPQSTVQEKSQNSQASPSPRQMEKGQAGFPVPIHNVQEGQGPQWLKPSPTHDLLEISSIQATPLV

SEQ ID NO: 744620 - protein, 1315 aa, Homo sapiens
DFEVGDKIRILATLEDGWLEGSLKGRTGIFPYRFVKLCPDTRVEETMALPQEGSLARIPETSLDCLENTLGVEEQRHETSDHEAEEPDCIISEAPTSPLGHLTSEYDTDRNSYQDEDTAGGPPRSPGVEWEMPLATDSPTSDPTEVVNGISSQPQVPFHPNLQKSQYYSTVGGSHPHSEQYPDLLPLEARTRDYASLPPKRMYSQLKTLQKPVLPLYRGSSVSASRVVKPRQSSPQLHNLASYTKKHHTSSVYSISERLEMKPGPQAQGLVMEAATHSQGDGSTDLDSKLTQQLIEFEKSLAGPGTEPDKILRHFSIMDFNSEKDIVRGSSKLITEQELPERRKALRPPPPRPCTPVSTSPHLLVDQNLKPAPPLVVRPSRPAPLPPSAQQRTNAVSPKLLSRHRPTCETLEKEGPGHMGRSLDQTSPCPLVLVRIEEMERDLDMYSRAQEELNLMLEEKQDESSRAETLEDLKFCESNIESLNMELQQLREMTLLSSQSSSLVAPSGSVSAENPEQRMLEKRAKVIEELLQTERDYIRDLEMCIERIMVPMQQAQVPNIDFEGLFGNMQMVIKVSKQLLAALEISDAVGPVFLGHRDELEGTYKIYCQNHDEAIALLEIYEKDEKIQKHLQDSLADLKSLYNEWGCTNYINLGSFLIKPVQRVMRYPLLLMELLNSTPESHPDKVPLTNAVLAVKEINVNINEYKRRKDLVLKYRKGDEDSLMEKISKLNIHSIIKKSNRVSSHLKHLTGFAPQIKDEVFEETEKNFRMQERLIKSFIRDLSLYLQHIRESACVKVVAAVSMWDVCMERGHRDLEQFERVHRYISDQLFTNFKERTERLVISPLNQLLSMFTGPHKLVQKRFDKLLDFYNCTERAEKLKDKKTLEELQSARNNYEALNAQLLDELPKFHQYAQGLFTNCVHGYAEAHCDFVHQALEQLKPLLSLLKVAGREGNLIAIFHEEHSRVLQQLQVFTFFPESLPATKKPFERKTIDRQSARKPLLGLPSYMLQSEELRASLLARYPPEKLFQAERNFNAAQDLDVSLLEGDLVGVIKKKDPMGSQNRWLIDNGVTKGFVYSSFLKPYNPRRSHSDASVGSHSSTESEHGSSSPRFPRQNSGSTLTFNPSSMAVSFTSGSCQKQPQDASPPPKECDQGTLSASLNPSNSESSPSRCPSDPDSTSQPRSGDSADVARDVKQPTATPRSYRNFRHPEIVGYSVPGRNGQSQDLVKGCARTAQAPEDRSTEPDGSEAEGNQVYFAVYTFKARNPNELSVSANQKLKILEFKDVTGNTEWWLAEVNGKKGYVPSNYIRKTEYT

SEQ ID NO: 744621 - protein, 998 aa, Homo sapiens
MDFNSEKDIVRGSSKLITEQELPERRKALRPPPPRPCTPVSTSPHLLVDQNLKPAPPLVVRPSRPAPLPPSAQQRTNAVSPKLLSRHRPTCETLEKEGPGHMGRSLDQTSPCPLVLVRIEEMERDLDMYSRAQEELNLMLEEKQDESSRAETLEDLKFCESNIESLNMELQQLREMTLLSSQSSSLVAPSGSVSAENPEQRMLEKRAKVIEELLQTERDYIRDLEMCIERIMVPMQQAQVPNIDFEGLFGNMQMVIKVSKQLLAALEISDAVGPVFLGHRDELEGTYKIYCQNHDEAIALLEIYEKDEKIQKHLQDSLADLKSLYNEWGCTNYINLGSFLIKPVQRVMRYPLLLMELLNSTPESHPDKVPLTNAVLAVKEINVNINEYKRRKDLVLKYRKGDEDSLMEKISKLNIHSIIKKSNRVSSHLKHLTGFAPQIKDEVFEETEKNFRMQERLIKSFIRDLSLYLQHIRESACVKVVAAVSMWDVCMERGHRDLEQFERVHRYISDQLFTNFKERTERLVISPLNQLLSMFTGPHKLVQKRFDKLLDFYNCTERAEKLKDKKTLEELQSARNNYEALNAQLLDELPKFHQYAQGLFTNCVHGYAEAHCDFVHQALEQLKPLLSLLKVAGREGNLIAIFHEEHSRVLQQLQVFTFFPESLPATKKPFERKTIDRQSARKPLLGLPSYMLQSEELRASLLARYPPEKLFQAERNFNAAQDLDVSLLEGDLVGVIKKKDPMGSQNRWLIDNGVTKGFVYSSFLKPYNPRRSHSDASVGSHSSTESEHGSSSPRFPRQNSGSTLTFNPSSMAVSFTSGSCQKQPQDASPPPKECDQGTLSASLNPSNSESSPSRCPSDPDSTSQPRSGDSADVARDVKQPTATPRSYRNFRHPEIVGYSVPGRNGQSQDLVKGCARTAQAPEDRSTEPDGSEAEGNQVYFAVYTFKARNPNELSVSANQKLKILEFKDVTGNTEWWLAEVNGKKGYVPSNYIRKTEYT

SEQ ID NO: 744622 - protein, 1315 aa, Homo sapiens; identical to SEQ ID NO: 744620

SEQ ID NO: 744623 - protein, 816 aa, Homo sapiens
DFEVGDKIRILATLEDGWLEGSLKGRTGIFPYRFVKLCPDTRVEETMALPQEGSLARIPETSLDCLENTLGVEEQRHETSDHEAEEPDCIISEAPTSPLGHLTSEYDTDRNSYQDEDTAGGPPRSPGVEWEMPLATDSPTSDPTEVVNGISSQPQVPFHPNLQKSQYYSTVGGSHPHSEQYPDLLPLEARTRDYASLPPKRMYSQLKTLQKPVLPLYRGSSVSASRVVKPRQSSPQLHNLASYTKKHHTSSVYSISERLEMKPGPQAQGLVMEAATHSQGDGSTDLDSKLTQQLIEFEKSLAGPGTEPDKILRHFSIMDFNSEKDIVRGSSKLITEQELPERRKALRPPPPRPCTPVSTSPHLLVDQNLKPAPPLVVRPSRPAPLPPSAQQRTNAVSPKLLSRHRPTCETLEKEGPGHMGRSLDQTSPCPLVLVRIEEMERDLDMYSRAQEELNLMLEEKQDESSRAETLEDLKFCESNIESLNMELQQLREMTLLSSQSSSLVAPSGSVSAENPEQRMLEKRAKVIEELLQTERDYIRDLEMCIERIMVPMQQAQVPNIDFEGLFGNMQMVIKVSKQLLAALEISDAVGPVFLGHRDELEGTYKIYCQNHDEAIALLEIYEKDEKIQKHLQDSLADLKSLYNEWGCTNYINLGSFLIKPVQRVMRYPLLLMELLNSTPESHPDKVPLTNAVLAVKEINVNINEYKRRKDLVLKYRKGDEDSLMEKISKLNIHSIIKKSNRVSSHLKHLTGFAPQIKDEVFEETEKNFRMQERLIKSFIRDLSLYLQHIRVSVNITVVRLTYDVILSPFLFISHIV

SEQ ID NO: 744624 - protein, 865 aa, Homo sapiens
MPTLFKGVWGVVEHSRALGRFCPACLPSGPHLHTQPALGTAEMTLLSSQSSSLVAPSGSVSAENPEQRMLEKRAKVIEELLQTERDYIRDLEMCIERIMVPMQQAQVPNIDFEGLFGNMQMVIKVSKQLLAALEISDAVGPVFLGHRDELEGTYKIYCQNHDEAIALLEIYEKDEKIQKHLQDSLADLKSLYNEWGCTNYINLGSFLIKPVQRVMRYPLLLMELLNSTPESHPDKVPLTNAVLAVKEINVNINEYKRRKDLVLKYRKGDEDSLMEKISKLNIHSIIKKSNRVSSHLKHLTGFAPQIKDEVFEETEKNFRMQERLIKSFIRDLSLYLQHIRESACVKVVAAVSMWDVCMERGHRDLEQFERVHRYISDQLFTNFKERTERLVISPLNQLLSMFTGPHKLVQKRFDKLLDFYNCTERAEKLKDKKTLEELQSARNNYEALNAQLLDELPKFHQYAQGLFTNCVHGYAEAHCDFVHQALEQLKPLLSLLKVAGREGNLIAIFHEEHSRVLQQLQVFTFFPESLPATKKPFERKTIDRQSARKPLLGLPSYMLQSEELRASLLARYPPEKLFQAERNFNAAQDLDVSLLEGDLVGVIKKKDPMGSQNRWLIDNGVTKGFVYSSFLKPYNPRRSHSDASVGSHSSTESEHGSSSPRFPRQNSGSTLTFNPSSMAVSFTSGSCQKQPQDASPPPKECDQGTLSASLNPSNSESSPSRCPSDPDSTSQPRSGDSADVARDVKQPTATPRSYRNFRHPEIVGYSVPGRNGQSQDLVKGCARTAQAPEDRSTEPDGSEAEGNQVYFAVYTFKARNPNELSVSANQKLKILEFKDVTGNTEWWLAEVNGKKGYVPSNYIRKTEYT

SEQ ID NO: 744625 - protein, 1033 aa, Homo sapiens
RARYPNDGPPLCSGSQGSLAGPGTEPDKILRHFSIMDFNSEKDIVRGSSKLITEQELPERRKALRPPPPRPCTPVSTSPHLLVDQNLKPAPPLVVRPSRPAPLPPSAQQRTNAVSPKLLSRHRPTCETLEKEGPGHMGRSLDQTSPCPLVLVRIEEMERDLDMYSRAQEELNLMLEEKQDESSRAETLEDLKFCESNIESLNMELQQLREMTLLSSQSSSLVAPSGSVSAENPEQRMLEKRAKVIEELLQTERDYIRDLEMCIERIMVPMQQAQVPNIDFEGLFGNMQMVIKVSKQLLAALEISDAVGPVFLGHRDELEGTYKIYCQNHDEAIALLEIYEKDEKIQKHLQDSLADLKSLYNEWGCTNYINLGSFLIKPVQRVMRYPLLLMELLNSTPESHPDKVPLTNAVLAVKEINVNINEYKRRKDLVLKYRKGDEDSLMEKISKLNIHSIIKKSNRVSSHLKHLTGFAPQIKDEVFEETEKNFRMQERLIKSFIRDLSLYLQHIRESACVKVVAAVSMWDVCMERGHRDLEQFERVHRYISDQLFTNFKERTERLVISPLNQLLSMFTGPHKLVQKRFDKLLDFYNCTERAEKLKDKKTLEELQSARNNYEALNAQLLDELPKFHQYAQGLFTNCVHGYAEAHCDFVHQALEQLKPLLSLLKVAGREGNLIAIFHEEHSRVLQQLQVFTFFPESLPATKKPFERKTIDRQSARKPLLGLPSYMLQSEELRASLLARYPPEKLFQAERNFNAAQDLDVSLLEGDLVGVIKKKDPMGSQNRWLIDNGVTKGFVYSSFLKPYNPRRSHSDASVGSHSSTESEHGSSSPRFPRQNSGSTLTFNPSSMAVSFTSGSCQKQPQDASPPPKECDQGTLSASLNPSNSESSPSRCPSDPDSTSQPRSGDSADVARDVKQPTATPRSYRNFRHPEIVGYSVPGRNGQSQDLVKGCARTAQAPEDRSTEPDGSEAEGNQVYFAVYTFKARNPNELSVSANQKLKILEFKDVTGNTEWWLAEVNGKKGYVPSNYIRKTEYT

SEQ ID NO: 744626 - protein, 1315 aa, Homo sapiens; identical to SEQ ID NO: 744620

SEQ ID NO: 744627 - protein, 1315 aa, Homo sapiens; identical to SEQ ID NO: 744620

SEQ ID NO: 744628 - protein, 563 aa, Homo sapiens
DFEVGDKIRILATLEDGWLEGSLKGRTGIFPYRFVKLCPDTRVEETMALPQEGSLARIPETSLDCLENTLGVEEQRHETSDHEAEEPDCIISEAPTSPLGHLTSEYDTDRNSYQDEDTAGGPPRSPGVEWEMPLATDSPTSDPTEVVNGISSQPQVPFHPNLQKSQYYSTVGGSHPHSEQYPDLLPLEARTRDYASLPPKRMYSQLKTLQKPVLPLYRGSSVSASRVVKPRQSSPQLHNLASYTKKHHTSSVYSISERLEMKPGPQAQGLVMEAATHSQGDGSTDLDSKLTQQLIEFEKSLAGPGTEPDKILRHFSIMDFNSEKDIVRGSSKLITEQELPERRKALRPPPPRPCTPVSTSPHLLVDQNLKPAPPLVVRPSRPAPLPPSAQQRTNAVSPKLLSRHRPTCETLEKEGPGHMGRSLDQTSPCPLVLVRIEEMERDLDMYSRAQEELNLMLEEKQDESSRAETLEDLKFCESNIESLNMELQQLREMTLLSSQSSSLVAPSGSVSAENPEQRMLEKRAKVIEELLQTERDYIRDLEMCIERIMVPMQQAQVGTGRQS

SEQ ID NO: 744629 - protein, 101 aa, Homo sapiens
LQSFLHGIRHIAVGTRSVLLVIVLLQVSRVSQLRHMNYFFLLLGGYTFNYIHSITEQFRFVKYFFSPNLFPKHTSPSRKFLGRDNLRNLKVAKKLASWPGA

SEQ ID NO: 744630 - protein, 147 aa, Homo sapiens
SSPAPPPRLSFSFGLSQPRRDAEPGAEPCSCACRAGMDGREAFCKREIAMNGIVHDVDVLGAGIRLVTLLVDRDGLYKMNRLYLTPDGFFFRVHMLALDSSSCNKPCPEFKPGSRYIVMGHIYHKRRQLPTALLQVLRGRLRPGMDC

SEQ ID NO: 744631 - protein, 111 aa, Homo sapiens
ALSLRAPVRSGRTRGFCETFAMNGIVHDVDVLGAGIRLVTLLVDRDGLYKMNRLYLTPDGFFFRVHMLALDSSSCNKPCPEFKPGIETDLNDAAYVLYTTVCNVGCHSPGC

SEQ ID NO: 744632 - protein, 69 aa, Homo sapiens
MYIAAFQGKGHRDSSLCLPSPGATTSTRPIHTVESHLKFSGARPPMHTVLVWASHLHPHKCQGSSRLPS

SEQ ID NO: 744633 - protein, 139 aa, Homo sapiens
PKFWDYRCDPAKLGFHHVGQAGLEPLTSDDPPPLPPKVLGITGVHSEQAWDDFREVSGLLQSERNLLCGVVGIGVRGFRSFVLAYSKYEAKSPWLTPVIPAFWKAEVGGLLEARSWRPAWATQRVDHEVRRSRPSWLTR

SEQ ID NO: 744634 - protein, 115 aa, Homo sapiens
NLLLSWLLGPELPELSPRARKADLKDENLKFSCWWEPRKTAGVLTWPFLAELAEVGVLADGMYLGAVSVAQQRCRADWLSHWVLPAGSPLHWAFTQPCSWVSLPCKQSHNNTRIV

SEQ ID NO: 744635 - protein, 96 aa, Homo sapiens
QHSPLSGGLGLVALDLGRDLPPGRQLSPLGAPGFRSHFCILQLQGPKGHSTQSSGHRVAGGFSLSPKGPGRITPPLLCLHPLPLPLHSSEPASDPT

SEQ ID NO: 744636 - protein, 52 aa, Homo sapiens
MACRIIPLSRFSPRTLDNAGFSYVHHQRAYPASGVYLDSWAHGPFLHLQTSN

SEQ ID NO: 744637 - protein, 92 aa, Homo sapiens
TWPSRKACLRGAALHSWSRPSARHQERRGRGFGKETQVRELTEKSASMDGKMHLSATKEPPEVQIPTSAAPVWRKQRWISCRGFCDFESRGC

SEQ ID NO: 744638 - protein, 108 aa, Homo sapiens
ALLICFAESLQPFLEACSNSLFFRTCSVLLRAPKLDLQILEKLSIILQKLSKIKSNKKLFELFTIHLMLQEIQRTTNPEHAFLCINLNSTLFNLGLTKCNSLVSSASP

SEQ ID NO: 744639 - protein, 434 aa, Homo sapiens
MEPRVVKPPGQDLVVESLKSRYGLGGSCPDEYDFSNFYQSKYKRRTLTSPGDLDIYSGDKVGSSLKYSDESKHCRTPLGSLFKHVNVNCLDDELDSFHDLKKQETEEELIENDYRVSTSKITKQSFKEIEKVALPTNTTSSRPRTECCSDAGDSPLKPVSCPKSKASDKRSLLPHQISQIYDELFQIHLKLQCETAAQQKFAEELQKRERFLLEREQLLFRHENALSKIKGVEEEVLTRFQIIKEQHDAEVEHLTEVLKEKNKETKRLRSSFDALKELNDTLKKQLNEASEENRKIDIQAKRVQARLDNLQRKYEFMTIQRLKGSSHAVHEMKSLKQEKAPVSKTYKVPLNGQVYELLTVFMDWISDHHLSKVKHEESGMDGKKPQLKFASQRNDIQEKCVKNPCSLSWKPVATLYFFVLALCCFEPLSLIFKY

SEQ ID NO: 744640 - protein, 434 aa, Homo sapiens; identical to SEQ ID NO: 744639

SEQ ID NO: 744641 - protein, 467 aa, Homo sapiens
MEPRVVKPPGQDLVVESLKSRYGLGGSCPDEYDFSNFYQSKYKRRTLTSPGDLDIYSGDKVGSSLKYSDESKHCRTPLGSLFKHVNVNCLDDELDSFHDLKKQETEEELIENDYRVSTSKITKQSFKEIEKVALPTNTTSSRPRTECCSDAGDSPLKPVSCPKSKASDKRSLLPHQISQIYDELFQIHLKLQCETAAQQKFAEELQKRERFLLEREQLLFRHENALSKIKGVEEEVLTRFQIIKEQHDAEVEHLTEVLKEKNKETKRLRSSFDALKELNDTLKKQLNEASEENRKIDIQAKRVQARLDNLQRKYEFMTIQRLKGSSHAVHEMKSLKQEKAPVSKTYKVPLNGQVYELLTVFMDWISDHHLSKVKHEESGMDGKKPQLKFASQRNDIQEKCVKLLPLMTEQLQWMPFVNIKLHEPFVKFIYWSLRQLDAGAQHSTMTSTLRRLGEDIFKGVVTNRNSG

SEQ ID NO: 744642 - protein, 351 aa, Homo sapiens
MVNLPRMMNVGFFPVIGRKQETEEELIENDYRVSTSKITKQSFKEIEKVALPTNTTSSRPRTECCSDAGDSPLKPVSCPKSKASDKRSLLPHQISQIYDELFQIHLKLQCETAAQQKFAEELQKRERFLLEREQLLFRHENALSKIKGVEEEVLTRFQIIKEQHDAEVEHLTEVLKEKNKETKRLRSSFDALKELNDTLKKQLNEASEENRKIDIQAKRVQARLDNLQRKYEFMTIQRLKGSSHAVHEMKSLKQEKAPVSKTYKVPLNGQVYELLTVFMDWISDHHLSKVKHEESGMDGKKPQLKFASQRNDIQEKCVKNPCSLSWKPVATLYFFVLALCCFEPLSLIFKY

SEQ ID NO: 744643 - protein, 253 aa, Homo sapiens
MEPRVVKPPGQDLVVESLKSRYGLGGSCPDEYDFSNFYQSKYKRRTLTSPGDLDIYSGDKVGSSLKYSDESKHCRTPLGSLFKHVNVNCLDDELDSFHDLKKQETEEELIENDYRVSTSKITKQSFKEIEKVALPTNTTSSRPRTECCSDAGDSPLKPVSCPKSKASDKRSLLPHQISQIYDELFQIHLKLQCETAAQQKFAEELQKRERFLLEREQLLFRHENALSKIKGVEEEVLTRFQIIKSSMMQKLNT

SEQ ID NO: 744644 - protein, 108 aa, Homo sapiens; identical to SEQ ID NO: 744638

SEQ ID NO: 744645 - protein, 432 aa, Homo sapiens
RGLMNAVPGETGTVAVCYGAEGRQATGAGFSSGESQKPLRTRGQLPRRGDLDIYSGDKVGSSLKYSDESKHCRTPLGSLFKHVNVNCLDDELDSFHDLKKQETEEELIENDYRVSTSKITKQSFKEIEKVALPTNTTSSRPRTECCSDAGDSPLKPVSCPKSKASDKRSLLPHQISQIYDELFQIHLKLQCETAAQQKFAEELQKRERFLLEREQLLFRHENALSKIKGVEEEVLTRFQIIKEQHDAEVEHLTEVLKEKNKETKRLRSSFDALKELNDTLKKQLNEASEENRKIDIQAKRVQARLDNLQRKYEFMTIQRLKGSSHAVHEMKSLKQEKAPVSKTYKVPLNGQVYELLTVFMDWISDHHLSKVKHEESGMDGKKPQLKFASQRNDIQEKCVKNPCSLSWKPVATLYFFVLALCCFEPLSLIFKY

SEQ ID NO: 744646 - protein, 407 aa, Homo sapiens
MEPRVVKPPGQDLVVESLKSRYGLGGSCPDEYDFSNFYQSKYKRRTLTSPGDLDIYSGDKVGSSLKYSDESKHCRTPLGSLFKHVNVNCLDDELDSFHDLKKQETEEELIENDYRVSTSKITKQSFKEIEKVALPTNTTSSRPRTECCSDAGDSPLKPVSCPKSKASDKRSLLPHQISQIYDELFQIHLKLQCETAAQQKFAEELQKRERFLLEREQLLFRHENALSKIKGVEEEVLTRFQIIKEQHDAEVEHLTEVLKEKNKETKRLRSSFDALKELNDTLKKQLNEASEENRKIDIQAKRVQARLDNLQRKYEFMTIQRLKGSSHAVHEMKSLKQEKAPVSKTYKVPLNGQVYELLTVFMDWISDHHLSKVKHEESGMDGKKPQLKFASQRNDIQEKCVKVCFLI

SEQ ID NO: 744647 - protein, 1232 aa, Homo sapiens
MSSPRLIPLWKDLKLLLNDTINKSKQPSEDPKNCLIVLSDRSQALFKESRYPQNMPCVCYYFSDAHFFASLSWVTSNTKEIQAVAWMKSKTEDMVEKRTFSMTERLPPIQSMVHAGSFHILVVYCGDLILRLFGDHFRAFKPLGKVPCRFNISCLCYDPEMKMLLVWHPGGSGVLGIELGGTGLQIAHMVSMPGDELVQDIVLNGPSGSLLALCETVVRVLMHQGKGQLGEVKRFTSTSSGSSITCCFTCFDQGFLYAGNQAGETQVWSLQQGHPLHSFQAHQSGVICIRSRPEAHTLLTAGSDSLIKEWNLTSGSLLRRLELGEELYRLQFIDSITFFCQTAHSFSLHRLPCFYSLFNVCGSAPQQLRRVCCGNNWFRILCTTEDGLLRFVSPVTGDLLVITWPFSILDQAVDWAYDPGKEELFVATGSSEVLVFDTTRCPCPAKYLLGTSPNSQDFVQCLAYGHFNLGRGLEGLIFSGHQSGVIRVLSQHSCARLEKFMHFGAVLALSTLSGGIFGGQGNSLLCSYGMDDYVHLSEAVLDGVKVQLRPLASILSSCHLTHLILLPQSVGAITETNCLRLWKFHDFLSSGSQNGLKFIETLPLHLCAITSFDVCLSLSLFVTGSADGSVRIWDFHGRLIAILDSSLHFGPVCFANDRGDLLVTFNQSLYLVSCLKLLPPALLTRLSFMSISDEVLEVPKPFIPSFFFSFETMFVPKYIYPGQAQQKLVGLEKLVNNRAIAFDHSVPHVIEEDEEGSPVLLRSSMHYSLQDMEDWMQVSKRYQCHYVLPPQLQLTSWDGLNPYQILRYYFGHGREWLFAPDCYIPNSVIRARLWPEGTPIYLQCNLHAPQRELEWNSSQDSFSDTAGYRAISNTEYPKNKEEDEHFLEMRLSKDVTYSVLTDGANRSWLGRKMSEITINSMIETMLNIMVHASLLKYQCCVGALGQIFASYQVSPALRSETARRLLNDTTNSNPLIRGLAWEGLKRLGMITHLFAMPLAQGLMDKDERVRIKTLSLMAEIGIHSRTSLLQLTQKQETFREMQQQMIGEEPLDHLLGMRATDLQILSTQVEQRLNENLTLSHRDEKPAFSLDVSMPSELKSSLKPPTVSEESEVAIKPSKGQRRGQAGVKKHSQKWLRGLKKTKERDSKQMSTEPGLLEDESGTEAAPLRWRKHPSIPKWSSSTSVIKLSKDVDSQEKDISKDHIALTLKRLQKIRDKRDKKATAQKLKKKHK

SEQ ID NO: 744648 - protein, 135 aa, Homo sapiens
MMESSPVWVETFTGLTHFSCRGLSEGCNIPACLCRPHTSLATVGSLGKGAFRQASPPTGRMLQSLCTQTCWKHIPHAECVSSPGCSCCWPGTEEPVPWQGVLSAATCSIVGRLLGSQPLSCPLPMGCTDRCVSSL

SEQ ID NO: 744649 - protein, 98 aa, Homo sapiens
GELRVMEYPQEPADITSLQNRGLSPGCIFLQREGFRNAVPELHPRPTKSDSPGCGQGISMWKAFRKTEQNESQFKEEGIKYIIVQMIHGNGKNGDNGT

SEQ ID NO: 744650 - protein, 98 aa, Homo sapiens; identical to SEQ ID NO: 744649

SEQ ID NO: 744651 - protein, 420 aa, Homo sapiens
LNSSFPPARGAQLICFLSPSQNHRMKAVKSERERGSRRRHRDGDVVLPAGVVVKQERLSPEVAPPAHRRPDHSGGSPSPPTSEPARSGHRGNRARGVSRSPPKKKNKASGRRSKSPRSKRNRSPHHSTVKVKQEREDHPRRGREDRQHREPSEQEHRRARNSDRDRHRGHSHQRRTSNERPGSGQGQGRDRDTQNLQAQEEEREFYNARRREHRQRNDVGGGGSESQELVPRPGGNNKEKEVPAKEKPSFELSGALLEDTNTFRGVVIKYSEPPEARIPKKRWRLYPFKNDEVLPVMYIHRQSAYLLGRHRRIADIPIDHPSCSKQHAVFQYRLVEYTRADGTVGRRVKPYIIDLGSGNGTFLNNKRIEPQRYYELKEKDVLKFGFSSREYVLLHESSDTSEIDRKDDEDEEEEEEVSDS

SEQ ID NO: 744652 - protein, 420 aa, Homo sapiens; identical to SEQ ID NO: 744651

SEQ ID NO: 744653 - protein, 420 aa, Homo sapiens; identical to SEQ ID NO: 744651

SEQ ID NO: 744654 - protein, 390 aa, Homo sapiens
MKAVKSERERGSRSPPKKKNKASGRRSKSPRSKRNRSPHHSTVKVKQIRFHAVDKDIPETRRFTKERGLMDLQFHMAGEASQSWWEARRSKSHGWRQARRDKREREDHPRRGREDRQHREPSEQEHRRARNSDRDRHRGHSHQRRTSNERPGSGQGQGRDRDTQNLQAQEEEREFYNARRREHRQRNDVGGGGSESQELVPRPGGNNKEKEVPAKEKPSFELSGALLEDTNTFRGVVIKYSEPPEARIPKKRWRLYPFKNDEVLPVMYIHRQSAYLLGRHRRIADIPIDHPSCSKQHAVFQYRLVEYTRADGTVGRRVKPYIIDLGSGNGTFLNNKRIEPQRYYELKEKDVLKFGFSSREYVLLHESSDTSEIDRKDDEDEEEEEEVSDS

SEQ ID NO: 744655 - protein, 456 aa, Homo sapiens
MFLLLPFDSLIVNLLGISLTVLFTLLLVFIIVPAIFGVSFGIRKLYMKSLLKIFAWATLRMERGAKEKNHQLYKPYTNGIIAKDPTSLEEEIKEIRRSGSSKALDNTPEFELSDIFYFCRKGMETIMDDEVTKRFSAEELESWNLLSRTNYNFQYISLRLTVLWGLGVLIRYCFLLPLRIALAFTGISLLVVGTTVVGYLPNGRFKEFMSKHVHLMCYRICVRALTAIITYHDRENRPRNGGICVANHTSPIDVIILASDGYYAMVGQVHGGLMGVIQRAMVKACPHVWFERSEVKDRHLVAKRLTEHVQDKSKLPILIFPEGTCINNTSVMMFKKGSFEIGATVYPVAIKYDPQFGDAFWNSSKYGMVTYLLRMMTSWAIVCSVWYLPPMTREADEDAVQFANRVKSAIARQGGLVDLLWDGGLKREKVKDTFKEEQQKLYSKMIVGNHKDRSRS

SEQ ID NO: 744656 - protein, 456 aa, Homo sapiens; identical to SEQ ID NO: 744655

SEQ ID NO: 744657 - protein, 456 aa, Homo sapiens; identical to SEQ ID NO: 744655

SEQ ID NO: 744658 - protein, 519 aa, Homo sapiens
MFLLLPFDSLIVNLLGISLTVLFTLLLVFIIVPAIFGVSFGIRKLYMKSLLKIFAWATLRMERGAKEKNHQLYKPYTNGIIAKDPTSLEEEIKEIRRSGSSKALDNTPEFELSDIFYFCRKGMETIMDDEVTKRFSAEELESWNLLSRTNYNFQYISLRLTVLWGLGVLIRYCFLLPLRIALAFTGISLLVVGTTVVGYLPNGRFKEFMSKHVHLMCYRICVRALTAIITYHDRLRALCIDRKGDGAAGNTTHLYLAKWEDTSELLVRADEACEVRGVLHELFHTNFGCFAYIFKPRENRPRNGGICVANHTSPIDVIILASDGYYAMVGQVHGGLMGVIQRAMVKACPHVWFERSEVKDRHLVAKRLTEHVQDKSKLPILIFPEGTCINNTSVMMFKKGSFEIGATVYPVAIKYDPQFGDAFWNSSKYGMVTYLLRMMTSWAIVCSVWYLPPMTREADEDAVQFANRVKSAIARQGGLVDLLWDGGLKREKVKDTFKEEQQKLYSKMIVGNHKDRSRS

SEQ ID NO: 744659 - protein, 291 aa, Homo sapiens [sequence omitted]

SEQ ID NO: 744660 - protein, 230 aa, Homo sapiens
MFLLLPFDSLIVNLLGISLTVLFTLLLVFIIVPAIFGVSFGIRKLYMKSLLKIFAWATLRMERGAKEKNHQLYKPYTNGIIAKDPTSLEEEIKEIRRSGSSKALDNTPEFELSDIFYFCRKGMETIMDDEVTKRFSAEELESWNLLTEAVQQDDRGEPQGQEPLLSLPPAGWGHRAGCQRAQSWSCRRRPHCCVLSRLQGSPGCSGSQDSGFRRAAAGSLCTRRSLPLVV

SEQ ID NO: 744661 - protein, 125 aa, Homo sapiens [sequence omitted]

SEQ ID NO: 744662 - protein, 155 aa, Homo sapiens
ERGFHSTHARSGSSTPVPARPSGVTHSSHCGLANVVRTTHVLPPAFHCFQYDPQFGDAFWNSSKYGMVTYLLRMMTSWAIVCSVWYLPPMTREADEDAVQFANRVKSAIARQGGLVDLLWDGGLKREKVKDTFKEEQQKLYSKMIVGNHKDRSRS

SEQ ID NO: 744663 - protein, 159 aa, Homo sapiens
MFLLLPFDSLIVNLLGISLTVLFTLLLVFIIVPAIFGVSFGIRKLYMKSLLKIFAWATLRMERGAKEKNHQLYKPYTNGIIAKDPTSLEEEIKEIRRSGSSKALDNTPEFELSDIFYFCRKGMETIMDDEVTKRFSAEELESWNLLSRTNYNFQYISGR

SEQ ID NO: 744664 - protein, 456 aa, Homo sapiens; identical to SEQ ID NO: 744655

SEQ ID NO: 744665 - protein, 456 aa, Homo sapiens; identical to SEQ ID NO: 744655

SEQ ID NO: 744666 - protein, 456 aa, Homo sapiens; identical to SEQ ID NO: 744655

SEQ ID NO: 744667 - protein, 456 aa, Homo sapiens; identical to SEQ ID NO: 744655

SEQ ID NO: 744668 - protein, 448 aa, Homo sapiens
MFLLLPFDSLIVNLLGISLTVLFTLLLVFIIVPAIFGVSFGIRKLYMKSLLKIFAWATLRMERGAKEKNHQLYKPYTNGIIAKDPTSLEEEIKEIRRSGSSKALDNTPEFELSDIFYFCRKGMETIMDDEVTKRFSAEELESWNLLSRTNYNFQYISLRLTVLWGLGVLIRYCFLLPLRIALAFTGISLLVVGTTVVGYLPNGRFKEFMSKHVHLMCYRICVRALTAIITYHDRENRPRNGGICVANHTSPIDVIILASDGYYAMVGQVHGGLMGVIQRAMVKACPHVWFERSEVKDRHLVAKRLTEHVQDKSKLPILIFPEGTCINNTSVMMFKKGSFEIGATVYPVAIKYDPQFGDAFWNSSKYGMVTYLLRMMTSWAIVCSVWYLPPMTREADEDAVQFANRVKSAIARQGGLVDLLWDGGLKREKVKDTFKEEQQKLYSKMIGR

SEQ ID NO: 744669 - protein, 183 aa, Homo sapiens [sequence omitted]

SEQ ID NO: 744670 - protein, 159 aa, Homo sapiens; identical to SEQ ID NO: 744663

SEQ ID NO: 744671 - protein, 196 aa, Homo sapiens
MANPKLLGLELSEAEAIGADSARFEELLLQASKELQQAQTTRPESTQIQPQPGFCIKTNSSEGKVFINICHSPSIPPPADVTEEELLQMLEEDQAGFRIPMSLGEPHAELDAKGQGCTAYDVAVNSDFYRRMQTGILAELGSHRREGLGRYIGVNGWGCETGSRGIRGKLAEQPTKGGGPPPTRLANLHCGPPRWL

SEQ ID NO: 744672 - protein, 36 aa, Homo sapiens
MANPKLLGLELSEAEAIGADSCWSSFEACSSRNSNR

SEQ ID NO: 744673 - protein, 111 aa, Homo sapiens
MLEEDQAGFRIPMSLGEPHAELDASQCPQRTQESGPLGPFFPRTQESWAQDPPPSAPGDLAPRSDSFPYGRSLVPWTSHTRAVLVLPPGQAGTFPCPTPGPGGLGRVLFVH

SEQ ID NO: 744674 - protein, 290 aa, Homo sapiens
MANPKLLGLELSEAEAIGADSARFEELLLQASKELQQAQTTRPESTQIQPQPGFCIKTNSSEGKVFINICHSPSIPPPADVTEEELLQMLEEDQAGFRIPMSLGEPHAELDAKGQGCTAYDVAVNSDFYRRMQNSDFLRELVITIAREGLEDKYNLQLNPEWRMMKNRPFMGSISQQNIRSEQRPRIQELGDLYTPAPGRAESGPEKPHLNLWLEAPDLLLAEIDLPKLDGALGLSLEIGENRLVMGGPQQLYHLDAYIPLQINSHESKAAFHRKRKQLMVAMPLLPVPS

SEQ ID NO: 744675 - protein, 290 aa, Homo sapiens; identical to SEQ ID NO: 744674

SEQ ID NO: 744676 - protein, 240 aa, Homo sapiens [sequence omitted]

SEQ ID NO: 744677 - protein, 233 aa, Homo sapiens
MANPKLLGLELSEAEAIGADSARFEELLLQASKELQQAQTTRPESTQIQPQPGFCIKTNSSEGKVFINICHSPSIPPPADVTEEELLQMLEEDQAGFRIPMSLGEPHAELDAKGQGCTAYDVAVNSDFYRRMQNSDFLRELVITIAREGLEDKYNLQLNPEWRMMKNRPFMGSISQQNIRSEQRPRIQELGDLYTPAPGRAESGPEKPHLNLWLEAPDLLLAEIDLPKLTLQI

SEQ ID NO: 744678 - protein, 193 aa, Homo sapiens
MANPKLLGLELSEAEAIGADSARFEELLLQASKELQQAQTTRPESTQIQPQPGFCIKTNSSEGKVFINICHSPSIPPPADVTEEELLQMLEEDQAGFRIPMSLGEPHAELDAKGQGCTAYDVAVNSDFYRRMQNSDFLRELVITIAREGLEDKYNLQLNPGTSARSSVLGSRSWGTCTRPPPGELSQALKSLT

SEQ ID NO: 744679 - protein, 200 aa, Homo sapiens
MANPKLLGLELSEAEAIGADSARFEELLLQASKELQQAQTTRPESTQIQPQPGFCIKTNSSEGKVFINICHSPSIPPPADVTEEELLQMLEEDQAGFRIPMSLGEPHAELDAKGQGCTAYDVAVNSDFYRRMQNSDFLRELVITIAREGLEDKYNLQLNPELYHLDAYIPLQINSHESKAAFHRKRKQLMVAMPLLPVPS

SEQ ID NO: 744680 - protein, 166 aa, Homo sapiens
MANPKLLGLELSEAEAIGADSARFEELLLQASKELQQAQTTRPESTQIQPQPGFCIKTNSSEGKVFINICHSPSIPPPADVTEEELLQMLEEDQAGFRIPMSLGEPHAELDAKGQGCTAYDVAVNSDFYRRMQNSDFLRELVITIAREGLEDKYNLQLNPALKSLT

SEQ ID NO: 744681 - protein, 202 aa, Homo sapiens [sequence omitted]

SEQ ID NO: 744682 - protein, 193 aa, Homo sapiens; identical to SEQ ID NO: 744678

SEQ ID NO: 744683 - protein, 351 aa, Homo sapiens
MANPKLLGLELSEAEAIGADSARFEELLLQLSCIRIAPFEEQMRGLMAQTPSLEVVFLYTGLEGAPASPDNQTRIDTNPASAWFLHKDQLLGREGFHQHLPLPLYPSSRRRDRGGAASDARGGPSWVSHPHESGRASCRTGCKRPGMYRLRRSCQQRLLPEDAGWGAGLRLRPGQGSLPLPSPPPPVFSLSVTPNSDFLRELVITIAREGLEDKYNLQLNPEWRMMKNRPFMGSISQQNIRSEQRPRIQELGDLYTPAPGRAESGPEKPHLNLWLEAPDLLLAEIDLPKLDGALGLSLEIGENRLVMGGPQQLYHLDAYIPLQINSHESKAAFHRKRKQLMVAMPLLPVPS

SEQ ID NO: 744684 - protein, 159 aa, Homo sapiens
MQNSDFLRELVITIAREGLEDKYNLQLNPEWRMMKNRPFMGSISQQNIRSEQRPRIQELGDLYTPAPGRAESGPEKPHLNLWLEAPDLLLAEIDLPKLDGALGLSLEIGENRLVMGGPQQLYHLDAYIPLQINSHESKAAFHRKRKQLMVAMPLLPVPS

SEQ ID NO: 744685 - protein, 152 aa, Homo sapiens
MNWSTNPSLRSGFCIKTNSSEGKVFINICHSPSIPPPADVTEEELLQMLEEDQAGFRIPMSLGEPHAELDAKGQGCTAYDVAVNSDFYRRMQNSDFLRELVITIAREGLEDKYNLQLNPGTSARSSVLGSRSWGTCTRPPPGELSQALKSLT

SEQ ID NO: 744686 - protein, 146 aa, Homo sapiens
MANPKLLGLELSEAEAIGADSARFEELLLQASKELQQAQTTRPESTQIQPQPALDLVLLSPEKPHLNLWLEAPDLLLAEIDLPKLDGALGLSLEIGENRLVMGGPQQLYHLDAYIPLQINSHESKAAFHRKRKQLMVAMPLLPVPS

SEQ ID NO: 744687 - protein, 187 aa, Homo sapiens
MANPKLLGLELSEAEAIGADSARFEELLLQASKELQQAQTTRPESTQIQPQPGFCIKTNSSEGKVFINICHSPSIPPPADVTEEELLQMLEEDQAGFRIPMSLGEPHAELDAKGQGCTAYDVAVNSDFYRRMQNSDFLRELVMGGPQQLYHLDAYIPLQINSHESKAAFHRKRKQLMVAMPLLPVPS

SEQ ID NO: 744688 - protein, 290 aa, Homo sapiens; identical to SEQ ID NO: 744674

SEQ ID NO: 744689 - protein, 199 aa, Homo sapiens [sequence omitted]

SEQ ID NO: 744690 - protein, 112 aa, Homo sapiens
LEGEKGQHARQRPGSCAQPWTLFLLSPEKPHLNLWLEAPDLLLAEIDLPKLDGALGLSLEIGENRLVMGGPQQLYHLDAYIPLQINSHESKAAFHRKRKQLMVAMPLLPVPS

SEQ ID NO: 744691 - protein, 45 aa, Homo sapiens
MANPKLLGLELSEAEAIGADSVLKLRCSHARSCTEPRGDSLETAC

SEQ ID NO: 744692 - protein, 351 aa, Homo sapiens [sequence omitted]

SEQ ID NO: 744693 - protein, 257 aa, Homo sapiens
MANPKLLGLELSEAEAIGADSARFEELLLQASKELQQAQTTRPESTQIQPQPGFCIKTNSSEGKVFINICHSPSIPPPADVTEEELLQMLEEDQAGFRIPMSLGEPHAELDAKGQGCTAYDVAVNSDFYRRMQNSDFLRELVITIAREGLEDKYNLQLNPEWRMMKNRPFMGSISQQNIRSEQRPRIQELGDLYTPAPGRAESGPEKPHLNLWLEAPDLLLAEIDLPKLINSHESKAAFHRKRKQLMVAMPLLPVPS

SEQ ID NO: 744694 - protein, 192 aa, Homo sapiens
MANPKLLGLELSEAEAIGADSARFEELLLQASKELQQAQTTRPESTQIQPQPGFCIKTNSSEGKVFINICHSPSIPPPADVTEEELLQMLEEDQAGFRIPMSLGEPHAELDAKGQGCTAYDVAVNSDFYRRMQNSDFLRELVITIAREGLEDKYNLQLNPEWRMMKNRPFMGSISQQAVSSRRLYPAADQLS

SEQ ID NO: 744695 - protein, 290 aa, Homo sapiens; identical to SEQ ID NO: 744674

SEQ ID NO: 744696 - protein, 321 aa, Homo sapiens
MANPKLLGLELSEAEAIGADSARFEELLLQASKELQQAQTTRPESTQIQPQPGFCIKTNSSEGKVFINICHSPSIPPPADVTEEELLQMLEEDQAGFRIPMSLGEPHAELDAKGQGCTAYDVAVNSDFYRRMQVGGRGCGSGLGRGLYPYPPRHRLSFPSLSPQNSDFLRELVITIAREGLEDKYNLQLNPEWRMMKNRPFMGSISQQNIRSEQRPRIQELGDLYTPAPGRAESGPEKPHLNLWLEAPDLLLAEIDLPKLDGALGLSLEIGENRLVMGGPQQLYHLDAYIPLQINSHESKAAFHRKRKQLMVAMPLLPVPS

SEQ ID NO: 744697 - protein, 193 aa, Homo sapiens; identical to SEQ ID NO: 744678

SEQ ID NO: 744698 - protein, 126 aa, Homo sapiens
MKNRPFMGSISQQNIRSEQRPRIQELGDLYTPAPGRAESGPEKPHLNLWLEAPDLLLAEIDLPKLDGALGLSLEIGENRLVMGGPQQLYHLDAYIPLQINSHESKAAFHRKRKQLMVAMPLLPVPS

SEQ ID NO: 744699 - protein, 140 aa, Homo sapiens
MANPKLLGLELSEAEAIGADSARFEELLLQASKELQQAQTTRPESTQIQPQPGFCIKTNSSEGKVFINICHSPSIPPPADVTEEELLQMLEEDQAGFRIPMSLGEPHAELDAKGQGCTAYDVAVNSDFYRRMQVGGRGCG

SEQ ID NO: 744700 - protein, 134 aa, Homo sapiens
MRLKVMEVVVEERLGLSLELGDLYTPAPGRAESGPEKPHLNLWLEAPDLLLAEIDLPKLVSFARWPEQGNEVWKGQGLSLSVSDKGLLLDLSVASSLPGGPQATFWCCPEGAQGIVSARSLRLVIAVFCLFLGD

SEQ ID NO: 744701 - protein, 115 aa, Homo sapiens
HGQQVPPFGLHTQPLEKQKKGPPLPPLSGGQIQQLARCQLMHMLKWNKGVHTKSDRGKDTPTQGGESSTGCDDSLSLRKEVLQAQGPFLRGRVEVERPLAPDCLSSHFAVGIQTW

SEQ ID NO: 744702 - protein, 110 aa, Homo sapiens
GLCQTSEVPGGPAQSQRLRNRLAFPEALCELRRLMKCTRMLLKYVRTRLESLALDGLLLQCPPCLTFCLSLCKAALRTSCSRGTHPCVTLIPRAGHSASFCSCLSLWFRT

SEQ ID NO: 744703 - protein, 159 aa, Homo sapiens
MLQAGEKRSLTSVGIRGTPLGPLDEGCWAGEPHPQGGVKGEKGSSQAGLPRPSGFARCQGQHLILNLNFRLSTKRHPFAVCFLEGTPFLDSCPDLPCPGHENSGMVEAGCPSQMGKEAKVQSGGGASLQKHGRTRPWILAQGSFQHRRLLALVSNPPCH

SEQ ID NO: 744704 - protein, 175 aa, Homo sapiens
GAGPLVSGLGCMGCSGADLLDDGGGPVAAEAVSPWLLHAMCCVCVCPLCMALHEFSLLSLLCDACMHVTCASDGCHRRWSPIPGADSAHRCPTDGPCVPVLAAVGVLRVTHRPLLSGHAATTCPTLSMSCAVVHLTCADRHGLHHVWLGMRLAGTLAWTGHRDRGADGLWPTGIG

SEQ ID NO: 744705 - protein, 886 aa, Homo sapiens
MALLVDRVRGHWRIAAGLLFNLLVSICIVFLNKWIYVYHGFPNMSLTLVHFVVTWLGLYICQKLDIFAPKSLPPSRLLLLALSFCGFVVFTNLSLQNNTIGTYQLAKAMTTPVIIAIQTFCYQKTFSTRIQLTLIPITLGVILNSYYDVKFNFLGMVFAALGVLVTSLYQVWVGAKQHELQVNSMQLLYYQAPMSSAMLLVAVPFFEPVFGEGGIFGPWSVSALLMVLLSGVIAFMVNLSIYWIIGNTSPVTYNMFGHFKFCITLFGGYVLFKDPLSINQALGILCTLFGILAYTHFKLSEQEGSGVNWHNVLNWVFVEKRMLSQEDKKYCEVCKLLKKKKKTRDSSGEFVASGSQDTNIKLWDIRRKGCVFRYRGHSQAVRCLRFSPDGKWLASAADDHTVKLWDLTAGKMMSEFPGHTGPVNVVEFHPNEYLLASGSSDRTIRFWDLEKFQVVSCIEGEPGPVRSVLFNPDGCCLYSGCQDSLRVYGWEPERCFDVVLVNWGKVADLAICNDQLIGVAFSQSNVSSYVVDLTRVTRTGTVARDPVQDHRPLAQPLPNPSAPLRRIYERPSTTCSKPQRVKQNSESERRSPSSEDDRDERESRAEIQNAEDYNEIFQPKNSISRTPPRRSEPFPAPPEDDAATAKEAAKPSPAMDVQFPVPNLEVLPRPPVVASTPAPKAEPAIIPATRNEPIGLKASDFLPAVKIPQQAELVDEDAMSQIRKGHDTMCVVLTSRHKNLDTVRAVWTMGDIKTSVDSAVAINDLSVVVDLLNIVNQKASLWKLDLCTTVLPQIEKLLQSKYESYVQTGCTSLKLILQRFLPLITDMLAAPPSVGVDISREERLHKCRLCYKQLKSISGLVKSKSGLSGRHGSTFRELHLLMASLD

SEQ ID NO: 744706 - protein, 139 aa, Homo sapiens
MATPVVTKTAWKLQEIVAHASNVSSLVLGKASGRLLATGGDDCRVNLWSINKPNCIMSLTGHTSPVESVRLNTPEELIVAGSQSGSIRVWDLEAAKIWPSWAQASLCWFHPSELWPGPERTYLDSGRGFQGAPAGGHVL

SEQ ID NO: 744707 - protein, 256 aa, Homo sapiens
MATPVVTKTAWKLQEIVAHASNVSSLVLGKASGRLLATGGDDCRVNLWSINKPNCIMSLTGHTSPVESVRLNTPEELIVAGSQSGSIRVWDLEAAKILRTLMGHKANICSLDFHPYGEFVASGSQDTNIKLWDIRRKGCVFRYRGHSQAVRCLRFSPDGKWLASAADDHTVKLWDLTAGKMMSEFPGHTGPVNVVEFHPNEYLLASGSSDRTSVSGPWGKSQMSGWASQVNPSRTDNATFTQRICTLQQVAGTQVS

SEQ ID NO: 744708 - protein, 143 aa, Homo sapiens
TTASVRGPVSNRPRPVWTEESSGQGRSAAHRAWPQPPLLFLVHPLAHEPLPGPCCCPVAVLEEVMLVPGHLYSPELLRQLSPAIAAQLCPTVASWGSELSPGAAAVIYKANFIKFVTITKKKKKKPASFFFFFLFSFFVSFYV

SEQ ID NO: 744709 - protein, 655 aa, Homo sapiens
MATPVVTKTAWKLQEIVAHASNVSSLVLGKASGRLLATGGDDCRVNLWSINKPNCIMSLTGHTSPVESVRLNTPEELIVAGSQSGSIRVWDLEAAKILRTLMGHKANICSLDFHPYGEFVASGSQDTNIKLWDIRRKGCVFRYRGHSQAVRCLRFSPDGKWLASAADDHTVKLWDLTAGKMMSEFPGHTGPVNVVEFHPNEYLLASGSSDRTIRFWDLEKFQVVSCIEGEPGPVRSVLFNPDGCCLYSGCQDSLRVYGWEPERCFDVVLVNWGKVADLAICNDQLIGVAFSQSNVSSYVVDLTRVTRTGTVARDPVQDHRPLAQPLPNPSAPLRRIYERPSTTCSKPQRVKQNSESERRSPSSEDDRDERESRAEIQNAEDYNEIFQPKNSISRTPPRRSEPFPAPPEDDAATAKEAAKPSPAMDVQFPVPNLEVLPRPPVVASTPAPKAEPAIIPATRNEPIGLKASDFLPAVKIPQQAELVDEDAMSQIRKGHDTMCVVLTSRHKNLDTVRAVWTMGDIKTSVDSAVAINDLSVVVDLLNIVNQKASLWKLDLCTTVLPQIEKLLQSKYESYVQTGCTSLKLILQRFLPLITDMLAAPPSVGVDISREERLHKCRLCYKQLKSISGLVKSKSGLSGRHGSTFRELHLLMASLD

SEQ ID NO: 744710 - protein, 672 aa, Homo sapiens
MATPVVTKTAWKLQEIVAHASNVSSLVLGKASGRLLATGGDDCRVNLWSINKPNCIMSLTGHTSPVESVRLNTPEELIVAGSQSGSIRVWDLEAAKILRTLMGHKANICSLDFHPYGEFVASGSQDTNIKLWDIRRKGCVFRYRGHSQAVRCLRFSPDGKWLASAADDHTVKLWDLTAGKMMSEFPGHTGPVNVVEFHPNEYLLASGSSDRTIRFWDLEKFQVVSCIEGEPGPVRSVLFNPDGCCLYSGCQDSLRVYGWEPERCFDVVLVNWGKVADLAICNDQLIGVAFSQSNVSSYVVDLTRVTRTGTVARDPVQDHRPLAQPLPNPSAPLRRIYERPSTTCSKPQRVKQNSESERRSPSSEDDRDERESRAEIQNAEDYNEIFQPKNSISRTPPRRSEPFPAPPEDDAATAKEAAKPSPAMDVQFPVPNLEVLPRPPVVASTPAPKAEPAIIPATRNEPIGLKASDFLPAVKIPQQAELVDEDAMSQIRKGHDTMCVVLTSRHKNLDTVRAVWTMGDIKGHTVPHCPTPDGALFAQTSVDSAVAINDLSVVVDLLNIVNQKASLWKLDLCTTVLPQIEKLLQSKYESYVQTGCTSLKLILQRFLPLITDMLAAPPSVGVDISREERLHKCRLCYKQLKSISGLVKSKSGLSGRHGSTFRELHLLMASLD

SEQ ID NO: 744711 - protein, 655 aa, Homo sapiens; identical to SEQ ID NO: 744709

SEQ ID NO: 744712 - protein, 655 aa, Homo sapiens; identical to SEQ ID NO: 744709

SEQ ID NO: 744713 - protein, 548 aa, Homo sapiens [sequence omitted]

SEQ ID NO: 744714 - protein, 565 aa, Homo sapiens
MATPVVTKTAWKLQEIVAHASNVSSLVLGKASGRLLATGGDDCRVNLWSINKPNCIMSLTGHTSPVESVRLNTPEELIVAGSQSGSIRVWDLEAAKILRTLMGHKANICSLDFHPYGEFVASGSQDTNIKLWDIRRKGCVFRYRGHSQAVRCLRFSPDGKWLASAADDHTVKLWDLTAGKMMSEFPGHTGPVNVVEFHPNEYLLASGSSDRTIRFWDLEKFQVVSCIEGEPGPVRSVLFNPDGCCLYSGCQDSLRVYGWEPERCFDVVLVNWGKVADLAICNDQLIGVAFSQSNVSSYVVDLTRVTRTGTVARDPVQDHRPLAQPLPNPSAPLRRIYERPSTTCSKPQRVKQNSESERRSPSSEDDRDERESRAEIQNAEDYNEIFQPKNSISRTPPRRSEPFPAPPEDDAATAKEAAKPSPAMDVQFPVPNLEVLPRPPVVASTPAPKAEPAIIPATRNEPIGLKASDFLPAVKIPQQAELVDEDAMSQIRKGHDTMCVVLTSRHKNLDTVRAVWTMGDIKGHTVPHCPTPDGALFAQTSVDSAVAINDLSVVVDLLNIVNQKA

SEQ ID NO: 744715 - protein, 407 aa, Homo sapiens
MATPVVTKTAWKLQEIVAHASNVSSLVLGKASGRLLATGGDDCRVNLWSINKPNCIMSLTGHTSPVESVRLNTPEELIVAGSQSGSIRVWDLEAAKILRTLMGHKANICSLDFHPYGEFVASGSQDTNIKLWDIRRKGCVFRYRGHSQAVRCLRFSPDGKWLASAADDHTVKLWDLTAGKMMSEFPGHTGPVNVVEFHPNEYLLASGSSDRTIRFWDLEKFQVVSCIEGEPGPVRSVLFNPDGCCLYSGCQDSLRVYGWEPERCFDVVLVNWGKVADLAICNDQLIGVAFSQSNVSSYVVDLTRVTRTGTVARDPVQDHRPLAQPLPNPSAPLRRIYERPSTTCSKPQRVKQNSESERRSPSSEDDRDERESRAEIQNAEDYNEIFQPKNSISPERPTPGRSEGPFP

SEQ ID NO: 744716 - protein, 292 aa, Homo sapiens
MATPVVTKTAWKLQEIVAHASNVSSLVLGKASGRLLATGGDDCRVNLWSINKPNCIMSLTGHTSPVESVRLNTPEELIVAGSQSGSIRVWDLEAAKILRTLMGHKANICSLDFHPYGEFVASGSQDTNIKLWDIRRKGCVFRYRGHSQAVRCLRFSPDGKWLASAADDHTVKLWDLTAGKMMSEFPGHTGPVNVVEFHPNEYLLASGSSDRTIRFWDLEKFQVVSCIEGEPGPVRSVLFNPDGCCLYSGCQDSLRVYGWEPERCFDVVLVNWGKVADLAICNDQLVREPWHP

SEQ ID NO: 744717 - protein, 256 aa, Homo sapiens; identical to SEQ ID NO: 744707

SEQ ID NO: 744718 - protein, 185 aa, Homo sapiens
MATPVVTKTAWKLQEIVAHASNVSSLVLGKASGRLLATGGDDCRVNLWSINKPNCIMSLTGHTSPVESVRLNTPEELIVAGSQSGSIRVWDLEAAKILRTLMGHKANICSLDFHPYGEFVASGSQDTNIKLWDIRRKGCVFRYRGHSQAVRCLRFSPDGKWLASAADDHTVKIWISRLAIRGGSL

SEQ ID NO: 744719 - protein, 475 aa, Homo sapiens
MMSEFPGHTGPVNVVEFHPNEYLLASGSSDRTIRFWDLEKFQVVSCIEGEPGPVRSVLFNPDGCCLYSGCQDSLRVYGWEPERCFDVVLVNWGKVADLAICNDQLIGVAFSQSNVSSYVVDLTRVTRTGTVARDPVQDHRPLAQPLPNPSAPLRRIYERPSTTCSKPQRVKQNSESERRSPSSEDDRDERESRAEIQNAEDYNEIFQPKNSISRTPPRRSEPFPAPPEDDAATAKEAAKPSPAMDVQFPVPNLEVLPRPPVVASTPAPKAEPAIIPATRNEPIGLKASDFLPAVKIPQQAELVDEDAMSQIRKGHDTMCVVLTSRHKNLDTVRAVWTMGDIKTSVDSAVAINDLSVVVDLLNIVNQKASLWKLDLCTTVLPQIEKLLQSKYESYVQTGCTSLKLILQRFLPLITDMLAAPPSVGVDISREERLHKCRLCYKQLKSISGLVKSKSGLSGRHGSTFRELHLLMASLD

SEQ ID NO: 744720 - protein, 599 aa, Homo sapiens
MSLTGHTSPVESVRLNTPEELIVAGSQSGSIRVWDLEAAKILRTLMGHKANICSLDFHPYGEFVASGSQDTNIKLWDIRRKGCVFRYRGHSQAVRCLRFSPDGKWLASAADDHTVKLWDLTAGKMMSEFPGHTGPVNVVEFHPNEYLLASGSSDRTIRFWDLEKFQVVSCIEGEPGPVRSVLFNPDGCCLYSGCQDSLRVYGWEPERCFDVVLVNWGKVADLAICNDQLIGVAFSQSNVSSYVVDLTRVTRTGTVARDPVQDHRPLAQPLPNPSAPLRRIYERPSTTCSKPQRVKQNSESERRSPSSEDDRDERESRAEIQNAEDYNEIFQPKNSISRTPPRRSEPFPAPPEDDAATAKEAAKPSPAMDVQFPVPNLEVLPRPPVVASTPAPKAEPAIIPATRNEPIGLKASDFLPAVKIPQQAELVDEDAMSQIRKGHDTMCVVLTSRHKNLDTVRAVWTMGDIKTSVDSAVAINDLSVVVDLLNIVNQKASLWKLDLCTTVLPQIEKLLQSKYESYVQTGCTSLKLILQRFLPLITDMLAAPPSVGVDISREERLHKCRLCYKQLKSISGLVKSKSGLSGRHGSTFRELHLLMASLD

SEQ ID NO: 744721 - protein, 599 aa, Homo sapiens; identical to SEQ ID NO: 744720

SEQ ID NO: 744722 - protein, 652 aa, Homo sapiens
QLIGAGGKVGGALSRRFVVRVGCQAAANQGRGWRQVGDDCRVNLWSINKPNCIMSLTGHTSPVESVRLNTPEELIVAGSQSGSIRVWDLEAAKILRTLMGHKANICSLDFHPYGEFVASGSQDTNIKLWDIRRKGCVFRYRGHSQAVRCLRFSPDGKWLASAADDHTVKLWDLTAGKMMSEFPGHTGPVNVVEFHPNEYLLASGSSDRTIRFWDLEKFQVVSCIEGEPGPVRSVLFNPDGCCLYSGCQDSLRVYGWEPERCFDVVLVNWGKVADLAICNDQLIGVAFSQSNVSSYVVDLTRVTRTGTVARDPVQDHRPLAQPLPNPSAPLRRIYERPSTTCSKPQRVKQNSESERRSPSSEDDRDERESRAEIQNAEDYNEIFQPKNSISRTPPRRSEPFPAPPEDDAATAKEAAKPSPAMDVQFPVPNLEVLPRPPVVASTPAPKAEPAIIPATRNEPIGLKASDFLPAVKIPQQAELVDEDAMSQIRKGHDTMCVVLTSRHKNLDTVRAVWTMGDIKTSVDSAVAINDLSVVVDLLNIVNQKASLWKLDLCTTVLPQIEKLLQSKYESYVQTGCTSLKLILQRFLPLITDMLAAPPSVGVDISREERLHKCRLCYKQLKSISGLVKSKSGLSGRHGSTFRELHLLMASLD

SEQ ID NO: 744723 - protein, 114 aa, Homo sapiens
DVICSIIFHKRFDYKDQQFLNLMEKLNGKYESYVQTGCTSLKLILQRFLPLITDMLAAPPSVGVDISREERLHKCRLCYKQLKSISGLVKSKSGLSGRHGSTFRELHLLMASLD

SEQ ID NO: 744724 - protein, 144 aa, Homo sapiens
AAAMAVPSASCTCSWPVWTEESSGQGRSAAHRAWPQPPLLFLVHPLAHEPLPGPCCCPVAVLEEVMLVPGHLYSPELLRQLSPAIAAQLCPTVASWGSELSPGAAAVIYKANFIKFVTITRFPCGECFLLATGLPGPRSACPMV

SEQ ID NO: 744725 - protein, 296 aa, Homo sapiens
LEDPISGRDERESRAEIQNAEDYNEIFQPKNSISRTPPRRSEPFPAPPEDDAATAKEAAKPSPAMDVQFPVPNLEVLPRPPVVASTPAPKAEPAIIPATRNEPIGLKASDFLPAVKIPQQAELVDEDAMSQIRKGHDTMCVVLTSRHKNLDTVRAVWTMGDIKTSVDSAVAINDLSVVVDLLNIVNQKASLWKLDLCTTVLPQIEKLLQSKYESYVQTGCTSLKLILQRFLPLITDMLAAPPSVGVDISREERLHKCRLCYKQLKSISGLVKSKSGLSGRHGSTFRELHLLMASLD

SEQ ID NO: 744726 - protein, 65 aa, Homo sapiens
MATPVVTKTAWKLQEIVAHASNVSSLVLGKASGRLLATGGDDCRVNLWSINKPNCIMSRFGILYN

SEQ ID NO: 744727 - protein, 896 aa, Homo sapiens
MIVLLLFALLWMVEGVFSQLHYTVQEEQEHGTFVGNIAEDLGLDITKLSARGFQTVPNSRTPYLDLNLETGVLYVNEKIDREQICKQSPSCVLHLEVFLENPLELFQVEIEVLDINDNPPSFPEPDLTVEISESATPGTRFPLESAFDPDVGTNSLRDYEITPNSYFSLDVQTQGDGNRFAELVLEKPLDREQQAVHRYVLTAVDGGGGGGVGEGGGGGGGAGLPPQQQRTGTALLTIRVLDSNDNVPAFDQPVYTVSLPENSPPGTLVIQLNATDPDEGQNGEVVYSFSSHISPRARELFGLSPRTGRLEVSGELDYEESPVYQVYVQAKDLGPNAVPAHCKVLVRVLDANDNAPEISFSTVKEAVSEGAAPGTVVALFSVTDRDSEENGQVQCELLGDVPFRLKSSFKNYYTIVTEAPLDREAGDSYTLTVVARDRGEPALSTSKSIQVQVSDVNDNAPRFSQPVYDVYVTENNVPGAYIYAVSATDRDEGANAQLAYSILECQIQGMSVFTYVSINSENGYLYALRSFDYEQLKDFSFQVEARDAGSPQALAGNATVNILIVDQNDNAPAIVAPLPGRNGTPAREVLPRSAEPGYLLTRVAAVDADDGENARLTYSIVRGNEMNLFRMDWRTGELRTARRVPAKRDPQRPYELVIEVRDHGQPPLSSTATLVVQLVDGAVEPQGGGGSGGGGSGEHQRPSRSGGGETSLDLTLILIIALGSVSFIFLLAMIVLAVRCQKEKKLNIYTCLASDCCLCCCCCGGGGSTCCGRQARARKKKLSKSDIMLVQSSNVPSNPAQVPIEESGGFGSHHHNQNYCYQVCLTPESAKTDLMFLKPCSPSRSTDTEHNPCGAIVTGYTDQQPDIISNGSILSNEVRLKRKDHHLSSPPSESLL

SEQ ID NO: 744728 - protein, 1048 aa, Homo sapiens
MIVLLLFALLWMVEGVFSQLHYTVQEEQEHGTFVGNIAEDLGLDITKLSARGFQTVPNSRTPYLDLNLETGVLYVNEKIDREQICKQSPSCVLHLEVFLENPLELFQVEIEVLDINDNPPSFPEPDLTVEISESATPGTRFPLESAFDPDVGTNSLRDYEITPNSYFSLDVQTQGDGNRFAELVLEKPLDREQQAVHRYVLTAVDGGGGGGVGEGGGGGGGAGLPPQQQRTGTALLTIRVLDSNDNVPAFDQPVYTVSLPENSPPGTLVIQLNATDPDEGQNGEVVYSFSSHISPRARELFGLSPRTGRLEVSGELDYEESPVYQVYVQAKDLGPNAVPAHCKVLVRVLDANDNAPEISFSTVKEAVSEGAAPGTVVALFSVTDRDSEENGQVQCELLGDVPFRLKSSFKNYYTIVTEAPLDREAGDSYTLTVVARDRGEPALSTSKSIQVQVSDVNDNAPRFSQPVYDVYVTENNVPGAYIYAVSATDRDEGANAQLAYSILECQIQGMSVFTYVSINSENGYLYALRSFDYEQLKDFSFQVEARDAGSPQALAGNATVNILIVDQNDNAPAIVAPLPGRNGTPAREVLPRSAEPGYLLTRVAAVDADDGENARLTYSIVRGNEMNLFRMDWRTGELRTARRVPAKRDPQRPYELVIEVRDHGQPPLSSTATLVVQLVDGAVEPQGGGGSGGGGSGEHQRPSRSGGGETSLDLTLILIIALGSVSFIFLLAMIVLAVRCQKEKKLNIYTCLASDCCLCCCCCGGGGSTCCGRQARARKKKLSKSDIMLVQSSNVPSNPAQVPIEESGGFGSHHHNQNYCYQVCLTPESAKTDLMFLKPCSPSRSTDTEHNPCGAIVTGYTDQQPDIISNGSILSNETKHQRAELSYLVDRPRRVNSSAFQEADIVSSKDSGHGDSEQGDSDHDATNRAQSAGMDLFSNCTEECKALGHSDRCWMPSFVPSDGRQAADYRSNLHVPGMDSVPDTEVFETPEAQPGAERSFSTFGKEKALHSTLERKELDGLLTNTRAPYKPPYLTRKQDMLVNSTGLT

SEQ ID NO: 744729 - protein, 574 aa, Homo sapiens
MEASLGIQMDEPMAFSPQRDRFQAEGSLKKNEQNFKLAGVKKDIEKLYEAVPQLSNVFKIEDKIGEGTFSSVYLATAQLQVGPEEKIALKHLIPTSHPIRIAAELQCLTVAGGQDNVMGVKYCFRKNDHVVIAMPYLEHESFLDILNSLSFQEVREYMLNLFKALKRIHQFGIVHRDVKPSNFLYNRRLKKYALVDFGLAQGTHDTKIELLKFVQSEAQQERCSQNKSHIITGNKIPLSGPVPKELDQQSTTKASVKRPYTNAQIQIKQGKDGKEGSVGLSVQRSVFGERNFNIHSSISHESPAVKLMKQSKTVDVLSRKLATKKKAISTKVMNSAVMRKTASSCPASLTCDCYATDKVCSICLSRRQQVAPRAGTPGFRAPEVLTKCPNQTTAIDMWSAGVIFLSLLSGRYPFYKASDDLTALAQIMTIRGSRETIQAAKTFGKSILCSKEVPAQDLRKLCERLRGMDSSTPKLTSDIQGHASHQPAISEKTDHKASCLVQTPPGQYSGNSFKKGDSNSCEHCFDEYNTNLEGWNEVPDEAYDLLDKLLDLNPASRITAEEALLHPFFKDMSL

SEQ ID NO: 744730 - protein, 610 aa, Homo sapiens
RAAAGSVAQAHPIDSLLCSPCGCNPLAGILHLNWLVMEASLGIQMDEPMAFSPQRDRFQAEGSLKKNEQNFKLAGVKKDIEKLYEAVPQLSNVFKIEDKIGEGTFSSVYLATAQLQVGPEEKIALKHLIPTSHPIRIAAELQCLTVAGGQDNVMGVKYCFRKNDHVVIAMPYLEHESFLDILNSLSFQEVREYMLNLFKALKRIHQFGIVHRDVKPSNFLYNRRLKKYALVDFGLAQGTHDTKIELLKFVQSEAQQERCSQNKSHIITGNKIPLSGPVPKELDQQSTTKASVKRPYTNAQIQIKQGKDGKEGSVGLSVQRSVFGERNFNIHSSISHESPAVKLMKQSKTVDVLSRKLATKKKAISTKVMNSAVMRKTASSCPASLTCDCYATDKVCSICLSRRQQVAPRAGTPGFRAPEVLTKCPNQTTAIDMWSAGVIFLSLLSGRYPFYKASDDLTALAQIMTIRGSRETIQAAKTFGKSILCSKEVPAQDLRKLCERLRGMDSSTPKLTSDIQGHASHQPAISEKTDHKASCLVQTPPGQYSGNSFKKGDSNSCEHCFDEYNTNLEGWNEVPDEAYDLLDKLLDLNPASRITAEEALLHPFFKDMSL

SEQ ID NO: 744731 - protein, 650 aa, Homo sapiens
GPSRLSSRPALAGGFPFIHPSPPPPSTRGQGRISSPSTCLGPWTSLLALPVSGEKLLCSPCGCNPLAGILHLNWLVMEASLGIQMDEPMAFSPQRDRFQAEGSLKKNEQNFKLAGVKKDIEKLYEAVPQLSNVFKIEDKIGEGTFSSVYLATAQLQVGPEEKIALKHLIPTSHPIRIAAELQCLTVAGGQDNVMGVKYCFRKNDHVVIAMPYLEHESFLDILNSLSFQEVREYMLNLFKALKRIHQFGIVHRDVKPSNFLYNRRLKKYALVDFGLAQGTHDTKIELLKFVQSEAQQERCSQNKSHIITGNKIPLSGPVPKELDQQSTTKASVKRPYTNAQIQIKQGKDGKEGSVGLSVQRSVFGERNFNIHSSISHESPAVKLMKQSKTVDVLSRKLATKKKAISTKVMNSAVMRKTASSCPASLTCDCYATDKVCSICLSRRQQVAPRAGTPGFRAPEVLTKCPNQTTAIDMWSAGVIFLSLLSGRYPFYKASDDLTALAQIMTIRGSRETIQAAKTFGKSILCSKEVPAQDLRKLCERLRGMDSSTPKLTSDIQGHASHQPAISEKTDHKASCLVQTPPGQYSGNSFKKGDSNSCEHCFDEYNTNLEGWNEVPDEAYDLLDKLLDLNPASRITAEEALLHPFFKDMSL

SEQ ID NO: 744732 - protein, 107 aa, Homo sapiens [sequence omitted]

SEQ ID NO: 744733 - protein, 107 aa, Homo sapiens
MACYGSQPPRWTPLILDSWCQNHCTQINCKQEQSFNGNFKQEDENPEAFLSRIVTGDETWFYQYNPEDKVQSEQWLPRGGSGPVKAKADLPRAKVVGIVFWDTYFAC

SEQ ID NO: 744734 - protein, 254 aa, Homo sapiens [sequence omitted]

SEQ ID NO: 744735 - protein, 67 aa, Homo sapiens
MEGTLNTSEHQKEQTLVTPSLRTITLTARVGGFILEVSETKNPPIPDTQWPLGGFHQGSGPGLGLDE

SEQ ID NO: 744736 - protein, 365 aa, Homo sapiens
GTRAIFTTGQGASAVGLTAYVQRHPVSREWTLEAGALVLADRGVCLIDEFDKMNDQDRTSIHEAMEQQSISISKAGIVTSLQARCTVIAAANPIGGRYDPSLTFSENVDLTEPIISRFDILCVVRDTVDPVQDEMLARFVVGSHVRHHPSNKEEEGLANGSAAEPAMPNTYGVEPLPQEVLKKYIIYAKERVHPKLNQMDQDKVAKMYSDLRKESMATGSIPITVRHIESMIRMAEAHARIHLRDYVIEDDVNMAIRVMLESFIDTQKFSVMRSMRKTFARYLSFRRDNNELLLFILKQLVAEQVTYQRNRFGAQQDTIEVPEKDLVDKARQINIHNLSAFYDSELFRMNKFSHDLKRKMILQQF

SEQ ID NO: 744737 - protein, 365 aa, Homo sapiens; identical to SEQ ID NO: 744736

SEQ ID NO: 744738 - protein, 71 aa, Homo sapiens
EKVHIPGLANGCASWGEEWRGGLVQAAGHLPSLKAQACELAFLCHNSLTTAGLRHQLTLPHNPGACKGIWI

SEQ ID NO: 744739 - protein, 893 aa, Homo sapiens
HEGPRSWGAWTRPRSAGTMTLARFVLALMLGALPEVVGFDSVLNDSLHHSHRHSPPAGPHYPYYLPTQQRPPTTRPPPPLPRFPRPPRALPAQRPHALQAGHTPRPHPWGCPAGEPWVSVTDFGAPCLRWAEVPPFLERSPPASWAQLRGQRHNFCRSPDGAGRPWCFYGDARGKVDWGYCDCRHGSVRLRGGKNEFEGTVEVYASGVWGTVCSSHWDDSDASVICHQLQLGGKGIAKQTPFSGLGLIPIYWSNVRCRGDEENILLCEKDIWQGGVCPQKMAAAVTCSFSHGPTFPIIRLAGGSSVHEGRVELYHAGQWGTVCDDQWDDADAEVICRQLGLSGIAKAWHQAYFGEGSGPVMLDEVRCTGNELSIEQCPKSSWGEHNCGHKEDAGVSCTPLTDGVIRLAGGKGSHEGRLEVYYRGQWGTVCDDGWTELNTYVVCRQLGFKYGKQASANHFEESTGPIWLDDVSCSGKETRFLQCSRRQWGRHDCSHREDVSIACYPGGEGHRLSLGFPVRLMDGENKKEGRVEVFINGQWGTICDDGWTDKDAAVICRQLGYKGPARARTMAYFGEGKGPIHVDNVKCTGNERSLADCIKQDIGRHNCRHSEDAGVICDYFGKKASGNSNKESLSSVCGLRLLHRRQKRIIGGKNSLRGGWPWQVSLRLKSSHGDGRLLCGATLLSSCWVLTAAHCFKRYGNSTRSYAVRVGDYHTLVPEEFEEEIGVQQIVIHREYRPDRSDYDIALVRLQGPEEQCARFSSHVLPACLPLWRERPQKTASNCYITGWGDTGRAYSRTLQQAAIPLLPKRFCEERYKGRFTGRMLCAGNLHEHKRVDSCQGDSGGPLMCERPGESWVVYGVTSWGYGCGVKDSPGVYTKVSAFVPWIKSVTKL

SEQ ID NO: 744740 - protein, 852 aa, Homo sapiens
HEGPRSWGAWTRPRSAGTMTLARFVLALMLGALPEVVGFDSVLNDSLHHSHRHSPPAGPHYPYYLPTQQRPPTTRPPPPLPRFPRPPRALPAQRPHALQAGHTPRPHPWGCPAGEPWVSVTDFGAPCLRWAEVPPFLERSPPASWAQLRGQRHNFCRSPDGAGRPWCFYGDARGKVDWGYCDCRHGSVRLRGGKNEFEGTVEVYASGVWGTVCSSHWDDSDASVICHQLQLGGKGIAKQTPFSGLGLIPIYWSNVRCRGDEENILLCEKDIWQGGVCPQKMAAAVTCSFSHGPTFPIIRLAGGSSVHEGRVELYHAGQWGTVCDDQWDDADAEVICRQLGLSGIAKAWHQAYFGEGSGPVMLDEVRCTGNELSIEQCPKSSWGEHNCGHKEDAGVSCTPLTDGVIRLAGGKGSHEGRLEVYYRGQWGTVCDDGWTELNTYVVCRQLGFKYGKQASANHFEESTGPIWLDDVSCSGKETRFLQCSRRQWGRHDCSHREDVSIACYPGGEGHRLSLGFPVRLMDGENKKEGRVEVFINGQWGTICDDGWTDKDAAVICRQLGYKGPARARTMAYFGEGKGPIHVDNVKCTGNERSLADCIKQDIGRHNCRHSEDAGVICDYFGKKASGNSNKESLSSVCGLRLLHRRQKRIIGGKNSLRYGNSTRSYAVRVGDYHTLVPEEFEEEIGVQQIVIHREYRPDRSDYDIALVRLQGPEEQCARFSSHVLPACLPLWRERPQKTASNCYITGWGDTGRAYSRTLQQAAIPLLPKRFCEERYKGRFTGRMLCAGNLHEHKRVDSCQGDSGGPLMCERPGESWVVYGVTSWGYGCGVKDSPGVYTKVSAFVPWIKSVTKL

SEQ ID NO: 744741 - protein, 613 aa, Homo sapiens
MAAAVTCSFSHGPTFPIIRLAGGSSVHEGRVELYHAGQWGTVCDDQWDDADAEVICRQLGLSGIAKAWHQAYFGEGSGPVMLDEVRCTGNELSIEQCPKSSWGEHNCGHKEDAGVSCTPLTDGVIRLAGGKGSHEGRLEVYYRGQWGTVCDDGWTELNTYVVCRQLGFKYGKQASANHFEESTGPIWLDDVSCSGKETRFLQCSRRQWGRHDCSHREDVSIACYPGGEGHRLSLGFPVRLMDGENKKEGRVEVFINGQWGTICDDGWTDKDAAVICRQLGYKGPARARTMAYFGEGKGPIHVDNVKCTGNERSLADCIKQDIGRHNCRHSEDAGVICDYFGKKASGNSNKESLSSVCGLRLLHRRQKRIIGGKNSLRGGWPWQVSLRLKSSHGDGRLLCGATLLSSCWVLTAAHCFKRYGNSTRSYAVRVGDYHTLVPEEFEEEIGVQQIVIHREYRPDRSDYDIALVRLQGPEEQCARFSSHVLPACLPLWRERPQKTASNCYITGWGDTGRAYSRTLQQAAIPLLPKRFCEERYKGRFTGRMLCAGNLHEHKRVDSCQGDSGGPLMCERPGESWVVYGVTSWGYGCGVKDSPGVYTKVSAFVPWIKSVTKL

SEQ ID NO: 744742 - protein, 324 aa, Homo sapiens [sequence omitted]

SEQ ID NO: 744743 - protein, 548 aa, Homo sapiens
HEGPRSWGAWTRPRSAGTMTLARFVLALMLGALPEVVGFDSVLNDSLHHSHRHSPPAGPHYPYYLPTQQRPPTTRPPPPLPRFPRPPRALPAQRPHALQAGHTPRPHPWGCPAGEPWVSVTDFGAPCLRWAEVPPFLERSPPASWAQLRGQRHNFCRSPDGAGRPWCFYGDARGKVDWGYCDCRHGSVRLRGGKNEFEGTVEVYASGVWGTVCSSHWDDSDASVICHQLQLGGKGIAKQTPFSGLGLIPIYWSNVRCRGDEENILLCEKDIWQGGVCPQKMAAAVTCSFSHGPTFPIIRLAGGSSVHEGRVELYHAGQWGTVCDDQWDDADAEVICRQLGLSGIAKAWHQAYFGEGSGPVMLDEVRCTGNELSIEQCPKSSWGEHNCGHKEDAGVSCTPLTDGVIRLAGGKGSHEGRLEVYYRGQWGTVCDDGWTELNTYVVCRQLGFKYGKQASANHFEESTGPIWLDDVSCSGKETRFLQCSRRQWGRHDCSHREDVSIACYPGGEGHRLSLGFPVRLMDGENKKEGRVEVFINGQWGTISDTIQS

SEQ ID NO: 744744 - protein, 868 aa, Homo sapiens
KAPAAGGKVGEARAVQGEGAGGGGPPPPPPSEKGSDQRWARTRAKVAGRKKQQPCRAKKTTTAAATAAGTQASQKRDKHRPHPWGCPAGEPWVSVTDFGAPCLRWAEVPPFLERSPPASWAQLRGQRHNFCRSPDGAGRPWCFYGDARGKVDWGYCDCRHGSVRLRGGKNEFEGTVEVYASGVWGTVCSSHWDDSDASVICHQLQLGGKGIAKQTPFSGLGLIPIYWSNVRCRGDEENILLCEKDIWQGGVCPQKMAAAVTCSFSHGPTFPIIRLAGGSSVHEGRVELYHAGQWGTVCDDQWDDADAEVICRQLGLSGIAKAWHQAYFGEGSGPVMLDEVRCTGNELSIEQCPKSSWGEHNCGHKEDAGVSCTPLTDGVIRLAGGKGSHEGRLEVYYRGQWGTVCDDGWTELNTYVVCRQLGFKYGKQASANHFEESTGPIWLDDVSCSGKETRFLQCSRRQWGRHDCSHREDVSIACYPGGEGHRLSLGFPVRLMDGENKKEGRVEVFINGQWGTICDDGWTDKDAAVICRQLGYKGPARARTMAYFGEGKGPIHVDNVKCTGNERSLADCIKQDIGRHNCRHSEDAGVICDYFGKKASGNSNKESLSSVCGLRLLHRRQKRIIGGKNSLRGGWPWQVSLRLKSSHGDGRLLCGATLLSSCWVLTAAHCFKRYGNSTRSYAVRVGDYHTLVPEEFEEEIGVQQIVIHREYRPDRSDYDIALVRLQGPEEQCARFSSHVLPACLPLWRERPQKTASNCYITGWGDTGRAYSRTLQQAAIPLLPKRFCEERYKGRFTGRMLCAGNLHEHKRVDSCQGDSGGPLMCERPGESWVVYGVTSWGYGCGVKDSPGVYTKVSAFVPWIKSVTKL

SEQ ID NO: 744745 - protein, 573 aa, Homo sapiens
HEGPRSWGAWTRPRSAGTMTLARFVLALMLGALPEVVGFDSVLNDSLHHSHRHSPPAGPHYPYYLPTQQRPPTTRPPPPLPRFPRPPRALPAQRPHALQAGHTPRPHPWGCPAGEPWVSVTDFGAPCLRWAEVPPFLERSPPASWAQLRGQRHNFCRSPDGAGRPWCFYGDARGKVDWGYCDCRHGSVRLRGGKNEFEGTVEVYASGVWGTVCSSHWDDSDASVICHQLQLGGKGIAKQTPFSGLGLIPIYWSNVRCRGDEENILLCEKDIWQGGVCPQKMAAAVTCSFSHGPTFPIIRLAGGSSVHEGRVELYHAGQWGTVCDDQWDDADAEVICRQLGLSGIAKAWHQAYFGEGSGPVMLDEVRCTGNELSIEQCPKSSWGEHNCGHKEDAGVSCTPLTDGVIRLAGGKGSHEGRLEVYYRGQWGTVCDDGWTELNTYVVCRQLGFKYGKQASANHFEESTGPIWLDDVSCSGKETRFLQCSRRQWGRHDCSHREDVSIACYPGGEGHRLSLGFPVRLMDGENKKEGRVEVFINGQWGTICDDGWTDKDAAVICRQLGYNIICNSQDVETA

SEQ ID NO: 744746 - protein, 216 aa, Homo sapiens
GGRWRRRKELVPVQVVEDNHHGHSPEERIIYGVENSSTFLECSPKSQRALVYWQFQRRNEERKEEIRVDDHIIRTDQGLLLRSLQQKDSGNYLCHAVEHGFIQTLLKVTLEVIDTEHLEELLHKDDDGDGSKTKEMSNSMTPSQKVWYRDFMQLINHPNLNTMDEFCEQVWKRDRKQRRQRPGHTPGNSNKWKHLQENKKGRNRRTHEFERAPRSV

SEQ ID NO: 744747 - protein, 306 aa, Homo sapiens
KETWYDLEEVLLEEMTVFREPTAISAMELSTKQQQLYIGSTAGVAQLPLHRCDIYGKACAECCLARDPYCAWDGSACSRYFPTAKRRTRRQDIRNGDPLTHCSDLHHDNHHGHSPEERIIYGVENSSTFLECSPKSQRALVYWQFQRRNEERKEEIRVDDHIIRTDQGLLLRSLQQKDSGNYLCHAVEHGFIQTLLKVTLEVIDTEHLEELLHKDDDGDGSKTKEMSNSMTPSQKVWYRDFMQLINHPNLNTMDEFCEQVWKRDRKQRRQRPGHTPGNSNKWKHLQENKKGRNRRTHEFERAPRSV

SEQ ID NO: 744748 - protein, 219 aa, Homo sapiens
MDSGTRPVGSCCSSPAGLSREYKLVMLGAGGVGKSAMTMQFISHRFPEDHDPTIEDAYKIRIRIDDEPANLDILDTAGQAEFTAMRDQYMRAGEGFIICYSITDRRSFHEVREFKQLIYRVRRTDDTPVVLVGNKSDLKQLRQVTKEEGLALAREFSCPFFETSAAYRYYIDDVFHALVREIRRKEKEAVLAMEKKSKPKNSVWKRLKSPFRKKKDSVT

SEQ ID NO: 744749 - protein, 219 aa, Homo sapiens; identical to SEQ ID NO: 744748

SEQ ID NO: 744750 - protein, 103 aa, Homo sapiens
PTTTTKLAAARPVVLVGNKSDLKQLRQVTKEEGLALAREFSCPFFETSAAYRYYIDDVFHALVREIRRKEKEAVLAMEKKSKPKNSVWKRLKSPFRKKKDSVT

SEQ ID NO: 744751 - protein, 183 aa, Homo sapiens
MTMQFISHRFPEDHDPTIEDAYKIRIRIDDEPANLDILDTAGQAEFTAMRDQYMRAGEGFIICYSITDRRSFHEVREFKQLIYRVRRTDDTPVVLVGNKSDLKQLRQVTKEEGLALAREFSCPFFETSAAYRYYIDDVFHALVREIRRKEKEAVLAMEKKSKPKNSVWKRLKSPFRKKKDSVT

SEQ ID NO: 744752 - protein, 1062 aa, Homo sapiens
MVSSAQMGFNLQALLEQLSQDELSKFKYLITTFSLAHELQKIPHKEVDKADGKQLVEILTTHCDSYWVEMASLQVFEKMHRMDLSERAKDEVREAALKSFNKRKPLSLGITRKERPPLDVDEMLERFKTEAQAFTETKGNVICLGKEVFKGKKPDKDNRCRYILKTKFREMWKSWPGDSKEVQVMAERYKMLIPFSNPRVLPGPFSYTVVLYGPAGLGKTTLAQKLMLDWAEDNLIHKFKYAFYLSCRELSRLGPCSFAELVFRDWPELQDDIPHILAQARKILFVIDGFDELGAAPGALIEDICGDWEKKKPVPVLLGSLLNRVMLPKAALLVTTRPRALRDLRILAEEPIYIRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQTSVLHREDLERLGVQESDLRLFLDGDILRQDRVSKGCYSFIHLSFQQFLTALFYTLEKEEEEDRDGHTWDIGDVQKLLSGVERLRNPDLIQAGYYSFGLANEKRAKELEATFGCRMSPDIKQELLRCDISCKGGHSTVTDLQELLGCLYESQEEELVKEVMAQFKEISLHLNAVDVVPSSFCVKHCRNLQKMSLQVIKENLPENVTASESDAEVERSQDDQHMLPFWTDLCSIFGSNKDLMGLAINDSFLSASLVRILCEQIASDTCHLQRVVFKNISPADAHRNLCLALRGHKTVTYLTLQGNDQDDMFPALCEVLRHPECNLRYLGLVSCSATTQQWADLSLALEVNQSLTCVNLSDNELLDEGAKLLYTTLRHPKCFLQRLSLENCHLTEANCKDLAAVLVVSRELTHLCLAKNPIGNTGVKFLCEGLRYPECKLQTLVLWNCDITSDGCCDLTKLLQEKSSLLCLDLGLNHIGVKGMKFLCEALRKPLCNLRCLWLWGCSIPPFSCEDLCSALSCNQSLVTLDLGQNPLGSSGVKMLFETLTCSSGTLRTLRLKIDDFNDELNKLLEEIEEKNPQLIIDTEKHHPWAERPSSHDFMI

SEQ ID NO: 744753 - protein, 1040 aa, Homo sapiens
MVSSAQMGFNLQALLEQLSQDELSKFKYLITTFSLAHELQKIPHKEVDKADGKQLVEILTTHCDSYWVEMASLQVFEKMHRMDLSERAKDEVREAALKSFNKRKPLSLGITRKERPPLDVDEMLERFKTEAQDKDNRCRYILKTKFREMWKSWPGDSKEVQVMAERYKMLIPFSNPRVLPGPFSYTVVLYGPAGLGKTTLAQKLMLDWAEDNLIHKFKYAFYLSCRELSRLGPCSFAELVFRDWPELQDDIPHILAQARKILFVIDGFDELGAAPGALIEDICGDWEKKKPVPVLLGSLLNRVMLPKAALLVTTRPRALRDLRILAEEPIYIRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQTSVLHREDLERLGVQESDLRLFLDGDILRQDRVSKGCYSFIHLSFQQFLTALFYTLEKEEEEDRDGHTWDIGDVQKLLSGVERLRNPDLIQAGYYSFGLANEKRAKELEATFGCRMSPDIKQELLRCDISCKGGHSTVTDLQELLGCLYESQEEELVKEVMAQFKEISLHLNAVDVVPSSFCVKHCRNLQKMSLQVIKENLPENVTASESDAEVERSQDDQHMLPFWTDLCSIFGSNKDLMGLAINDSFLSASLVRILCEQIASDTCHLQRVVFKNISPADAHRNLCLALRGHKTVTYLTLQGNDQDDMFPALCEVLRHPECNLRYLGLVSCSATTQQWADLSLALEVNQSLTCVNLSDNELLDEGAKLLYTTLRHPKCFLQRLSLENCHLTEANCKDLAAVLVVSRELTHLCLAKNPIGNTGVKFLCEGLRYPECKLQTLVLWNCDITSDGCCDLTKLLQEKSSLLCLDLGLNHIGVKGMKFLCEALRKPLCNLRCLWLWGCSIPPFSCEDLCSALSCNQSLVTLDLGQNPLGSSGVKMLFETLTCSSGTLRTLRLKIDDFNDELNKLLEEIEEKNPQLIIDTEKHHPWAERPSSHDFMI

SEQ ID NO: 744754 - protein, 102 aa, Homo sapiens
MVSSAQMGFNLQALLEQLSQDELSKFKYLITTFSLAHELQKIPHKEVDKADGKQLVEILTTHCDSYWVEMASLQVFEKMHRMDLSERAKDEVREASKPLKTL

SEQ ID NO: 744755 - protein, 542 aa, Homo sapiens
MSQVWPSLSWDIGDVQKLLSGVERLRNPDLIQAGYYSFGLANEKRAKELEATFGCRMSPDIKQELLRCDISCKGGHSTVTDLQELLGCLYESQEEELVKEVMAQFKEISLHLNAVDVVPSSFCVKHCRNLQKMSLQVIKENLPENVTASESDAEVERSQDDQHMLPFWTDLCSIFGSNKDLMGLAINDSFLSASLVRILCEQIASDTCHLQRVVFKNISPADAHRNLCLALRGHKTVTYLTLQGNDQDDMFPALCEVLRHPECNLRYLGLVSCSATTQQWADLSLALEVNQSLTCVNLSDNELLDEGAKLLYTTLRHPKCFLQRLSLENCHLTEANCKDLAAVLVVSRELTHLCLAKNPIGNTGVKFLCEGLRYPECKLQTLVLWNCDITSDGCCDLTKLLQEKSSLLCLDLGLNHIGVKGMKFLCEALRKPLCNLRCLWLWGCSIPPFSCEDLCSALSCNQSLVTLDLGQNPLGSSGVKMLFETLTCSSGTLRTLRLKIDDFNDELNKLLEEIEEKNPQLIIDTEKHHPWAERPSSHDFMI

SEQ ID NO: 744756 - protein, 846 aa, Homo sapiens
MVSSAQMGFNLQALLEQLSQDELSKFKYLITTFSLAHELQKIPHKEVDKADGKQLVEILTTHCDSYWVEMASLQVFEKMHRMDLSERAKDEVREAALKSFNKRKPLSLGITRKERPPLDVDEMLERFKTEAQAFTETKGNVICLGKEVFKGKKPDKDNRCRYILKTKFREMWKSWPGDSKEVQVMAERYKMLIPFSNPRVLPGPFSYTVVLYGPAGLGKTTLAQKLMLDWAEDNLIHKFKYAFYLSCRELSRLGPCSFAELVFRDWPELQDDIPHILAQARKILFVIDGFDELGAAPGALIEDICGDWEKKKPVPVLLGSLLNRVMLPKAALLVTTRPRALRDLRILAEEPIYIRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQTSVLHREDLERLGVQESDLRLFLDGDILRQDRVSKGCYSFIHLSFQQFLTALFYTLEKEEEEDRDGHTWDIGDVQKLLSGVERLRNPDLIQAGYYSFGLANEKRAKELEATFGCRMSPDIKQELLRCDISCKGGHSTVTDLQELLGCLYESQEEELVKEVMAQFKEISLHLNAVDVVPSSFCVKHCRNLQKMSLQVIKENLPENVTASESDAEVERSQDDQHMLPFWTDLCSIFGSNKDLMGLAINDSFLSASLVRILCEQIASDTCHLQRVVFKNISPADAHRNLCLALRGHKTVTYLTLQGNDQDDMFPALCEVLRHPECNLRYLGLVSCSATTQQWADLSLALEVNQSLTCVNLSDNELLDEGAKLLYTTLRHPKCFLQRLS

SEQ ID NO: 744757 - protein, 197 aa, Homo sapiens
MSPLSLSVSNPRLKSQRCITAVRTHRFGFAFFLWLISRLWNCDITSDGCCDLTKLLQEKSSLLCLDLGLNHIGVKGMKFLCEALRKPLCNLRCLWLWGCSIPPFSCEDLCSALSCNQSLVTLDLGQNPLGSSGVKMLFETLTCSSGTLRTLRLKIDDFNDELNKLLEEIEEKNPQLIIDTEKHHPWAERPSSHDFMI

SEQ ID NO: 744758 - protein, 838 aa, Homo sapiens
MVSSAQMGFNLQALLEQLSQDELSKFKYLITTFSLAHELQKIPHKEVDKADGKQLVEILTTHCDSYWVEMASLQVFEKMHRMDLSERAKDEVREAALKSFNKRKPLSLGITRKERPPLDVDEMLERFKTEAQAFTETKGNVICLGKEVFKGKKPDKDNRCRYILKTKFREMWKSWPGDSKEVQVMAERYKMLIPFSNPRVLPGPFSYTVVLYGPAGLGKTTLAQKLMLDWAEDNLIHKFKYAFYLSCRELSRLGPCSFAELVFRDWPELQDDIPHILAQARKILFVIDGFDELGAAPGALIEDICGDWEKKKPVPVLLGSLLNRVMLPKAALLVTTRPRALRDLRILAEEPIYIRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQTSVLHREDLERLGVQESDLRLFLDGDILRQDRVSKGCYSFIHLSFQQFLTALFYTLEKEEEEDRDGHTWDIGDVQKLLSGVERLRNPDLIQAGYYSFGLANEKRAKELEATFGCRMSPDIKQELLRCDISCKGGHSTVTDLQELLGCLYESQEEELVKEVMAQFKEISLHLNAVDVVPSSFCVKHCRNLQKMSLQVIKENLPENVTASESDAEVERSQDDQHMLPFWTDLCSIFGSNKDLMGLAINDSFLSASLVRILCEQIASDTCHLQRVVFKNISPADAHRNLCLALRGHKTVTYLTLQGNDQNPLGSSGVKMLFETLTCSSGTLRTLRLKIDDFNDELNKLLEEIEEKNPQLIIDTEKHHPWAERPSSHDFMI

SEQ ID NO: 744759 - protein, 909 aa, Homo sapiens
MVSSAQMGFNLQALLEQLSQDELSKFKYLITTFSLAHELQKIPHKEVDKADGKQLVEILTTHCDSYWVEMASLQVFEKMHRMDLSERAKDEVREAALKSFNKRKPLSLGITRKERPPLDVDEMLERFKTEAQAFTETKGNVICLGKEVFKGKKPDKDNRCRYILKTKFREMWKSWPGDSKEVQVMAERYKMLIPFSNPRVLPGPFSYTVVLYGPAGLGKTTLAQKLMLDWAEDNLIHKFKYAFYLSCRELSRLGPCSFAELVFRDWPELQDDIPHILAQARKILFVIDGFDELGAAPGALIEDICGDWEKKKPVPVLLGSLLNRVMLPKAALLVTTRPRALRDLRILAEEPIYIRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQTSVLHREDLERLGVQESDLRLFLDGDILRQDRVSKGCYSFIHLSFQQFLTALFYTLEKEEEEDRDGHTWDIGDVQKLLSGVERLRNPDLIQAGYYSFGLANEKRAKELEATFGCRMSPDIKQELLRCDISCKGGHSTVTDLQELLGCLYESQEEELVKEVMAQFKEISLHLNAVDVVPSSFCVKHCRNLQKMSLQVIKENLPENVTASESDAEVERSQDDQHMLPFWTDLCSIFGSNKDLMGLAINDSFLSASLVRILCEQIASDTCHLQRVVFKNISPADAHRNLCLALRGHKTVTYLTLQGNDQDDMFPALCEVLRHPECNLRYLGLVSCSATTQQWADLSLALEVNQSLTCVNLSDNELLDEGAKLLYTTLRHPKCFLQRLSLENCHLTEANCKDLAAVLVVSRELTHLCLAKNPIGNTGVKFLCEGLRYPECKLQTLVKPTTDY

SEQ ID NO: 744760 - protein, 924 aa, Homo sapiens
MVSSAQMGFNLQALLEQLSQDELSKFKYLITTFSLAHELQKIPHKEVDKADGKQLVEILTTHCDSYWVEMASLQVFEKMHRMDLSERAKDEVREAALKSFNKRKPLSLGITRKERPPLDVDEMLERFKTEAQAFTETKGNVICLGKEVFKGKKPDKDNRCRYILKTKFREMWKSWPGDSKEVQVMAERYKMLIPFSNPRVLPGPFSYTVVLYGPAGLGKTTLAQKLMLDWAEDNLIHKFKYAFYLSCRELSRLGPCSFAELVFRDWPELQDDIPHILAQARKILFVIDGFDELGAAPGALIEDICGDWEKKKPVPVLLGSLLNRVMLPKAALLVTTRPRALRDLRILAEEPIYIRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQTSVLHREDLERLGVQESDLRLFLDGDILRQDRVSKGCYSFIHLSFQQFLTALFYTLEKEEEEDRDGHTWDIGDVQKLLSGVERLRNPDLIQAGYYSFGLANEKRAKELEATFGCRMSPDIKQELLRCDISCKGGHSTVTDLQELLGCLYESQEEELVKEVMAQFKEISLHLNAVDVVPSSFCVKHCRNLQKMSLQVIKENLPENVTASESDAEVERSQDDQHMLPFWTDLCSIFGSNKDLMGLAINDSFLSASLVRILCEQIASDTCHLQRVVFKNISPADAHRNLCLALRGHKTVTYLTLQGNDQDDMFPALCEVLRHPECNLRYLGLVSCSATTQQWADLSLALEVNQSLTCVNLSDNELLDEGAKLLYTTLRHPKCFLQRLSLENCHLTEANCKDLAAVLVVSRELTHLCLAKNPIGNTGVKFLCEGLRYPECKLQTLVVSPCWLPVCVGVYAHAPHLRV

SEQ ID NO: 744761 - protein, 73 aa, Homo sapiens
ASSLPSLLTNDKDKDNRCRYILKTKFREMWKSWPGDSKEVQVMAERYKMLIPFSNPRVLPGPFSYTVVLYGPA

SEQ ID NO: 744762 - protein, 85 aa, Homo sapiens
MFSRDGFHHVGQAGLELLSSGDPPTSASQSAGITGVSHRARLCPQPGNGVLLCCPTVLEVLTSRDPSARAFQSAEITGVSRHARP

SEQ ID NO: 744763 - protein, 69 aa, Homo sapiens
NHLVLAIPLRVLVVLWAFVLGLSRVMLGRHNVTDVAFGFFLGYMQYSIVDYCWLSPHNAPVLFLLWSQR

SEQ ID NO: 744764 - protein, 69 aa, Homo sapiens; identical to SEQ ID NO: 744763

SEQ ID NO: 744765 - protein, 69 aa, Homo sapiens; identical to SEQ ID NO: 744763

SEQ ID NO: 744766 - protein, 86 aa, Homo sapiens
TQLGEAFSGSACENSPGLGPNQDGWPREVTAQFPLAGKTQSPVAVFQALLPTPALGPLGGEVRCLMPGSFPGAYMLGIQRGPNSSC

SEQ ID NO: 744767 - protein, 278 aa, Homo sapiens
LCGEVAGEHAQRDCGRVVQSLEGSHALAVWTFKFFRFFRKATGSLGQGRQDCMSEKRRRLDARNPLKQETALSRKMTQDRPLLAVQEALKKCFPVVEEQQGLWQSALRDCQPLLSSLSNLAEQLQAAQNLRFEDVPALRAFPDLKERLRRKQLVAGDIVLDKLGERLAILLKVRDMVSSHVERVFQIYEQHADTVGIDAVLQPSAVSPSVADMLEWLQDIERHYRKSYLKRKYLLSSIQWGDLANIQALPKAWDRISKDEHQDLVQDILLNVSFFLEE

SEQ ID NO: 744768 - protein, 206 aa, Homo sapiens
LCGEVAGEHAQRDCGRVVQSLEGSHALAVWTFKFFRFFRKATGSLGQGRQDCMSEKRRRLDARNPLKQETALSRLPFPRGNQGLLQKAEAGRARWLTPVIPALWKTEAGGSPEKMTQDRPLLAVQEALKKCFPVVEEQQGLWQSALRDCQPLLSSLSNLAEQLQAAQNLRFEDVPALRAFPDLKERLRRKQLVAGDIVLDKLGERL

SEQ ID NO: 744769 - protein, 144 aa, Homo sapiens
LCGEVAGEHAQRDCGRVVQSLEGSHALAVWTFKFFRFFRKATGSLGQGRQDCMSEKRRRLDARNPLKQETALSRLPFPRGNQGLLQKAGLFSLLNALVAVVVTATGAWAEGARAAADITKHLLCARMFTQSLVKSFPSVSLVLL

SEQ ID NO: 744770 - protein, 198 aa, Homo sapiens
MTQDRPLLAVQEALKKCFPVVEEQQGLWQSALRDCQPLLSSLSNLAEQLQAAQNLRFEDVPALRAFPDLKERLRRKQLVAGDIVLDKLGERLAILLKVRDMVSSHVERVFQIYEQHADTVGIDAVLQPSAVSPSVADMLEWLQDIERHYRKSYLKRKYLLSSIQWGDLANIQALPKAWDRISKDEHQDLVQGTGLCSS

SEQ ID NO: 744771 - protein, 317 aa, Homo sapiens
LCGEVAGEHAQRDCGRVVQSLEGSHALAVWTFKFFRFFRKATGSLGQGRQDCMSEKRRRLDARNPLKQETALSRLPFPRGNQGLLQKAEAGRARWLTPVIPALWKTEAGGSPEKMTQDRPLLAVQEALKKCFPVVEEQQGLWQSALRDCQPLLSSLSNLAEQLQAAQNLRFEDVPALRAFPDLKERLRRKQLVAGDIVLDKLGERLAILLKVRDMVSSHVERVFQIYEQHADTVGIDAVLQPSAVSPSVADMLEWLQDIERHYRKSYLKRKYLLSSIQWGDLANIQALPKAWDRISKDEHQDLVQDILLNVSFFLEE

SEQ ID NO: 744772 - protein, 203 aa, Homo sapiens
MTQDRPLLAVQEALKKCFPVVEEQQGLWQSALRDCQPLLSSLSNLAEQLQAAQNLRFEDVPALRAFPDLKERLRRKQLVAGDIVLDKLGERLAILLKVRDMVSSHVERVFQIYEQHADTVGIDAVLQPSAVSPSVADMLEWLQDIERHYRKSYLKRKYLLSSIQWGDLANIQALPKAWDRISKDEHQDLVQDILLNVSFFLEE

SEQ ID NO: 744773 - protein, 203 aa, Homo sapiens; identical to SEQ ID NO: 744772

SEQ ID NO: 744774 - protein, 226 aa, Homo sapiens
MSEKRRRLDARNPLKQETALSRKMTQDRPLLAVQEALKKCFPVVEEQQGLWQSALRDCQPLLSSLSNLAEQLQAAQNLRFEDVPALRAFPDLKERLRRKQLVAGDIVLDKLGERLAILLKVRDMVSSHVERVFQIYEQHADTVGIDAVLQPSAVSPSVADMLEWLQDIERHYRKSYLKRKYLLSSIQWGDLANIQALPKAWDRISKDEHQDLVQDILLNVSFFLEE

SEQ ID NO: 744775 - protein, 203 aa, Homo sapiens; identical to SEQ ID NO: 744772

SEQ ID NO: 744776 - protein, 136 aa, Homo sapiens
MSEKRRRLDARNPLKQETALSRKMTQDRPLLAVQEALKKCFPVVEEQQGLWQSALRDCQPLLSSLSNLAEQLQAAQNLRFEDVPALRAFPDLKERLRQPSSSRCETWSAAMWSECFRSMSNTQTQLALMLSCSLQQ

SEQ ID NO: 744777 - protein, 317 aa, Homo sapiens; identical to SEQ ID NO: 744771

SEQ ID NO: 744778 - protein, 317 aa, Homo sapiens; identical to SEQ ID NO: 744771

SEQ ID NO: 744779 - protein, 124 aa, Homo sapiens
ITEMTPTLDPVPPRLTWHPNVVIFCFYLFQQKMTQDRPLLAVQEALKKCFPVVEEQQGLWQSALRDCQPLLSSLSNLAEQLQAAQNLRFEDVPALRAFPDLKERLRRKQLVAGDIVLDKLGERL

SEQ ID NO: 744780 - protein, 315 aa, Homo sapiens
MTHQDLSITAKLINGGVAGLVGVTCVFPIDLAKTRLQNQHGKAMYKGMIDCLMKTARAEGFFGMYRGAAVNLTLVTPEKAIKLAANDFFRRLLMEDGMQRNLKMEMLAGCGAGMCQVVVTCPMEMLKIQLQDAGRLAVHHQGSASAPSTSRSYTTGSASTHRRPSATLIAWELLRTQGLAGLYRGLGATLLRDIPFSIIYFPLFANLNNLGFNELAGKASFAHSFVSGCVAGSIAAVAVTPLDVLKTRIQTLKKGLGEDMYSGITDCARKLWIQEGPSAFMKGAGCRALVIAPLFGIAQGVYFIGIGERILKCFD

SEQ ID NO: 744781 - protein, 315 aa, Homo sapiens; identical to SEQ ID NO: 744780

SEQ ID NO: 744782 - protein, 438 aa, Homo sapiens
MNVDSLAGKLSLSSDLNYILGSRKGRGSYRKQMEARCVTQAGVQWCDLGSLQFCLPGEEAAAQGGRHLPGRWLGPGCTQNPCSVHTATGPEPRKLPLLPPDSPNSGYPKEPAALCPGIPSPCRMTHQDLSITAKLINGGVAGLVGVTCVFPIDLAKTRLQNQHGKAMYKGMIDCLMKTARAEGFFGMYRGAAVNLTLVTPEKAIKLAANDFFRRLLMEDGMQRNLKMEMLAGCGAGMCQVVVTCPMEMLKIQLQDAGRLAVHHQGSASAPSTSRSYTTGSASTHRRPSATLIAWELLRTQGLAGLYRGLGATLLRDIPFSIIYFPLFANLNNLGFNELAGKASFAHSFVSGCVAGSIAAVAVTPLDVLKTRIQTLKKGLGEDMYSGITDCARKLWIQEGPSAFMKGAGCRALVIAPLFGIAQGVYFIGIGERILKCFD

SEQ ID NO: 744783 - protein, 315 aa, Homo sapiens; identical to SEQ ID NO: 744780

SEQ ID NO: 744784 - protein, 50 aa, Homo sapiens
ASDALDKIRYESLTDPSKLDSGKELKIDIIPSPFIWRRNKTRKLVMMRQK

SEQ ID NO: 744785 - protein, 320 aa, Homo sapiens
QFRFLSVSQGMRPARHWETRFGARDFGGFQDCFFRDRLMDTARIAVVGAGVVGLSTAVCISKLVPRCSVTIISDKFTPDTTSDVAAGMLIPHTYPDTPIHTQKQWFRETFNHLFAIANSAEAGDAGVHLVSGIKGSGGWTLTRRIEDLWELHPSFDIVVNCSGLGSRQLAGDSKIFPVRGQVLQVQAPWVEHFIRDGSGLTYIYPGTSHVTLGGTRQKGDWNLSPDAENSREILSRCCALEPSLHGACNIREKVGLRPYRPGVRLQTELLARDGQRLPVVHHYGHGSGGISVHWGTALEAARLVSECVHALRTPIPKSNL

SEQ ID NO: 744786 - protein, 379 aa, Homo sapiens
QFRFLSVSQGMRPARHWETRFGARDFGGFQDCFFRDRLMDTARIAVVGAGVVGLSTAVCISKLVPRCSVTIISDKFTPDTTSDVAAGMLIPHTYPDTPIHTQKQWFRETFNHLFAIANSAEAGDAGVHLVSGWQIFQSTPTEEVPFWADVVLGFRKMTEAELKKFPQYVFGQAFTTLKCECPAYLPWLEKRIKGSGGWTLTRRIEDLWELHPSFDIVVNCSGLGSRQLAGDSKIFPVRGQVLQVQAPWVEHFIRDGSGLTYIYPGTSHVTLGGTRQKGDWNLSPDAENSREILSRCCALEPSLHGACNIREKVGLRPYRPGVRLQTELLARDGQRLPVVHHYGHGSGGISVHWGTALEAARLVSECVHALRTPIPKSNL

SEQ ID NO: 744787 - protein, 379 aa, Homo sapiens; identical to SEQ ID NO: 744786

SEQ ID NO: 744788 - protein, 320 aa, Homo sapiens; identical to SEQ ID NO: 744785

SEQ ID NO: 744789 - protein, 55 aa, Homo sapiens
MPIDKSRGSARHGAKRFYAHGLHEMARFTDEETEARRVRNLVLDPIPAEVEDAST

SEQ ID NO: 744790 - protein, 132 aa, Homo sapiens
MDVTRLLLATLLVFLCFFTANSHLPPEEKLRDDRSLRSNSSVNLLDVPSVSIVALNKKSKQIGRKAAEKKRSSKKEASMKKVVRPRTPLSAPCVATRNSCKPPAPACCDPCASCQCRFFRSACSCRVLSLNC

SEQ ID NO: 744791 - protein, 377 aa, Homo sapiens
MLRLVPTGARAIVDMSYARHFLDFQGSAIPQAMQKLVVTRLSPNFREAVTLSRDCPVPLPGDGDLLVRNRFVGVNASDINYSAGRYDPSVKPPFDIGFEGIGEVVALGLSASARYTVGQAVAYMAPGSFAEYTVVPASIATPVPSVKPEYLTLLVSGTTAYISLKELGGLSEGKKVLVTAAAGGTGQFAMQLSKKAKCHVIGTCSSDEKSAFLKSLGCDRPINYKTEPVGTVLKQEYPEGVDVVYESVGGAMFDLAVDALATKGRLIVIGFISGYQTPTGLSPVKAGTLPAKLLKKSASVQGFFLNHYLSKYQAAMSHLLEMCVSGDLVCEVDLGDLSPEGRFTGLESIFRAVNYMYMGKNTGKIVVELPHSVNSKL

SEQ ID NO: 744792 - protein, 278 aa, Homo sapiens
ISSDLTSHDLSASARYTVGQAVAYMAPGSFAEYTVVPASIATPVPSVKPEYLTLLVSGTTAYISLKELGGLSEGKKVLVTAAAGGTGQFAMQLSKKAKCHVIGTCSSDEKSAFLKSLGCDRPINYKTEPVGTVLKQEYPEGVDVVYESVGGAMFDLAVDALATKGRLIVIGFISGYQTPTGLSPVKAGTLPAKLLKKSASVQGFFLNHYLSKYQAAMSHLLEMCVSGDLVCEVDLGDLSPEGRFTGLESIFRAVNYMYMGKNTGKIVVELPHSVNSKL

SEQ ID NO: 744793 - protein, 377 aa, Homo sapiens; identical to SEQ ID NO: 744791

SEQ ID NO: 744794 - protein, 377 aa, Homo sapiens; identical to SEQ ID NO: 744791

SEQ ID NO: 744795 - protein, 377 aa, Homo sapiens; identical to SEQ ID NO: 744791

SEQ ID NO: 744796 - protein, 377 aa, Homo sapiens; identical to SEQ ID NO: 744791

SEQ ID NO: 744797 - protein, 1015 aa, Homo sapiens
EDSLPGVIVTHVSVHDVDLNSAFIFSFAKESNPGTKFAIDQNTGVVVLVKTLDFEEMTEYELLIQISDSVHYTEGALVVRVLDVNDNPPVFSQDFYQVTVPESIPVGYSVLTLSATDLESNENISYRILSSSKEFSIDPKNGTIFTISPVLLLDTISTTQFLVEASDGGNPDLRALTLVEIGIEDMNNYAPEFTVKSYNLSLSEDALVGSTLVTFSNIDHDWTRENTYVEYSIISGNSQNNFHVETKFFHSEYPYKQVGYLVLLHSLDREASASHELVILASDSGCPPLSSTAVISIQVLDVNDNPPNFSSLSYHTHVKESTPLGSHITVVSANDRDTGSHAEIIYNIISGNEKGHFYLEENTGVLYLIKPLDYEKMTKFTLTVQASDAEKKHFSFAVVFVSVLDDNDHAPQFMFSSFSCIVPENLPISSTICSINALDFDAGPYGELTYSIVSPCFLTHGMSYDHDLFLIDPLTGDIHAKQILDYENGNKYCLTVQAKDKGDATASLVVWVDIEGIDEFEPIFTQDQYFFTLPEKNKDRQLIGRVEASDADAGIDGVILYSLGTSSPFFSVNRTNGNIYLIRALPLIKSQLNKEDTLEMKIIAHSPKSDSKFASCTVFVNVSFSSEGTPLAVFASSFSISLVVSFLVFLILICILIVMILRHKQKDTINNYEEKKTSSLDADLRVTRDASVLKAFQKTDDCSNEVVPVDATPEWLSLISIMEKDIVNLYRYSNSSGHCSVEGETAEDKEIQRINEHPYRKCSDSALSDHESRVPDSGIPRDSDQLSCLSGETDVMVTAETAEASQTFGEGDQGEGCSTTCAQNNVLPQTVQKREAKESILADVRKESVFISGDQEVRCAALSTQTTSDHDGKDNYHWNYLLSWEPKFQPLASVFNDIAKLKDEHLHMPGIPKEKKSFVFPPPLITAVAQPGIKAVPPRMPAVNLGQVPPKHPRSPIPYHLGSLPEGMTPNFSPSLSLLTMQPPALSPLLREGELLGTHISGTCHELKAEDEVQI

SEQ ID NO: 744798 - protein, 789 aa, Homo sapiens
LGDLRILVSGNSQNNFHVETKFFHSEYPYKQVGYLVLLHSLDREASASHELVILASDSGCPPLSSTAVISIQVLDVNDNPPNFSSLSYHTHVKESTPLGSHITVVSANDRDTGSHAEIIYNIISGNEKGHFYLEENTGVLYLIKPLDYEKMTKFTLTVQASDAEKKHFSFAVVFVSVLDDNDHAPQFMFSSFSCIVPENLPISSTICSINALDFDAGPYGELTYSIVSPCFLTHGMSYDHDLFLIDPLTGDIHAKQILDYENGNKYCLTVQAKDKGDATASLVVWVDIEGIDEFEPIFTQDQYFFTLPEKNKDRQLIGRVEASDADAGIDGVILYSLGTSSPFFSVNRTNGNIYLIRALPLIKSQLNKEDTLEMKIIAHSPKSDSKFASCTVFVNVSFSSEGTPLAVFASSFSISLVVSFLVFLILICILIVMILRHKQKDTINNYEEKKTSSLDADLRVTRDASVLKAFQKTDDCSNEVVPVDATPEWLSLISIMEKDIVNLYRYSNSSGHCSVEGETAEDKEIQRINEHPYRKCSDSALSDHESRVPDSGIPRDSDQLSCLSGETDVMVTAETAEASQTFGEGDQGEGCSTTCAQNNVLPQTVQKREAKESILADVRKESVFISGDQEVRCAALSTQTTSDHDGKDNYHWNYLLSWEPKFQPLASVFNDIAKLKDEHLHMPGIPKEKKSFVFPPPLITAVAQPGIKAVPPRMPAVNLGQVPPKHPRSPIPYHLGSLPEGMTPNFSPSLSLLTMQPPALSPLLREGELLGTHISGTCHELKAEDEVQI

SEQ ID NO: 744799 - protein, 879 aa, Homo sapiens [sequence omitted]

SEQ ID NO: 744800 - protein, 67 aa, Homo sapiens
MAETIQEVEDEYKAFCKSFSKESDDPVACIHFTAEGEVTFKSILFVPTFVPRGLFDEYGSKKSDYIK

SEQ ID NO: 744801 - protein, 503 aa, Homo sapiens
GGERSLLTKMATEAQSEGEVPARESGRSDAICSFVICNDSSLRGQPIIFNPDFFVEKLRHEKPEIFTELVVSNITRLIDLPGTELAQLMGEVDLKLPGGAGPASGFFRSLMSLKRKEKGVIFGSPLTEEGIAQIYQLIEYLHKNLRVEGLFRVPGNSVRQQILRDALNNGTDIDLESGEFHSNDVATLLKMFLGELPEPLLTHKHFNAHLKIADLMQFDDKGNKTNIPDKDRQIEALQLLFLILPPPNRNLLKLLLDLLYQTAKKQDKNKMSAYNLALMFAPHVLWPKNVTANDLQENITKLNSGMAFMIKHSQKLFKAPAYIRECARLHYLGSRTQASKDDLDLIASCHTKSFQLAKSQKRNRVDSCPHQEETQHHTEEALRELFQHVHDMPESAKKKQLIRQFNKQSLTQTPGREPSTSQVQKRARSRSFSGLIKRKVLGNQMMSEKKKKNPTPESVAIGELKGTSKENRNLLFSGSPAVTMTPTRLKWSEGKKEGKKGFL

SEQ ID NO: 744802 - protein, 430 aa, Homo sapiens
GGERSLLTKMATEAQSEGEVPARESGRSDAICSFVICNDSSLREKGVIFGSPLTEEGIAQIYQLIEYLHKNLRVEGLFRVPGNSVRQQILRDALNNGTDIDLESGEFHSNDVATLLKMFLGELPEPLLTHKHFNAHLKIADLMQFDDKGNKTNIPDKDRQIEALQLLFLILPPPNRNLLKLLLDLLYQTAKKQDKNKMSAYNLALMFAPHVLWPKNVTANDLQENITKLNSGMAFMIKHSQKLFKAPAYIRECARLHYLGSRTQASKDDLDLIASCHTKSFQLAKSQKRNRVDSCPHQEETQHHTEEALRELFQHVHDMPESAKKKQLIRQFNKQSLTQTPGREPSTSQVQKRARSRSFSGLIKRKVLGNQMMSEKKKKNPTPESVAIGELKGTSKENRNLLFSGSPAVTMTPTRLKWSEGKKEGKKGFL

SEQ ID NO: 744803 - protein, 503 aa, Homo sapiens; identical to SEQ ID NO: 744801

SEQ ID NO: 744804 - protein, 503 aa, Homo sapiens; identical to SEQ ID NO: 744801

SEQ ID NO: 744805 - protein, 411 aa, Homo sapiens
GGERSLLTKMATEAQSEGEVPARESGRSDAICSFVICNDSSLRGQPIIFNPDFFVEKLRHEKPEIFTELVVSNITRLIDLPGTELAQLMGEVDLKLPGGAGPASGFFRSLMSLKRKEKGVIFGSPLTEEGIAQIYQLIEYLHKNLRVEGLFRVPGNSVRQQILRDALNNGTDIDLESGEFHSNDVATLLKMFLGELPEPLLTHKHFNAHLKIADLMQFDDKGNKTNIPDKDRQIEALQLLFLILPPPNRNLLKLLLDLLYQTAKKQDKNKMSAYNLALMFAPHVLWPKNVTANDLQENITKLNSGMAFMIKHSQKLFKAPAYIRECARLHYLGSRTQASKDDLDLIASCHTKSFQLAKSQKRNRVDSCPHQEETQHHTEEALRELFQHVHDMPEFLTHKAPSHNKCYGTKK

SEQ ID NO: 744806 - protein, 73 aa, Homo sapiens
LLRSCLSSGQLGTSCLPLSVLEGTRPFALACVVLKLCFSGTSSSKPRTSRPAPSEQPRLASSPLSRLTPLPSL

SEQ ID NO: 744807 - protein, 73 aa, Homo sapiens; identical to SEQ ID NO: 744806

SEQ ID NO: 744808 - protein, 122 aa, Homo sapiens
MEFTTSPAAPATAQRLDETVWKHGCHLSRCLPSRYRNVGLGTGAPTLKRGEAMERTRGALIQQFTVPWSSPAAPHLHLDSSPGICLAPLCSQSNPTVFPQSQALLSLTADPSPECPEILCKE

SEQ ID NO: 744809 - protein, 110 aa, Homo sapiens
LPCCILPHPSPSSQKSLDLTPRGCPKGLLRTFKELVKLGLNTEVTNSSCYLLNTYYVLGTELFTCVFFLRANYSPKRKVLLPAFHRKGNPASKSWSQLLKYTWLTGKGRI

SEQ ID NO: 744810 - protein, 97 aa, Homo sapiens
PSPANPLSPVSRAVPHSSYSRPVTHICPSPVSHAAPAPASDLHLSLSCLPRCPLQLLLQASDLHRIICLHISLVLHSTTGFPGVFRSLFWALSLAHA

SEQ ID NO: 744811 - protein, 123 aa, Homo sapiens
PWEKLLFRQFPTTLWDRQEQQCPQFYDIWPLLCWSLSGSRNVAGWASPSHPGGSRHIWMTYCPRTCSKSLKPASPPTLGCQPQLSTRLWGQLHSFSKVFWGPSRHQGTGLSHHGHAPGLEMVW

SEQ ID NO: 744812 - protein, 83 aa, Homo sapiens
ANDQGMIHCPDRASSPARESKQHTSDHLAILWKLLLPPPAMSSDAPGSFNLKTQSSCSSCFVSFCGEFSLLPISRNWVHAVRQ

SEQ ID NO: 744813 - protein, 130 aa, Homo sapiens
MSKAELITLAPPPFSSSCIPVLCEQHRHLPCGLDVNPETSSLCWILQRAQKKHRLGTPRKQTQSAKKLFQKCVVTYTHVYSSTICNCKNVEPTQMPINQRVDKETVVCVCVCVCIHTYIYIYIYDGILLS

SEQ ID NO: 744814 - protein, 125 aa, Homo sapiens
GKSQEFLPPAQPGPLKEVISTELTNPIPLPLPPPHSLWFQPAKPPPRPRQGQAQEKSKTGQVHSRRREAPSPDFPPGAPGLGWTEVGPSPGRPPSQLQEKQRWGPNFLPGAPGWGDTEVSGEGQR

SEQ ID NO: 744815 - protein, 284 aa, Homo sapiens
MEPGMLGPHNLPHHEPISFGIDQILSGPETPGGGLGLGRGGQGHGENGAFSGGYHGASGYGPAGSLAPLPGSSGVGPGGVIRVPAHRPLPVPPPAGGAPAVPGPSGLGGAGGLAGLTFPWMDSGRRFAKDRLTAALSPFSGTRRIGHPYQNRTPPKRKKPRTSFSRSQVLELERRFLRQKYLASAERAALAKALRMTDAQVKTWFQNRRTKWRRQTAEEREAERHRAGRLLLHLQQDALPRPLRPPLPPDPLCLHNSSLFALQNLQPWAEDNKVASVSGLASVV

SEQ ID NO: 744816 - protein, 235 aa, Homo sapiens
MEARCALALLWDAPHRPPLPKPDPSEAEEAAHVLLPLTGAGVGAALPAPEVPGLCGEGGAGQGLAHDRRTGQNVVPEPTHQVAAPDGGGARGRAAPRGPAAPASAAGRVATAAAAAAAPGPSLPAQLVALRAAEPAALGRGQQSGFSVRARLGGVSDARPIGVERRARSGGARGCLRPWSSGSRAREERQALRLSSRAPPPPAGSQASVAQMHGQLRGGLSRHFSLHCRYALAGT

SEQ ID NO: 744817 - protein, 137 aa, Homo sapiens [sequence omitted]

SEQ ID NO: 744818 - protein, 179 aa, Homo sapiens
MAATEPILAATGSPAAVPPEKLEGAGSSSAPERNCVGSSLPEASPPAPEPSSPNAAVPEAIPTPRAAASAALELPLGPAPVSVAPQAEAEARSTPGPAGSRLGPETFRQRFRQFRYQDAAGPREAFRQLRELSRQWLRPDIRTKEQIVEMLVQEQLLAILPEAARARRIRRRTDVRITG

SEQ ID NO: 744819 - protein, 179 aa, Homo sapiens; identical to SEQ ID NO: 744818

SEQ ID NO: 744820 - protein, 179 aa, Homo sapiens; identical to SEQ ID NO: 744818

SEQ ID NO: 744821 - protein, 179 aa, Homo sapiens; identical to SEQ ID NO: 744818

SEQ ID NO: 744822 - protein, 179 aa, Homo sapiens; identical to SEQ ID NO: 744818

SEQ ID NO: 744823 - protein, 179 aa, Homo sapiens; identical to SEQ ID NO: 744818

SEQ ID NO: 744824 - protein, 179 aa, Homo sapiens
MAATEPILAATGSPAAVPPEKLEGAGSSSAPERNCVGSSLPEASPPAPEPSSPNAAVPEAIPTPRAAASAALELPLGPAPVSVAPQAEAEARSTPGPAGSRLGPETFRQRFRQFRYQDAAGPREAFRQLRELSRQWLRPDIRTKEQIVEMLVQEQLLIIGTELLYTEGLTVALRLAYLR

SEQ ID NO: 744825 - protein, 104 aa, Homo sapiens
MIGPGGLSLGPHPVLMKNEFWQQKKNNKPFLINSLHNNHNHITTYNSIQFNRAGFYISGLGKLCYSPLNSLGLITLSFASALRSGPHSSPFNNSVTLLQLAILS

SEQ ID NO: 744826 - protein, 216 aa, Homo sapiens
MVEAVLSDEGLPQALRWCRRSAEHTATGQRVTPGAGVMAATEPILAATGSPAAVPPEKLEGAGSSSAPERNCVGSSLPEASPPAPEPSSPNAAVPEAIPTPRAAASAALELPLGPAPVSVAPQAEAEARSTPGPAGSRLGPETFRQRFRQFRYQDAAGPREAFRQLRELSRQWLRPDIRTKEQIVEMLVQEQLLAILPEAARARRIRRRTDVRITG

SEQ ID NO: 744827 - protein, 179 aa, Homo sapiens; identical to SEQ ID NO: 744818

SEQ ID NO: 744828 - protein, 179 aa, Homo sapiens; identical to SEQ ID NO: 744818

SEQ ID NO: 744829 - protein, 179 aa, Homo sapiens; identical to SEQ ID NO: 744818

SEQ ID NO: 744830 - protein, 123 aa, Homo sapiens
MAATEPILAATGSPAAVPPEKLEGAGSSSAPERNCVGSSLPEASPPAPEPSSPNAAVPEAIPTPRAAASAALELPLGPAPVSVAPQAEAEARSTPGPAGSRLGPETFRQRFRQFRRTDVRITG

SEQ ID NO: 744831 - protein, 108 aa, Homo sapiens
MAATEPILAATGSPAAVPPEKLEGAGSSSAPERNCVGSSLPEASPPAPEPSSPNAAVPEAIPTPRAAASAALELPLGPAPVSVAPQAEAEARSTPGPAGSRTDVRITG

SEQ ID NO: 744832 - protein, 110 aa, Homo sapiens
MAPSILGSQEAPTGANLLYLGHRTQSIPRPGAVERKPSVRICCRGLHAPTGKSLRTSCLFPAARSERRKWKYQVGICESPIPVMCYMGVVNRLTSFSSLACLLLQYLVCY

SEQ ID NO: 744833 - protein, 147 aa, Homo sapiens
MCLQAFVEAFFFLAQRKFKMLPLHEQVASLIDLCEYHLSLLDEKRLEAPTGANLLYLGHRTQSIPRPGAVERKPSVRICCRGLHAPTGKSLRTSCLFPAARSERRKWKYQVGICESPIPVMCYMGVVNRLTSFSSLACLLLQYLVCY

SEQ ID NO: 744834 - protein, 130 aa, Homo sapiens
SECKAILAQWEEFQIEDPFGNNAFFEHLPVMQYAPGRRLAYSHALTAPLCLSETALICPTSHASLSSPFAALGRWIIFCPPVALPLGPGSTLACLSSSLLLSTSLSPSSPGGPLAGLAHLKPFLPKLSCM

SEQ ID NO: 744835 - protein, 549 aa, Homo sapiens [sequence omitted]

SEQ ID NO: 744836 - protein, 673 aa, Homo sapiens
MDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNTEEMKLKNPGRYQIMKEKGKKSSEHIQRIDRDVSGTLRKHIFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLGLTLRLWDVYLVEGEQALMPITRIAFKVQQSKSTCAQRGLGSPGVRPRLARGQLPHTVLMILCSGPEGGLAQVGWAGHCDTEPIPHMTQMKVESVVSTSLSGSPPSHSLLCISGHLGWPQKDPAPPSRRLKWPRGMSCDQFPGNSPGLISTLSLERLTKTSRCGPWARFCNRFVDTWARDEDTVLKHLRASMKKLTRKKGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQQCAPTSGPCLCGLHLESSQFPPGF

SEQ ID NO: 744837 - protein, 415 aa, Homo sapiens
CRSTHSSDPLYIRDVSGTLRKHIFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKKGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQQCAPTSGPCLCGLHLESSQFPPGF

SEQ ID NO: 744838 - protein, 426 aa, Homo sapiens
MDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNTEEMKLKNPGRYQIMKEKGKKSSEHIQRIDRDVSGTLRKHIFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLGLTLRLWDVYLVEGEQALMPITRIAFKVQQSKSTCAQRGLGSPGVRPRLARGQLPHTVLMILCSGPEGGLAQVGWAGHCDTEPIPHMTQMKVESVVSTSLSGSPPSHSLLCISGHLGWPQKDPAPPSRRLKWPRGMSCDHSQVTPLA

SEQ ID NO: 744839 - protein, 293 aa, Homo sapiens
MDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNTEEMKLKNPGRYQIMKEKGKKSSEHIQRIDRDVSGTLRKHIFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLLRAMGVWYVYALSA

SEQ ID NO: 744840 - protein, 122 aa, Homo sapiens
DKKDLCGQCSPLGCLIRILIDGVRRHRETLAQGPSLPCSALLPQPGGLAHSQPTGGSGGSPKDTQAKPSAQGGSSQGHGWGSGPASWADWARTRLERAQGSLKPWASPSLQEPHPHSNECPP

SEQ ID NO: 744841 - protein, 434 aa, Homo sapiens
MTSPRDPLWRLKPQCAQLEPPAPAWKDQVLSHLLSPQISLGLTLRLWDVYLVEGEQALMPITRIAFKVQQSKSTCAQRGLGSPGVRPRLARGQLPHTVLMILCSGPEGGSGQVGWAGHCDTEPIPHMTQMKVESVVSTSLSGSPPSHSLLCISGHLGWPQKDPAPPSRRLKWPRGMSCDQFPGNSPGLISTLSLERLTKTSRCGPWARFCNRFVDTWARDEDTVLKHLRASMKKLTRKKGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQQCAPTSGPCLCGLHLESSQFPPGF

SEQ ID NO: 744842 - protein, 370 aa, Homo sapiens
ILGSLNLKQRELLHISLAYDGVYTREVGYCRDLSHIAALFLLYLPEEDAFWALVQLLASERHSLQGFHSPNGGTVQGLQDQQEHVVATSQPKTMGHQISLGLTLRLWDVYLVEGEQALMPITRIAFKVQQKRLTKTSRCGPWARFCNRFVDTWARDEDTVLKHLRASMKKLTRKKGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQQCAPTSGPCLCGLHLESSQFPPGF

SEQ ID NO: 744843 - protein, 295 aa, Homo sapiens
MDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNTEEMKLKNPGRYQIMKEKGKKSSEHIQRIDRDVSGTLRKHIFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQISLGLTLRLWDVYLVEGEQALMPITRIAFKVQQKRLTKTSR

SEQ ID NO: 744844 - protein, 110 aa, Homo sapiens
DVPSESRAEGILRECPDAQGSGTAMGFTCTGTPGPILTAATPTLLPMEIPELYRIPCFMKRGRRGSSPQVAQPHGQPGFEPWTTCFPHTQGLSRGCLEGEGSRCLVGEPP

SEQ ID NO: 744845 - protein, 136 aa, Homo sapiens
TRAAESPLKGQVTSRPALGTVCRKTGVRLGLKMKHILKFTDLCHRMLGEVQLIHAFLGSCLKPITLLSSHSSARFSSTRAAKSPLKGQATLTPALGTVCRSQCRPAPHPEGDAIRVRTAQRLNGPITREEPGGYSI

SEQ ID NO: 744846 - protein, 168 aa, Homo sapiens
PGMSDLLQFVAKQGACFEVILISDANTFGVESSLRAAGHHSLFRRILSNPSGPDARGLLALRPFHTHSCARCPANMCKHKVLSDYLRERAHDGVHFERLFYVGDGANDFCPMGLLAGGDVAFPRRGYPMHRLIQEAQKAEPSSFRASVVPWETAADVRLHLQQVLKSC

SEQ ID NO: 744847 - protein, 71 aa, Homo sapiens
LWLRWDMLLSHAGESTYWRCPPAKPQEQRAVTVGNAAGTRAGRKETEEKGHLPPLALLAPSEPTVGQAGKG

SEQ ID NO: 744848 - protein, 71 aa, Homo sapiens; identical to SEQ ID NO: 744847

SEQ ID NO: 744849 - protein, 79 aa, Homo sapiens
AAVIRSGCLLPDTKAYGDRIERMPCLSLNTPDAKVEEPDEEPEETAEDKEQDKDKEMDVGTDEEKQETAKESTAEKDEL

SEQ ID NO: 744850 - protein, 300 aa, Homo sapiens
KLGTRLGFKSAEPGTAKSQFLKYIEKVSSRAIFTTGQGASAVGLTAYVQRHPVSREWTLEAGALVLADRGVCLIDEFDKMNDQDRTSIHEAMEQQSISISKAGIVTSLQARCTVIAAANPIGGRYDPSLTFSENVDLTEPIISRFDILCVVRDTVDPVQDEMLARFVVGSHVRHHPSNKEEEGLANGSAAEPAMPNTYGVEPLPQEVLKKYIIYAKERVHPKLNQMDQDKVAKMYSDLRKESMATGSIPITVRHIESMIRMAEAHARIHLRDYVIEDDVNMAIRVMLESFIDTQKFSVMR

SEQ ID NO: 744851 - protein, 721 aa, Homo sapiens
MNRPSLDDEDVEELTASQREAAERAMRQRDREAGRGLGRMRRGLLYDSDEEDEERPARKRRQVERATEDGEEDEEMIESIENLEDLKGHSVREWVSMAGPRLEIHHRFKNFLRTHVDSHGHNVFKERISDMCKENRESLVVNYEDLAAREHVLAYFLPEAPAELLQIFDEAALEVVLAMYPKYDRITNHIHVRISHLPLVEELRSLRQLHLNQLIRTSGVVTSCTGVLPQLSMVKYNCNKCNFVLGPFCQSQNQEVKPGSCPECQSAGPFEVNMEETIYQNYQRIRIQESPGKVAAGRLPRSKDAILLADLVDSCKPGDEIELTGIYHNNYDGSLNTANGFPVFATVILANHVAKKDNKVAVGELTDEDVKMITSLSKDQQIGEKIFASIAPSIYGHEDIKRGLALALFGGEPKNPGGKHKVRGDINVLLCGDPGTAKSQFLKYIEKVSSRAIFTTGQGASAVGLTAYVQRHPVSREWTLEAGALVLADRGVCLIDEFDKMNDQDRTSIHEAMEQQSISISKAGIVTSLQARCTVIAAANPIGGRYDPSLTFSENVDLTEPIISRFDILCVVRDTVDPVQDEMLARFVVGSHVRHHPSNKEEEGLANGSAAEPAMPNTYGVEPLPQEVLKKYIIYAKERVHPKLNQMDQDKVAKMYSDLRKESMATGSIPITVRHIESMIRMAEAHARIHLRDYVIEDDVNMAIRVMLESFIDTQKFSVMR

SEQ ID NO: 744852 - protein, 606 aa, Homo sapiens
VSKIRSYGLPKSASANVQENRESLVVNYEDLAAREHVLAYFLPEAPAELLQIFDEAALEVVLAMYPKYDRITNHIHVRISHLPLVEELRSLRQLHLNQLIRTSGVVTSCTGVLPQLSMVKYNCNKCNFVLGPFCQSQNQEVKPGSCPECQSAGPFEVNMEETIYQNYQRIRIQESPGKVAAGRLPRSKDAILLADLVDSCKPGDEIELTGIYHNNYDGSLNTANGFPVFATVILANHVAKKDNKVAVGELTDEDVKMITSLSKDQQIGEKIFASIAPSIYGHEDIKRGLALALFGGEPKNPGGKHKVRGDINVLLCGDPGTAKSQFLKYIEKVSSRAIFTTGQGASAVGLTAYVQRHPVSREWTLEAGALVLADRGVCLIDEFDKMNDQDRTSIHEAMEQQSISISKAGIVTSLQARCTVIAAANPIGGRYDPSLTFSENVDLTEPIISRFDILCVVRDTVDPVQDEMLARFVVGSHVRHHPSNKEEEGLANGSAAEPAMPNTYGVEPLPQEVLKKYIIYAKERVHPKLNQMDQDKVAKMYSDLRKESMATGSIPITVRHIESMIRMAEAHARIHLRDYVIEDDVNMAIRVMLESFIDTQKFSVMR

SEQ ID NO: 744853 - protein, 396 aa, Homo sapiens
YGWVRGWVCAHTANGFPVFATVILANHVAKKDNKVAVGELTDEDVKMITSLSKDQQIGEKIFASIAPSIYGHEDIKRGLALALFGGEPKNPGGKHKVRGDINVLLCGDPGTAKSQFLKYIEKVSSRAIFTTGQGASAVGLTAYVQRHPVSREWTLEAGALVLADRGVCLIDEFDKMNDQDRTSIHEAMEQQSISISKAGIVTSLQARCTVIAAANPIGGRYDPSLTFSENVDLTEPIISRFDILCVVRDTVDPVQDEMLARFVVGSHVRHHPSNKEEEGLANGSAAEPAMPNTYGVEPLPQEVLKKYIIYAKERVHPKLNQMDQDKVAKMYSDLRKESMATGSIPITVRHIESMIRMAEAHARIHLRDYVIEDDVNMAIRVMLESFIDTQKFSVMR

SEQ ID NO: 744854 - protein, 432 aa, Homo sapiens
SWSVILGKAFLKYVKIRGSDEGSSKLQSSVTLGKSQLMKSFRVGHGLIPGPDAVAAAVEVGVFELGMSWFPDASSMWVTYSVSICSHSCRSPSLSQIFASIAPSIYGHEDIKRGLALALFGGEPKNPGGKHKVRGDINVLLCGDPGTAKSQFLKYIEKVSSRAIFTTGQGASAVGLTAYVQRHPVSREWTLEAGALVLADRGVCLIDEFDKMNDQDRTSIHEAMEQQSISISKAGIVTSLQARCTVIAAANPIGGRYDPSLTFSENVDLTEPIISRFDILCVVRDTVDPVQDEMLARFVVGSHVRHHPSNKEEEGLANGSAAEPAMPNTYGVEPLPQEVLKKYIIYAKERVHPKLNQMDQDKVAKMYSDLRKESMATGSIPITVRHIESMIRMAEAHARIHLRDYVIEDDVNMAIRVMLGELHRHTEVQRHA

SEQ ID NO: 744855 - protein, 812 aa, Homo sapiens
MAESSESFTMASSPAQRRRGNDPLTSSPGRSSRRTDALTSSPGRDLPPFEDESEGLLGTEGPLEEEEDGEELIGDGMERDYRAIPELDAYEAEGLALDDEDVEELTASQREAAERAMRQRDREAGRGLGRMRRGLLYDSDEEDEERPARKRRQVERATEDGEEDEEMIESIENLEDLKGHSVREWVSMAGPRLEIHHRFKNFLRTHVDSHGHNVFKERISDMCKENRESLVVNYEDLAAREHVLAYFLPEAPAELLQIFDEAALEVVLAMYPKYDRITNHIHVRISHLPLVEELRSLRQLHLNQLIRTSGVVTSCTGVLPQLSMVKYNCNKCNFVLGPFCQSQNQEVKPGSCPECQSAGPFEVNMEETIYQNYQRIRIQESPGKVAAGRLPRSKDAILLADLVDSCKPGDEIELTGIYHNNYDGSLNTANGFPVFATVILANHVAKKDNKVAVGELTDEDVKMITSLSKDQQIGEKIFASIAPSIYGHEDIKRGLALALFGGEPKNPGGKHKVRGDINVLLCGDPGTAKSQFLKYIEKVSSRAIFTTGQGASAVGLTAYVQRHPVSREWTLEAGALVLADRGVCLIDEFDKMNDQDRTSIHEAMEQQSISISKAGIVTSLQARCTVIAAANPIGGRYDPSLTFSENVDLTEPIISRFDILCVVRDTVDPVQDEMLARFVVGSHVRHHPSNKEEEGLANGSAAEPAMPNTYGVEPLPQEVLKKYIIYAKERVHPKLNQMDQDKVAKMYSDLRKESMATGSIPITVRHIESMIRMAEAHARIHLRDYVIEDDVNMAIRVMLESFIDTQKFSVMR

SEQ ID NO: 744856 - protein, 672 aa, Homo sapiens
MAESSESFTMASSPAQRRRGNDPLTSSPGRSSRRTDALTSSPGRDLPPFEDESEGLLGTEGPLEEEEDGEELIGDGMERDYRAIPELDAYEAEGLALDDEDVEELTASQREAAERAMRQRDREAGRGLGRMRRGLLYDSDEEDEERPARKRRQVERATEDGEEDEEMIESIENLEDLKGHSVREWVSMAGPRLEIHHRFKNFLRTHVDSHGHNVFKERISDMCKENRESLVVNYEDLAAREHVLAYFLPEAPAELLQIFDEAALEVVLAMYPKYDRITNHIHVRISHLPLVEELRSLRQLHLNQLIRTSGVVTSCTGVLPQLSMVKYNCNKCNFVLGPFCQSQNQEVKPGSCPECQSAGPFEVNMEETIYQNYQRIRIQESPGKVAAGRLPRSKDAILLADLVDSCKPGDEIELTGIYHNNYDGSLNTANGFPVFATVILANHVAKKDNKVAVGELTDEDVKMITSLSKDQQIGEKIFASIAPSIYGHEDIKRGLALALFGGEPKNPGGKHKVRGDINVLLCGDPGTAKSQFLKYIEKVSSRAIFTTGQGASAVGLTAYVQRHPVSREWTLEAGALVLADRGVCLIDEFDKMNDQDRTSIHEAMEQQSISISKAGIVTSLQARCTVIAAANPIGGRYDPSLTFSENVDLTEPIISRFDILCVVRDTVDPVQV

SEQ ID NO: 744857 - protein, 367 aa, Homo sapiens
KLGEVEAWCESADEDVKMITSLSKDQQIGEKIFASIAPSIYGHEDIKRGLALALFGGEPKNPGGKHKVRGDINVLLCGDPGTAKSQFLKYIEKVSSRAIFTTGQGASAVGLTAYVQRHPVSREWTLEAGALVLADRGVCLIDEFDKMNDQDRTSIHEAMEQQSISISKAGIVTSLQARCTVIAAANPIGGRYDPSLTFSENVDLTEPIISRFDILCVVRDTVDPVQDEMLARFVVGSHVRHHPSNKEEEGLANGSAAEPAMPNTYGVEPLPQEVLKKYIIYAKERVHPKLNQMDQDKVAKMYSDLRKESMATGSIPITVRHIESMIRMAEAHARIHLRDYVIEDDVNMAIRVMLESFIDTQKFSVMR

SEQ ID NO: 744858 - protein, 289 aa, Homo sapiens
VGLPHLLYPQMKLWGESAQTSLSTSDKEEASDVEISLESDSDDSVVIVPEGLPGGTDRGVSRIDEFDKMNDQDRTSIHEAMEQQSISISKAGIVTSLQARCTVIAAANPIGGRYDPSLTFSENVDLTEPIISRFDILCVVRDTVDPVQDEMLARFVVGSHVRHHPSNKEEEGLANGSAAEPAMPNTYGVEPLPQEVLKKYIIYAKERVHPKLNQMDQDKVAKMYSDLRKESMATGSIPITVRHIESMIRMAEAHARIHLRDYVIEDDVNMAIRVMLESFIDTQKFSVMR

SEQ ID NO: 744859 - protein, 1137 aa, Homo sapiens
GAAPTSDMAHAGGGSGGSGAGGPAGRGLSGARWGRSGSAGHEKLPVHVEDALTYLDQVKIRFGSDPATYNGFLEIMKEFKSQSIDTPGVIRRVSQLFHEHPDLIVGFNAFLPLGYRIDIPKNGKLNIQSPLTSQENSHNHGDGAEDFKQQVPYKEDKPQVPLESDSVEFNNAISYVNKIKTRFLDHPEIYRSFLEILHTYQKEQLNTRGRPFRGMSEEEVFTEVANLFRGQEDLLSEFGQFLPEAKRSLFTGNGPCEMHSVQKNEHDKTPEHSRKRSRPSLLRPVSAPAKKKMKLRGTKDLSIAAVGKYGTLQEFSFFDKVRRVLKSQEVYENFLRCIALFNQELVSGSELLQLVSPFLGKFPELFAQFKSFLGVKELSFAPPMSDRSGDGISREIDYASCKRIGSSYRALPKTYQQPKCSGRTAICKEVLNDTWVSFPSWSEDSTFVSSKKTPYEEQLHRCEDERFELDVVLETNLATIRVLESVQKKLSRMAPEDQEKFRLDDSLGGTSEVIQRRAIYRIYGDKAPEIIESLKKNPVTAVPVVLKRLKAKEEEWREAQQGFNKIWREQYEKAYLKSLDHQAVNFKQNDTKALRSKSLLNEIESVYDEHQEQHSEGRSAPSSEPHLIFVYEDRQILEDAAALISYYVKRQPAIQKEDQGTIHQLLHQFVPSLFFSQQLDLGASEESADEDRDSPQGQTTDPSERKKPAPGPHSSPPEEKGAFGDAPATEQPPLPPPAPHKPLDDVYSLFFANNNWYFFLRLHQTLCSRLLKIYRQAQKQLLEYRTEKEREKLLCEGRREKGSDPAMELRLKQPSEVELEEYYPAFLDMVRSLLEGSIDPTQYEDTLREMFTIHAYVGFTMDKLVQNIARQLHHLVSDDVCLKVVELYLNEKKRGAAGGNLSSRCVRAARETSYQWKAERCMADENCFKVMFLQRKGQVIMTIELLDTEEAQTEDPVEVQHLARYVEQYVGTEGASSSPTEGFLLKPVFLQRNLKKFRRRWQSEQARALRGEARSSWKRLVGVESACDVDCRFKLSTHKMVFIVNSEDYMYRRGTLCRAKQVQPLVLLRHHQHFEEWHSRWLEDNVTVEAASLVQDWLMGEEDEDMVPCKTLCETVHVHGLPVTRYRVQYSRRPASP

SEQ ID NO: 744860 - protein, 674 aa, Homo sapiens
GAAPTSDMAHAGGGSGGSGAGGPAGRGLSGARWGRSGSAGHEKLPVHVEDALTYLDQVKIRFGSDPATYNGFLEIMKEFKSQSIDTPGVIRRVSQLFHEHPDLIVGFNAFLPLGYRIDIPKNGKLNIQSPLTSQENSHNHGDGAEDFKQQVPYKEDKPQVPLESDSVEFNNAISYVNKIKTRFLDHPEIYRSFLEILHTYQKEQLNTRGRPFRGMSEEEVFTEVANLFRGQEDLLSEFGQFLPEAKRSLFTGNGPCEMHSVQKNEHDKTPEHSRKRSRPSLLRPVSAPAKNNWYFFLRLHQTLCSRLLKIYRQAQKQLLEYRTEKEREKLLCEGRREKGSDPAMELRLKQPSEVELEEYYPAFLDMVRSLLEGSIDPTQYEDTLREMFTIHAYVGFTMDKLVQNIARQLHHLVSDDVCLKVVELYLNEKKRGAAGGNLSSRCVRAARETSYQWKAERCMADENCFKVMFLQRKGQVIMTIELLDTEEAQTEDPVEVQHLARYVEQYVGTEGASSSPTEGFLLKPVFLQRNLKKFRRRWQSEQARALRGEARSSWKRLVGVESACDVDCRFKLSTHKMVFIVNSEDYMYRRGTLCRAKQVQPLVLLRHHQHFEEWHSRWLEDNVTVEAASLVQDWLMGEEDEDMVPCKTLCETVHVHGLPVTRYRVQYSRRPASP

SEQ ID NO: 744861 - protein, 379 aa, Homo sapiens
EEPPGPSSQSQFLRGQMFPAHLPHPGDSEALTRVCPQGGHWGLQLPAPANRSSVCAHYSARPTPFISWGYHHNDHKPRGFKQQKSIPSTSWRSAVHNHSVGRAVLLPKALGRILPALPASGGFWRSSAVAWLCESLLSLGPLSRAIVCWGLRQGSESSAAALLMLWQWGAQNPCELLNSESRVRVAIALLWGITGCVSPCPQHLARYVEQYVGTEGASSSPTEGFLLKPVFLQRNLKKFRRRWQSEQARALRGEARSSWKRLVGVESACDVDCRFKLSTHKMVFIVNSEDYMYRRGTLCRAKQVQPLVLLRHHQHFEEWHSRWLEDNVTVEAASLVQDWLMGEEDEDMVPCKTLCETVHVHGLPVTRYRVQYSRRPASP

SEQ ID NO: 744862 - protein, 1137 aa, Homo sapiens; identical to SEQ ID NO: 744859

SEQ ID NO: 744863 - protein, 1137 aa, Homo sapiens; identical to SEQ ID NO: 744859

SEQ ID NO: 744864 - protein, 360 aa, Homo sapiens
GAAPTSDMAHAGGGSGGSGAGGPAGRGLSGARWGRSGSAGHEKLPVHVEDALTYLDQVKIRFGSDPATYNGFLEIMKEFKSQSIDTPGVIRRVSQLFHEHPDLIVGFNAFLPLGYRIDIPKNGKLNIQSPLTSQENSHNHGDGAEDFKQQVPYKEDKPQVPLESDSVEFNNAISYVNKIKTRFLDHPEIYRSFLEILHTYQKEQLNTRGRPFRGMSEEEVFTEVANLFRGQEDLLSEFGQFLPEAKRSLFTGNGPCEMHSVQKNEHDKTPEHSRKRSRPSLLRPVSAPAKKKMKLRGTKDLSIAAVGKYGTLQEFSFFDKVRRVLKSQEVYENFLRCIALFNQELVSGSELLQLVSPFLG

SEQ ID NO: 744865 - protein, 296 aa, Homo sapiens
GAAPTSDMAHAGGGSGGSGAGGPAGRGLSGARWGRSGSAGHEKLPVHVEDALTYLDQVKIRFGSDPATYNGFLEIMKEFKSQSIDTPGVIRRVSQLFHEHPDLIVGFNAFLPLGYRIDIPKNGKLNIQSPLTSQENSHNHGDGAEDFKQQVPYKEDKPQVPLESDSVEFNNAISYVNKIKTRFLDHPEIYRSFLEILHTYQKEQLNTRGRPFRGMSEEEVFTEVANLFRGQEDLLSEFGQFLPEAKRSLFTGNGPCEMHSVQKNEHDKTPMLTRPPGLPTPAPQVSHRHFVHILVF

SEQ ID NO: 744866 - protein, 72 aa, Homo sapiens
MGAFVGALSCQSLACVTLRSPGGIWMRRCVSAGEVELEEYYPAFLDMVRSLLEGSIDPTQYEDTLREMFTIH

SEQ ID NO: 744867 - protein, 1137 aa, Homo sapiens; identical to SEQ ID NO: 744859

SEQ ID NO: 744868 - protein, 775 aa, Homo sapiens
GAAPTSDMAHAGGGSGGSGAGGPAGRGLSGARWGRSGSAGHEKLPVHVEDALTYLDQVKIRFGSDPATYNGFLEIMKEFKSQSIDTPGVIRRVSQLFHEHPDLIVGFNAFLPLGYRIDIPKNGKLNIQSPLTSQENSHNHGDGAEDFKQQVPYKEDKPQVPLESDSVEFNNAISYVNKIKTRFLDHPEIYRSFLEILHTYQKEQLNTRGRPFRGMSEEEVFTEVANLFRGQEDLLSEFGQFLPEAKRSLFTGNGPCEMHSVQKNEHDKTPEHSRKRSRPSLLRPVSAPAKKKMKLRGTKDLSIAAQFVPSLFFSQQLDLGASEESADEDRDSPQGQTTDPSERKKPAPGPHSSPPEEKGAFGDAPATEQPPLPPPAPHKPLDDVYSLFFANNNWYFFLRLHQTLCSRLLKIYRQAQKQLLEYRTEKEREKLLCEGRREKGSDPAMELRLKQPSEVELEEYYPAFLDMVRSLLEGSIDPTQYEDTLREMFTIHAYVGFTMDKLVQNIARQLHHLVSDDVCLKVVELYLNEKKRGAAGGNLSSRCVRAARETSYQWKAERCMADENCFKVMFLQRKGQVIMTIELLDTEEAQTEDPVEVQHLARYVEQYVGTEGASSSPTEGFLLKPVFLQRNLKKFRRRWQSEQARALRGEARSSWKRLVGVESACDVDCRFKLSTHKMVFIVNSEDYMYRRGTLCRAKQVQPLVLLRHHQHFEEWHSRWLEDNVTVEAASLVQDWLMGEEDEDMVPCKTLCETVHVHGLPVTRYRVQYSRRPASP

SEQ ID NO: 744869 - protein, 720 aa, Homo sapiens
MQRHSRHFLLVQVLNDTWVSFPSWSEDSTFVSSKKTPYEEQLHRCEDERFELDVVLETNLATIRVLESVQKKLSRMAPEDQEKFRLDDSLGGTSEVIQRRAIYRIYGDKAPEIIESLKKNPVTAVPVVLKRLKAKEEEWREAQQGFNKIWREQYEKAYLKSLDHQAVNFKQNDTKALRSKSLLNEIESVYDEHQEQHSEGRSAPSSEPHLIFVYEDRQILEDAAALISYYVKRQPAIQKEDQGTIHQLLHQFVPSLFFSQQLDLGASEESADEDRDSPQGQTTDPSERKKPAPGPHSSPPEEKGAFGDAPATEQPPLPPPAPHKPLDDVYSLFFANNNWYFFLRLHQTLCSRLLKIYRQAQKQLLEYRTEKEREKLLCEGRREKGSDPAMELRLKQPSEVELEEYYPAFLDMVRSLLEGSIDPTQYEDTLREMFTIHAYVGFTMDKLVQNIARQLHHLVSDDVCLKVVELYLNEKKRGAAGGNLSSRCVRAARETSYQWKAERCMADENCFKVMFLQRKGQVIMTIELLDTEEAQTEDPVEVQHLARYVEQYVGTEGASSSPTEGFLLKPVFLQRNLKKFRRRWQSEQARALRGEARSSWKRLVGVESACDVDCRFKLSTHKMVFIVNSEDYMYRRGTLCRAKQVQPLVLLRHHQHFEEWHSRWLEDNVTVEAASLVQDWLMGEEDEDMVPCKTLCETVHVHGLPVTRYRVQYSRRPASP

SEQ ID NO: 744870 - protein, 309 aa, Homo sapiens
EEPPGPSSQSQFLRGQMFPAHLPHPGDSEALTRVCPQGGHWGLQLPAPANRSSVCAHYSARPTPFISWGYHHNDHKPRGFKQQKSIPSTSWRSAVHNHSVGGRCSCQRLWGGSFLLFQLPGASGAPQLWPGCHLARYVEQYVGTEGASSSPTEGFLLKPVFLQRNLKKFRRRWQSEQARALRGEARSSWKRLVGVESACDVDCRFKLSTHKMVFIVNSEDYMYRRGTLCRAKQVQPLVLLRHHQHFEEWHSRWLEDNVTVEAASLVQDWLMGEEDEDMVPCKTLCETVHVHGLPVTRYRVQYSRRPASP

SEQ ID NO: 744871 - protein, 360 aa, Homo sapiens; identical to SEQ ID NO: 744864

SEQ ID NO: 744872 - protein, 504 aa, Homo sapiens
GAAPTSDMAHAGGGSGGSGAGGPAGRGLSGARWGRSGSAGHEKLPVHVEDALTYLDQVKIRFGSDPATYNGFLEIMKEFKSQSIDTPGVIRRVSQLFHEHPDLIVGFNAFLPLGYRIDIPKNGKLNIQSPLTSQENSHNHGDGAEDFKQQVPYKEDKPQVPLESDSVEFNNAISYVNKIKTRFLDHPEIYRSFLEILHTYQKEQLNTRGRPFRGMSEEEVFTEVANLFRGQEDLLSEFGQFLPEAKRSLFTGNGPCEMHSVQKNEHDKTPEHSRKRSRPSLLRPVSAPAKKKMKLRGTKDLSIAAVGKYGTLQEFSFFDKVRRVLKSQEVYENFLRCIALFNQELVSGSELLQLVSPFLGKFPELFAQFKSFLGVKELSFAPPMSDRSGDGISREIDYASCKRIGSSYRALPKTYQQPKCSGRTAICKELDHWTLLQGSWTDDYCMSKFKNTCWIPGYSAGVSKLWPTGPGPLPVFVNKVLLSHRHNHSFTYCLWLLFSPQRQS

SEQ ID NO: 744873 - protein, 439 aa, Homo sapiens
GAAPTSDMAHAGGGSGGSGAGGPAGRGLSGARWGRSGSAGHEKLPVHVEDALTYLDQVKIRFGSDPATYNGFLEIMKEFKSQSIDTPGVIRRVSQLFHEHPDLIVGFNAFLPLGYRIDIPKNGKLNIQSPLTSQENSHNHGDGAEDFKQQVPYKEDKPQVPLESDSVEFNNAISYVNKIKTRFLDHPEIYRSFLEILHTYQKEQLNTRGRPFRGMSEEEVFTEVANLFRGQEDLLSEFGQFLPEAKRSLFTGNGPCEMHSVQKNEHDKTPEHSRKRSRPSLLRPVSAPAKKKMKLRGTKDLSIAAVGKYGTLQEFSFFDKVRRVLKSQEVYENFLRCIALFNQELVSGSELLQLVSPFLGKFPELFAQFKSFLGVKELSFAPPMSDRSGDGISREIDYASCKRIGSSYRALPKTYQQPKCSGRTAICKEVALPGAQMFV

SEQ ID NO: 744874 - protein, 99 aa, Homo sapiens
SPQIRPISQWVFPHGAVFRPVRAISSVGGGFTECPVSRVVSRYPRTCVTPSYRSDSSPRLAPHVSLFENTPLFLHSNDDHRLVFYGNHCSLGFITAFIG

SEQ ID NO: 744875 - protein, 528 aa, Homo sapiens
MAEHLELLAEMPMVGRMSTQERLKHAQKRRAQQVKMWAQAEKEAQGKKGPGERPRKEAASQGLLKQVLFPPSVVLLEAAARNDLEEVRQFLGSGVSPDLANEDGLTALHQCCIDDFREMVQQLLEAGANINACDSECWTPLHAAATCGHLHLVELLIASGANLLAVNTDGNMPYDLCDDEQTLDCLETAMADRGITQDSIEAARAVPELRMLDDIRSRLQAGADLHAPLDHGATLLHVAAANGFSEAAALLLEHRASLSAKDQDGWEPLHAAAYWGQVPLVELLVAHGADLNAKSLMDETPLDVCGDEEVRAKLLELKHKHDALLRAQSRQRSLLRRRTSSAGSRGKVVRRVSLTQRTDLYRKQHAQEAIVWQQPPPTSPEPPEDNDDRQTGAELRPPPPEEDNPEVVRPHNGRVGGSPVRHLYSKRLDRSVSYQLSPLDSTTPHTLVHDKAHHTLADLKRQRAAAKLQRPPPEGPESPETAEPGLPGDTVTPQPDCGFRAGGDPPLLKLTAPAVEAPVERRPCCLLM

SEQ ID NO: 744876 - protein, 560 aa, Homo sapiens
MAEHLELLAEMPMVGRMSTQERLKHAQKRRAQQVKMWAQAEKEAQGKKGPGERPRKEAASQGLLKQVLFPPSVVLLEAAARNDLEEVRQFLGSGVSPDLANEDGLTALHQCCIDDFREMVQQLLEAGANINACDSECWTPLHAAATCGHLHLVELLIASGANLLAVNTDGNMPYDLCDDEQTLDCLETAMADRGITQDSIEAARAVPELRMLDDIRSRLQAGADLHAPLDHGATLVRAGGLRGTRGWGPRYLEVGDGAEFRPGACLQLHVAAANGFSEAAALLLEHRASLSAKDQDGWEPLHAAAYWGQVPLVELLVAHGADLNAKSLMDETPLDVCGDEEVRAKLLELKHKHDALLRAQSRQRSLLRRRTSSAGSRGKVVRRVSLTQRTDLYRKQHAQEAIVWQQPPPTSPEPPEDNDDRQTGAELRPPPPEEDNPEVVRPHNGRVGGSPVRHLYSKRLDRSVSYQLSPLDSTTPHTLVHDKAHHTLADLKRQRAAAKLQRPPPEGPESPETAEPGLPGDTVTPQPDCGFRAGGDPPLLKLTAPAVEAPVERRPCCLLM

SEQ ID NO: 744877 - protein, 528 aa, Homo sapiens; identical to SEQ ID NO: 744875

SEQ ID NO: 744878 - protein, 257 aa, Homo sapiens
MAEHLELLAEMPMVGRMSTQERLKHAQKRRAQQVKMWAQAEKEAQGKKGPGERPRKEAASQGLLKQVLFPPSVVLLEAAARNDLEEVRQFLGSGVSPDLANEDGLTALHSAALMISERWCSSSWRLGPTSMPVTVSAGRLCMLRPPAATCTWWSCSSPVAPISWRSTPTGTCPMTCVMMSRRWTAWRLPWPTVASPRTASRPPGPCQNCACWTTSGAGCRPGQTSMPPWTTGPRCCTSQPPTGSARRLPCCWNTEPA

SEQ ID NO: 744879 - protein, 129 aa, Homo sapiens
EFKLGIGQGPSGSNVGGVPGRSWSLQKLTPESINPDDFSCESTTPHTLVHDKAHHTLADLKRQRAAAKLQRPPPEGPESPETAEPGLPGDTVTPQPDCGFRAGGDPPLLKLTAPAVEAPVERRPCCLLM

SEQ ID NO: 744880 - protein, 49 aa, Homo sapiens
SLSSLLPRKVVRRVSLTQRTDLYRKQHAQEAIVWQQPPPTSPEPPEDND

SEQ ID NO: 744881 - protein, 528 aa, Homo sapiens; identical to SEQ ID NO: 744875

SEQ ID NO: 744882 - protein, 528 aa, Homo sapiens; identical to SEQ ID NO: 744875

SEQ ID NO: 744883 - protein, 550 aa, Homo sapiens
MAEHLELLAEMPMVGRMSTQERLKHAQKRRAQQVKMWAQAEKEAQGKKGPGERPRKEAASQGLLKQVLFPPSVVLLEAAARNDLEEVRQFLGSGVSPDLANEDGLTALHQCCIDDFREMVQQLLEAGANINACDSECWTPLHAAATCGHLHLVELLIASGANLLAVNTDGNMPYDLCDDEQTLDCLETAMADRGRCGGAAVGGLPVALPLSLPPPGITQDSIEAARAVPELRMLDDIRSRLQAGADLHAPLDHGATLLHVAAANGFSEAAALLLEHRASLSAKDQDGWEPLHAAAYWGQVPLVELLVAHGADLNAKSLMDETPLDVCGDEEVRAKLLELKHKHDALLRAQSRQRSLLRRRTSSAGSRGKVVRRVSLTQRTDLYRKQHAQEAIVWQQPPPTSPEPPEDNDDRQTGAELRPPPPEEDNPEVVRPHNGRVGGSPVRHLYSKRLDRSVSYQLSPLDSTTPHTLVHDKAHHTLADLKRQRAAAKLQRPPPEGPESPETAEPGLPGDTVTPQPDCGFRAGGDPPLLKLTAPAVEAPVERRPCCLLM

SEQ ID NO: 744884 - protein, 528 aa, Homo sapiens; identical to SEQ ID NO: 744875

SEQ ID NO: 744885 - protein, 576 aa, Homo sapiens
MAEHLELLAEMPMVGRMSTQERLKHAQKRRAQQVKMWAQAEKEAQGKKGPGERPRKEAASQGLLKQVLFPPSVVLLEAAARNDLEEVRQFLGSGVSPDLANEDGLTALHQCCIDDFREMVQQLLEAGANINACDSECWTPLHAAATCGHLHLVELLIASGANLLAVNTDGNMPYDLCDDEQTLDCLETAMADRGITQDSIEAARAVPELRMLDDIRSRLQAGADLHAPLDHGATLLHVAAANGFSEAAALLLEHRASLSAKDQDGWEPLHAAAYWGQVPLVELLVAHGADLNAKSLMDETPLDVCGDEEVRAKLLELKHKHDALLRAQSRQRSLLRRRTSSAGSRGKVVRRVSLTQRTDLYRKQHAQEAIVWQQPPPTSPEPPEDNDDRQTGAELRPPPPEEDNPEVVRPHNGRVGGSPVRHLYSKRLDRSVSYQLSPLDSTTPHTLVHDKAHHTLADLKRQRAAAKLQRPPPEGPESPETAEPGLPGDTVTPQPDCGFRAGGDPPLLKLTAPVRALVLRVQHGNPGFYCTGHWPLSGQKTCLEGCLAAKTIFILQLLIKGCFAMEKTPHTHHRHK

SEQ ID NO: 744886 - protein, 229 aa, Homo sapiens
MAEHLELLAEMPMVGRMSTQERLKHAQKRRAQQVKMWAQAEKEAQGKKGPGERPRKEAASQGLLKQVLFPPSVVLLEAAARNDLEEVRQFLGSGVSPDLANEDGLTALHQCCIDDFREMVQQLLEAGANINACDSECWTPLHAAATCGHLHLVELLIASGANLLAVNTDGNMPYDLCDDEQTLDCLETAMADRGEVRRCGCGRAAGRAPSEPAASQASPRTASRPCLLM

SEQ ID NO: 744887 - protein, 180 aa, Homo sapiens [sequence omitted]

SEQ ID NO: 744888 - protein, 181 aa, Homo sapiens
MMKFKPNQTRTYDREGFKKRAACLCFRSEQEDEVLLVSSSRYPDQWIVPGGGMEPEEEPGGAAVREVYEEAGVKGKLGRLLGIFEQNQDRKHRTYVYVLTVTEILEDWEDSVNIGRKREWFKVEDAIKVLQCHKPVHAEYLEKLKLGCSPANGNSTVPSLPDNNALFVTAAQTSGLPSSVR

SEQ ID NO: 744889 - protein, 180 aa, Homo sapiens [sequence omitted]

SEQ ID NO: 744890 - protein, 181 aa, Homo sapiens; identical to SEQ ID NO: 744888

SEQ ID NO: 744891 - protein, 180 aa, Homo sapiens [sequence omitted]

SEQ ID NO: 744892 - protein, 180 aa, Homo sapiens [sequence omitted]

SEQ ID NO: 744893 - protein, 180 aa, Homo sapiens [sequence omitted]

SEQ ID NO: 744894 - protein, 180 aa, Homo sapiens [sequence omitted]

SEQ ID NO: 744895 - protein, 180 aa, Homo sapiens [sequence omitted]

SEQ ID NO: 744896 - protein, 180 aa, Homo sapiens [sequence omitted]

SEQ ID NO: 744897 - protein, 927 aa, Homo sapiens
MPIDEVNILGIQRIYGNVDKDIYQDKALERKAIKIKCSAAKDLEWLTCNISIWCNITVIRNDICEGSEWKLIQPVGELLSSILSQLHTYPFTQQFHSWESSQQMDKLHNQAMVKYVCCRIYETGTNLIFKCDEVMAIYLLDTLWLPKSYVLPQGVLSIVIEKGRTLLDRTTCFMHVLAYTEKAESLKMRLYRIVDFVFKRLYGLKNVLGNRHEQGRELQPTGQTPPHCLFVRPTSLKFFYVLGFFFFKKILCPFVYKSSVGAFSLQWQNSVVETDLWSTKAEIFTVLGEKNNMNCNNLDLLGCSVLMCPVKTKEKQHQVQSSAISLITSKLLLPDLISTPDLKPGDFVNLLGYNKIKNYRYLLIYIMELFQKQSYGKMDQESLKIKLRKKNHVINSVVETEVGIKFYVHTLTSATQQGHTRHMKGDQLKGDKMKLGEGRGDPNSEYWIPHKRKNFSPAPSMAANGKSQYHKANSWNIPDFHDENGDECRGECIVKKTNNILLVQVVDDRFLLFTFSQIITFSMFCFLCYLKYKPSYNSLRWVACQVAEMKYHPSPKVLIRMKYYIFLKYSNKLGTLLSWYFLFWPAFPDKVVLLLQLTKKMWQGWAARFSGSHLMFRFFSSLPGLCRCCCSLCLEMFIWPESKSLSKLLLFSMTELQLFVCPPSPLEYMVPKGKPHAIHSPPNHPQQLVGKHETLLLNNVFPLAQGLQVKGLQGGRTSRCARRGLLANWRVTGEEDNDMLLGCLLLRSSQLSPVHKGGSGLLLPDLQIIQKLPEFWIFMQISQFLKMLASNSECFNQPHCVGQGKQAQRPGEAAVFNCCLGLSQSPLSPKKAQSHTGTRFIPLVEKASLSKVMGESYQNCKGKKYDTMKLEIHCFEMKMTYFCTSITHKFSRHHLDIFVVQQIEIWNFMVCKSLCDTSYNHEQYYGQ

SEQ ID NO: 744898 - protein, 108 aa, Homo sapiens
NRVITLQRFENVVYIRSASQAGSIQLWFTLQVLLVSSSRYPDQWIVPGGGMEPEEEPGGAAVREVYEEVRCSFTQILFRSFKNKALCYITLRQRDGSRSAFCLMQLYF

SEQ ID NO: 744899 - protein, 181 aa, Homo sapiens; identical to SEQ ID NO: 744888

SEQ ID NO: 744900 - protein, 85 aa, Homo sapiens
SALLSNQKLETLDLGQNHLWKSGIIKLFGVLRQRTGSLKILRLKTYETNLEIKKLLEEVKEKNPKLTIDCNASGATAPPCCDFFC

SEQ ID NO: 744901 - protein, 355 aa, Homo sapiens
MEDLEETLFEEFENYSYDLDYYSLESDLEEKVQLGVVHWVSLVLYCLAFVLGIPGNAIVIWFTGFKWKKTVTTLWFLNLAIADFIFLLFLPLYISYVAMNFHWPFGIWLCKANSFTAQLNMFASVFFLTVISLDHYIHLIHPVLSHRHRTLKNSLIVIIFIWLLASLIGGPALYFRDTVEFNNHTLCYNNFQKHDPDLTLIRHHVLTWVKFIIGYLFPLLTMSICYLCLIFKVKKRTFLISSRHFWTILVVVVAFVVCWTPYHLFSIWELTIHHNSYSHHVMQAGIPLSTGLAFLNSCLNPILYVLISKKFQARFRSSVAEILKYTLWEVSCSGTVSEQLRNSETKNLCLLETAQ

SEQ ID NO: 744902 - protein, 299 aa, Homo sapiens
MEEFDSEDFSTSEEDEDYVPSGGEYSEDDVNELVKEDEVDGEEQTQKTQGKKRKAQSIPARKRRQGGLSLEEEEEEDANSESEGSSSEEEDDAAEQEKGIGSEDARKKKEDELWASFLNDVGPKSKVPPSTQVKKGEETEETSSSKLLVKAEELEKPKETEKVKITKVFDFAGEEVRVTKEVDATSKEAKSFFKQNEKEKPQANVPSALPSLPAGSGLKRSSGMSSLLGKIGAKKQKMSTLEKSKLDWESFKEEEGIGEELAIHNRGKEGYIERKAFLDRVDHRQFEIERDLRLSKMKP

SEQ ID NO: 744903 - protein, 217 aa, Homo sapiens
MEEFDSEDFSTSEEDEDYVPSGGEYSEDDVNELVKEDEVDGEEQTQKTQGKKRKAQSIPARKRRQGGLSLEEEEEEDANSESEGSSSEEEDDAAEQEKGIGSEDARKKKEDELWASFLNDVGPKSKVPPSTQVKKGEETEETSSSKLLVKAEELEKPKETEKVKITKVFDFAGEEVRVTKEVDATSKEAKSFFKQNEKEKPQANVPSALPSLPAGSG

SEQ ID NO: 744904 - protein, 158 aa, Homo sapiens
MFILCPVVSQELENPKTSVTCENSPKSIDPAGQEVRVTKEVDATSKEAKSFFKQNEKEKPQANVPSALPSLPAGSGLKRSSGMSSLLGKIGAKKQKMSTLEKSKLDWESFKEEEGIGEELAIHNRGKEGYIERKAFLDRVDHRQFEIERDLRLSKMKP

SEQ ID NO: 744905 - protein, 299 aa, Homo sapiens; identical to SEQ ID NO: 744902

SEQ ID NO: 744906 - protein, 317 aa, Homo sapiens
MERLIGSGRMKQFGEDRSLNGYLNGFKPFKYPPEDYVPSGGEYSEDDVNELVKEDEVDGEEQTQKTQGKKRKAQSIPARKRRQGGLSLEEEEEEDANSESEGSSSEEEDDAAEQEKGIGSEDARKKKEDELWASFLNDVGPKSKVPPSTQVKKGEETEETSSSKLLVKAEELEKPKETEKVKITKVFDFAGEEVRVTKEVDATSKEAKSFFKQNEKEKPQANVPSALPSLPAGSGLKRSSGMSSLLGKIGAKKQKMSTLEKSKLDWESFKEEEGIGEELAIHNRGKEGYIERKAFLDRVDHRQFEIERDLRLSKMKP

SEQ ID NO: 744907 - protein, 307 aa, Homo sapiens
MSRRPAYCSLQFLGSSDPPASASPVDGTTGGEYSEDDVNELVKEDEVDGEEQTQKTQGKKRKAQSIPARKRRQGGLSLEEEEEEDANSESEGSSSEEEDDAAEQEKGIGSEDARKKKEDELWASFLNDVGPKSKVPPSTQVKKGEETEETSSSKLLVKAEELEKPKETEKVKITKVFDFAGEEVRVTKEVDATSKEAKSFFKQNEKEKPQANVPSALPSLPAGSGLKRSSGMSSLLGKIGAKKQKMSTLEKSKLDWESFKEEEGIGEELAIHNRGKEGYIERKAFLDRVDHRQFEIERDLRLSKMKP

SEQ ID NO: 744908 - protein, 299 aa, Homo sapiens; identical to SEQ ID NO: 744902

SEQ ID NO: 744909 - protein, 223 aa, Homo sapiens
FWVFADMFPTPQMVSVSLETSSNVQRPGAEPFLTDELWASFLNDVGPKSKVPPSTQVKKGEETEETSSSKLLVKAEELEKPKETEKVKITKVFDFAGEEVRVTKEVDATSKEAKSFFKQNEKEKPQANVPSALPSLPAGSGLKRSSGMSSLLGKIGAKKQKMSTLEKSKLDWESFKEEEGIGEELAIHNRGKEGYIERKAFLDRVDHRQFEIERDLRLSKMKP

SEQ ID NO: 744910 - protein, 280 aa, Homo sapiens
MEEFDSEDFSTSEEDEDYVPSGGEYSEDDVNELVKEDEVDGEEQTQKTQGKKRKAQSIPARKRRQGGLSLEEEEEEDANSESEGSSSEEEDDAAEQEKGIGSEDARKKKEDELWASFLNDVGPKSKVPPSTQVKKGEETEETSSSKLLVKAEELEKPKETEKVKITKVFDFAGEEVRVTKEVDATSKEAKSFFKQNEKEKPQANVPSALPSLPAGSGLKRSSGMSSLLGKIGAKKQKMSTLEKSKLDWESFKEEEGIGEELAIHNRGKEGWIKGAQPLGQ

SEQ ID NO: 744911 - protein, 121 aa, Homo sapiens
MSRRPAYCSLQFLGSSDPPASASPVDGTTGGEYSEDDVNELVKEDEVDGEEQTQKTQGKKRKAQSIPARKRRQGGLSLEEEEEEDANSESEGYIERKAFLDRVDHRQFEIERDLRLSKMKP

SEQ ID NO: 744912 - protein, 56 aa, Homo sapiens
MGTPEGEERKAAIFDAIMTENFPKLMTDTTSQIQETQDIEPRHIVFKCQKIKDGHG

SEQ ID NO: 744913 - protein, 87 aa, Homo sapiens
KGRGGGGERAGVMPRGRRLGMVFAPPRPGQRQAGAPWVPERRKRRPDGDTFLLSFLSTTWLKTWRSQQYKESKSRSCAREQMNSSSC

SEQ ID NO: 744914 - protein, 82 aa, Homo sapiens
AWGLNRPRARGRRLGMVFAPPRPGQRQAGAPWVPERRKRRPDGDTFLLSFLSTTWLKTWRSQQYKESKSRSCAREQMNSSSC

SEQ ID NO: 744915 - protein, 97 aa, Homo sapiens
AWGLNRPRARGRRLGMVFAPPRPGQRQAGAPWVPERRKRRPDGVSTGPGQALPVNGARDTFLLSFLSTTWLKTWRSQQYKESKSRSCAREQMNSSSC

SEQ ID NO: 744916 - protein, 422 aa, Homo sapiens
SACADGKIRIYNFLNGNCMKVLKANGRGDPVLSFFIQGNRMVVNTESNVLMFQFEHIKWQYAVEKTKQKKNKEKEEEKEENSLMEILSKCNIQVHSPRESVSSKQTVIQELLPGKPPKSRVLLKPAKFSSAVLIEELQSQGKSKSPRRDDDAEKAQKQGQLETPGKLPSHPKKKSWKIPMSPDQFLLTVSALQHARNSGEFAYPCRPQTEITDVWGPSISYPRKVLNFKGKSIQRAVDRLRLSNPPIDVKRTSIPLEIQKLQPNLKISLHSPRAQSTIPEPMIIRSRFSGSLKGGDQVTSSIERAVCSTGPLTSMQVIKPNRMLAPQVGTATLSLKKERPRIYTALDPFRVNAEFVLLTVKEEKEHQEAKMKEYQARESTGVVDPGKASKAAWIRKIKGLPIDNFTKQGKTAAPELGQNVFI

SEQ ID NO: 744917 - protein, 111 aa, Homo sapiens
AITPEQEGGTLLPSSSTTPRGGGPSLYGGSGAPHQASILPGPDGPSAGGWLRVVAPGSTHFQEGPCNQVKLPDVLESLAPLRLDSSVVASGHSLVLAPFSSLLCAVLIPRR

SEQ ID NO: 744918 - protein, 121 aa, Homo sapiens
LGLPKCWDYRREPPHPALMFVFLVETGFHHVCQAGLELLTSGDPPTSASQSARITGLSHHTRAKEGLLLKRMGHVSYLTISPRFPCSSLTCPSVGVCLRAHLKPCPSRWRVLIHGIVLGMG

SEQ ID NO: 744919 - protein, 106 aa, Homo sapiens [sequence omitted]

SEQ ID NO: 744920 - protein, 469 aa, Homo sapiens
AGEPTEALWTAVGPPVPLNPQASSLLGICLGLKTVGSINLHEDGSLPEEAAEEEMAGPNQLCIRRWTTKHVAVWLKDEGFFEYVDILCNKHRLDGITLLTLTEYDLRSPPLEIKVLGDIKRLMLSVRKLQKIHIDVLEEMGYNSDSPMGSMTPFISALQSTDWLCNGELSHDCDGPITDLNSDQYQYMNGKNKHSVRRLDPEYWKTILSCIYVFIVFGFTSFIMVIVHERVPDMQTYPPLPDIFLDSVPRIPWAFAMTEVCGMILCYIWLLVLLLHKHRSILLRRLCSLMGTVFLLRCFTMFVTSLSVPGQHLQCTGKIYGSVWEKLHRAFAIWSGFGMTLTGVHTCGDYMFSGHTVVLTMLNFFVTEYTPRSWNFLHTLSWVLNLFGIFFILAAHEHYSIDVFIAFYITTRLFLYYHTLANTRAYQQSRRARIWFPMFSFFECNVNGTVPNEYCWPFSKPAIMKRLIG

SEQ ID NO: 744921 - protein, 449 aa, Homo sapiens
GEAGRAPDSDGGSDADSEVGPGSPTRTAEAAEEEMAGPNQLCIRRWTTKHVAVWLKDEGFFEYVDILCNKHRLDGITLLTLTEYDLRSPPLEIKVLGDIKRLMLSVRKLQKIHIDVLEEMGYNSDSPMGSMTPFISALQSTDWLCNGELSHDCDGPITDLNSDQYQYMNGKNKHSVRRLDPEYWKTILSCIYVFIVFGFTSFIMVIVHERVPDMQTYPPLPDIFLDSVPRIPWAFAMTEVCGMILCYIWLLVLLLHKHRSILLRRLCSLMGTVFLLRCFTMFVTSLSVPGQHLQCTGKIYGSVWEKLHRAFAIWSGFGMTLTGVHTCGDYMFSGHTVVLTMLNFFVTEYTPRSWNFLHTLSWVLNLFGIFFILAAHEHYSIDVFIAFYITTRLFLYYHTLANTRAYQQSRRARIWFPMFSFFECNVNGTVPNEYCWPFSKPAIMKRLIG

SEQ ID NO: 744922 - protein, 158 aa, Homo sapiens
PHRAGTPHRAQTPRTPHGAGSSHRAQTPRTPHRGTDPTHPTQGTDPTHPTQGRHLTQGTDPMHPTQGRHPTQGTDPTHPTQGRHPTQGTDPTHPTQGRDPTQGTDPTQGRASPRPGPSPVDLLPGRTRATVTSTLSPSLETSADSSSSPRYTGAPATA

SEQ ID NO: 744923 - protein, 88 aa, Homo sapiens
RPLQHQNGPTQGRHPTQGTDPTHPTQGRDPTQGTDPTQGRASPRPGPSPVDLLPGRTRATVTSTLSPSLETSADSSSSPRYTGAPATA

SEQ ID NO: 744924 - protein, 243 aa, Homo sapiens
PTQGRHPTQGTDPTHPTRGRQLTQGPDPTHPTQGHRPHAPHTGHRPHTPHTGQAPHTGHRPHASHTGQAPHTGHRPHTPHTGQAPHTGHRPHAPHTGQGSHAGHRSHAGQGQPKARPLPCRSPPRQDQSHSHFHTISFPRNLCRLFLLSSIHRGPCHSLTLCHLVSLWKAGSASEYRGLGSCRRMLGQWVLAREQPPGSQSGAAAKAVVVEVRVVARSCCRSEDSGVTLRATTFRHSRKSTSK

SEQ ID NO: 744925 - protein, 268 aa, Homo sapiens
SDQHHGGGKNKRLTKGGKKGAKKKVVDPFSKKDWYDVKAPAMFNIRNIGKTLVTRTQGTKIASDGLKGRVFEVSLADLQNDEVAFRKFKLITEDVQGKNCLTNFHGMDLTRDKMCSMVKKWQTMIEAHVDVKTTDGYLLRLFCVGFTKKRNNQIRKTSYAQHQQVRQIRKKMMEIMTREVQTNDLKEVVNKLIPDSIGKDIEKACQSIYPLHDVFVRKVKMLKKPKFELGKLMELHGEGSSSGKATGDETGAKVERADGYEPPVQESV

SEQ ID NO: 744926 - protein, 123 aa, Homo sapiens
MAHVPSPPPPCPSAAEPRRVCLKVSIRASPDVAHLPLCWAVCVTRPAGTARPCFLTSRPLSELHELSLTVRGVEPPLAGTWVYLLSPICQLPLDSGGSPAWGREGTLRGLSEQRWFFQNQRKV

SEQ ID NO: 744927 - protein, 146 aa, Homo sapiens
PAPDTKLLRGSPPHLQHGAPRAFENHRTPLRRARHSPGLPEPPGAAAPAAISSRSPSPRPRCQVTPFTWACSSLRRASASTPPAGACGDCAAPGWPAASARPAATAHSRLENPTGSRTAPPRPHAPLAPWRHESEPVIGQGLAVKG

SEQ ID NO: 744928 - protein, 146 aa, Homo sapiens; identical to SEQ ID NO: 744927

SEQ ID NO: 744929 - protein, 146 aa, Homo sapiens; identical to SEQ ID NO: 744927

SEQ ID NO: 744930 - protein, 275 aa, Homo sapiens [sequence omitted]

SEQ ID NO: 744931 - protein, 325 aa, Homo sapiens [sequence omitted]

SEQ ID NO: 744932 - protein, 577 aa, Homo sapiens
MKHQERFLFQGNNGTVLYTGDFRLAQGEAARMELLHSGGRVKDIQSVYLDTTFCDPRFYQIPSREECLSGVLELVRSWITRSPYHVVWLNCKAAYGYEYLFTNLSEELGVQVHVNKLDMFRNMPEILHHLTTDRNTQIHACRHPKAEEYFQWSKLPCGITSRNRIPLHIISIKPSTMWFGERSRKTNVIVRTGESSYRACFSFHSSYSEIKDFLSYLCPVNAYPNVIPVGTTMDKVVEILKPLCRSSQSTEPKYKPLGKLKRARTVHRDSEEEDDYLFDDPLPIPLRHKVPYPETFHPEVFSMTAVSEKQPEKLRQTPGCCRAECMQSSRFTNFVDCEESNSESEEEVGIPASLQGDLGSVLHLQKADGDVPQWEVFFKRNDEITDESLENFPSSTVAGGSQSPKLFSDSDGESTHISSQNSSQSTHITEQGSQGWDSQSDTVLLSSQERNSGDITSLDKADYRPTIKENIPASLMEQNVICPKDTYSDLKSRDKDVTIVPSTGEPTTLSSETHIPEEKSLLNLSTNADSQSSSDFEVPSTPEAELPKREHLQYLYEKLATGESIAVKKRKCSLLDT

SEQ ID NO: 744933 - protein, 720 aa, Homo sapiens
LPGSGGAVRAGLGFSCGFGVPDSGIGGAMSSFEGQMAEYPTISIDRFDRENLRARAYFLSHCHKDHMKGLRAPTLKRRLECSLKVYLYCSPVTKELLLTSPKYRFWKKRIISIEIETPTQISLVDEASGEKEEIVVTLLPAGHCPGSVMFLFQGNNGTVLYTGDFRLAQGEAARMELLHSGGRVKDIQSVYLDTTFCDPRFYQIPSREECLSGVLELVRSWITRSPYHVVWLNCKAAYGYEYLFTNLSEELGVQVHVNKLDMFRNMPEILHHLTTDRNTQIHACRHPKAEEYFQWSKLPCGITSRNRIPLHIISIKPSTMWFGERSRKTNVIVRTGESSYRACFSFHSSYSEIKDFLSYLCPVNAYPNVIPVGTTMDKVVEILKPLCRSSQSTEPKYKPLGKLKRARTVHRDSEEEDDYLFDDPLPIPLRHKVPYPETFHPEVFSMTAVSEKQPEKLRQTPGCCRAECMQSSRFTNFVDCEESNSESEEEVGIPASLQGDLGSVLHLQKADGDVPQWEVFFKRNDEITDESLENFPSSTVAGGSQSPKLFSDSDGESTHISSQNSSQSTHITEQGSQGWDSQSDTVLLSSQERNSGDITSLDKADYRPTIKENIPASLMEQNVICPKDTYSDLKSRDKDVTIVPSTGEPTTLSSETHIPEEKSLLNLSTNADSQSSSDFEVPSTPEAELPKREHLQYLYEKLATGESIAVKKRKCSLLDT

SEQ ID NO: 744934 - protein, 572 aa, Homo sapiens
MFLFQGNNGTVLYTGDFRLAQGEAARMELLHSGGRVKDIQSVYLDTTFCDPRFYQIPSREECLSGVLELVRSWITRSPYHVVWLNCKAAYGYEYLFTNLSEELGVQVHVNKLDMFRNMPEILHHLTTDRNTQIHACRHPKAEEYFQWSKLPCGITSRNRIPLHIISIKPSTMWFGERSRKTNVIVRTGESSYRACFSFHSSYSEIKDFLSYLCPVNAYPNVIPVGTTMDKVVEILKPLCRSSQSTEPKYKPLGKLKRARTVHRDSEEEDDYLFDDPLPIPLRHKVPYPETFHPEVFSMTAVSEKQPEKLRQTPGCCRAECMQSSRFTNFVDCEESNSESEEEVGIPASLQGDLGSVLHLQKADGDVPQWEVFFKRNDEITDESLENFPSSTVAGGSQSPKLFSDSDGESTHISSQNSSQSTHITEQGSQGWDSQSDTVLLSSQERNSGDITSLDKADYRPTIKENIPASLMEQNVICPKDTYSDLKSRDKDVTIVPSTGEPTTLSSETHIPEEKSLLNLSTNADSQSSSDFEVPSTPEAELPKREHLQYLYEKLATGESIAVKKRKCSLLDT

SEQ ID NO: 744935 - protein, 577 aa, Homo sapiens; identical to SEQ ID NO: 744932

SEQ ID NO: 744936 - protein, 252 aa, Homo sapiens [sequence omitted]

SEQ ID NO: 744937 - protein, 702 aa, Homo sapiens
LPGSGGAVRAGLGFSCGFGVPDSGIGGAMSSFEGQMAEYPTISIDRFDRENLRARAYFLSHCHKDHMKGLRAPTLKRRLECSLKVYLYCSPVTKELLLTSPKYRFWKKRIISIEIETPTQISLVDEASGEKEEIVVTLLPAGHCPGSVMFLFQGNNGTVLYTGDFRLAQGEAARMELLHSGGRVKDIQSVYLDTTFCDPRFYQIPSREECLSGVLELVRSWITRSPYHVVWLNCKAAYGYEYLFTNLSEELGVQVHVNKLDMFRNMPEILHHLTTDRNTQIHACRHPKAEEYFQWSKLPCGITSRNRIPLHIISIKTIHHVVWRKEQKNKCNCEIKDFLSYLCPVNAYPNVIPVGTTMDKVVEILKPLCRSSQSTEPKYKPLGKLKRARTVHRDSEEEDDYLFDDPLPIPLRHKVPYPETFHPEVFSMTAVSEKQPEKLRQTPGCCRAECMQSSRFTNFVDCEESNSESEEEVGIPASLQGDLGSVLHLQKADGDVPQWEVFFKRNDEITDESLENFPSSTVAGGSQSPKLFSDSDGESTHISSQNSSQSTHITEQGSQGWDSQSDTVLLSSQERNSGDITSLDKADYRPTIKENIPASLMEQNVICPKDTYSDLKSRDKDVTIVPSTGEPTTLSSETHIPEEKSLLNLSTNADSQSSSDFEVPSTPEAELPKREHLQYLYEKLATGESIAVKKRKCSLLDT

SEQ ID NO: 744938 - protein, 572 aa, Homo sapiens; identical to SEQ ID NO: 744934

SEQ ID NO: 744939 - protein, 572 aa, Homo sapiens; identical to SEQ ID NO: 744934

SEQ ID NO: 744940 - protein, 447 aa, Homo sapiens
LPGSGGAVRAGLGFSCGFGVPDSGIGGAMSSFEGQMAEYPTISIDRFDRENLRARAYFLSHCHKDHMKGLRAPTLKRRLECSLKVYLYCSPVTKELLLTSPKYRFWKKRIISIEIETPTQISLVDEASGEKEEIVVTLLPAGHCPGSVMFLFQGNNGTVLYTGDFRLAQGEAARMELLHSGGRVKDIQSVYLDTTFCDPRFYQIPSREECLSGVLELVRSWITRSPYHVVWLNCKAAYGYEYLFTNLSEELGVQVHVNKLDMFRNMPEILHHLTTDRNTQIHACRHPKAEEYFQWSKLPCGITSRNRIPLHIISIKPSTMWFGERSRKTNVIVRTGESSYRACFSFHSSYSEIKDFLSYLCPVNAYPNVIPVGTTMDKVVEILKPLCRSSQSTEPKYKPLGKLKRARTVHRDSGKKNGPGFRGVGSLQTLLSRELGSGRSGLGQSGP

SEQ ID NO: 744941 - protein, 82 aa, Homo sapiens
LPGSGGAVRAGLGFSCGFGVPDSGIGGAMSSFEGQMAEYPTISIDRFDRENLRARAYFLSHCHKDHMKGLRAPTLKRRLECR

SEQ ID NO: 744942 - protein, 697 aa, Homo sapiens
MAGLGPGVGDSEGGPRPLFCRKGALRQKVVHEVKSHKFTARFFKQPTFCSHCTDFIWGIGKQGLQCQVCSFVVHRRCHEFVTFECPGAGKGPQTDDPRNKHKFRLHSYSSPTFCDHCGSLLYGLVHQGMKCSCCEMNVHRRCVRSVPSLCGVDHTERRGRLQLEIRAPTADEIHVTVGEARNLIPMDPNGLSDPYVKLKLIPDPRNLTKQKTRTVKATLNPVWNETFVFNLKPGDVERRLSVEVWDWDRTSRNDFMGAMSFGVSELLKAPVDGWYKLLNQEEGEYYNVPVADADNCSLLQKFEACNYPLELYERVRMGPSSSPIPSPSPSPTDPKRCFFGASPGRLHISDFSFLMVLGKGSFGKVMLAERRGSDELYAIKILKKDVIVQDDDVDCTLVEKRVLALGGRGPGGRPHFLTQLHSTFQTPDRLYFVMEYVTGGDLMYHIQQLGKFKEPHAAFYAAEIAIGLFFLHNQGIIYRDLKLDNVMLDAEGHIKITDFGMCKENVFPGTTTRTFCGTPDYIAPEIIAYQPYGKSVDWWSFGVLLYEMLAGQPPFDGEDEEELFQAIMEQTVTYPKSLSREAVAICKGFLTKHPGKRLGSGPDGEPTIRAHGFFRWIDWERLERLEIPPPFRPRPCGRSGENFDKFFTRAAPALTPPDRLVLASIDQADFQGFTYVNPDFVHPDARSPTSPVPVPVM

SEQ ID NO: 744943 - protein, 97 aa, Homo sapiens
TSPPTPSSRFYAAEIAIGLFFLHNQGIIYRDLKLDNVMLDAEGHIKITDFGMCKENVFPGTTTRTFCGTPDYIAPEIICLPPLWEFCRLVLLRSFAE

SEQ ID NO: 744944 - protein, 473 aa, Homo sapiens
HHGQGDFYVDEAAQRLLLRHLLLHHEGVPVPWERVQDRCSEDTEHSQDLQSALIRLEEEPQRSASLAQVKAMLREHLDQAGSANQALSEDIQKVTNDWTRSRKELEHGRRRGGARRRDLLQLGGELARTSRAVQEAGLGLSTGLRLAESRAEAALEKQALLQAQLEEQLRDKVLREKDLAQQQMQSDLDKADLSARVTELGLAVKRLEKQNLEKDQVNKDLTEKLEALESLRLQEQVALETEDGEGLQQTLRDLAQAVLSDSESGVQLSGSERTADASNGSLRGLSGQRTPSPPRRSSPGRGRSPRRGSSPACSDSSTLALIHSALHKRQLQVQDMRGRYEASQDLLGTLRKQLSDSESERRALEEQLQRLRDKTDGAMQAHEHAQREVQRLRSANELLSRLGHNWSITAHCSLELPDSSDPPTSTSQLPLVGGLGLAWGRIWDRSLRVRFPLPSSVPSPPSEPSPPWVPGQL

SEQ ID NO: 744945 - protein, 138 aa, Homo sapiens
MRGRYEASQDLLGTLRKQLSDSESERRALEEQLQRLRDKTDGAMQAHEHAQREVQRLRSANELLSRLGHNWSITAHCSLELPDSSDPPTSTSQLPLVGGLGLAWGRIWDRSLRVRFPLPSSVPSPPSEPSPPWVPGQL

SEQ ID NO: 744946 - protein, 87 aa, Homo sapiens
SPPRDRTVLCTFTVKPVSLSEKCHVCRGNHGNCFLNSPFLMRAWDSAACFTWDEQLVVSGWRGTSASAVSSHLVACPAGCHCLLSLG

SEQ ID NO: 744947 - protein, 642 aa, Homo sapiens
LDLSHNFISSFPWSDLRNLSALQLLKMNHNRLGSLPRDALGALPDLRSLRINNNRLRTLAPGTFDALSALSHLQLYHNPFHCGCGLVWLQAWAASTRVSLPEPDSIACASPPALQGVPVYRLPALPCAPPSVHLSAEPPLEAPGTPLRAGLAFVLHCIADGHPTPRLQWQLQIPGGTVVLEPPVLSGEDDGVGAEEGEGEGDGDLLTQTQAQTPTPAPAWPAPPATPRFLALANGSLLVPLLSAKEAGVYTCRAHNELGANSTSIRVAVAATGPPKHAPGAGGEPDGQAPTSERKSTAKGRGNSVLPSKPEGKIKGQGLAKVSILGETETEPEEDTSEGEEAEDQILADPAEEQRCGNGDPSRYVSNHAFNQSAELKPHVFELGVIALDVAEREARVQLTPLAARWGPGPGGAGGAPRPGRRPLRLLYLCPAGGGAAVQWSRVEEGVNAYWFRGLRPGTNYSVCLALAGEACHVQVVFSTKKELPSLLVIVAVSVFLLVLATVPLLGAACCHLLAKHPGKPYRLILRPQAPDPMEKRIAADFDPRASYLESEKSYPAGGEAGGEEPEDVQGEGLDEDAEQGDPSGDLQREESLAACSLVESQSKANQEEFEAGSEYSDRLPLGAEAVNIAQEINGNYRQTAG

SEQ ID NO: 744948 - protein, 1657 aa, Homo sapiens
MDSKKRSSTEAEGSKERGLVHIWQAGSFPITPERLPGWGGKTVLQAALGVKHGVLLTEDGEVYSFGTLPWRSGPVEICPSSPILENALVGQYVITVATGSFHSGAVTDNGVAYMWGENSAGQCAVANQQYVPEPNPVSIADSEASPLLAVRILQLACGEEHTLALSISREIWAWGTGCQLGLITTAFPVTKPQKVEHLAGRVVLQVACGAFHSLALVQCLPSQDLKPVPERCNQCSQLLITMTDKEDHVIISDSHCCPLGVTLTESQAENHASTALSPSTETLDRQEEVFENTLVANDQSVATELNAVSAQITSSDAMSSQQNVMGTTEISSARNIPSYPDTQAVNEYLRKLSDHSVREDSEHGEKPVPSQPLLEEAIPNLHSPPTTSTSALNSLVVSCASAVGVRVAATYEAGALSLKKVMNFYSTTPCETGAQAGSSAIGPEGLKDSREEQVKQESMQGKKSSSLVDIREEETEGGSRRLSLPGLLSQVSPRLLRKAARVKTRTVVLTPTYSGEADALLPSLRTEVWTWGKGKEGQLGHGDVLPRLQPLCVKCLDGKEVIHLEAGGYHSLALTAKSQVYSWGSNTFGQLGHSDFPTTVPRLAKISSENGVWSIAAGRDYSLFLVDTEDFQPGLYYSGRQDPTEGDNLPENHSGSKTPVLLSCSKLGYISRVTAGKDSYLALVDKNIMGYIASLHELATTERRFYSKLSDIKSQILRPLLSLENLGTTTTVQLLQEVASRFSKLCYLIGQHGASLSSFLHGVKEARSLVILKHSSLFLDSYTEYCTSITNFLVMGGFQLLAKPAIDFLNKNQELLQDLSEVNDENTQLMEILNTLFFLPIRRLHNYAKVLLKLATCFEVASPEYQKLQDSSSCYECLALHLGRKRKEAEYTLGFWKTFPGKMTDSLRKPERRLLCESSNRALSLQHAGRFSVNWFILFNDALVHAQFSTHHVFPLATLWAEPLSEEAGGVNGLKITTPEEQFTLISSTPQEKTKWLRAISQAVDQALRGMSDLPPYGSGSSVQRQEPPISRSAKYTFYKDPRLKDATYDGRWLSGKPHGRGVLKWPDGKMYSGMFRNGLEDGYGEYRIPNKAMNKEDHYVGHWKEGKMCGQGVYSYASGEVFEGCFQDNMRHGHGLLRSGKLTSSSPSMFIGQWVMDKKAGYGVFDDITRGEKYMGMWQDDVCQGNGVVVTQFGLYYEGNFHLNKMMGNGVLLSEDDTIYEGEFSDDWTLSGKGTLTMPNGDYIEGYFSGEWGSGIKITGTYFKPSLYESDKDRPKVFRKLGNLAVPADEKWKAVFDECWRQLGCEGPGQGEVWKAWDNIAVALTTSRRQHRDSPEILSRSQTQTLESLEFIPQHVGAFSVEKYDDIRKYLIKACDTPLHPLGRLVETLVAVYRMTYVGVGANRRLLQEAVKEIKSYLKRIFQLVRFLFPELPEEGSTIPLSAPLPTERKSFCTGKSDSRSESPEPGYVVTSSGLLLPVLLPRLYPPLFMLYALDNDREEDIYWECVLRLNKQPDIALLGFLGVQRKFWPATLSILGESKKVLPTTKDACFASAVECLQQISTTFTPSDKLKVIQQTFEEISQSVLASLHEDFLWSMDDLFPVFLYVVLRARIRNLGSEVHLIEDLMDPYLQHGEQGIMFTTLKACYYQIQREKLN

SEQ ID NO: 744949 - protein, 396 aa, Homo sapiens
MDSKKRSSTEAEGSKERGLVHIWQAGSFPITPERLPGWGGKTVLQAALGVKHGVLLTEDGEVYSFGTLPWRSGPVEICPSSPILENALVGQYVITVATGSFHSGAVTDNGVAYMWGENSAGQCAVANQQYVPEPNPVSIADSEASPLLAVRILQLACGEEHTLALSISREIWAWGTGCQLGLITTAFPVTKPQKVEHLAGRVVLQVACGAFHSLALVQCLPSQDLKPVPERCNQCSQLLITMTDKEDHVIISDSHCCPLGVTLTESQAENHASTALSPSTETLDRQEEVFENTLVANDQSVATELNAVSAQITSSDAMSSQQNVMGTTEISSARNIPSYPDTQAVNEYLRKLSDHSVREDSEHGEKPVPSQVPAQFYKIKVCLELNCMGFSLETLK

SEQ ID NO: 744950 - protein, 69 aa, Homo sapiens
MCLRSGVLAGCLMGETDLVVCDFLYVVLRARIRNLGSEVHLIEDLMDPYLQHGEQGIMFTTLKVSIVII

SEQ ID NO: 744951 - protein, 1701 aa, Homo sapiens
MDSKKRSSTEAEGSKERGLVHIWQAGSFPITPERLPGWGGKTVLQAALGVKHGVLLTEDGEVYSFGTLPWRSGPVEICPSSPILENALVGQYVITVATGSFHSGAVTDNGVAYMWGENSAGQCAVANQQYVPEPNPVSIADSEASPLLAVRILQLACGEEHTLALSISREIWAWGTGCQLGLITTAFPVTKPQKVEHLAGRVVLQVACGAFHSLALVQCLPSQDLKPVPERCNQCSQLLITMTDKEDHVIISDSHCCPLGVTLTESQAENHASTALSPSTETLDRQEEVFENTLVANDQSVATELNAVSAQITSSDAMSSQQNVMGTTEISSARNIPSYPDTQAVNEYLRKLSDHSVREDSEHGEKPVPSQPLLEEAIPNLHSPPTTSTSALNSLVVSCASAVGVRVAATYEAGALSLKKVMNFYSTTPCETGAQAGSSAIGPEGLKDSREEQVKQESMQGKKSSSLVDIREEETEGGSRRLSLPGLLSQVSPRLLRKAARVKTRTVVLTPTYSGEADALLPSLRTEVWTWGKGKEGQLGHGDVLPRLQPLCVKCLDGKEVIHLEAGGYHSLALTAKSQVYSWGSNTFGQLGHSDFPTTVPRLAKISSENGVWSIAAGRDYSLFLVDTEDFQPGLYYSGRQDPTEGDNLPENHSGSKTPVLLSCSKLGYISRVTAGKDSYLALVDKNIMGYIASLHELATTERRFYSKLSDIKSQILRPLLSLENLGTTTTVQLLQEVASRFSKLCYLIGQHGASLSSFLHGVKEARSLVILKHSSLFLDSYTEYCTSITNFLVMGGFQLLAKPAMEANPHLPVIILSAKDDILKCSVFECSGKALTSSFYQTSQNINFHDFLNKNQELLQDLSEVNDENTQLMEILNTLFFLPIRRLHNYAKVLLKLATCFEVASPEYQKLQDSSSCYECLALHLGRKRKEAEYTLGFWKTFPGKMTDSLRKPERRLLCESSNRALSLQHAGRFSVNWFILFNDALVHAQFSTHHVFPLATLWAEPLSEEAGGVNGLKITTPEEQFTLISSTPQEKTKWLRAISQAVDQALRGMSDLPPYGSGSSVQRQEPPISRSAKYTFYKDPRLKDATYDGRWLSGKPHGRGVLKWPDGKMYSGMFRNGLEDGYGEYRIPNKAMNKEDHYVGHWKEGKMCGQGVYSYASGEVFEGCFQDNMRHGHGLLRSGKLTSSSPSMFIGQWVMDKKAGYGVFDDITRGEKYMGMWQDDVCQGNGVVVTQFGLYYEGNFHLNKMMGNGVLLSEDDTIYEGEFSDDWTLSGKGTLTMPNGDYIEGYFSGEWGSGIKITGTYFKPSLYESDKDRPKVFRKLGNLAVPADEKWKAVFDECWRQLGCEGPGQGEVWKAWDNIAVALTTSRRQHRDSPEILSRSQTQTLESLEFIPQHVGAFSVEKYDDIRKYLIKACDTPLHPLGRLVETLVAVYRMTYVGVGANRRLLQEAVKEIKSYLKRIFQLVRFLFPELPEEGSTIPLSAPLPTERKSFCTGKSDSRSESPEPGYVVTSSGLLLPVLLPRLYPPLFMLYALDNDREEDIYWECVLRLNKQPDIALLGFLGVQRKFWPATLSILGESKKVLPTTKDACFASAVECLQQISTTFTPSDKLKVIQQTFEEISQSVLASLHEDFLWSMDDLFPVFLYVVLRARIRNLGSEVHLIEDLMDPYLQHGEQGIMFTTLKACYYQIQREKLN

SEQ ID NO: 744952 - protein, 472 aa, Homo sapiens
SGQFWPHRTSWEVFPPPLFSESLRSFGIISSLNVWENSPMKSSGPKHYFGTLTMPNGDYIEGYFSGEWGSGIKITGTYFKPSLYESDKDRPKVFRKLGNLAVPADEKWKAVFDECWRQLGCEGPGQGEVWKAWDNIAVALTTSRRQHRDSPEILSRSQTQTLESLEFIPQHVGAFSVEKYDDIRKYLIKACDTPLHPLGRLVETLVAVYRMTYVGVGANRRLLQEAVKEIKSYLKRIFQLVRFLFPELPEEGSTIPLSAPLPTERKSFCTGKSDSRSESPEPGYVVTSSGLLLPVLLPRLYPPLFMLYALDNDREEDIYWECVLRLNKQPDIALLGFLGVQRKFWPATLSILGESKKVLPTTKDACFASAVECLQQISTTFTPSDKLKVIQQTFEEISQSVLASLHEDFLWSMDDLFPVFLYVVLRARIRNLGSEVHLIEDLMDPYLQHGEQGIMFTTLKACYYQIQREKLN

SEQ ID NO: 744953 - protein, 1237 aa, Homo sapiens
MDSKKRSSTEAEGSKERGLVHIWQAGSFPITPERLPGWGGKTVLQAALGVKHGVLLTEDGEVYSFGTLPWRSGPVEICPSSPILENALVGQYVITVATGSFHSGAVTDNGVAYMWGENSAGQCAVANQQYVPEPNPVSIADSEASPLLAVRILQLACGEEHTLALSISREIWAWGTGCQLGLITTAFPVTKPQKVEHLAGRVVLQVACGAFHSLALVQCLPSQDLKPVPERCNQCSQLLITMTDKEDHVIISDSHCCPLGVTLTESQAENHASTALSPSTETLDRQEEVFENTLVANDQSVATELNAVSAQITSSDAMSSQQNVMGTTEISSARNIPSYPDTQAVNEYLRKLSDHSVREDSEHGEKPVPSQPLLEEAIPNLHSPPTTSTSALNSLVVSCASAVGVRVAATYEAGALSLKKVMNFYSTTPCETGAQAGSSAIGPEGLKDSREEQVKQESMQGKKSSSLVDIREEETEGGSRRLSLPGLLSQVSPRLLRKAARVKTRTVVLTPTYSGEADALLPSLRTEVWTWGKGKEGQLGHGDVLPRLQPLCVKCLDGKEVIHLEAGGYHSLALTAKSQVYSWGSNTFGQLGHSDFPTTVPRLAKISSENGVWSIAAGRDYSLFLVDTEDFQPGLYYSGRQDPTEGDNLPENHSGSKTPVLLSCSKLGYISRVTAGKDSYLALVDKNIMGYIASLHELATTERRFYSKLSDIKSQILRPLLSLENLGTTTTVQLLQEVASRFSKLCYLIGQHGASLSSFLHGVKEARSLVILKHSSLFLDSYTEYCTSITNFLVMGGFQLLAKPAIDFLNKNQELLQDLSEVNDENTQLMEILNTLFFLPIRRLHNYAKVLLKLATCFEVASPEYQKLQDSSSCYECLALHLGRKRKEAEYTLGFWKTFPGKMTDSLRKPERRLLCESSNRALSLQHAGRFSVNWFILFNDALVHAQFSTHHVFPLATLWAEPLSEEAGGVNGLKITTPEEQFTLISSTPQEKTKWLRAISQAVDQALRGMSDLPPYGSGSSVQRQEPPISRSAKYTFYKDPRLKDATYDGRWLSGKPHGRGVLKWPDGKMYSGMFRNGLEDGYGEYRIPNKAMNKEDHYVGHWKEGKMCGQGVYSYASGEVFEGCFQDNMRHGHGLLRSGKLTSSSPSMFIGQWVMDKKAGYGVFDDITRGEKYMGMWQDDVCQGNGVVVTQFGLYYEGNFHLNKMMGNGVLLSEDDTIYEGEFSDDWTLSGKVGN

SEQ ID NO: 744954 - protein, 126 aa, Homo sapiens
LSNHSYASGEVFEGCFQDNMRHGHGLLRSGKLTSSSPSMFIGQWVMDKKAGYGVFDDITRGEKYMGMWQDDVCQGNGVVVTQFGLYYEGNFHLNKMMGNGVLLSEDDTIYEGEFSDDWTLSGKVGN

SEQ ID NO: 744955 - protein, 1639 aa, Homo sapiens
MDSKKRSSTEAEGSKERGLVHIWQAGSFPITPERLPGWGGKTVLQAALGVKHGVLLTEDGEVYSFGTLPWRSGPVEICPSSPILDGAVTDNGVAYMWGENSAGQCAVANQQYVPEPNPVSIADSEASPLLAVRILQLACGEEHTLALSISREIWAWGTGCQLGLITTAFPVTKPQKVEHLAGRVVLQVACGAFHSLALVQCLPSQDLKPVPERCNQCSQLLITMTDKEDHVIISDSHCCPLGVTLTESQAENHASTALSPSTETLDRQEEVFENTLVANDQSVATELNAVSAQITSSDAMSSQQNVMGTTEISSARNIPSYPDTQAVNEYLRKLSDHSVREDSEHGEKPVPSQPLLEEAIPNLHSPPTTSTSALNSLVVSCASAVGVRVAATYEAGALSLKKVMNFYSTTPCETGAQAGSSAIGPEGLKDSREEQVKQESMQGKKSSSLVDIREEETEGGSRRLSLPGLLSQVSPRLLRKAARVKTRTVVLTPTYSGEADALLPSLRTEVWTWGKGKEGQLGHGDVLPRLQPLCVKCLDGKEVIHLEAGGYHSLALTAKSQVYSWGSNTFGQLGHSDFPTTVPRLAKISSENGVWSIAAGRDYSLFLVDTEDFQPGLYYSGRQDPTEGDNLPENHSGSKTPVLLSCSKLGYISRVTAGKDSYLALVDKNIMGYIASLHELATTERRFYSKLSDIKSQILRPLLSLENLGTTTTVQLLQEVASRFSKLCYLIGQHGASLSSFLHGVKEARSLVILKHSSLFLDSYTEYCTSITNFLVMGGFQLLAKPAIDFLNKNQELLQDLSEVNDENTQLMEILNTLFFLPIRRLHNYAKVLLKLATCFEVASPEYQKLQDSSSCYECLALHLGRKRKEAEYTLGFWKTFPGKMTDSLRKPERRLLCESSNRALSLQHAGRFSVNWFILFNDALVHAQFSTHHVFPLATLWAEPLSEEAGGVNGLKITTPEEQFTLISSTPQEKTKWLRAISQAVDQALRGMSDLPPYGSGSSVQRQEPPISRSAKYTFYKDPRLKDATYDGRWLSGKPHGRGVLKWPDGKMYSGMFRNGLEDGYGEYRIPNKAMNKEDHYVGHWKEGKMCGQGVYSYASGEVFEGCFQDNMRHGHGLLRSGKLTSSSPSMFIGQWVMDKKAGYGVFDDITRGEKYMGMWQDDVCQGNGVVVTQFGLYYEGNFHLNKMMGNGVLLSEDDTIYEGEFSDDWTLSGKGTLTMPNGDYIEGYFSGEWGSGIKITGTYFKPSLYESDKDRPKVFRKLGNLAVPADEKWKAVFDECWRQLGCEGPGQGEVWKAWDNIAVALTTSRRQHRDSPEILSRSQTQTLESLEFIPQHVGAFSVEKYDDIRKYLIKACDTPLHPLGRLVETLVAVYRMTYVGVGANRRLLQEAVKEIKSYLKRIFQLVRFLFPELPEEGSTIPLSAPLPTERKSFCTGKSDSRSESPEPGYVVTSSGLLLPVLLPRLYPPLFMLYALDNDREEDIYWECVLRLNKQPDIALLGFLGVQRKFWPATLSILGESKKVLPTTKDACFASAVECLQQISTTFTPSDKLKVIQQTFEEISQSVLASLHEDFLWSMDDLFPVFLYVVLRARIRNLGSEVHLIEDLMDPYLQHGEQGIMFTTLKACYYQIQREKLN

SEQ ID NO: 744956 - protein, 503 aa, Homo sapiens
ATTSTHGRIWCLDDITRGEKYMGMWQDDVCQGNGVVVTQFGLYYEGNFHLNKMMGNGVLLSEDDTIYEGEFSDDWTLSGKGTLTMPNGDYIEGYFSGEWGSGIKITGTYFKPSLYESDKDRPKVFRKLGNLAVPADEKWKAVFDECWRQLGCEGPGQGEVWKAWDNIAVALTTSRRQHRDSPEILSRSQTQTLESLEFIPQHVGAFSVEKYDDIRKYLIKACDTPLHPLGRLVETLVAVYRMTYVGVGANRRLLQEAVKEIKSYLKRIFQLVRFLFPELPEEGSTIPLSAPLPTERKSFCTGKSDSRSESPEPGYVVTSSGLLLPVLLPRLYPPLFMLYALDNDREEDIYWECVLRLNKQPDIALLGFLGVQRKFWPATLSILGESKKVLPTTKDACFASAVECLQQISTTFTPSDKLKVIQQTFEEISQSVLASLHEDFLWSMDDLFPVFLYVVLRARIRNLGSEVHLIEDLMDPYLQHGEQGIMFTTLKACYYQIQREKLN

SEQ ID NO: 744957 - protein, 812 aa, Homo sapiens
MDSKKRSSTEAEGSKERGLVHIWQAGSFPITPERLPGWGGKTVLQAALGVKHGVLLTEDGEVYSFGTLPWRSGPVEICPSSPILENALVGQYVITVATGSFHSGAVTDNGVAYMWGENSAGQCAVANQQYVPEPNPVSIADSEASPLLAVRILQLACGEEHTLALSISREIWAWGTGCQLGLITTAFPVTKPQKVEHLAGRVVLQVACGAFHSLALVQCLPSQDLKPVPERCNQCSQLLITMTDKEDHVIISDSHCCPLGVTLTESQAENHASTALSPSTETLDRQEEVFENTLVANDQSVATELNAVSAQITSSDAMSSQQNVMGTTEISSARNIPSYPDTQAVNEYLRKLSDHSVREDSEHGEKPVPSQPLLEEAIPNLHSPPTTSTSALNSLVVSCASAVGVRVAATYEAGALSLKKVMNFYSTTPCETGAQAGSSAIGPEGLKDSREEQVKQESMQGKKSSSLVDIREEETEGGSRRLSLPGLLSQVSPRLLRKAARVKTRTVVLTPTYSGEADALLPSLRTEVWTWGKGKEGQLGHGDVLPRLQPLCVKCLDGKEVIHLEAGGYHSLALTAKSQVYSWGSNTFGQLGHSDFPTTVPRLAKISSENGVWSIAAGRDYSLFLVDTEDFQPGLYYSGRQDPTEGDNLPENHSGSKTPVLLSCSKLGYISRVTAGKDSYLALVDKNIMGYIASLHELATTERRFYSKLSDIKSQILRPLLSLENLGTTTTVQLLQEVASRFSKLCYLIGQHGASLSSFLHGVKEARSLVILKHSSLFLDSYTEQVSSPVSCSISAGLFCQGEQLLNQKRLD

SEQ ID NO: 744958 - protein, 82 aa, Homo sapiens
QTPYERLRVVAMNTILDYLLLHSSFQKELATRFVKRIPAHVSDFLAQKAFLSCYITACVPHFFNRQVLLHKQKASSCNRWQS

SEQ ID NO: 744959 - protein, 98 aa, Homo sapiens
IDDTYLLLLLGPQFVLLGSSSYSCCGWLSAGCAYATSPPRKPQTPRPKQASLSRDISHMSLQFAAGRHILCGLGQDLCQTSLNLPMYIFFLLLLCSLL

SEQ ID NO: 744960 - protein, 914 aa, Homo sapiens
MVQRMWAEAAGPAGGAEPLFPGSRRSRSVWDAVRLEVGVPDSCPVVLHSFTQLDPDLPRPESSTQEIGEELINGVIYSISLRKVQLHHGGNKGQRWLGYENESALNLYETCKVRTVKAGTLEKLVEHLVPAFQGSDLSYVTIFLCTYRAFTTTQQVLDLLFKRYGRCDALTASSRYGCILPYSDEDGGPQDQLKNAISSILGTWLDQYSEDFCQPPDFPCLKQLVAYVQLNMPGSDLERRAHLLLAQLEHSEPIEAEPEALSPVPALKPTPELELALTPARAPSPVPAPAPEPEPAPTPAPGSELEVAPAPAPELQQAPEPAVGLESAPAPALELEPAPEQDPAPSQTLELEPAPAPVPSLQPSWPSPVVAENGLSEEKPHLLVFPPDLVAEQFTLMDAELFKKVVPYHCLGSIWSQRDKKGKEHLAPTIRATVTQFNSVANCVITTCLGNRSTKAPDRARVVEHWIEVARECRILKNFSSLYAILSALQSNSIHRLKKTWEDVSRDSFRIFQKLSEIFSDENNYSLSRELLIKEGTSKFATLEMNPKRAQKRPKETGIIQGTVPYLGTFLTDLVMLDTAMKDYLYGRLINFEKRRKEFEVIAQIKLLQSACNNYSIAPDEQFGAWFRAVERLSETESYNLSCELEPPSESASNTLRTKKNTAIVKRWSDRQAPSTELSTSGSSHSKSCDQLRCGPYLSSGDIADALSVHSAGSSSSDVEEINISFVPESPDGQEKKFWESASQSSPETSGISSASSSTSSSSASTTPVAATRTHKRSVSGLCNSSSALPLYNQQVGDCCIIRVSLDVDNGNMYKSILVTSQDKAPAVIRKAMDKHNLEEEEPEDYELLQILSDDRKLKIPENANVFYAMNSTANYDFVLKKRTFTKGVKVKHGASSTLPRMKQKGLKIAKGIF

SEQ ID NO: 744961 - protein, 105 aa, Homo sapiens
MARYEAVVAVTSQDKAPAVIRKAMDKHNLEEEEPEDYELLQILSDDRKLKIPENANVFYAMNSTANYDFVLKKRTFTKGVKVKHGASSTLPRMKQKGLKIAKGIF

SEQ ID NO: 744962 - protein, 105 aa, Homo sapiens
KIVIVRGRVVTSQDKAPAVIRKAMDKHNLEEEEPEDYELLQILSDDRKLKIPENANVFYAMNSTANYDFVLKKRTFTKGVKVKHGASSTLPRMKQKGLKIAKGIF

SEQ ID NO: 744963 - protein, 468 aa, Homo sapiens
MYAILSALQSNSIHRLKKTWEDVSRDSFRIFQKLSEIFSDENNYSLSRELLIKEGTSKFATLEMNPKRAQKRPKETGIIQGTVPYLGTFLTDLVMLDTAMKDYLYGRLINFEKRRKEFEVIAQIKLLQSACNNYSIAPDEQFGAWFRAVERLSETESYNLSCELEPPSESASNTLRTKKNTAIVKRWSDRQAPSTELSTSGSSHSKSCDQLRCGPYLSSGDIADALSVHSAGSSSSDVEEINISFVPESPDGQEKKVTACPSPQYPFPSPHSKSMHGARKPWILNTASRRFPIWQLAWGAPTGQWDLLILPSPSVLGISLTVIPGDLRHQLSLQQHLVLLSLHHARGCHTHPQALCLRALQLQLRAAALQPAGGRLLYHPRQPGRGQWQHVQEHPGKPAGVAWVPPSTGGKCTLNTVHHPCPSGVYLVVGGEGQMSARYRNEEGSDQGQGWPEGRGGGKEQPCKAPRS

SEQ ID NO: 744964 - protein, 433 aa, Homo sapiens
MYAILSALQSNSIHRLKKTWEDVSRDSFRIFQKLSEIFSDENNYSLSRELLIKEGTSKFATLEMNPKRAQKRPKETGIIQGTVPYLGTFLTDLVMLDTAMKDYLYGRLINFEKRRKEFEVIAQIKLLQSACNNYSIAPDEQFGAWFRAVERLSETESYNLSCELEPPSESASNTLRTKKNTAIVKRWSDRQAPSTELSTSGSSHSKSCDQLRCGPYLSSGDIADALSVHSAGSSSSDVEEINISFVPESPDGQEKKFWESASQSSPETSGISSASSSTSSSSASTTPVAATRTHKRSVSGLCNSSSALPLYNQQVGDCCIIRVSLDVDNGNMYKSILVTSQDKAPAVIRKAMDKHNLEEEEPEDYELLQILSDDRKLKIPENANVFYAMNSTANYDFVLKKRTFTKGVKVKHGASSTLPRMKQKGLKIAKGIF

SEQ ID NO: 744965 - protein, 952 aa, Homo sapiens
EPSMVQRMWAEAAGPAGGAEPLFPGSRRSRSVWDAVRLEVGVPDSCPVVLHSFTQLDPDLPRPESSTQEIGEELINGVIYSISLRKVQLHHGGNKGQRWLGYENESALNLYETCKVRTVKAGTLEKLVEHLVPAFQGSDLSYVTIFLCTYRAFTTTQQVLDLLFKRYGRCDALTASSRYGCILPYSDEDGGPQDQLKNAISSILGTWLDQYSEDFCQPPDFPCLKQLVAYVQLNMPGSDLERRAHLLLAQLEHSEPIEAEPEALSPVPALKPTPELELALTPARAPSPVPAPAPEPEPAPTPAPGSELEVAPAPAPELQQAPEPAVGLESAPAPALELEPAPEQDPAPSQTLELEPAPAPVPSLQPSWPSPVVAENGLSEEKPHLLVFPPDLVAEQFTLMDAELFKKVVPYHCLGSIWSQRDKKGKEHLAPTIRATVTQFNSVANCVITTCLGNRSTKAPDRARVVEHWIEVARECRILKNFSSLYAILSALQSNSIHRLKKTWEDVSRDSFRIFQKLSEIFSDENNYSLSRELLIKEGTSKFATLEMNPKRAQKRPKETGIIQGTVPYLGTFLTDLVMLDTAMKDYLYGRLINFEKRRKEFEVIAQIKLLQSACNNYSIAPDEQFGAWFRAVERLSETESYNLSCELEPPSESASNTLRTKKNTAIVKRWSDRQAPSTELSTSGSSHSKSCDQLRCGPYLSSGDIADALSVHSAGSSSSDVEEINISFVPESPDGQEKKVTACPSPQYPFPSPHSKSMHGARKPWILNTASRRFPIWQLAWGAPTGQWDLLILPSPSVLGISLTVIPGDLRHQLSLQQHLVLLSLHHARGCHTHPQALCLRALQLQLRAAALQPAGGRLLYHPRQPGRGQWQHVQEHPGKPAGVAWVPPSTGGKCTLNTVHHPCPSGVYLVVGGEGQMSARYRNEEGSDQGQGWPEGRGGGKEQPCKAPRS

SEQ ID NO: 744966 - protein, 832 aa, Homo sapiens
MYAILSALQSNSIHRLKKTWEDVSRDSFRIFQKLSEIFSDENNYSLSRELLIKEGTSKFATLEMNPKRAQKRPKETGIIQGTVPYLGTFLTDLVMLDTAMKDYLYGRLINFEKRRKEFEVIAQIKLLQSACNNYSIAPDEQFGAWFRAVERLSETESYNLSCELEPPSESASNTLRTKKNTAIVKRWSDRQAPSTELSTSGSSHSKSCDQLRCGPYLSSGDIADALSVHSAGSSSSDVEEINISFVPESPDGQEKKVTACPSPQYPFPSPHSKSMHGARKPWILNTASRRFPIWQLAWGAPTGQWDLLILPSPSVLGISLTVIPGDLRHQLSLQQHLVLLSLHHARGCHTHPQALCLRALQLQLRAAALQPAGGRLLYHPRQPGRGQWQHVQEHPGKPAGVAWVPPSTGGKCTLNTVHHPCPSGVYLVVGGEGQMSARYRNEEGSDQGQGWPEGRGGGKEQPCKAPRSRRGCAVGEVRSGKYPGPGHIGPEPCQDLDFLGEEDRSNDGWLLCLAWAGTRAAGVLVRRPLWQPGWEPWKGPAGSESRQDLETADGNCSQNGFAWGLFLHPPGVLRQMNHFNPHPLYPSPGSGAPLFTHAPDPSLPGASMVVIKQSPVALCPSSACALALRVKVAGAWPMLTTLSILAGPSFLTSRAWTRDCLFPRLSDAVILEGQVLLKEVWEEGTVSYRRSRVGTAGTDPSSFLEASHGEQKDGGLTWGVGECDKALSGPSTWPEAVTSQDKAPAVIRKAMDKHNLEEEEPEDYELLQILSDDRKLKIPENANVFYAMNSTANYDFVLKKRTFTKGVKVKHGASSTLPRMKQKGLKIAKGIF

SEQ ID NO: 744967 - protein, 403 aa, Homo sapiens
MVLILGRRLNREDLGVRDSPATKRKVFEMDPKSLTGHEFFDFSSGSSHAENILQIFNEFRDSRLFTDVIICVEGKEFPCHRAVLSACSSYFRAMFCNDHRESREMLVEINGILAEAMECFLQYVYTGKVKITTENVQYLFETSSLFQISVLRDACAKFLEEQLDPCNCLGIQRFADTHSLKTLFTKCKNFALQTFEDVSQHEEFLELDKDEVYVVGGYDGQNRLSSVECYDSFSNRWTEVAPLKEAVSSPAVTSCVGKLFVIGGGPDDNTCSDKVQSYDPETNSWLLRAAIPIAKRCITAVSLNNLIYVAGGLTKAIYCYDPVEDYWMHVQNTFSRQENCGMSVCNGKIYILGGRRENGEATDTILCYDPATSIITGVAAMPRPVSYHGCVTIHRYNEKCFKL

SEQ ID NO: 744968 - protein, 135 aa, Homo sapiens
GRYPRESSSFYWRVFMVTRWACPWAILPVPGEPGRAGERAFRRRSPRLTSPPSYHSRTQFLNLVPNGPALKFWTPRVKTVNAAGAGGARSRPCCGRLVASVAAAALLLPDPAGSSGHAEIGYRGLPSEDRKINTL

SEQ ID NO: 744969 - protein, 120 aa, Homo sapiens
GFSLGSLHKRHFFNCLCLKQGVFESAALWVGLVLLGTRHPPHGGSPRWPRRPPGSVNYISQGSPGRRTPTRIGQGSLTLSVLARTVTCFLCCELRQRLVAGGDAGAGECAAPPAAEGPRG

SEQ ID NO: 744970 - protein, 600 aa, Homo sapiens
MVLILGRRLNREDLGVRDSPATKRKVFEMDPKSLTGHEFFDFSSGSSHAENILQIFNEFRDSRLFTDVIICVEGKEFPCHRAVLSACSSYFRAMFCNDHRESREMLVEINGILAEAMECFLQYVYTGKVKITTENVQYLFETSSLFQISVLRDACAKFLEEQLDPCNCLGIQRFADTHSLKTLFTKCKNFALQTFEDVSQHEEFLELDKDELIDYICSDELVIGKEEMVFEAVMRWVYRAVDLRRPLLHELLTHVRLPLLHPNYFVQTVEVDQLIQNSPECYQLLHEARRYHILGNEMMSPRTRPRRSTGYSEVIVVVGGCERVGGFNLPYTECYDPVTGEWKSLAKLPEFTKSEYAVCALRNDILVSGGRINSRDVWIYNSQLNIWIRVASLNKGRWRHKMAVLLGKVYVVGGYDGQNRLSSVECYDSFSNRWTEVAPLKEAVSSPAVTSCVGKLFVIGGGPDDNTCSDKVQSYDPETNSWLLRAAIPIAKRCITAVSLNNLIYVAGGLTKAIYCYDPVEDYWMHVQNTFSRQENCGMSVCNGKIYILGGRRENGEATDTILCYDPATSIITGVAAMPRPVSYHGCVTIHRYNEKCFKL

SEQ ID NO: 744971 - protein, 199 aa, Homo sapiens
MAVLLGKVYVVGGYDGQNRLSSVECYDSFSNRWTEVAPLKEAVSSPAVTSCVGKLFVIGGGPDDNTCSDKVQSYDPETNSWLLRAAIPIAKRCITAVSLNNLIYVAGGLTKAIYCYDPVEDYWMHVQNTFSRQENCGMSVCNGKIYILGGRRENGEATDTILCYDPATSIITGVAAMPRPVSYHGCVTIHRYNEKCFKL

SEQ ID NO: 744972 - protein, 537 aa, Homo sapiens
MVLILGRRLNREDLGVRDSPATKRKVFEMDPKSLTGHEFFDFSSGSSHAENILQIFNEFRDSRLFTDVIICVEGKEFPCHRAVLSACSSYFRAMFCNDHRESREMLVEINGILAEAMECFLQYVYTGKVKITTENVQYLFETSSLFQISVLRDACAKFLEEQLDPCNCLGIQRFADTHSLKTLFTKCKNFALQTFEDVSQHEEFLELDKDELIDYICSDELVIGKEEMVFEAVMRWVYRAVDLRRPLLHELLTHVRLPLLHPNYFVQTVEVDQLIQNSPECYQLLHEARRYHILGNEMMSPRTRPRRSTGYSEVIVVVGGCERVGGFNLPYTECYDPVTGEWKSLAKLPEFTKSEYAVCALRNDILVSGGRINSRDVWIYNSQLNIWIRVASLNKGRWRHKMAVLLGKVYVVGGYDGQNRLSSVECYDSFSNRWTEVAPLKEAVSSPAVTSCVGKLFVIGGGPDDNTCSDKVQSYDPETNSWLLRAAIPIAKRCITAVSLNNLIYVAGGLTKAIYCYDPVEDYWMHVQNTFSRQVIT

SEQ ID NO: 744973 - protein, 600 aa, Homo sapiens; identical to SEQ ID NO: 744970

SEQ ID NO: 744974 - protein, 227 aa, Homo sapiens
MVLILGRRLNREDLGVRDSPATKRKVFEMDPKSLTGHEFFDFSSGSSHAENILQIFNEFRDSRLFTDVIICVEGKEFPCHRAVLSACSSYFRAMFCNDHRESREMLVEINGILAEAMECFLQYVYTGKVKITTENVQYLFETSSLFQISVLRDACAKFLEEQLDPCNCLGIQRFADTHSLKTLFTKCKNFALQTFEDVSQHEEFLELDKDELIDYICSDEGFSSCYF

SEQ ID NO: 744975 - protein, 30 aa, Homo sapiens
MGCERGAAFYFRKPGGVRPPQIQPSCLVGR

SEQ ID NO: 744976 - protein, 108 aa, Homo sapiens
LQPFEEPRPGRSLSQGCDFLFGDLWCLGSPSLWATPHSPVPAMEAACGVPSPAAASQRAGTPAGTWSCLPHSSSQCVGAVAESHACSHTPCCSTPDSQSPLEVWDLGW

SEQ ID NO: 744977 - protein, 1566 aa, Homo sapiens
GVGAAPSRGRGLCAGLAPDPSHRPAASASPDSPPGDPEAPTSSEMSRNDKEPFFVKFLKSSDNSKCFFKALESIKEFQSEEYLQIITEEEALKIKENDRSLYICDPFSGVVFDHLKKLGCRIVGPQVVIFCMHHQRCVPRAEHPVYNMVMSDVTISCTSLEKEKREEVHKYVQMMGGRVYRDLNVSVTHLIAGEVGSKKYLVAANLKKPILLPSWIKTLWEKSQEKKITRYTDINMEDFKCPIFLGCIICVTGLCGLDRKEVQQLTVKHGGQYMGQLKMNECTHLIVQEPKGQKYECAKRWNVHCVTTQWFFDSIEKGFCQDESIYKTEPRPEAKTMPNSSTPTSQINTIDSRTLSDVSNISNINASCVSESICNSLNSKLEPTLENLENLDVSAFQAPEDLLDGCRIYLCGFSGRKLDKLRRLINSGGGVRFNQLNEDVTHVIVGDYDDELKQFWNKSAHRPHVVGAKWLLECFSKGYMLSEEPYIHANYQPVEIPVSHQPESKAALLKKKNSSFSKKDFAPSEKHEQADEDLLSQYENGSSTVVEAKTSEARPFNDSTHAEPLNDSTHISLQEENQSSVSHCVPDVSTITEEGLFSQKSFLVLGFSNENESNIANIIKENAGKIMSLLSRTVADYAVVPLLGCEVEATVGEVVTNTWLVTCIDYQTLFDPKSNPLFTPVPVMTGMTPLEDCVISFSQCAGAEKESLTFLANLLGASVQEYFVRKSNAKKGMFASTHLILKERGGSKYEAAKKWNLPAVTIAWLLETARTGKRADESHFLIENSTKEERSLETEITNGINLNSDTAEHPGTRLQTHRKTVVTPLDMNRFQSKAFRAVVSQHARQVAASPAVGQPLQKEPSLHLDTPSKFLSKDKLFKPSFDVKDALAALETPGRPSQQKRKPSTPLSEVIVKNLQLALANSSRNAVALSASPQLKEAQSEKEEAPKPLHKVVVCVSKKLSKKQSELNGIAASLGADYRWSFDETVTHFIYQGRPNDTNREYKSVKERGVHIVSEHWLLDCAQECKHLPESLYPHTYNPKMSLDISAVQDGRLCNSRLLSAVSSTKDDEPDPLILEENDVDNMATNNKESAPSNGSGKNDSKGVLTQTLEMRENFQKQLQEIMSATSIVKPQGQRTSLSRSGCNSASSTPDSTRSARSGRSRVLEALRQSRQTVPDVNTEPSQNEQIIWDDPTAREERARLASNLQWPSCPTQYSELQVDIQNLEDSPFQKPLHDSEIAKQAVCDPGNIRVTEAPKHPISEELETPIKDSHLIPTPQAPSIAFPLANPPVAPHPREKIITIEETHEELKKQYIFQLSSLNPQERIDYCHLIEKLGGLVIEKQCFDPTCTHIVVGHPLRNEKYLASVAAGKWVLHRSYLEACRTAGHFVQEEDYEWGSSSILDVLTGINVQQRRLALAAMRWRKKIQQRQESGIVEGAFSGWKVILHVDQSREAGFKRLLQSGGAKVLPGHSVPLFKEATHLFSDLNKLKPDDSGVNIAEAAAQNVYCLRTEYIADYLMQESPPHVENYCLPEAISFIQNNKELGTGLSQKRKAPTEKNKIKRPRVH

SEQ ID NO: 744978 - protein, 1259 aa, Homo sapiens
GVGAAPSRGRGLCAGLAPDPSHRPAASASPDSPPGDPEAPTSSEMSRNDKEPFFVKFLKSSDNSKCFFKALESIKEFQSEEYLQIITEEEALKIKENDRSLYICDPFSGVVFDHLKKLGCRIVGPQVVIFCMHHQRCVPRAEHPVYNMVMSDVTISCTSLEKEKREEVHKYVQMMGGRVYRDLNVSVTHLIAGEVGSKKYLVAANLKKPILLPSWIKTLWEKSQEKKITRYTDINMEDFKCPIFLGCIICVTGLCGLDRKEVQQLTVKHGGQYMGQLKMNECTHLIVQEPKGQKYECAKRWNVHCVTTQWFFDSIEKGFCQDESIYKTEPRPEAKTMPNSSTPTSQINTIDSRTLSDVSNISNINASCVSESICNSLNSKLEPTLENLENLDVSAFQAPEDLLDGCRIYLCGFSGRKLDKLRRLINSGGGVRFNQLNEDVTHVIVGDYDDELKQFWNKSAHRPHVVGAKWLLECFSKGYMLSEEPYIHANYQPVEIPVSHQPESKAALLKKKNSSFSKKDFAPSEKHEQADEDLLSQYENGSSTVVEAKTSEARPFNDSTHAEPLNDSTHISLQEENQSSVSHCVPDVSTITEEGLFSQKSFLVLGFSNENESNIANIIKENAGKIMSLLSRTVADYAVVPLLGCEVEATVGEVVTNTWLVTCIDYQTLFDPKSNPLFTPVPVMTGMTPLEDCVISFSQCAGAEKESLTFLANLLGASVQEYFVRKSNAKKGMFASTHLILKERGGSKYEAAKKWNLPAVTIAWLLETARTGKRADESHFLIENSTKEERSLETEITNGINLNSDTAEHPGTRLQTHRKTVVTPLDMNRFQSKAFRAVVSQHARQVAASPAVGQPLQKEPSLHLDTPSKFLSKDKLFKPSFDVKDALAALETPGRPSQQKRKPSTPLSEVIVKNLQLALANSSRNAVALSASPQLKEAQSEKEEAPKPLHKVVVCVSKKLSKKQSELNGIAASLGADYRWSFDETVTHFIYQGRPNDTNREYKSVKERGVHIVSEHWLLDCAQECKHLPESLYPHTYNPKMSLDISAVQDGRLCNSRLLSAVSSTKDDEPDPLILEENDVDNMATNNKESAPSNGSGKNDSKGVLTQTLEMRENFQKQLQEIMSATSIVKPQGQRTSLSRSGCNSASSTPDSTRSARSGRSRVLEALRQSRQTVPDVNTEPSQNEQIIWDDPTAREERARLASNLQWPSCPTQYSELQVDIQNLEDSPFQKPLHDSEIAKQGNKKEIFAFVCIKYMLTS

SEQ ID NO: 744979 - protein, 1112 aa, Homo sapiens
MVMSDVTISCTSLEKEKREEVHKYVQMMGGRVYRDLNVSVTHLIAGEVGSKKYLVAANLKKPILLPSWIKTLWEKSQEKKITRYTDINMEDFKCPIFLGCIICVTGLCGLDRKEVQQLTVKHGGQYMGQLKMNECTHLIVQEPKGQKYECAKRWNVHCVTTQWFFDSIEKGFCQDESIYKTEPRPEAKTMPNSSTPTSQINTIDSRTLSDVSNISNINASCVSESICNSLNSKLEPTLENLENLDVSAFQAPEDLLDGCRIYLCGFSGRKLDKLRRLINSGGGVRFNQLNEDVTHVIVGDYDDELKQFWNKSAHRPHVVGAKWLLECFSKGYMLSEEPYIHANYQPVEIPVSHQPESKAALLKKKNSSFSKKDFAPSEKHEQADEDLLSQYENGSSTVVEAKTSEARPFNDSTHAEPLNDSTHISLQEENQSSVSHCVPDVSTITEEGLFSQKSFLVLGFSNENESNIANIIKENAGKIMSLLSRTVADYAVVPLLGCEVEATVGEVVTNTWLVTCIDYQTLFDPKSNPLFTPVPVMTGMTPLEDCVISFSQCAGAEKESLTFLANLLGASVQEYFVRKSNAKKGMFASTHLILKERGGSKYEAAKKWNLPAVTIAWLLETARTGKRADESHFLIENSTKEERSLETEITNGINLNSDTAEHPGTRLQTHRKTVVTPLDMNRFQSKAFRAVVSQHARQVAASPAVGQPLQKEPSLHLDTPSKFLSKDKLFKPSFDVKDALAALETPGRPSQQKRKPSTPLSEVIVKNLQLALANSSRNAVALSASPQLKEAQSEKEEAPKPLHKVVVCVSKKLSKKQSELNGIAASLGADYRWSFDETVTHFIYQGRPNDTNREYKSVKERGVHIVSEHWLLDCAQECKHLPESLYPHTYNPKMSLDISAVQDGRLCNSRLLSAVSSTKDDEPDPLILEENDVDNMATNNKESAPSNGSGKNDSKGVLTQTLEMRENFQKQLQEIMSATSIVKPQGQRTSLSRSGCNSASSTPDSTRSARSGRSRVLEALRQSRQTVPDVNTEPSQNEQIIWDDPTAREERARLASNLQWPSCPTQYSELQVDIQNLEDSPFQKPLHDSEIAKQGNKKEIFAFVCIKYMLTS

SEQ ID NO: 744980 - protein, 1086 aa, Homo sapiens
MMGGRVYRDLNVSVTHLIAGEVGSKKYLVAANLKKPILLPSWIKTLWEKSQEKKITRYTDINMEDFKCPIFLGCIICVTGLCGLDRKEVQQLTVKHGGQYMGQLKMNECTHLIVQEPKGQKYECAKRWNVHCVTTQWFFDSIEKGFCQDESIYKTEPRPEAKTMPNSSTPTSQINTIDSRTLSDVSNISNINASCVSESICNSLNSKLEPTLENLENLDVSAFQAPEDLLDGCRIYLCGFSGRKLDKLRRLINSGGGVRFNQLNEDVTHVIVGDYDDELKQFWNKSAHRPHVVGAKWLLECFSKGYMLSEEPYIHANYQPVEIPVSHQPESKAALLKKKNSSFSKKDFAPSEKHEQADEDLLSQYENGSSTVVEAKTSEARPFNDSTHAEPLNDSTHISLQEENQSSVSHCVPDVSTITEEGLFSQKSFLVLGFSNENESNIANIIKENAGKIMSLLSRTVADYAVVPLLGCEVEATVGEVVTNTWLVTCIDYQTLFDPKSNPLFTPVPVMTGMTPLEDCVISFSQCAGAEKESLTFLANLLGASVQEYFVRKSNAKKGMFASTHLILKERGGSKYEAAKKWNLPAVTIAWLLETARTGKRADESHFLIENSTKEERSLETEITNGINLNSDTAEHPGTRLQTHRKTVVTPLDMNRFQSKAFRAVVSQHARQVAASPAVGQPLQKEPSLHLDTPSKFLSKDKLFKPSFDVKDALAALETPGRPSQQKRKPSTPLSEVIVKNLQLALANSSRNAVALSASPQLKEAQSEKEEAPKPLHKVVVCVSKKLSKKQSELNGIAASLGADYRWSFDETVTHFIYQGRPNDTNREYKSVKERGVHIVSEHWLLDCAQECKHLPESLYPHTYNPKMSLDISAVQDGRLCNSRLLSAVSSTKDDEPDPLILEENDVDNMATNNKESAPSNGSGKNDSKGVLTQTLEMRENFQKQLQEIMSATSIVKPQGQRTSLSRSGCNSASSTPDSTRSARSGRSRVLEALRQSRQTVPDVNTEPSQNEQIIWDDPTAREERARLASNLQWPSCPTQYSELQVDIQNLEDSPFQKPLHDSEIAKQGNKKEIFAFVCIKYMLTS

SEQ ID NO: 744981 - protein, 830 aa, Homo sapiens
FLWALVREVDVTHVIVGDYDDELKQFWNKSAHRPHVVGAKWLLECFSKGYMLSEEPYIHANYQPVEIPVSHQPESKAALLKKKNSSFSKKDFAPSEKHEQADEDLLSQYENGSSTVVEAKTSEARPFNDSTHAEPLNDSTHISLQEENQSSVSHCVPDVSTITEEGLFSQKSFLVLGFSNENESNIANIIKENAGKIMSLLSRTVADYAVVPLLGCEVEATVGEVVTNTWLVTCIDYQTLFDPKSNPLFTPVPVMTGMTPLEDCVISFSQCAGAEKESLTFLANLLGASVQEYFVRKSNAKKGMFASTHLILKERGGSKYEAAKKWNLPAVTIAWLLETARTGKRADESHFLIENSTKEERSLETEITNGINLNSDTAEHPGTRLQTHRKTVVTPLDMNRFQSKAFRAVVSQHARQVAASPAVGQPLQKEPSLHLDTPSKFLSKDKLFKPSFDVKDALAALETPGRPSQQKRKPSTPLSEVIVKNLQLALANSSRNAVALSASPQLKEAQSEKEEAPKPLHKVVVCVSKKLSKKQSELNGIAASLGADYRWSFDETVTHFIYQGRPNDTNREYKSVKERGVHIVSEHWLLDCAQECKHLPESLYPHTYNPKMSLDISAVQDGRLCNSRLLSAVSSTKDDEPDPLILEENDVDNMATNNKESAPSNGSGKNDSKGVLTQTLEMRENFQKQLQEIMSATSIVKPQGQRTSLSRSGCNSASSTPDSTRSARSGRSRVLEALRQSRQTVPDVNTEPSQNEQIIWDDPTAREERARLASNLQWPSCPTQYSELQVDIQNLEDSPFQKPLHDSEIAKQGNKKEIFAFVCIKYMLTS

SEQ ID NO: 744982 - protein, 957 aa, Homo sapiens
GVGAAPSRGRGLCAGLAPDPSHRPAASASPDSPPGDPEAPTSSEMSRNDKEPFFVKFLKSSDNSKCFFKALESIKEFQSEEYLQIITEEEALKIKENDRSLYICDPFSGVVFDHLKKLGCRIVGPQVVIFCMHHQRCVPRAEHPVYNMVMSDVTISCTSLEKEKREEVHKYVQMMGGRVYRDLNVSVTHLIAGEVGSKKYLVAANLKKPILLPSWIKTLWEKSQEKKITRYTDINMEDFKCPIFLGCIICVTGLCGLDRKEVQQLTVKHGGQYMGQLKMNECTHLIVQEPKGQKYECAKRWNVHCVTTQWFFDSIEKGFCQDESIYKTEPRPEAKTMPNSSTPTSQINTIDSRTLSDVSNISNINASCVSESICNSLNSKLEPTLENLENLDVSAFQAPEDLLDGCRIYLCGFSGRKLDKLRRLINSGGGVRFNQLNEDVTHVIVGDYDDELKQFWNKSAHRPHVVGAKWLLECFSKGYMLSEEPYIHANYQPVEIPVSHQPESKAALLKKKNSSFSKKDFAPSEKHEQADEDLLSQYENGSSSSSSPAVGQPLQKEPSLHLDTPSKFLSKDKLFKPSFDVKDALAALETPGRPSQQKRKPSTPLSEVIVKNLQLALANSSRNAVALSASPQLKEAQSEKEEAPKPLHKVVVCVSKKLSKKQSELNGIAASLGADYRWSFDETVTHFIYQGRPNDTNREYKSVKERGVHIVSEHWLLDCAQECKHLPESLYPHTYNPKMSLDISAVQDGRLCNSRLLSAVSSTKDDEPDPLILEENDVDNMATNNKESAPSNGSGKNDSKGVLTQTLEMRENFQKQLQEIMSATSIVKPQGQRTSLSRSGCNSASSTPDSTRSARSGRSRVLEALRQSRQTVPDVNTEPSQNEQIIWDDPTAREERARLASNLQWPSCPTQYSELQVDIQNLEDSPFQKPLHDSEIAKQGNKKEIFAFVCIKYMLTS

SEQ ID NO: 744983 - protein, 604 aa, Homo sapiens
STVGGLEYPRRAVADYRWSFDETVTHFIYQGRPNDTNREYKSVKERGVHIVSEHWLLDCAQECKHLPESLYPHTYNPKMSLDISAVQDGRLCNSRLLSAVSSTKDDEPDPLILEENDVDNMATNNKESAPSNGSGKNDSKGVLTQTLEMRENFQKQLQEIMSATSIVKPQGQRTSLSRSGCNSASSTPDSTRSARSGRSRVLEALRQSRQTVPDVNTEPSQNEQIIWDDPTAREERARLASNLQWPSCPTQYSELQVDIQNLEDSPFQKPLHDSEIAKQAVCDPGNIRVTEAPKHPISEELETPIKDSHLIPTPQAPSIAFPLANPPVAPHPREKIITIEETHEELKKQYIFQLSSLNPQERIDYCHLIEKLGGLVIEKQCFDPTCTHIVVGHPLRNEKYLASVAAGKWVLHRSYLEACRTAGHFVQEEDYEWGSSSILDVLTGINVQQRRLALAAMRWRKKIQQRQESGIVEGAFSGWKVILHVDQSREAGFKRLLQSGGAKVLPGHSVPLFKEATHLFSDLNKLKPDDSGVNIAEAAAQNVYCLRTEYIADYLMQESPPHVENYCLPEAISFIQNNKELGTGLSQKRKAPTEKNKIKRPRVH

SEQ ID NO: 744984 - protein, 1259 aa, Homo sapiens; identical to SEQ ID NO: 744978

SEQ ID NO: 744985 - protein, 1259 aa, Homo sapiens; identical to SEQ ID NO: 744978

SEQ ID NO: 744986 - protein, 1259 aa, Homo sapiens; identical to SEQ ID NO: 744978

SEQ ID NO: 744987 - protein, 1259 aa, Homo sapiens; identical to SEQ ID NO: 744978

SEQ ID NO: 744988 - protein, 1259 aa, Homo sapiens; identical to SEQ ID NO: 744978

SEQ ID NO: 744989 - protein, 1259 aa, Homo sapiens; identical to SEQ ID NO: 744978

SEQ ID NO: 744990 - protein, 1259 aa, Homo sapiens; identical to SEQ ID NO: 744978

SEQ ID NO: 744991 - protein, 1259 aa, Homo sapiens; identical to SEQ ID NO: 744978

SEQ ID NO: 744992 - protein, 1281 aa, Homo sapiens
GVGAAPSRGRGLCAGLAPDPSHRPAASASPDSPPGDPEAPTSSEMSRNDKEPFFVKFLKSSDNSKCFFKALESIKEFQSEEYLQIITEEEALKIKENDRSLYICDPFSGVVFDHLKKLGCRIVGPQVVIFCMHHQRCVPRAEHPVYNMVMSDVTISCTSLEKEKREEVHKYVQMMGGRVYRDLNVSVTHLIAGEVGSKKYLVAANLKKPILLPSWIKTLWEKSQEKKITRYTDINMEDFKCPIFLGCIICVTGLCGLDRKEVQQLTVKHGGQYMGQLKMNECTHLIVQEPKGQKYECAKRWNVHCVTTQWFFDSIEKGFCQDESIYKTEPRPEAKTMPNSSTPTSQINTIDSRTLSDVSNISNINASCVSESICNSLNSKLEPTLENLENLDVSAFQAPEDLLDGCRIYLCGFSGRKLDKLRRLINSGGGVRFNQLNEDVTHVIVGDYDDELKQFWNKSAHRPHVVGAKWLLECFSKGYMLSEEPYIHANYQPVEIPVSHQPESKAALLKKKNSSFSKKDFAPSEKHEQADEDLLSQYENGSSTVVEAKTSEARPFNDSTHAEPLNDSTHISLQEENQSSVSHCVPDVSTITEEGLFSQKSFLVLGFSNENESNIANIIKENAGKIMSLLSRTVADYAVVPLLGCEVEATVGEVVTNTWLVTCIDYQTLFDPKSNPLFTPVPVMTGMTPLEDCVISFSQCAGAEKESLTFLANLLGASVQEYFVRKSNAKKGMFASTHLILKERGGSKYEAAKKWNLPAVTIAWLLETARTGKRADESHFLIENSTKEERSLETEITNGINLNSDTAEHPGTRLQTHRKTVVTPLDMNRFQSKAFRAVVSQHARQVAASPAVGQPLQKEPSLHLDTPSKFLSKDKLFKPSFDVKDALAALETPGRPSQQKRKPSTPLSEVIVKNLQLALANSSRNAVALSASPQLKEAQSEKEEAPKPLHKVVVCVSKKLSKKQSELNGIAASLGADYRWSFDETVTHFIYQGRPNDTNREYKSVKERGVHIVSEHWLLDCAQECKHLPESLYPHTYNPKMSLDISAVQDGRLCNSRLLSAVSSTKDDEPDPLILEENDVDNMATNNKESAPSNGSGKNDSKGVLTQTLEMRENFQKQLQEIMSATSIVKPQGQRTSLSRSGCNSASSTPDSTRSARSGRSRVLEALRQSRQTVPDVNTEPSQNEQIIWDDPTAREERARLASNLQWPSCPTQYSELQVDIQNLEDSPFQKPLHDSEIAKQAVCDPGNIRVTEAPKHPISEELETPIKDSHLIPSFKTEKK

SEQ ID NO: 744993 - protein, 979 aa, Homo sapiens
GVGAAPSRGRGLCAGLAPDPSHRPAASASPDSPPGDPEAPTSSEMSRNDKEPFFVKFLKSSDNSKCFFKALESIKEFQSEEYLQIITEEEALKIKENDRSLYICDPFSGVVFDHLKKLGCRIVGPQVVIFCMHHQRCVPRAEHPVYNMVMSDVTISCTSLEKEKREEVHKYVQMMGGRVYRDLNVSVTHLIAGEVGSKKYLVAANLKKPILLPSWIKTLWEKSQEKKITRYTDINMEDFKCPIFLGCIICVTGLCGLDRKEVQQLTVKHGGQYMGQLKMNECTHLIVQEPKGQKYECAKRWNVHCVTTQWFFDSIEKGFCQDESIYKTEPRPEAKTMPNSSTPTSQINTIDSRTLSDVSNISNINASCVSESICNSLNSKLEPTLENLENLDVSAFQAPEDLLDGCRIYLCGFSGRKLDKLRRLINSGGGVRFNQLNEDVTHVIVGDYDDELKQFWNKSAHRPHVVGAKWLLECFSKGYMLSEEPYIHANYQPVEIPVSHQPESKAALLKKKNSSFSKKDFAPSEKHEQADEDLLSQYENGSSTVVEAKTSEARPFNDSTHAEPLNDSTHISLQEENQSSVSHCVPDVSTITEEGLFSQKSFLVLGFSNENESNIANIIKENAGKIMSLLSRTVADYAVVPLLGCEVEATVGEVVTNTWLVTCIDYQTLFDPKSNPLFTPVPVMTGMTPLEDCVISFSQCAGAEKESLTFLANLLGASVQEYFVRKSNAKKGMFASTHLILKERGGSKYEAAKKWNLPAVTIAWLLETARTGKRADESHFLIENSTKEERSLETEITNGINLNSDTAEHPGTRLQTHRKTVVTPLDMNRFQSKAFRAVVSQHARQVAASPAVGQPLQKEPSLHLDTPSKFLSKDKLFKPSFDVKDALAALETPGRPSQQKRKPSTPLSEVIVKNLQLALANSSRNAVALSASPQLKEAQSEKEEAPKPLHKVVVCVSKKLSKKQSELNGIAASLGADYR

SEQ ID NO: 744994 - protein, 970 aa, Homo sapiens
GVGAAPSRGRGLCAGLAPDPSHRPAASASPDSPPGDPEAPTSSEMSRNDKEPFFVKFLKSSDNSKCFFKALESIKEFQSEEYLQIITEEEALKIKENDRSLYICDPFSGVVFDHLKKLGCRIVGPQVVIFCMHHQRCVPRAEHPVYNMVMSDVTISCTSLEKEKREEVHKYVQMMGGRVYRDLNVSVTHLIAGEVGSKKYLVAANLKKPILLPSWIKTLWEKSQEKKITRYTDINMEDFKCPIFLGCIICVTGLCGLDRKEVQQLTVKHGGQYMGQLKMNECTHLIVQEPKGQKYECAKRWNVHCVTTQWFFDSIEKGFCQDESIYKTEPRPEAKTMPNSSTPTSQINTIDSRTLSDVSNISNINASCVSESICNSLNSKLEPTLENLENLDVSAFQAPEDLLDGCRIYLCGFSGRKLDKLRRLINSGGGVRFNQLNEDVTHVIVGDYDDELKQFWNKSAHRPHVVGAKWLLECFSKGYMLSEEPYIHANYQPVEIPVSHQPESKAALLKKKNSSFSKKDFAPSEKHEQADEDLLSQYENGSSTVVEAKTSEARPFNDSTHAEPLNDSTHISLQEENQSSVSHCVPDVSTITEEGLFSQKSFLVLGFSNENESNIANIIKENAGKIMSLLSRTVADYAVVPLLGCEVEATVGEVVTNTWLVTCIDYQTLFDPKSNPLFTPVPVMTGMTPLEDCVISFSQCAGAEKESLTFLANLLGASVQEYFVRKSNAKKGMFASTHLILKERGGSKYEAAKKWNLPAVTIAWLLETARTGKRADESHFLIENSTKEERSLETEITNGINLNSDTAEHPGTRLQTHRKTVVTPLDMNRFQSKAFRAVVSQHARQVAASPAVGQPLQKEPSLHLDTPSKFLSKDKLFKPSFDVKDALAALETPGRPSQQKRKPSTPLSEVIVKNLQLALANSSRNAVALSASPQLKEAQSEKEEAPKPLHKVVVCVSKKLSTFSRGEMVP

SEQ ID NO: 744995 - protein, 122 aa, Homo sapiens
HIKVSHNFYGLTYGFNEFGFVIAVYLNCHFYSLGSLVRQYLMSTQSLPKMNRSFGMTLQQGRREQGLPAICSGLVVPHNTLSFRLTFKTWRILLFKSLYMIQKLLNRVTRKKSLHLFVLSTC

SEQ ID NO: 744996 - protein, 117 aa, Homo sapiens [sequence omitted]

SEQ ID NO: 744997 - protein, 285 aa, Homo sapiens [sequence omitted]

SEQ ID NO: 744998 - protein, 139 aa, Homo sapiens
GQGRSQDGRIGTAPVYSSQRERRRRRVISAFPSETSDLFYFIVNKLHEYLPESRDKNALQNQSQRVDELVACIEIIQTLVLMFRETETESSRLNTLAAKNYRSLFWSIQILLQHFYMRYFLSFSREISDWDPQSLLLAG

SEQ ID NO: 744999 - protein, 139 aa, Homo sapiens; identical to SEQ ID NO: 744998

SEQ ID NO: 745000 - protein, 42 aa, Homo sapiens
MGVSVETTSVAEYNPATVTRKLRAHRDHGASTHDTTLRPTRR

SEQ ID NO: 745001 - protein, 150 aa, Homo sapiens
DFVCFLVSLGCWFGDFCLIAMSGRGKQGGKARAKAKSRSSRAGLQFPVGRVHRLLRKGNYAERVGAGAPVYLAAVLEYLTAEILELAGNAARDNKKTRIIPRHLQLAIRNDEELNKLLGRVTIAQGGVLPNIQAVLLPKKTESHHKAKGK

SEQ ID NO: 745002 - protein, 150 aa, Homo sapiens; identical to SEQ ID NO: 745001

SEQ ID NO: 745003 - protein, 166 aa, Homo sapiens
SGMISAHCNLRLLHSSDSPTSASRVAGITGVHHHAHLCIVFLVEMGFCHVGQAGLKLLTSCDPSTSTSQSAGITGLSHHAQPQLRAFLLAVLSTWDVLAPNHCMNASSCGSGLKFSFTCSETPSLILSIELVLLCLHITIKNYMRLGTVAHAYNPSSLGVHGRRIT

SEQ ID NO: 745004 - protein, 136 aa, Homo sapiens
SICVLPPQEHQLPEGRDPGPVQDSVAPGRRQPPLQMEDAGIRVLAASVFEPWSQAVFACPPGTLDHHEESLQSSQVQPLKGQGSGGSGTPPARTHMAPVAKWPCVAYKDLLSGDQPGAASPRAAEEEAIVGNRVRT

SEQ ID NO: 745005 - protein, 63 aa, Homo sapiens
YHLPGPTFDLVPVPLPVLVDGAPAPIAWDGSLSHSCLLRSLHSPYLTGHESFWFCPLNSEDLC

SEQ ID NO: 745006 - protein, 170 aa, Homo sapiens
MAMSNGNNDFVVLSNSSIATSAANPSPLTPCDGDHAAQQLTPKEATRTKVSPNGCLQLNGTVKSSFLPLDNQRMPQMLPQCCHPCPYHHPLTSHSSHQECHPEAGPAAPSALASCCMQPHSEYSASLCPNHSPVYQTTCCLQPSPSFCLHHPWPDHFQHQPVQQHIANIR

SEQ ID NO: 745007 - protein, 1352 aa, Homo sapiens
MAMSNGNNDFVVLSNSSIATSAANPSPLTPCDGDHAAQQLTPKEATRTKVSPNGCLQLNGTVKSSFLPLDNQRMPQMLPQCCHPCPYHHPLTSHSSHQECHPEAGPAAPSALASCCMQPHSEYSASLCPNHSPVYQTTCCLQPSPSFCLHHPWPDHFQHQPVQQHIANIRPSRPFKLPKSYAALIADWPVVVLGMCTMFIVVCALVGVLVPELPDFSDPLLGFEPRGTAIGQRLVTWNNMVKNTGYKATLANYPFKYADEQAKSHRDDRWSDDHYEREKREVDWNFHKDSFFCDVPSDRYSRVVFTSSGGETLWNLPAIKSMCNVDNSRIRSHPQFGDLCQRTTAASCCPSWTLGNYIAILNNRSSCQKIVERDVSHTLKLLRTCAKHYQNGTLGPDCWDMAARRKDQLKCTNVPRKCTKYNAVYQILHYLVDKDFMTPKTADYATPALKYSMLFSPTEKGESMMNIYLDNFENWNSSDGVTTITGIEFGIKHSLFQDYLLMDTVYPAIAIVIVLLVMCVYTKSMFITLMTMFAIISSLIVSYFLYRVVFHFEFFPFMNLTALIILVGIGADDAFVLCDVWNYTKFDKPHAETSETVSITLQHAALSMFVTSFTTAAAFYANYVSNITAIRCFGVYAGTAILVNYVLMVTWLPAVVVLHERYLLNIFTCFKKPQQQIYDNKSCWTVACQKCHKVLFAISEASRIFFEKVLPCIVIKFRYLWLFWFLALTVGGAYIVCINPKMKLPSLELSEFQVFRSSHPFERYDAEYKKLFMFERVHHGEELHMPITVIWGVSPEDNGNPLNPKSKGKLTLDSSFNIASPASQAWILHFCQKLRNQTFFYQTDEQDFTSCFIETFKQWMENQDCDEPALYPCCSHWSFPYKQEIFELCIKRAIMELERSTGYHLDSKTPGPRFDINDTIRAVVLEFQSTYLFTLAYEKMHQFYKEVDSWISSELSSAPEGLSNGWFVSNLEFYDLQDSLSDGTLIAMGLSVAVAFSVMLLTTWNIIISLYAIISIAGTIFVTVGSLVLLGWELNVLESVTISVAVGLSVDFAVHYGVAYRLAPDPDREGKVIFSLSRVGSAMAMAALTTFVAGAMMMPSTVLAYTQLGTFMMLIMCISWAFATFFFQCMCRCLGPQGTCGQIPLPKKLQCSAFSHALSTSPSDKGQSKTHTINAYHLDPRGPKSELEHEFYELEPLASHSCTAPEKTTYEETHICSEFFNSQAKNLGMPVHAAYNSELSKSTESDAGSALLQPPLEQHTVCHFFSLNQRCSCPDAYKHLNYGPHSCQQMGDCLCHQCSPTTSSFVQIQNGVAPLKATHQAVEGFVHPITHIHHCPCLQGRVKPAWNAEFSA

SEQ ID NO: 745008 - protein, 1399 aa, Homo sapiens
LARQSPSQSVGITESRNWSMAMSNGNNDFVVLSNSSIATSAANPSPLTPCDGDHAAQQLTPKEATRTKVSPNGCLQLNGTVKSSFLPLDNQRMPQMLPQCCHPCPYHHPLTSHSSHQECHPEAGPAAPSALASCCMQPHSEYSASLCPNHSPVYQTTCCLQPSPSFCLHHPWPDHFQHQPVQQHIANIRPSRPFKLPKSYAALIADWPVVVLGMCTMFIVVCALVGVLVPELPDFSDPLLGFEPRGTAIGQRLVTWNNMVKNTGYKATLANYPFKYADEQAKSHRDDRWSDDHYEREKREVDWNFHKDSFFCDVPSDRYSRVVFTSSGGETLWNLPAIKSMCNVDNSRIRSHPQFGDLCQRTTAASCCPSWTLGNYIAILNNRSSCQKIVERDVSHTLKLLRTCAKHYQNGTLGPDCWDMAARRKDQLKCTNVPRKCTKYNAVYQILHYLVDKDFMTPKTADYATPALKYSMLFSPTEKGESMMNIYLDNFENWNSSDGVTTITGIEFGIKHSLFQDYLLMDTVYPAIAIVIVLLVMCVYTKSMFITLMTMFAIISSLIVSYFLYRVVFHFEFFPFMNLTALIILVGIGADDAFVLCDVWNYTKFDKPHAETSETVSITLQHAALSMFVTSFTTAAAFYANYVSNITAIRCFGVYAGTAILVNYVLMVTWLPAVVVLHERYLLNIFTCFKKPQQQIYDNKSCWTVACQKCHKVLFAISEASRIFFEKVLPCIVIKFRYLWLFWFLALTVGGAYIVCINPKMKLPSLELSEFQVFRSSHPFERYDAEYKKLFMFERVHHGEELHMPITVIWGVSPEDNGNPLNPKSKGKLTLDSSFNIASPASQAWILHFCQKLRNQTFFYQTDEQDFTSCFIETFKQWMENQDCDEPALYPCCSHWSFPYKQEIFELCIKRAIMELERSTGYHLDSKTPGPRFDINDTIRAVVLEFQSTYLFTLAYEKMHQFYKEVDSWISSELSSAPEGLSNGWFVSNLEFYDLQDSLSDGTLIAMGLSVAVAFSVMLLTTWNIIISLYAIISIAGTIFVTVGSLVLLGWELNVLESVTISVAVGLSVDFAVHYGVAYRLAPDPDREGKVIFSLSRVGSAMAMAALTTFVAGAMMMPSTVLAYTQLGTFMMLIMCISWAFATFFFQCMCRCLGPQGTCGQIPLPKKLQCSAFSHALSTSPSDKGQSKTHTINAYHLDPRGPKSELEHEFYELEPLASHSCTAPEKTTYEETHICSEFFNSQAKNLGMPVHAAYNSELSKSTESDAGSALLQPPLEQHTVCHFFSLNQRCSCPDAYKHLNYGPHSCQQMGDCLCHQCSPTTSSFVQIQNGVAPLKATHQAVEGFVHPITHIHHCPCLQGRVKPAGMQNSLPRNFFLHPVQHIQAQEKIGKTNVTVFRGA

SEQ ID NO: 745009 - protein, 221 aa, Homo sapiens
LARQSPSQSVGITESRNWSMAMSNGNNDFVVLSNSSIATSAANPSPLTPCDGDHAAQQLTPKEATRTKVSPNGCLQLNGTVKSSFLPLDNQRMPQMLPQCCHPCPYHHPLTSHSSHQECHPEAGPAAPSALASCCMQPHSEYSASLCPNHSPVYQTTCCLQPSPSFCLHHPWPDHFQHQPVQQHIANIRPSRPFKLPQSYAASTTTSTQSSHLPFYVSVPS

SEQ ID NO: 745010 - protein, 104 aa, Homo sapiens
MCTMFIVVCALVGVLVPELPDFSDPLLGFEPRGTAIGQRLVTWNNMVKNTGYKATLANYPFKYADEQAKSHRDDRWSDDHYEREKREVDWNFHKDSFFCDVPSE

SEQ ID NO: 745011 - protein, 82 aa, Homo sapiens
TEKPQAPPQPTPLARALLDPQSILEVLVSTPPPSPGDTPYLSLQSKPMKPTPARGPAPVPGLGLLTKDWAGPSSAIHEPYQG

SEQ ID NO: 745012 - protein, 144 aa, Homo sapiens [sequence omitted]

SEQ ID NO: 745013 - protein, 124 aa, Homo sapiens
GRLWLNLVFWLLSSPMQGCGSPHRPLQRGTLGGAHGTSKQSPVAPGVSLEGTSRAHQPAHPRAQTPPRPFVPPWGGRASMAISWVLGMVAHCLHDVHKVVYPLNLASVSPMKPWCRIPTWMLRA

SEQ ID NO: 745014 - protein, 254 aa, Homo sapiens
MPRWQMLRVLEEELGRDWQAKVASLEEVPFAAASIGQVHQGLLRDGTEVAVKIQYPGIAQSIQSDVQNLLAVLKMSAALPAGLFAEQSLQALQQELAWECDYRREAACAQNFRQLLANDPFFRVPAVVKELCTTRVLGMELAGGVPLDQCQGLSQDLRNQICFQLLTLCLRELFEFRFMQTDPNWANFLYDASSHQVTLLDFGASREFGTEFTDHYIEVVKAAADGDRDCVLQKSRDLKFLTGFETKVGRHWGR

SEQ ID NO: 745015 - protein, 544 aa, Homo sapiens
MWLKVGGLLRGTGGQLGQTVGWPCGALGPGPHRWGPCGGSWAQKFYQDGPGRGLGEEDIRRAREARPRKTPRPQLSDRSRERKVPASRISRLANFGGLAVGLGLGVLAEMAKKSMPGGRLQSEGGSGLDSSPFLSEANAERIVQTLCTVRGAALKVGQMLSIQDNSFISPQLQHIFERVRQSADFMPRWQMLRVLEEELGRDWQAKVASLEEVPFAAASIGQVHQGLLRDGTEVAVKIQYPGIAQSIQSDVQNLLAVLKMSAALPAGLFAEQSLQALQQELAWECDYRREAACAQNFRQLLANDPFFRVPAVVKELCTTRVLGMELAGGVPLDQCQGLSQDLRNQICFQLLTLCLRELFEFRFMQTDPNWANFLYDASSHQVTLLDFGASREFGTEFTDHYIEVVKAAADGDRDCVLQKSRDLKFLTGFETKAFSDAHVEAVMILGEPFATQGPYDFGSGETARRIQDLIPVLLRHRLCPPPEETYALHRKLAGAFLACAHLRAHIACRDLFQDTYHRYWASRQPDAATAGSLPTKGDSWVDPS

SEQ ID NO: 745016 - protein, 591 aa, Homo sapiens
MWLKVGGLLRGTGGQLGQTVGWPCGALGPGPHRWGPCGGSWAQKFYQDGPGRGLGEEDIRRAREARPRKTPRPQLSDRSRERKVPASRISRLANFGGLAVGLGLGVLAEMAKKSMPGGRLQSEGGSGLDSSPFLSEANAERIVQTLCTVRGAALKVGQMLSIQGQHDPRLLTPDLPSTPALPTNRPQLQILTRGPSSPLRLLPPWFHVSQDNSFISPQLQHIFERVRQSADFMPRWQMLRVLEEELGRDWQAKVASLEEVPFAAASIGQVHQGLLRDGTEVAVKIQYPGIAQSIQSDVQNLLAVLKMSAALPAGLFAEQSLQALQQELAWECDYRREAACAQNFRQLLANDPFFRVPAVVKELCTTRVLGMELAGGVPLDQCQGLSQDLRNQICFQLLTLCLRELFEFRFMQTDPNWANFLYDASSHQVTLLDFGASREFGTEFTDHYIEVVKAAADGDRDCVLQKSRDLKFLTGFETKAFSDAHVEAVMILGEPFATQGPYDFGSGETARRIQDLIPVLLRHRLCPPPEETYALHRKLAGAFLACAHLRAHIACRDLFQDTYHRYWASRQPDAATAGSLPTKGDSWVDPS

SEQ ID NO: 745017 - protein, 520 aa, Homo sapiens
QVADSEAESSGPCGGSWAQKFYQDGPGRGLGEEDIRRAREARPRKTPRPQLSDRSRERKVPASRISRLANFGGLAVGLGLGVLAEMAKKSMPGGRLQSEGGSGLDSSPFLSEANAERIVQTLCTVRGAALKVGQMLSIQDNSFISPQLQHIFERVRQSADFMPRWQMLRVLEEELGRDWQAKVASLEEVPFAAASIGQVHQGLLRDGTEVAVKIQYPGIAQSIQSDVQNLLAVLKMSAALPAGLFAEQSLQALQQELAWECDYRREAACAQNFRQLLANDPFFRVPAVVKELCTTRVLGMELAGGVPLDQCQGLSQDLRNQICFQLLTLCLRELFEFRFMQTDPNWANFLYDASSHQVTLLDFGASREFGTEFTDHYIEVVKAAADGDRDCVLQKSRDLKFLTGFETKAFSDAHVEAVMILGEPFATQGPYDFGSGETARRIQDLIPVLLRHRLCPPPEETYALHRKLAGAFLACAHLRAHIACRDLFQDTYHRYWASRQPDAATAGSLPTKGDSWVDPS

SEQ ID NO: 745018 - protein, 591 aa, Homo sapiens
MWLKVGGLLRGTGGQLGQTVGWPCGALGPGPHRWGPCGGSWAQKFYQDGPGRGLGEEDIRRAREARPRKTPRPQLSDRSRERKVPASRISRLANFGGLAVGLGLGVLAEMAKKSMPGGRLQSEGGSGLDSSPFLSEANAERIVQTLCTVRGAALKVGQMLSIQGQHDPRLLTPDLPSTPALPTNRPQLQILTRGPSSPLRLLPPWFTVSQDNSFISPQLQHIFERVRQSADFMPRWQMLRVLEEELGRDWQAKVASLEEVPFAAASIGQVHQGLLRDGTEVAVKIQYPGIAQSIQSDVQNLLAVLKMSAALPAGLFAEQSLQALQQELAWECDYRREAACAQNFRQLLANDPFFRVPAVVKELCTTRVLGMELAGGVPLDQCQGLSQDLRNQICFQLLTLCLRELFEFRFMQTDPNWANFLYDASSHQVTLLDFGASREFGTEFTDHYIEVVKAAADGDRDCVLQKSRDLKFLTGFETKAFSDAHVEAVMILGEPFATQGPYDFGSGETARRIQDLIPVLLRHRLCPPPEETYALHRKLAGAFLACAHLRAHIACRDLFQDTYHRYWASRQPDAATAGSLPTKGDSWVDPS

SEQ ID NO: 745019 - protein, 359 aa, Homo sapiens [sequence omitted]

SEQ ID NO: 745020 - protein, 359 aa, Homo sapiens [sequence omitted]

SEQ ID NO: 745021 - protein, 158 aa, Homo sapiens
CSLLGESGLVLMVETGGSGGYTLFLGYAEGSMSTLAALLSPHPHSQAFSDAHVEAVMILGEPFATQGPYDFGSGETARRIQDLIPVLLRHRLCPPPEETYALHRKLAGAFLACAHLRAHIACRDLFQDTYHRYWASRQPDAATAGSLPTKGDSWVDPS

SEQ ID NO: 745022 - protein, 166 aa, Homo sapiens
MWLKVGGLLRGTGGQLGQTVGWPCGALGPGPHRWGPCGGSWAQKFYQDGPGRGLGEEDIRRAREARPRKTPRPQLSDRSRERKVPASRISRLANFGGLAVGLGLGVLAEMAKKSMPGGRLQSEGGSGLDSSPFLSEANAERIVQTLCTVRGAALKVGQMLSIQGTA

SEQ ID NO: 745023 - protein, 544 aa, Homo sapiens; identical to SEQ ID NO: 745015

SEQ ID NO: 745024 - protein, 514 aa, Homo sapiens
QVADSEAESSAMWLKVGGLLRGTGGQLGQTVGWPCGALGPGPHRWGPCGGSWAQKFYQDGPGRGLGEEDIRRAREARPRKTPRPQLSDRSRERKVPASRISRLANFGGLAVGLGLGVLAEMAKKSMPGGRLQSDNSFISPQLQHIFERVRQSADFMPRWQMLRVLEEELGRDWQAKVASLEEVPFAAASIGQVHQGLLRDGTEVAVKIQYPGIAQSIQSDVQNLLAVLKMSAALPAGLFAEQSLQALQQELAWECDYRREAACAQNFRQLLANDPFFRVPAVVKELCTTRVLGMELAGGVPLDQCQGLSQDLRNQICFQLLTLCLRELFEFRFMQTDPNWANFLYDASSHQVTLLDFGASREFGTEFTDHYIEVVKAAADGDRDCVLQKSRDLKFLTGFETKAFSDAHVEAVMILGEPFATQGPYDFGSGETARRIQDLIPVLLRHRLCPPPEETYALHRKLAGAFLACAHLRAHIACRDLFQDTYHRYWASRQPDAATAGSLPTKGDSWVDPS

SEQ ID NO: 745025 - protein, 369 aa, Homo sapiens
MPRWQMLYPGIAQSIQSDVQNLLAVLKMSAALPAGEAPTHSSADLPKGLCPERESRRGSPEESTGRVCWRCERECQRQKGHQGGESPGSMSSLFAEQSLQALQQELAWECDYRREAACAQNFRQLLANDPFFRVPAVVKELCTTRVLGMELAGGVPLDQCQGLSQDLRNQICFQLLTLCLRELFEFRFMQTDPNWANFLYDASSHQVTLLDFGASREFGTEFTDHYIEVVKAAADGDRDCVLQKSRDLKFLTGFETKAFSDAHVEAVMILGEPFATQGPYDFGSGETARRIQDLIPVLLRHRLCPPPEETYALHRKLAGAFLACAHLRAHIACRDLFQDTYHRYWASRQPDAATAGSLPTKGDSWVDPS

SEQ ID NO: 745026 - protein, 115 aa, Homo sapiens
MWLKVGGLLRGTGGQLGQTVGWPCGALGPGPHRWGPCGGSWAQKFYQDGPGRGLGEEDIRRAREARPRKTPRPQLSDRSRERKVPASRISRLANFGAAPRTVHKVCTIRSALASD

SEQ ID NO: 745027 - protein, 106 aa, Homo sapiens
LKFTQRKVTILKNAQNILFSITKAFHPGKLLYQNLIWPREKENLKNEASSSFLDNLMGWVGQGRKRERKEGRGGGGRGKRGPGGREEDRQAGKETSEVHSPGTQTY

SEQ ID NO: 745028 - protein, 89 aa, Homo sapiens
MGVTMITILQLPKVRKRKKAKGKKVVLTLAVLKKQETMKVVNLPFEKFGTGQDILALDRTSSPKGTSLALSNGPIILGCSSREPSSISS

SEQ ID NO: 745029 - protein, 515 aa, Homo sapiens
MATSTGRWLLLRLALFGFLWEASGGLDSGASRDDDLLLPYPRARARLPRDCTRVRAGNREHESWPPPPATPGAGGLAVRTFVSHFRDRAVAGHLTRAVEPLRTFSVLEPGGPGGCAARRRATVEETARAADCRVAQNGGFFRMNSGECLGNVVSDERRVSSSGGLQNAQFGIRRDGTLVTGYLSEEEVLDTENPFVQLLSGVVWLIRNGSIYINESQATECDETQETGSFSKFVNVISARTAIGHDRKGQLVLFHADGQTEQRGINLWEMAEFLLKQDVVNAINLDGGGSATFVLNGTLASYPSDHCQDNMWRCPRQVSTVVCVHEPRCQPPDCHGHGTCVDGHCQCTGHFWRGPGCDELDCGPSNCSQHGLCTETGCRCDAGWTGSNCSEECPLGWHGPGCQRPCKCEHHCPCDPKTGNCSVSRVKQCLQPPEATLRAGELSFFTRTAWLALTLALAFLLLISTAANLSLLLSRAERNRRLHGDYAYHPLQEMNGEPLAAEKEQPGGAHNPFKD

SEQ ID NO: 745030 - protein, 549 aa, Homo sapiens
MATSTGRWLLLRLALFGFLWEASGGLDSGASRDDDLLLPYPRARARLPRDCTRVRAGNREHESWPPPPATPGAGGLAVRTFVSHFRDRAVAGHLTRAVEPLRTFSVLEPGGPGGCAARRRATVEETARAADCRVAQNGGFFRMNSGECLGNVVSDERRVSSSGGLQNAQFGIRRDGTLVTGYLSEEEVLDTENPFVQLLSGVVWLIRNGSIYINESQATECDETQETGSFSKFVNVISARTAIGHDRKGQLVLFHADGQTEQRGINLWEMAEFLLKQDVVNAINLDGGGSATFVLNGTLASYPSDHWQADGAHLTVTAAQEARVEGSQYLISKIDRRHLVSQDNMWRCPRQVSTVVCVHEPRCQPPDCHGHGTCVDGHCQCTGHFWRGPGCDELDCGPSNCSQHGLCTETGCRCDAGWTGSNCSEECPLGWHGPGCQRPCKCEHHCPCDPKTGNCSVSRVKQCLQPPEATLRAGELSFFTRTAWLALTLALAFLLLISTAANLSLLLSRAERNRRLHGDYAYHPLQEMNGEPLAAEKEQPGGAHNPFKD

SEQ ID NO: 745031 - protein, 481 aa, Homo sapiens
MATSTGRWLLLRLALFGFLWEASGGLDSGASRDDDLLLPYPRARARLPRDCTRVRAGNREHESWPPPPATPGAGGLAVRTFVSHFRDRAVAGHLTRAVEPLRTFSVLEPGGPGGCAARRRATVEETARAADCRVAQNGGFFRMNSGECLGNVVSDERRVSSSGGLQNAQFGIRRDGTLVTGYLSEEEVLDTENPFVQLLSGVVWLIRNGSIYINESQATECDETQETGSFSKFVNVISARTAIGHDRKGQLVLFHADGQTEQRGINLWEMAEFLLKQDVVNAINLDGGGSATFVLNGTLASYPSDHCQDNMWRCPRQVSTVVCVHEPRCQPPDCHGHGTCVDGHCQCTGHFWRGPGCDELDCGPSNCSQHGLCTETGCRCDAGWTGSNCSEVKQCLQPPEATLRAGELSFFTRTAWLALTLALAFLLLISTAANLSLLLSRAERNRRLHGDYAYHPLQEMNGEPLAAEKEQPGGAHNPFKD

SEQ ID NO: 745032 - protein, 515 aa, Homo sapiens; identical to SEQ ID NO: 745029

SEQ ID NO: 745033 - protein, 212 aa, Homo sapiens
MAEFLLKQDVVNAINLDGGGSATFVLNGTLASYPSDHCQDNMWRCPRQVSTVVCVHEPRCQPPDCHGHGTCVDGHCQCTGHFWRGPGCDELDCGPSNCSQHGLCTETGCRCDAGWTGSNCSEVKQCLQPPEATLRAGELSFFTRTAWLALTLALAFLLLISTAANLSLLLSRAERNRRLHGDYAYHPLQEMNGEPLAAEKEQPGGAHNPFKD

SEQ ID NO: 745034 - protein, 228 aa, Homo sapiens
MATSTGRWLLLRLALFGFLWEASGGLDSGASRDDDLLLPYPRARARLPRDCTRVRAGNREHESWPPPPATPGAGGLAVRTFVSHFRDRAVAGHLTRAVEPLRTFSVLEPGGPGGCAARRRATVEETARAADCRVAQNGGFFRMNSGECLGNVVSDERRVSSSGGLQNAQFGIRRDGTLVTGYLSEEEVLDTENPFVQLLSGVVWLIRNGSIYINESQATEWTSLPSWL

SEQ ID NO: 745035 - protein, 515 aa, Homo sapiens; identical to SEQ ID NO: 745029

SEQ ID NO: 745036 - protein, 418 aa, Homo sapiens
MATSTGRWLLLRLALFGFLWEASGGLDSGASRDDDLLLPYPRARARLPRDCTRVRAGNREHESWPPPPATPGAGGLAVRTFVSHFRDRAVAGHLTRAVEPLRTFSVLEPGGPGGCAARRRATVEETARAADCRVAQNGGFFRMNSGECLGNVVSDERRVSSSGGLQNAQFGIRRDGTLVTGYLSEEEVLDTENPFVQLLSGVVWLIRNGSIYINESQATECDETQETGSFSKFVNVISARTAIGHDRKGQLVLFHADGQTEQRGINLWEMAEFLLKQDVVNAINLDGGGSATFVLNGTLASYPSDHWQADGAHLTVTAAQEARVEGSQYLISKIDRRHLVAGTSGGVPAVMSWTVAPLTAASTDCARRPAAAVMPDGPGPTAVKSVPLAGMGRAARGLVSVSTIVPVTPRLATAASPE

SEQ ID NO: 745037 - protein, 515 aa, Homo sapiens; identical to SEQ ID NO: 745029

SEQ ID NO: 745038 - protein, 212 aa, Homo sapiens; identical to SEQ ID NO: 745033

SEQ ID NO: 745039 - protein, 711 aa, Homo sapiens
KGGGKLTARYEAAVKSAEVLSSSTVEVLVMPSLRTRREEAEMELSVPGPSPWTPAAQARVRDAPAVTHPGSAACGTPCCSDTELEAICPHYQQPDCDTRTEDKEFLHKEDIHEDLESQAEISENYAGDVSQVPELGDLCDDVSERDWGVPEGRRLPQSLSQEGDFTPAAMGLLRGPLGEKDLDCNGFDSRFSLSPNLMACQEIPTEERPHPYDMGGQSFQHSVDLTGHEGVPTAESPLICNECGKTFQGNPDLIQRQIVHTGEASFMCDDCGKTFSQNSVLKNRHRSHMSEKAYQCSECGKAFRGHSDFSRHQSHHSSERPYMCNECGKAFSQNSSLKKHQKSHMSEKPYECNECGKAFRRSSNLIQHQRIHSGEKPYVCSECGKAFRRSSNLIKHHRTHTGEKPFECGECGKAFSQSAHLRKHQRVHTGEKPYECNDCGKPFSRVSNLIKHHRVHTGEKPYKCSDCGKAFSQSSSLIQHRRIHTGEKPHVCNVCGKAFSYSSVLRKHQIIHTGEKPYRCSVCGKAFSHSSALIQHQGVHTGDKPYACHECGKTFGRSSNLILHQRVHTGEKPYECTECGKTFSQSSTLIQHQRIHNGLKPHECNQCGKAFNRSSNLIHHQKVHTGEKPYTCVECGKGFSQSSHLIQHQIIHTGERPYKCSECGKAFSQRSVLIQHQRIHTGVKPYDCAACGKAFSQRSKLIKHQLIHTRE

SEQ ID NO: 745040 - protein, 711 aa, Homo sapiens
PLQIPLTTPSFSAGAHEGQKSQCQYNVLVMPSLRTRREEAEMELSVPGPSPWTPAAQARVRDAPAVTHPGSAACGTPCCSDTELEAICPHYQQPDCDTRTEDKEFLHKEDIHEDLESQAEISENYAGDVSQVPELGDLCDDVSERDWGVPEGRRLPQSLSQEGDFTPAAMGLLRGPLGEKDLDCNGFDSRFSLSPNLMACQEIPTEERPHPYDMGGQSFQHSVDLTGHEGVPTAESPLICNECGKTFQGNPDLIQRQIVHTGEASFMCDDCGKTFSQNSVLKNRHRSHMSEKAYQCSECGKAFRGHSDFSRHQSHHSSERPYMCNECGKAFSQNSSLKKHQKSHMSEKPYECNECGKAFRRSSNLIQHQRIHSGEKPYVCSECGKAFRRSSNLIKHHRTHTGEKPFECGECGKAFSQSAHLRKHQRVHTGEKPYECNDCGKPFSRVSNLIKHHRVHTGEKPYKCSDCGKAFSQSSSLIQHRRIHTGEKPHVCNVCGKAFSYSSVLRKHQIIHTGEKPYRCSVCGKAFSHSSALIQHQGVHTGDKPYACHECGKTFGRSSNLILHQRVHTGEKPYECTECGKTFSQSSTLIQHQRIHNGLKPHECNQCGKAFNRSSNLIHHQKVHTGEKPYTCVECGKGFSQSSHLIQHQIIHTGERPYKCSECGKAFSQRSVLIQHQRIHTGVKPYDCAACGKAFSQRSKLIKHQLIHTRE

SEQ ID NO: 745041 - protein, 713 aa, Homo sapiens
AGLPGVSRRWLRRLRATVLPPFQARPVEVLVMPSLRTRREEAEMELSVPGPSPWTPAAQARVRDAPAVTHPGSAACGTPCCSDTELEAICPHYQQPDCDTRTEDKEFLHKEDIHEDLESQAEISENYAGDVSQVPELGDLCDDVSERDWGVPEGRRLPQSLSQEGDFTPAAMGLLRGPLGEKDLDCNGFDSRFSLSPNLMACQEIPTEERPHPYDMGGQSFQHSVDLTGHEGVPTAESPLICNECGKTFQGNPDLIQRQIVHTGEASFMCDDCGKTFSQNSVLKNRHRSHMSEKAYQCSECGKAFRGHSDFSRHQSHHSSERPYMCNECGKAFSQNSSLKKHQKSHMSEKPYECNECGKAFRRSSNLIQHQRIHSGEKPYVCSECGKAFRRSSNLIKHHRTHTGEKPFECGECGKAFSQSAHLRKHQRVHTGEKPYECNDCGKPFSRVSNLIKHHRVHTGEKPYKCSDCGKAFSQSSSLIQHRRIHTGEKPHVCNVCGKAFSYSSVLRKHQIIHTGEKPYRCSVCGKAFSHSSALIQHQGVHTGDKPYACHECGKTFGRSSNLILHQRVHTGEKPYECTECGKTFSQSSTLIQHQRIHNGLKPHECNQCGKAFNRSSNLIHHQKVHTGEKPYTCVECGKGFSQSSHLIQHQIIHTGERPYKCSECGKAFSQRSVLIQHQRIHTGVKPYDCAACGKAFSQRSKLIKHQLIHTRE

SEQ ID NO: 745042 - protein, 153 aa, Homo sapiens
MQTCQCQVNAEDGDSPSGSECGKTFSQSSTLIQHQRIHNGLKPHECNQCGKAFNRSSNLIHHQKVHTGEKPYTCVECGKGFSQSSHLIQHQIIHTGERPYKCSECGKAFSQRSVLIQHQRIHTGVKPYDCAACGKAFSQRSKLIKHQLIHTRE

SEQ ID NO: 745043 - protein, 161 aa, Homo sapiens
VTLCPVAHLRGLAFGILPAQAGTGHQPPGSPSSKPQDQSLRGQHKAGAGVPLLCQGPGEHGPCSPLSSHQRPSLPDSSRGAALMDTIRCWEAGTTRTWTESPVTSLADRGALSYSITNNGWGRSDAILWVLLPGRRRPSPQRQPRDTRVRSQGAQEQCGPE

SEQ ID NO: 745044 - protein, 883 aa, Homo sapiens
MAENSVLTSTTGRTSLADSSIFDSKVTEISKENLLIGSTSYVEEEMPQIETRVILVQEAGKQEELIKALKDIKVGFVKMESVEEFEGLDSPEFENVFVVTDFQDSVFNDLYKADCRVIGPPVVLNCSQKGEPLPFSCRPLYCTSMMNLVLCFTGFRKKEELVRLVTLVHHMGGVIRKDFNSKVTHLVANCTQGEKFRVAVSLGTPIMKPEWIYKAWERRNEQDFYAAVDDFRNEFKVPPFQDCILSFLGFSDEEKTNMEEMTEMQGGKYLPLGDERCTHLVVEENIVKDLPFEPSKKLYVVKQEWFWGSIQMDARAGETMYLYEKANTPELKKSVSMLSLNTPNSNRKRRRLKETLAQLSRETDVSPFPPRKRPSAEHSLSIGSLLDISNTPESSINYGDTPKSCTKSSKSSTPVPSKQSARWQVAKELYQTESNYVNILATIIQLFQVPLEEEGQRGGPILAPEEIKTIFGSIPDIFDVHTKIKDDLEDLIVNWDESKSIGDIFLKYSKDLVKTYPPFVNFFEMSKETIIKCEKQKPRFHAFLKINQAKPECGRQSLVELLIRPVQRLPSVALLLNDLKKHTADENPDKSTLEKAIGSLKEVMTHINEDKRKTEAQKQIFDVVYEVDGCPANLLSSHRSLVQRVETISLGEHPCDRGEQVTLFLFNDCLEIARKRHKVIGTFRSPHGQTRPPASLKHIHLMPLSQIKKVLDIRETEDCHNAFALLVRPPTEQANVLLSFQMTSDELPKENWLKMLCRHVANTICKADAENLIYTADPESFEVNTKDMDSTLSRASRAIKKTSKKVTRAFSFSKTPKRALRRALMTSHGSVEGRSPSSNDKHVMSRLSSTSSLAGIPSPSLVSLPSFFERRSHTLSRSTTHLI

SEQ ID NO: 745045 - protein, 883 aa, Homo sapiens; identical to SEQ ID NO: 745044

SEQ ID NO: 745046 - protein, 712 aa, Homo sapiens
KKHTADENPDKSTLEKAIGSLKEVDDVAVSLGTPIMKPEWIYKAWERRNEQDFYAAVDDFRNEFKVPPFQDCILSFLGFSDEEKTNMEEMTEMQGGKYLPLGDERCTHLVVEENIVKDLPFEPSKKLYVVKQEWFWGSIQMDARAGETMYLYEKANTPELKKSVSMLSLNTPNSNRKRRRLKETLAQLSRETDVSPFPPRKRPSAEHSLSIGSLLDISNTPESSINYGDTPKSCTKSSKSSTPVPSKQSARWQVAKELYQTESNYVNILATIIQLFQVPLEEEGQRGGPILAPEEIKTIFGSIPDIFDVHTKIKDDLEDLIVNWDESKSIGDIFLKYSKDLVKTYPPFVNFFEMSKETIIKCEKQKPRFHAFLKINQAKPECGRQSLVELLIRPVQRLPSVALLLNDLKKHTADENPDKSTLEKAIGSLKEVMTHINEDKRKTEAQKQIFDVVYEVDGCPANLLSSHRSLVQRVETISLGEHPCDRGEQVTLFLFNDCLEIARKRHKVIGTFRSPHGQTRPPASLKHIHLMPLSQIKKVLDIRETEDCHNAFALLVRPPTEQANVLLSFQMTSDELPKENWLKMLCRHVANTICKADAENLIYTADPESFEVNTKDMDSTLSRASRAIKKTSKKVTRAFSFSKTPKRALRRALMTSHGSVEGRSPSSNDKHVMSRLSSTSSLAGIPSPSLVSLPSFFERRSHTLSRSTTHLI

SEQ ID NO: 745047 - protein, 914 aa, Homo sapiens
MAENSVLTSTTGRTSLADSSIFDSKVTEISKENLLIGSTSYVEEEMPQIETRVILVQEAGKQEELIKALKTIKIMEVPVIKIKESCPGKSDEKLIKSVINMDIKVGFVKMESVEEFEGLDSPEFENVFVVTDFQDSVFNDLYKADCRVIGPPVVLNCSQKGEPLPFSCRPLYCTSMMNLVLCFTGFRKKEELVRLVTLVHHMGGVIRKDFNSKVTHLVANCTQGEKFRVAVSLGTPIMKPEWIYKAWERRNEQDFYAAVDDFRNEFKVPPFQDCILSFLGFSDEEKTNMEEMTEMQGGKYLPLGDERCTHLVVEENIVKDLPFEPSKKLYVVKQEWFWGSIQMDARAGETMYLYEKANTPELKKSVSMLSLNTPNSNRKRRRLKETLAQLSRETDVSPFPPRKRPSAEHSLSIGSLLDISNTPESSINYGDTPKSCTKSSKSSTPVPSKQSARWQVAKELYQTESNYVNILATIIQLFQVPLEEEGQRGGPILAPEEIKTIFGSIPDIFDVHTKIKDDLEDLIVNWDESKSIGDIFLKYSKDLVKTYPPFVNFFEMSKETIIKCEKQKPRFHAFLKINQAKPECGRQSLVELLIRPVQRLPSVALLLNDLKKHTADENPDKSTLEKAIGSLKEVMTHINEDKRKTEAQKQIFDVVYEVDGCPANLLSSHRSLVQRVETISLGEHPCDRGEQVTLFLFNDCLEIARKRHKVIGTFRSPHGQTRPPASLKHIHLMPLSQIKKVLDIRETEDCHNAFALLVRPPTEQANVLLSFQMTSDELPKENWLKMLCRHVANTICKADAENLIYTADPESFEVNTKDMDSTLSRASRAIKKTSKKVTRAFSFSKTPKRALRRALMTSHGSVEGRSPSSNDKHVMSRLSSTSSLAGIPSPSLVSLPSFFERRSHTLSRSTTHLI

SEQ ID NO: 745048 - protein, 800 aa, Homo sapiens
HSSLLRVKLGPERRKDSDFQDSVFNDLYKADCRVIGPPVVLNCSQKGEPLPFSCRPLYCTSMMNLVLCFTGFRKKEELVRLVTLVHHMGGVIRKDFNSKVTHLVANCTQGEKFRVAVSLGTPIMKPEWIYKAWERRNEQDFYAAVDDFRNEFKVPPFQDCILSFLGFSDEEKTNMEEMTEMQGGKYLPLGDERCTHLVVEENIVKDLPFEPSKKLYVVKQEWFWGSIQMDARAGETMYLYEKANTPELKKSVSMLSLNTPNSNRKRRRLKETLAQLSRETDVSPFPPRKRPSAEHSLSIGSLLDISNTPESSINYGDTPKSCTKSSKSSTPVPSKQSARWQVAKELYQTESNYVNILATIIQLFQVPLEEEGQRGGPILAPEEIKTIFGSIPDIFDVHTKIKDDLEDLIVNWDESKSIGDIFLKYSKDLVKTYPPFVNFFEMSKETIIKCEKQKPRFHAFLKINQAKPECGRQSLVELLIRPVQRLPSVALLLNDLKKHTADENPDKSTLEKAIGSLKEVMTHINEDKRKTEAQKQIFDVVYEVDGCPANLLSSHRSLVQRVETISLGEHPCDRGEQVTLFLFNDCLEIARKRHKVIGTFRSPHGQTRPPASLKHIHLMPLSQIKKVLDIRETEDCHNAFALLVRPPTEQANVLLSFQMTSDELPKENWLKMLCRHVANTICKADAENLIYTADPESFEVNTKDMDSTLSRASRAIKKTSKKVTRAFSFSKTPKRALRRALMTSHGSVEGRSPSSNDKHVMSRLSSTSSLAGIPSPSLVSLPSFFERRSHTLSRSTTHLI

SEQ ID NO: 745049 - protein, 145 aa, Homo sapiens
LASGPPATDNIFIRLSLKLYCLAERMKVSEAALSLLVLILIITSASRSQPKVPEWVNTPSTCCLKYYEKVLPRRLVVGYRKALNCHLPAIIFVTKRNREVCTNPNDDWVQEYIKDPNLPLLPTRNLSTVKIITAKNGQPQLLNSQ

SEQ ID NO: 745050 - protein, 127 aa, Homo sapiens
RGGPGRLLYGPLLVLELHPKDCVCLCPRGRAPHNSLCPIGSLCHYLTQYTSDWGSSLRMALSLAQGLAFLHEERWQNGQYKPGIAHRDLSSQNVLIREDGSCAIGDLGLALVLPGLTQPPAWTPTPV

SEQ ID NO: 745051 - protein, 119 aa, Homo sapiens
ALAVQERRRPYIPSTWRCFATDPDGLRELLEDCWDADPEARLTAECVQQRLAALAHPQESHPFPESCPRGCPPLCPEDCTSIPAPTILPCRPQRSACHFSVQQGPCSRNPQPACTLSPV

SEQ ID NO: 745052 - protein, 211 aa, Homo sapiens
SCLDVQPCYSERTTECEGSLCHYLTQYTSDWGSSLRMALSLAQGLAFLHEERWQNGQYKPGIAHRDLSSQNVLIREDGSCAIGDLGLALVLPGLTQPPAWTPTQPQGPAAIMEDPDGLRELLEDCWDADPEARLTAECVQQRLAALAHPQESHPFPESCPRGCPPLCPEDCTSIPAPTILPCRPQRSACHFSVQQGPCSRNPQPACTLSPV

SEQ ID NO: 745053 - protein, 958 aa, Homo sapiens
AARMLPGRLCWVPLLLALGVGSGSGGGGDSRQRRLLAAKVNKHKPWIETSYHGVITENNDTVILDPPLVALDKDAPVPFAGEICAFKIHGQELPFEAVVLNKTSGEGRLRAKSPIDCELQKEYTFIIQAYDCGAGPHETAWKKSHKAVVHIQVKDVNEFAPTFKEPAYKAVVTEGKIYDSILQVEAIDEDCSPQYSQICNYEIVTTDVPFAIDRNGNIRNTEKLSYDKQHQYEILVTAYDCGQKPAAQDTLVQVDVKPVCKPGWQDWTKRIEYQPGSGSMPLFPSIHLETCDGAVSSLQIVTELQTNYIGKGCDRETYSEKSLQKLCGASSGIIDLLPSPSAATNWTAGLLVDSSEMIFKFDGRQGAKIPDGIVPKNLTDQFTITMWMKHGPSPGVRAEKETILCNSDKTEMNRHHYALYVHNCRLVFLLRKDFDQADTFRPAEFHWKLDQICDKEWHYYVINVEFPVVTLYMDGATYEPYLVTNDWPIHPSHIAMQLTVGACWQGGEVTKPQFAQFFHGSLASLTIRPGKMESQKVISCLQACKEGLDINSLESLGQGIKYHFNPSQSILVMEGDDIGNINRALQKVSYINSRQFPTAGVRRLKVSSKVQCFGEDVCISIPEVDAYVMVLQAIEPRITLRGTDHFWRPAAQFESARGVTLFPDIKIVSTFAKTEAPGDVKTTDPKSEVLEEMLHNLDFCDILVIGGDLDPRQECLELNHSELHQRHLDATNSTAGYSIYGVGSMSRYEQVLHHIRYRNWRPASLEARRFRIKCSELNGRYTSNEFNLEVSILHEDQVSDKEHVNHLIVQPPFLQSVHHPESRSSIQHSSVVPSIATVVIIISVCMLVFVVAMGVYRVRIAHQHFIQETEAAKESEMDWDDSALTITVNPMEKHEGPGHGEDETEGEEEEEAEEEMSSSSGSDDSEEEEEEEGMGRGRHGQNGARQAQLEWDDSTLPY

SEQ ID NO: 745054 - protein, 958 aa, Homo sapiens; identical to SEQ ID NO: 745053

SEQ ID NO: 745055 - protein, 86 aa, Homo sapiens
MLGLLGSTALVGWITGAAVAVLLLLLLLATCLFHGRQDCDVERNRTAAGGNRVRRAQPWPFRRRGHLGIFHHHRHPGHVSHVPNVG

SEQ ID NO: 745056 - protein, 477 aa, Homo sapiens
MTGQSLWDVSEANVEDGEIRINVGGFKRRLRSHTLLRFPETRLGRLLLCHSREAILELCDDYDDVQREFYFDRNPELFPYVLHFYHTGKLHVMAELCVFSFSQEIEYWGINEFFIDSCCSYSYHGRKVEPEQEKWDEQSDQESTTSSFDEILAFYNDASKFDGQPLGNFRRQLWLALDNPGYSVLSRVFSILSILVVMGSIITMCLNSLPDFQIPDSQGNPGEDPRFEIVEHFGIAWFTFELVARFAVAPDFLKFFKNALNLIDLMSIVPFYITLVVNLVVESTPTLANLGRVAQVLRLMRIFRILKLARHSTGLRSLGATLKYSYKEVGLLLLYLSVGISIFSVVAYTIEKEENEGLATIPACWWWATVSMTTVGYGDVVPGTTAGKLTASACILAGILVVVLPITLIFNKFSHFYRRQKQLESAMRSCDFGDGMKEVPSVNLRDYYAHKVKSLMASLTNMSRSSPSELSLNDSLR

SEQ ID NO: 745057 - protein, 477 aa, Homo sapiens; identical to SEQ ID NO: 745056

SEQ ID NO: 745058 - protein, 87 aa, Homo sapiens
LCGLLNQHLSKFKYSRGWKSEIRVSALLGSGEGPPPDFFMGESESRVEDGVEKKEKGEKERERMLQCTFSHASSYKDMNLLMRAPPS

SEQ ID NO: 745059 - protein, 610 aa, Homo sapiens
YDERWKEKQEQGFTWWLNFILTPDDFTVKTNISEVNAATLLLGIENQHKISVPRAPTKEEMSLRAYTARCRLNRLRRAACRLFTSEKMVKAIKKLEIEIEARRLIVRKDRHLWKDVGERQKVLNWLLSYNPLWLRIGLETTYGELISLEDNSDVTGLAMFILNRLLWNPDIAAEYRHPTVPHLYRDGHEEALSKFTLKKLLLLVCFLDYAKISRLIDHDPCLFCKDAEFKASKEILLAFSRDFLSGEGDLSRHLGLLGLPVNHVQTPFDEFDFAVTNLAVDLQCGVRLVRTMELLTQNWDLSKKLRIPAISRLQKMHNVDIVLQVLKSRGIELSDEHGNTILSKDIVDRHREKTLRLLWKIAFAFQVDISLNLDQLKEEIAFLKHTKSIKKTISLLSCHSDDLINKKKGKRDSGSFEQYSENIKLLMDWVNAVCAFYNKKVENFTVSFSDGRVLCYLIHHYHPCYVPFDAICQRTTQTVECTQTGSVVLNSSSESDDSSLDMSLKAFDHENTSELYKELLENEKKNFHLVRSAVRDLGGIPAMINHSDMSNTIPDEKVVITYLSFLCARLLDLRKEIRAARLIQTTWRKYKLKTDLKRHQVLLEYETTIV

SEQ ID NO: 745060 - protein, 817 aa, Homo sapiens
YDERWKEKQEQGFTWWLNFILTPDDFTVKTNISEVNAATLLLGIENQHKISVPRAPTKEEMSLRAYTARCRLNRLRRAACRLFTSEKMVKAIKKLEIEIEARRLIVRKDRHLWKDVGERQKVLNWLLSYNPLWLRIGLETTYGELISLEDNSDVTGLAMFILNRLLWNPDIAAEYRHPTVPHLYRDGHEEALSKFTLKKLLLLVCFLDYAKISRLIDHDPCLFCKDAEFKASKEILLAFSRDFLSGEGDLSRHLGLLGLPVNHVQTPFDEFDFAVTNLAVDLQCGVRLVRTMELLTQNWDLSKKLRIPAISRLQKMHNVDIVLQVLKSRGIELSDEHGNTILSKDIVDRHREKTLRLLWKIAFAFQVDISLNLDQLKEEIAFLKHTKSIKKTISLLSCHSDDLINKKKGKRDSGSFEQYSENIKLLMDWVNAVCAFYNKKVENFTVSFSDGRVLCYLIHHYHPCYVPFDAICQRTTQTVECTQTGSVVLNSSSESDDSSLDMSLKAFDHENTSELYKELLENEKKNFHLVRSAVRDLGGIPAMINHSDMSNTIPDEKVVITYLSFLCARLLDLRKEIRAARLIQTTWRKYKLKTDLKRHQEREKAARIIQLAVINFLAKQRLRKRVNAALVIQKYWRRVLAQRKLLMLKKEKLEKVQNKAASLIQGYWRRYSTRQRFLKLKYYSIILQSRIRMIIAVTSYKRYLWATVTIQRHWRAYLRRKQDQQRYEMLKSSTLIIQSMFRKWKQRKMQSQVKATVILQRAFREWHLRKQAKEENSAIIIQSWYRMHKELRKYIYIRSCVVIIQKRFRCFQAQKLY

SEQ ID NO: 745061 - protein, 702 aa, Homo sapiens
AETAPPNFVQRLQSMTVRQGSQVRLQVRVTGIPTPVVKFYRDGAEIQSSLDFQISQEGDLYSLLIAEAYPEDSGTYSVNATNSVGRATSTAELLVQGEEEVPAKKTKTIVSTAQISESRQTRIEKKIEAHFDARSIATVEMVIDGAAGEQLPHKTPPRIPPKPKSRSPTPPSIAAKAQLARQQSPSPIRHSPSPVRHVRAPTPSPVRSVSPAARISTSPIRSVRSPLLMRKTQASTVATGPEVPPPWKQEGYVASSSEAEMRETTLTTSTQIRTEERWEGRYGVQEQVTISGAAGLPPVCRPVLSYAAEAVATGAKEVKQDADKSAAVATVVAAVDMARVREPVISAVEQTAQRTTTTAVHIQPAQEQVRKEAEKTAVTKVVVAADKAKEQELKSRTKEVITTKQEQMHVTHEQIRKETEKTFVPKVVISAAKAKEQETRISEEITKKQKQVTQEAMRKEAEKTALSTIAVATAKAKEQETILRTRETMATRQEQIQVTHGKVDVGKKAEAVATVVAAVDQARVREPREPGHLEESYAQQTTLEYGYKERISAAKVAEPPQRPASEPHVVPKAVKPRVIQAPSETHIKTTDQKGMHISSQIKKTTDLTTERLVHVDKRPRTASPHFTVSKISVPKTEHGYEASIAGSAIATLQKELSATSSAQKITKSVKAPTVKPSETRVRAEPTPLPQFPFADTPDTYKS

SEQ ID NO: 745062 - protein, 794 aa, Homo sapiens
AETAPPNFVQRLQSMTVRQGSQVRLQVRVTGIPTPVVKFYRDGAEIQSSLDFQISQEGDLYSLLIAEAYPEDSGTYSVNATNSVGRATSTAELLVQGEEEVPAKKTKTIVSTAQISESRQTRIEKKIEAHFDARSIATVEMVIDGAAGEQLPHKTPPRIPPKPKSRSPTPPSIAAKAQLARQQSPSPIRHSPSPVRHVRAPTPSPVRSVSPAARISTSPIRSVRSPLLMRKTQASTVATGPEVPPPWKQEGYVASSSEAEMRETTLTTSTQIRTEERWEGRYGVQEQVTISGAAGLPPVCRPVLSYAAEAVATGAKEVKQDADKSAAVATVVAAVDMARVREPVISAVEQTAQRTTTTAVHIQPAQEQVRKEAEKTAVTKVVVAADKAKEQELKSRTKEVITTKQEQMHVTHEQIRKETEKTFVPKVVISAAKAKEQETRISEEITKKQKQVTQEAIRQETEITAASMVVVATAKSTKLETVPGAQEETTTQQDQMHLSYEKIMKETRKTVVPKVIVATPKVKEQDLVSRGREGITTKREQVQITQEKMRKEAEKTALSTIAVATAKAKEQETILRTRETMATRQEQIQVTHGKVDVGKKAEAVATVVAAVDQARVREPREPGHLEESYAQQTTLEYGYKERISAAKVAEPPQRPASEPHVVPKAVKPRVIQAPSETHIKTTDQKGMHISSQIKKTTDLTTERLVHVDKRPRTASPHFTVSKISVPKTEHGYEASIAGSAIATLQKELSATSSAQKITKSVKAPTVKPSETRVRAEPTPLPQFPFADTPDTYKS

SEQ ID NO: 745063 - protein, 656 aa, Homo sapiens
AETAPPNFVQRLQSMTVRQGSQVRLQVRVTGIPTPVVKFYRDGAEIQSSLDFQISQEGDLYSLLIAEAYPEDSGTYSVNATNSVGRATSTAELLVQGEEEVPAKKTKTIVSTAQISESRQTRIEKKIEAHFDARSIATVEMVIDGAAGEQLPHKTPPRIPPKPKSRSPTPPSIAAKAQLARQQSPSPIRHSPSPVRHVRAPTPSPVRSVSPAARISTSPIRSVRSPLLMRKTQASTVATGPEVPPPWKQEGYVASSSEAEMRETTLTTSTQIRTEERWEGRYGVQEQVTISGAAGLPPVCRPVLSYAAEAVATGAKEVKQDADKSAAVATVVAAVDMARVREPVISAVEQTAQRTTTTAVHIQPAQEQVRKEAEKTAVTKVVVAADKAKEQELKSRTKEVITTKQEQMHVTHEQIRKETEKTFVPKVVISAAKAKEQETRISEEITKKQKQVTQEAVDVGKKAEAVATVVAAVDQARVREPREPGHLEESYAQQTTLEYGYKERISAAKVAEPPQRPASEPHVVPKAVKPRVIQAPSETHIKTTDQKGMHISSQIKKTTDLTTERLVHVDKRPRTASPHFTVSKISVPKTEHGYEASIAGSAIATLQKELSATSSAQKITKSVKAPTVKPSETRVRAEPTPLPQFPFADTPDTYKS

SEQ ID NO: 745064 - protein, 101 aa, Homo sapiens
DHSLHQIETQLVNKLEQYTNIDTSSEDPGNTESGILELKLKALILDIIHNIDVVKQLNQIQVHTTEDWAWKKQLRFYMKSDHTCCVQMVDSEFQYTYEYQV

SEQ ID NO: 745065 - protein, 148 aa, Homo sapiens
MGDLSRTALWLGGRRDPSGSFRVRDGAAAEVGRACLGLPSECGSLVRARASPRPLLGPAVCPWRARSPRPGLPRPSPTCPWKRGGDWCALSLVAPAASRHPPLSASEQRIPPTSTCTCTRPLGNPLAFLTTVQNQKQIEHWENKDDAS

SEQ ID NO: 745066 - protein, 148 aa, Homo sapiens; identical to SEQ ID NO: 745065

SEQ ID NO: 745067 - protein, 49 aa, Homo sapiens
MTLSNALCMCAHPLTPLLLHTLHKWYSILCHCKNQNWLWIFVIHLYLKK

SEQ ID NO: 745068 - protein, 49 aa, Homo sapiens; identical to SEQ ID NO: 745067

SEQ ID NO: 745069 - protein, 49 aa, Homo sapiens; identical to SEQ ID NO: 745067

SEQ ID NO: 745070 - protein, 49 aa, Homo sapiens; identical to SEQ ID NO: 745067

SEQ ID NO: 745071 - protein, 161 aa, Homo sapiens
ECGKTFRLSFYLTEHRRTHAGKKPYECKECGKSFNVRGQLNRHKTIHTGIKPFACKVCEKAFSYSGDLRVHSRIHTGEKPYECKECGKAFMLRSVLTEHQRLHTGVKPYECKECGKTFRVRSQISLHKKIHTDVKPYKCVRCGKTFRFGFYLTEHQRIHTG

SEQ ID NO: 745072 - protein, 70 aa, Homo sapiens
LPFDPFANRDGLEQREVRLLGQPYGMSSQEAQDLLAQVAKRQAAECVCQPSEKGCLKPSISWGCSKSLLL

SEQ ID NO: 745073 - protein, 110 aa, Homo sapiens
TKTKKTCPVCKQKVVPSQGDSDSDTDSSQEENEVTEHTPLLRPLASVSAQSFGALSESRSHQNMTESSDYEEDDNEDTDSSDAENEINEHDVVVQLQPNGERDYNIANTV

SEQ ID NO: 745074 - protein, 106 aa, Homo sapiens
LKWFMTSSPLPRLLCSLVFLGGCWVTGFSSSLMWASAKEQLQHLFLIGSCLYKYFLPICHIASLPPCLPWSTAESVSVPGMHTWTLSFPNRLSAGQHFVMFGCYRH

SEQ ID NO: 745075 - protein, 148 aa, Homo sapiens [sequence omitted]

SEQ ID NO: 745076 - protein, 148 aa, Homo sapiens [sequence omitted]

SEQ ID NO: 745077 - protein, 92 aa, Homo sapiens
KRPELGVQAKSPRGEPGREAVANGIPWSSSTQIRHGGWARGLQKKEALGTTFYEYYVDDPPRIVLDKLERRGFRVLSMTGVGQTLVWCLHKE

SEQ ID NO: 745078 - protein, 148 aa, Homo sapiens [sequence omitted]

SEQ ID NO: 745079 - protein, 103 aa, Homo sapiens
LREMIIKGIRESVPHTQNLSRAFDVQQEKDEGPMKFLKRPREQTKKYADLDPEDSLGQEMLKLHVVTNSWSDITKQLQKLENWKNLSIEKLLGEAQKFYVRRD

SEQ ID NO: 745080 - protein, 619 aa, Homo sapiens
LSCLLGTRFNLDTSSKHPRVPLPSLLEYSLSGSFPLPDSAALVPAFSALPALRLGPGSFPLAGVSSPPPEGRADPSLLAACPASPPPRRPGSGRAGAPGAVRRPRATTAASASCCSGLFCAGLVGGDPDCARQWLRGRRVAMGSRWSSEEERQPLLGPGLGPGLGASWRSREAAAAALPAAVPGPGRVYGRRWLVLLLFSLLAFVQGLVWNTWGPIQNSARQAYGFSSWDIALLVLWGPIGFLPCFAFMWLLDKRGLRITVLLTSFLMVLGTGLRCIPISDLILKRRLIHGGQMLNGLAGPTVMNAAPFLSTTWFSADERATATAIASMLSYLGGACAFLVGPLVVPAPNGTSPLLAAESSRAHIKDRIEAVLYAEFGVVCLIFSATLAYFPPRPPLPPSVAAASQRLSYRRSVCRLLSNFRFLMIALAYAIPLGVFAGWSGVLDLILTPAHVSQVDAGWIGFWSIVGGCVVGIAMARFADFIRGMLKLILLLLFSGATLSSTWFTLTCLNSITHLPLTTVTLYASCILLGVFLNSSVPIFFELFVETVYPVPEGITCGVVTFLSNMFMGVLLFFLTFYHTELSWFNWCLPGSCLLSLLLILCFRESYDRLYLDVVVSV

SEQ ID NO: 745081 - protein, 438 aa, Homo sapiens
LSCLLGTRFNLDTSSKHPRVPLPSLLEYSLSGSFPLPDSAALVPAFSALPALRLGPGSFPLAGVSSPPPEGRADPSLLAACPASPPPRRPGSGRAGAPGAVRRPRATTAASASCCSGLFCAGLVGGDPDCARQWLRGRRVAMGSRWSSEEERQPLLGPGLGPGLGASWRSREAAAAALPAAVPGPGRVYGRRWLVLLLFSLLAFVQGLVWNTWGPIQNSARQAYGFSSWDIALLVLWGPIGFLPCFAFMWLLDKRGLRITVLLTSFLMVLGTGLRCIPISDLILKRRLIHGGQMLNGLAGPTVMNAAPFLSTTWFSADERATATAIASMLSYLGGACAFLVGPLVVPAPNGTSPLLAAESSRAHIKDRIEAVLYAEFGVVCLIFSATLAYFPPRPPLPPSVAAASQRLSYRRSVCRLLRFHFICYICIHLCILLSESD

SEQ ID NO: 745082 - protein, 256 aa, Homo sapiens
LSCLLGTRFNLDTSSKHPRVPLPSLLEYSLSGSFPLPDSAALVPAFSALPALRLGPGSFPLAGVSSPPAEGRADPSLLAACPASPPPRRPGSGRAGAPGAVRRPRATTAASASCCSGLFCAGLVGGDPDCARQWLRGRRVAMGSRWSSEEERQPLLGPGLGPGLGASWRSREAAAAALPAAVPGPGRVYGRRWLVLLLFSLLAFVQGLVWNTWGPIQNSARQAYGFSSWDIALLVLWGPIGFLPCFAFMWLLDKRD

SEQ ID NO: 745083 - protein, 529 aa, Homo sapiens
LSCLLGTRFNLDTSSKHPRVPLPSLLEYSLSGSFPLPDSAALVPAFSALPALRLGPGSFPLAGVSSPPPEGRADPSLLAACPASPPPRRPGSGRAGAPGAVRRPRATTAASASCCSGLFCAGLVGGDPDCARQWLRGRRVAMGSRWSSEEERQPLLGPGLGPGLGASWRSREAAAAALPAAVPGPGRVYGRRWLVLLLFSLLAFVQGLVWNTWGPIQNSARQAYGFSSWDIALLVLWGPIGFLPCFAFMWLLDKRGLRITVLLTSFLMVLGTGLRCIPISDLILKRRLIHGGQMLNGLAGPTVMNAAPFLSTTWFSADERATATAIASMLSYLGGACAFLVGPLVVPAPNGTSPLLAAESSRAHIKDRIEAVLYAEFGVVCLIFSATLAYFPPRPPLPPSVAAASQRLSYRRSVCRLLSNFRFLMIALAYAIPLGVFAGWSGVLDLILTPAHVSQVDAGWIGFWSIVGGCVVGIAMARFADFIRGMLKLILLLLFSGATLSSTWFTLTCLNSITHLPLTTGEHRLFLNF

SEQ ID NO: 745084 - protein, 75 aa, Homo sapiens
RPPRLPPGHCKDDLPHSHSGSPLTQHRPCAKPAGQVKVVSSPNLAEAPFFSSAHCFGTVYAADVSRQHGLHVTCL

SEQ ID NO: 745085 - protein, 109 aa, Homo sapiens
MLWGRPKEIFASRERETFLEDRKTFLEEIMKQAQKRKRAFKNDVKFMADLILETRSPSRVEIFSLRHQAMTVQSAAETAFRPSVLTQVQELCGVFHLGLLLFKAHKSRL

SEQ ID NO: 745086 - protein, 119 aa, Homo sapiens
ETSLILSPTLECSGAISAHCNLCLPGSSNSCASASRVAWITGMHHHAQLIFVFLVEMGVHHVGLAGLELLTSGDPPASASQSAGITGVSHRIWPHILFCTAWCPILQNTKLCNHILTGI

SEQ ID NO: 745087 - protein, 838 aa, Homo sapiens
VKETHLPKVVLVDLVPGDSDYEVISDDIPLQLVTDPPQLTVKDISCINTECIDIEDKSCDFFGSEVRCNCKASTPSMTNQCKETFKIINRKKDYIILGEPSCQSCGSEMNFNVDASDQSMTYESQGPDEKMVKYIDSEDKSCGYNGSKGKFNLEDTSHRTTHRLQKAHKEASLRKDPRNAGLKGKSCQSSASAVDFGASSKSALHRRADKKKRSKLKHRDLEVSCEPDGFEMNFQCAPPLPSDTDQPQETVKKRHPCKKVSSDLKEKNHDSQSSSVLKVDSVRNLKKAKDVIEDNPDEPVLEALPHVPPSFVGKTWSQIMREDDIKINALVKEFREGRFHCYFDDDCETKKVSSKGKKKVTWADLQGKEDTAPTQAVSESDDIVCGISDIDDLSVALDKPCHRHPPAERPPKQKGRVASQCQTAKISHSTQTSCKNYPVMKRKIIRQEEDPPKSKCSRLQDDRKTKKKVKIGTVEFPASCTKVLKPMQPKALVCVLSSLNIKLKEGEGLPFPKMRHHSWDNDIRFICKYKRNIFDYYEPLIKQIVISPPLSVIVPEFERRNWVKIHFNRSNQNSSAGDNDADGQGSASAPLMAVPARYGFNSHQGTSDSSLFLEESKVLHARELPKKRNFQLTFLNHDVVKISPKSVRNKLLESQSKKKIHGKRVTTSSNKLGFPKKVYKPIILQQKPRKASEKQSIWIRTKPSDIIRKYISKYSVFLRHRYQSRSAFLGRYLKKKKSVVSRLKKAKRTAKVLLNSSVPPAGAEELSSAMANPPPKRPVRASCRVARRRKKTDESYHGRQKGPSTPVRAYDLRSSSCLQQRERMMTRLANKLRGNEVK

SEQ ID NO: 745088 - protein, 838 aa, Homo sapiens; identical to SEQ ID NO: 745087

SEQ ID NO: 745089 - protein, 30 aa, Homo sapiens
MRLGWKSHGPLTESRCFSPSLSDTVLMVDE

SEQ ID NO: 745090 - protein, 50 aa, Homo sapiens
ATQPPPAPPPPVPAPPEAAATERLAAAAERLAAATTAASCKESSSSSKRG

SEQ ID NO: 745091 - protein, 640 aa, Homo sapiens
MGERTLHAAVPTPGYPESESIMMAPICLVENQEEQLTVNSKALEILDKISQPVVVVAIVGLYRTGKSYLMNRLAGKRNGFPLGSTVQSETKGIWMWCVPHLSKPNHTLVLLDTEGLGDVEKSNPKNDSWIFALAVLLSSSFVYNSVSTINHQALEQLHYVTELAELIRAKSCPRPDEAEDSSEFASFFPDFIWTVRDFTLELKLDGNPITEDEYLENALKLIPGKNPKIQNSNMPRECIRHFFRKRKCFVFDRPTNDKQYLNHMDEVPEENLERHFLMQSDNFCSYIFTHAKTKTLREGIIVTGKRLGTLVVTYVDAINSGAVPCLENAVTALAQLENPAAVQRAADHYSQQMAQQLRLPTDTLQELLDVHAACEREAIAVFMEHSFKDENHEFQKKLVDTIEKKKGDFVLQNEEASAKYCQAELKRLSEHLTESILRGIFSVPGGHNLYLEEKKQVEWDYKLVPRKGVKANEVLQNFLQSQVVVEESILQSDKALTAGEKAIAAERAMKEAAEKEQELLREKQKEQQQMMEAQERSFQENIAQLKKKMERERENLLREHERLLKHKLKVQEEMLKEEFQKKSEQLNKEINQLKEKIESTKNEQLRLLKILDMASNIMIVTLPGASKLLGVGTKYLGSRI

SEQ ID NO: 745092 - protein, 640 aa, Homo sapiens; identical to SEQ ID NO: 745091

SEQ ID NO: 745093 - protein, 477 aa, Homo sapiens
PLLGTQERCPRPDEAEDSSEFASFFPDFIWTVRDFTLELKLDGNPITEDEYLENALKLIPGKNPKIQNSNMPRECIRHFFRKRKCFVFDRPTNDKQYLNHMDEVPEENLERHFLMQSDNFCSYIFTHAKTKTLREGIIVTGKRLGTLVVTYVDAINSGAVPCLENAVTALAQLENPAAVQRAADHYSQQMAQQLRLPTDTLQELLDVHAACEREAIAVFMEHSFKDENHEFQKKLVDTIEKKKGDFVLQNEEASAKYCQAELKRLSEHLTESILRGIFSVPGGHNLYLEEKKQVEWDYKLVPRKGVKANEVLQNFLQSQVVVEESILQSDKALTAGEKAIAAERAMKEAAEKEQELLREKQKEQQQMMEAQERSFQENIAQLKKKMERERENLLREHERLLKHKLKVQEEMLKEEFQKKSEQLNKEINQLKEKIESTKNEQLRLLKILDMASNIMIVTLPGASKLLGVGTKYLGSRI

SEQ ID NO: 745094 - protein, 640 aa, Homo sapiens; identical to SEQ ID NO: 745091

SEQ ID NO: 745095 - protein, 510 aa, Homo sapiens
MGERTLHAAVPTPGYPESESIMMAPICLVENQEEQLTVNSKALEILDKISQPVVVVAIVGLYRTGKSYLMNRLAGKRNGFPLGSTVQSETKGIWMWCVPHLSKPNHTLVLLDTEGLGDVEKSNPKNDSWIFALAVLLSSSFVYNSVSTINHQALEQLHYVTELAELIRAKSCPRPDEAEDSSEFASFFPDFIWTVRDFTLELKLDGNPITEDEYLENALKLIPGKNPKIQNSNMPRECIRHFFRKRKCFVFDRPTNDKQYLNHMDEVPEENLERHFLMQSDNFCSYIFTHAKTKTLREGIIVTGKRLGTLVVTYVDAINSGAVPCLENAVTALAQLENPAAVQRAADHYSQQMAQQLRLPTDTLQELLDVHAACEREAIAVFMEHSFKDENHEFQKKLVDTIEKKKGDFVLQNEEASAKYCQAELKRLSEHLTESILRGIFSVPGGHNLYLEEKKQVEWDYKLVPRKGVKANEVLQNFLQSQVVVEESILQSDKALTAGEKAIAGTGAGL

SEQ ID NO: 745096 - protein, 120 aa, Homo sapiens
MVCGPNLAQHLFLEMRLYWSIRAPICLHIVFGSICATVADLHNGQRNLKAEKLEILTICKAENIYYLTSLFLCSFPFPFPFFLTGSHSVTQAVVQWCNHGSLHPRPPGLKRSSHLSMLGG

SEQ ID NO: 745097 - protein, 120 aa, Homo sapiens
SPQPPQNILHSHDSFRQIQRETGTLGYQRTRDEKVSSFRNTSDSPSGSPILQSPPRLVKNEDYCTRPQIQNEKCTWWRMGGEWGLVSAFFTSPQEFWHALAYEKHGEGTGGRWMGVDRIC

SEQ ID NO: 745098 - protein, 154 aa, Homo sapiens
MSTEQMQPLEVSEDRLDKLDPRCSHLDDLSDQFIKDCDLKKKPRKGKNVQATLNVESDQKKPRRKDTPALHIPPFIPGVFSEHLIKRYDVQERHPKGKMIPVLHNTDLEQKKPRRKDTPALHMSPFAAGVTLLRDERPKAIVEDDEKDGDKIAI

SEQ ID NO: 745099 - protein, 263 aa, Homo sapiens
MVIGQLEGILRELKEVAKELREVVSQIDKLTSDFDFELEPDDWTTATVSSTSSTDKAGMGGPFDLGHLDFMTADILSDSWEFCSFLDVSTPSDSVDGPESTRPGAGPDYRLMNGGTPIPNGPRVETPDSSSEEAFGAGPTVKSQLPQRTPGTRERVRFSDKVLYHALCCDDEEGDGEQEVEEEEVGLPPEPAHTEAHAGPHKPSPAPYKSRRSPLTSRHSGSTLAPEQTRRVTRNSSTQTVSDKSTQTVLPYTATRQKARGKN

SEQ ID NO: 745100 - protein, 154 aa, Homo sapiens
MGRPRGWAEQTLAAAPDAAGAGARTFWVRAERVLGARRCQLTPGGVGQGRPQRSTDPADLDWTERIPDGAEPGECRAWAEGIPAPSQPSDFGSRAGTCPASPRPPRAPVTCGLGAPNLPDPRSFPTPSLERLEKDFSCPLPWSAEAGGGGHIEL

SEQ ID NO: 745101 - protein, 289 aa, Homo sapiens
GYLEDPPGALPPGALTLRERIRQRMKMVIGQLEGILRELKEVAKELREVVSQIDKLTSDFDFELEPDDWTTATVSSTSSTDKAGMGGPFDLGHLDFMTADILSDSWEFCSFLDVSTPSDSVDGPESTRPGAGPDYRLMNGGTPIPNGPRVETPDSSSEEAFGAGPTVKSQLPQRTPGTRERVRFSDKVLYHALCCDDEEGDGEQEVEEEEVGLPPEPAHTEAHAGPHKPSPAPYKSRRSPLTSRHSGSTLAPEQTRRVTRNSSTQTVSDKSTQTVLPYTATRQKARGKN

SEQ ID NO: 745102 - protein, 884 aa, Homo sapiens
SLCARFDLSQLAKLRSVLFYTACLDPNFPATLFKDKMKCTVNNQQSKKIMVAADIVTIFNLIQMNGGAAKEKLPTGRQKVRKKEASFESCRSDTEICNAAECEPLNCELSERSFSRGYPIRQSSKCRKMDCKDCPQFVPASEPNFLLGVSKEVKNRAASLDRLQALAPYSVTSPQPCEMQRTYFPMNIENESISDQDSLPINQSIKETFISNEEPFVVQSCVQKRNIFKEDFHNLMAVSPSLVGPISKAENEHREPQSRKEPHKPPFFNHSFEMPYNSQYLNPVYSPVPDKRRAKHESLDDLQASTYFGPTPVMGTQEARRCLGKPNKQTPWPAKSWSLNTEEVPDFERSFFNRNPSEEKLHYPNASSQTPNFPAPERRPTYLVPKDQQPILPIAYAAKQNGLKSKEISSPVDLEKHEPVKKFKDKSINCTSGQLSSDTSSVGTQTEHVLEPKKCRDLCTSGQGKYSDRHTMKHSDDDSEIVSDDISDIFRFLDDMSISGSTGVIQSSCYNSTGSLSQLHKSDCDSSPEHNLTKIANGVPNSKGDKGNRPENTHHSEEELKTSVCKLVLRIGEIERKLESLSGVRDEISQVLGKLNKLDQKMQQPEKVSVQIDLNSLTSEGPSDDSASPRMFHAHSGSHGPKLENNPDWCCSDASGSNSESLRVKALKKSLFTRPSSRSLTEENSATESKIASISNSPRDWRTITYTNRVGLNEEEIKDTGPGDNKDWHRKSKEADRQYDIPPQHRLPKQPKDGFLVEQVFSPHPYPASLKAHMKSNPLYTDMRLTELAEVKRGQPSWTIEEYARNAGDKGKLTALDLQTQESLNPNNLEYWMEDIYTPGYDSLLKRKEAEFRRAKVCKIAALIAAAACTVILVIVVPICTMKS

SEQ ID NO: 745103 - protein, 520 aa, Homo sapiens
PAWPSEPTTFGPTGVPAPIPVLSVTQTLTTGPDSAVSQAHLTPSPVPVSIQAVNQPLMPLPQTLSLYQDPLYPGFPCNEKGDRAIVPPYSLCQTGEDLPKDKNILRFFFNLGVKAYSCPMWAPHSYLYPLHQAYLAACRMYPKVPVPVYPHNPWFQEAPAAQNESDCTCTDAHFPMQTEASVNGQMPQPEIGPPTFSSPLVIPPSQVSESHGQLSYQADLESETPGQLLHADYEESLSGKNMFPQPSFGPNPFLGPVPIAPPFFPHVWYGYPFQGFIENPVMRQNIVLPSDEKGELDLSLENLDLSKDCGSVSTVDEFPEARGEHVHSLPEASVSSKPDEGRTEQSSQTRKADTALASIPPVAEGKAHPPTQILNRERETVPVELEPKRTIQSLKEKTEKVKDPKTAADVVSPGANSVDSRVQRPKEESSEDENEVSNILRSGRSKQFYNQTYGSRKYKSDWGYSGRGGYQHVRSEESWKGQPSRSRDEGYQYHRNVRGRPFRGDRRRSGMGDGHRGQHT

SEQ ID NO: 745104 - protein, 491 aa, Homo sapiens
DALPQGWLTAVLTTGMERVLNELGIQPLMPLPQTLSLYQDPLYPGFPCNEKGDRAIVPPYSLCQTGEDLPKDKNILRFFFNLGVKAYSCPMWAPHSYLYPLHQAYLAACRMYPKVPVPVYPHNPWFQEAPAAQNESDCTCTDAHFPMQTEASVNGQMPQPEIGPPTFSSPLVIPPSQVSESHGQLSYQADLESETPGQLLHADYEESLSGKNMFPQPSFGPNPFLGPVPIAPPFFPHVWYGYPFQGFIENPVMRQNIVLPSDEKGELDLSLENLDLSKDCGSVSTVDEFPEARGEHVHSLPEASVSSKPDEGRTEQSSQTRKADTALASIPPVAEGKAHPPTQILNRERETVPVELEPKRTIQSLKEKTEKVKDPKTAADVVSPGANSVDSRVQRPKEESSEDENEVSNILRSGRSKQFYNQTYGSRKYKSDWGYSGRGGYQHVRSEESWKGQPSRSRDEGYQYHRNVRGRPFRGDRRRSGMGDGHRGQHT

SEQ ID NO: 745105 - protein, 429 aa, Homo sapiens
PAWPSEPTTFGPTGVPAPIPVLSVTQTLTTGPDSAVSQAHLTPSPVPVSIQAVNQPLMPLPQTLSLYQDPLYPGFPCNEKGDRAIVPPYSLCQTGEDLPKDKNILRFFFNLGVKAYSCPMWAPHSYLYPLHQAYLAACRMYPKVPVPVYPHNPWFQEAPAAQNESDCTCTDAHFPMQTEASVNGQMPQPEIGPPTFSSPLVIPPSQVSESHGQLSKDCGSVSTVDEFPEARGEHVHSLPEASVSSKPDEGRTEQSSQTRKADTALASIPPVAEGKAHPPTQILNRERETVPVELEPKRTIQSLKEKTEKVKDPKTAADVVSPGANSVDSRVQRPKEESSEDENEVSNILRSGRSKQFYNQTYGSRKYKSDWGYSGRGGYQHVRSEESWKGQPSRSRDEGYQYHRNVRGRPFRGDRRRSGMGDGHRGQHT

SEQ ID NO: 745106 - protein, 108 aa, Homo sapiens
PAWPSEPTTFGPTGVPAPIPVLSVTQTLTTGPDSAVSQAHLTPSPVPVSIQAVNQPLMPLPQTLSLYQDPLYPGFPCNEKGDRAIVPPYSLTTPHCQRLTDNALTDNA

SEQ ID NO: 745107 - protein, 401 aa, Homo sapiens
MWAPHSYLYPLHQAYLAACRMYPKVPVPVYPHNPWFQEAPAAQNESDCTCTDAHFPMQTEASVNGQMPQPEIGPPTFSSPLVIPPSQVSESHGQLSYQADLESETPGQLLHADYEESLSGKNMFPQPSFGPNPFLGPVPIAPPFFPHVWYGYPFQGFIENPVMRQNIVLPSDEKGELDLSLENLDLSKDCGSVSTVDEFPEARGEHVHSLPEASVSSKPDEGRTEQSSQTRKADTALASIPPVAEGKAHPPTQILNRERETVPVELEPKRTIQSLKEKTEKVKDPKTAADVVSPGANSVDSRVQRPKEESSEDENEVSNILRSGRSKQFYNQTYGSRKYKSDWGYSGRGGYQHVRSEESWKGQPSRSRDEGYQYHRNVRGRPFRGDRRRSGMGDGHRGQHT

SEQ ID NO: 745108 - protein, 251 aa, Homo sapiens
PAWPSEPTTFGPTGVPAPIPVLSVTQTLTTGPDSAVSQAHLTPSPVPVSIQAVNQPLMPLPQTLSLYQDPLYPGFPCNEKGDRAIVPPYSLCQTGEDLPKDKNILRFFFNLGVKAYSCPMWAPHSYLYPLHQAYLAACRMYPKVPVPVYPHNPWFQEAPAAQNESDCTCTDAHFPMQTEASVNGQMPQPEIGPPTFSSPLVIPPSQVSESHGQLSYQADLESETPGQLLHADYEESLSGKNMFPTAKQKSG

SEQ ID NO: 745109 - protein, 520 aa, Homo sapiens; identical to SEQ ID NO: 745103

SEQ ID NO: 745110 - protein, 231 aa, Homo sapiens
MAGEKVEKPDTKEKKPEAKKVDAGGKVKKGNLKAKKPKKGKPHCSRNPVLVRGIGRYSRSAMYSRKAMYKRKYSAAKSKVEKKKKEKVLATVTKPVGGDKNGGTRVVKLRKMPRYYPTEDVPRKLLSHGKKPFSQHVRKLRAQHYPPPGGGGTPKFFLGQFSQKFSPPPFFLPRLRGKPGPPPKNEDRGKRVVFLKQLASGLLLVTGPLVLNRVPLRRTHQKFVIATSTKI

SEQ ID NO: 745111 - protein, 202 aa, Homo sapiens
MAGEKVEKPDTKEKKPEAKKVDAGGKVKKGNLKAKKPKKGKPHCSRNPVLVRGIGRYSRSAMYSRKAMYKRKYSAAKSKVEKKKKEKVLATVTKPVGGDKNGGTRVVKLRKMPRYYPTEDVPRKLLSHGKKPFSQHVRKLRASITPGTILIILTGRHRGKRVVFLKQLASGLLLVTGPLVLNRVPLRRTHQKFVIATSTKID

SEQ ID NO: 745112 - protein, 183 aa, Homo sapiens
MAGEKVEKPDTKEKKPEAKKVDAGGKVKKGNLKAKKPKKGKPHCSRNPVLVRGIGRYSRSAMYSRKAMYKRKYSAAKSKVEKKKKEKVLATVTKPVGGDKNGGTRVVKLRKMPRYYPTEDVPRKLLSHGKKPFSQHVNRGKRVVFLKQLASGLLLVTGPLVLNRVPLRRTHQKFVIATSTKID

SEQ ID NO: 745113 - protein, 428 aa, Homo sapiens
MKRRKYGFIYKTHLFGRPTVRVMGADNVRRILLGEHRLVSVHWPASVRTILGSGCLSNLHDSSHKQRKKVIMRAFSREALECYVPVITEEVGSSLEQWLSCGERGLLVYPEVKRLMFRIAMRILLGCEPQLAGDGDSEQQLVEAFEEMTRNLFSLPIDVPFSGLYRGMKARNLIHARIEQNIRAKICGLRASEAGQGCKDALQLLIEHSWERGERLDMQALKQSSTELLFGGHETTASAATSLITYLGLYPHVLQKVREELKSKGLLCKSNQDNKLDMEILEQLKYIGCVIKETLRLNPPVPGGFRVALKTFELNGYQIPKGWNVIYSICDTHDVAEIFTNKEEFNPDRFMLPHPEDASRFSFIPFGGGLRSCVGKEFAKILLKIFTVELARHCDWQLLNGPPTMKTSPTVYPVDNLPARFTHFHGEI

SEQ ID NO: 745114 - protein, 490 aa, Homo sapiens
MGLPALLASALCTFVLPLLLFLAAIKLWDLYCVSGRDRSCALPLPPGTMGFPFFGETLQMVLQRRKFLQMKRRKYGFIYKTHLFGRPTVRVMGADNVRRILLGETGWCRSTGQRRCAPFWDLAASLTCTTPRTSSARSREALECYVPVITEEVGSSLEQWLSCGERGLLVYPEVKRLMFRIAMRILLGCEPQLAGDGDSEQQLVEAFEEMTRNLFSLPIDVPFSGLYRGMKARNLIHARIEQNIRAKICGLRASEAGQGCKDALQLLIEHSWERGERLDMQALKQSSTELLFGGHETTASAATSLITYLGLYPHVLQKVREELKSKGLLCKSNQDNKLDMEILEQLKYIGCVIKETLRLNPPVPGGFRVALKTFELNGYQIPKGWNVIYSICDTHDVAEIFTNKEEFNPDRFMLPHPEDASRFSFIPFGGGLRSCVGKEFAKILLKIFTVELARHCDWQLLNGPPTMKTSPTVYPVDNLPARFTHFHGEI

SEQ ID NO: 745115 - protein, 89 aa, Homo sapiens
KYGFIYKTHLFGRPTVRVMGADNVRRILLGEHRLVSVHWPASVRTILGSGCLSNLHDSSHKQRKKVGAGGDGWTGRGTPFMSGIPADGC

SEQ ID NO: 745116 - protein, 497 aa, Homo sapiens
MGLPALLASALCTFVLPLLLFLAAIKLWDLYCVSGRDRSCALPLPPGTMGFPFFGETLQMVLQRRKFLQMKRRKYGFIYKTHLFGRPTVRVMGADNVRRILLGEHRLVSVHWPASVRTILGSGCLSNLHDSSHKQRKKVIMRAFSREALECYVPVITEEVGSSLEQWLSCGERGLLVYPEVKRLMFRIAMRILLGCEPQLAGDGDSEQQLVEAFEEMTRNLFSLPIDVPFSGLYRGMKARNLIHARIEQNIRAKICGLRASEAGQGCKDALQLLIEHSWERGERLDMQALKQSSTELLFGGHETTASAATSLITYLGLYPHVLQKVREELKSKGLLCKSNQDNKLDMEILEQLKYIGCVIKETLRLNPPVPGGFRVALKTFELNGYQIPKGWNVIYSICDTHDVAEIFTNKEEFNPDRFMLPHPEDASRFSFIPFGGGLRSCVGKEFAKILLKIFTVELARHCDWQLLNGPPTMKTSPTVYPVDNLPARFTHFHGEI

SEQ ID NO: 745117 - protein, 34 aa, Homo sapiens
MKRRKYGFIYKTHLFGRPTVRVMGADNVRRILLG

SEQ ID NO: 745118 - protein, 230 aa, Homo sapiens
SGGERQTYIKLGMARVATFLDIYEDGILDIVVLSKGYTKNDFAIHTLKNNFEADAYFVKVIVLSGLCSNDCPRKITPFGVNQPGPYIMYTTVDANGYLKNGSAGQLSQSAHLALQLPYNVLGLGRSANFLDHLYVGIPRPSGEKSIRKQEWTAIIPNSQLIVIPYPHNVPRSWSAKLYLTPSNIVLLTAIALIGVCVFILAIIGILHWQEKKADDREKRQEAHRFHFDAM

SEQ ID NO: 745119 - protein, 136 aa, Homo sapiens
LLNSNLASDNIHLELLSFNFLRPLFVSYHIISSVPCSQDFFCLECLPSLLSRLSFLNSIQVLPAPGSQLSFWSSGWPCLSKVLWVSLSLLMEPAHGMPPQAAWKTLHRYGESLTQAEGQSSTRLLIFRDGRPRREF

SEQ ID NO: 745120 - protein, 121 aa, Homo sapiens
ESIWNNRWLRTISIILYLNKQDMLAEKVLAGKSKIEDYFPEYANYTVPEDATPDAGEDPKVTRAKFFIRDLFLRISTATGDGKHYCYPHFTCAVDTENIRRVFNDCRDIIQRMHLKQYELL

SEQ ID NO: 745121 - protein, 107 aa, Homo sapiens
MSHFFNPEMFLFMWERGGGGESPSWSSPNLFLSSEGHFSHRQRDSRAALERAVRPEVSKPQLWQPLESPWTEAHWAEWVECPCQSRTDGWFLPWGWASAPCFLCPPS

SEQ ID NO: 745122 - protein, 74 aa, Homo sapiens
LVLMEAILEGGGSYNDSGNYNNQSSNFEPMMKGNFGGRSSGSYGGGSQYFPKPQNRGGYGSSSSSSSYSSGRRF

SEQ ID NO: 745123 - protein, 577 aa, Homo sapiens
HEGEEGCVCFPFCDDSKFSEASPAMLNSIGCDDYLGSDKVVDKCGVCGGDNTGCQVVSGVFKHALTSLGYHRVVEIPEGATKINITEMYKSNNYLALRSRSGRSIINGNWAIDRPGKYEGGGTMFTYKRPNEISSTAGESFLAEGPTNEILDVYMIHQQPNPGVHYEYVIMGTNAISPQVPPHRRPGEPFNGQMVTEGRSQEEGEQKGRNEEKEDLRGEAPEMFTSESAQTFPVRHPDRFSPHRPDNLVPPAPQPPRRSRDHNWKQLGTTECSTTCGKGSQYPIFRCVHRSTHEEAPESYCDSSMKPTPEEEPCNIFPCPAFWDIGEWSECSKTCGLGMQHRQVLCRQVYANRSLTVQPYRCQHLEKPETTSTCQLKICSEWQIRTDWTSCSVPCGVGQRTRDVKCVSNIGDVVDDEECNMKLRPNDIENCDMGPCAKSWFLTEWSERCSAECGAGVRTRSVVCMTNHVSSLPLEGCGNNRPAEATPCDNGPCTGKVEWFAGSWSQCSIECGSGTQQREVICVRKNADTFEVLDPSECSFLEKPPSQQSCHLKPCGAKWFSTEWSMSLQRAMLTRPS

SEQ ID NO: 745124 - protein, 661 aa, Homo sapiens
HEGEEGCVCFPFCDDSKFSEASPAMLNSIGCDDYLGSDKVVDKCGVCGGDNTGCQVVSGVFKHALTSLGYHRVVEIPEGATKINITEMYKSNNYLALRSRSGRSIINGNWAIDRPGKYEGGGTMFTYKRPNEISSTAGESFLAEGPTNEILDVYMIHQQPNPGVHYEYVIMGTNAISPQVPPHRRPGEPFNGQMVTEGRSQEEGEQKGRNEEKEDLRGEAPEMFTSESAQTFPVRHPDRFSPHRPDNLVPPAPQPPRRSRDHNWKQLGTTECSTTCGKGSQYPIFRCVHRSTHEEAPESYCDSSMKPTPEEEPCNIFPCPAFWDIGEWSECSKTCGLGMQHRQVLCRQVYANRSLTVQPYRCQHLEKPETTSTCQLKICSEWQIRTDWTSCSVPCGVGQRTRDVKCVSNIGDVVDDEECNMKLRPNDIENCDMGPCAKSWFLTEWSERCSAECGAGVRTRSVVCMTNHVSSLPLEGCGNNRPAEATPCDNGPCTGKVEWFAGSWSQCSIECGSGTQQREVICVRKNADTFEVLDPSECSFLEKPPSQQSCHLKPCGAKWFSTEWSMCSKSCQGGFRVREVRCLSDDMTLSNLCDPQLKPEERESCNPQDCVPEVDENCKDKYYNCNVVVQARLCVYNYYKTACCASCTRVANRQTGFLGSR

SEQ ID NO: 745125 - protein, 374 aa, Homo sapiens
LGPMCRSQRHVPLPKRHVPLPEKKPCNIFSLAQPFWDIGEWSECSKTCGLGMQHRQVLCRQVYANRSLTVQPYRCQHLEKPETTSTCQLKICSEWQIRTDWTSCSVPCGVGQRTRDVKCVSNIGDVVDDEECNMKLRPNDIENCDMGPCAKSWFLTEWSERCSAECGAGVRTRSVVCMTNHVSSLPLEGCGNNRPAEATPCDNGPCTGKVEWFAGSWSQCSIECGSGTQQREVICVRKNADTFEVLDPSECSFLEKPPSQQSCHLKPCGAKWFSTEWSMCSKSCQGGFRVREVRCLSDDMTLSNLCDPQLKPEERESCNPQDCVPEVDENCKDKYYNCNVVVQARLCVYNYYKTACCASCTRVANRQTGFLGSR

SEQ ID NO: 745126 - protein, 583 aa, Homo sapiens
HEGEEGCVCFPFCDDSKFSEASPAMLNSIGCDDYLGSDKVVDKCGVCGGDNTGCQVVSGVFKHALTSLGYHRVVEIPEGATKINITEMYKSNNYLALRSRSGRSIINGNWAIDRPGKYEGGGTMFTYKRPNEISSTAGESFLAEGPTNEILDVYMIHQQPNPGVHYEYVIMGTNAISPQVPPHRRPGEPFNGQMVTEGRSQEEGEQKGRNEEKEDLRGEAPEMFTSESAQTFPVRHPDRFSPHRPDNLVPPAPQPPRRSRDHNWKQLGTTECSTTCGKGSQYPIFRCVHRSTHEEAPESYCDSSMKPTPEEEPCNIFPCPAFWDIGEWSECSKTCGLGMQHRQVLCRQVYANRSLTVQPYRCQHLEKPETTSTCQLKICSEWQIRTDWTSCSVPCGVGQRTRDVKCVSNIGDVVDDEECNMKLRPNDIENCDMGPCAKSWFLTEWSERCSAECGAGVRTRSVVCMTNHVSSLPLEGCGNNRPAEATPCDNGPCTGKVEWFAGSWSQCSIECGSGTQQREVICVRKNADTFEVLDPSECSFLEKPPSQQSCHLKPCGAKWFSTEWSMVSHGALDGGCIGTTSPT

SEQ ID NO: 745127 - protein, 661 aa, Homo sapiens; identical to SEQ ID NO: 745124

SEQ ID NO: 745128 - protein, 721 aa, Homo sapiens
RSYTNRMFSKAVEYPGGTVCIYNQQPFMGLVFMRWEPFAELKGNLKCEYNCQAMGYRFYLLPAETVVCIAPSVDLNEPALCLSGLCQSIGCDDYLGSDKVVDKCGVCGGDNTGCQVVSGVFKHALTSLGYHRVVEIPEGATKINITEMYKSNNYLALRSRSGRSIINGNWAIDRPGKYEGGGTMFTYKRPNEISSTAGESFLAEGPTNEILDVYMIHQQPNPGVHYEYVIMGTNAISPQVPPHRRPGEPFNGQMVTEGRSQEEGEQKGRNEEKEDLRGEAPEMFTSESAQTFPVRHPDRFSPHRPDNLVPPAPQPPRRSRDHNWKQLGTTECSTTCGKGSQYPIFRCVHRSTHEEAPESYCDSSMKPTPEEEPCNIFPCPAFWDIGEWSECSKTCGLGMQHRQVLCRQVYANRSLTVQPYRCQHLEKPETTSTCQLKICSEWQIRTDWTSCSVPCGVGQRTRDVKCVSNIGDVVDDEECNMKLRPNDIENCDMGPCAKSWFLTEWSERCSAECGAGVRTRSVVCMTNHVSSLPLEGCGNNRPAEATPCDNGPCTGKVEWFAGSWSQCSIECGSGTQQREVICVRKNADTFEVLDPSECSFLEKPPSQQSCHLKPCGAKWFSTEWSMCSKSCQGGFRVREVRCLSDDMTLSNLCDPQLKPEERESCNPQDCVPEVDENCKDKYYNCNVVVQARLCVYNYYKTACCASCTRVANRQTGFLGSR

SEQ ID NO: 745129 - protein, 221 aa, Homo sapiens
MCPSPVSQCSAECGAGVRTRSVVCMTNHVSSLPLEGCGNNRPAEATPCDNGPCTGKVEWFAGSWSQCSIECGSGTQQREVICVRKNADTFEVLDPSECSFLEKPPSQQSCHLKPCGAKWFSTEWSMCSKSCQGGFRVREVRCLSDDMTLSNLCDPQLKPEERESCNPQDCVPEVDENCKDKYYNCNVVVQARLCVYNYYKTACCASCTRVANRQTGFLGSR

SEQ ID NO: 745130 - protein, 430 aa, Homo sapiens
MAAVVLPPTAALSSLFPASQREGHTEGGELVNELLKSWLKGLVTFEDVAVEFTQEEWALLDPAQRTLYRDVMLENCRNLASLGNQVDKPRLISQLEQEDKVMTEERGILSGTCPDVENPFKAKGLTPKLHVFRKEQSRNMKMERNHLGATLNECNQCFKVFSTKSSLTRHRKIHTGERPYGCSECGKSYSSRSYLAVHKRIHNGEKPYECNDCGKTFSSRSYLTVHKRIHNGEKPYECSDCGKTFSNSSYLRPHLRIHTGEKPYKCNQCFREFRTQSIFTRHKRVHTGEGHYVCNQCGKAFGTRSSLSSHYSIHTGEYPYECHDCGRTFRRRSNLTQHIRTHTGEKPYTCNECGKSFTNSFSLTIHRRIHNGEKSYECSDCGKSFNVLSSVKKHMRTHTGKKPYECNYCGKSFTSNSYLSVHTRMHNRQM

SEQ ID NO: 745131 - protein, 272 aa, Homo sapiens
MAAVVLPPTAALSSLFPASQREGHTEGGELVNELLKSWLKGLVTFEDVAVEFTQEEWALLDPAQRTLYRDVMLENCRNLASLGNQVDKPRLISQLEQEDKVMTEERGILSGTCPDVENPFKAKGLTPKLHVFRKEQSRNMKMERNHLGATLNECNQCFKVFSTKSSLTRHRKIHTGERPYGCSECGKSYSSRSYLAVHKRIHNGEKPYECNDCGKTFSSRSYLTVHKRIHNGEKPYECSDCGKTFSNSSYLRPHLRIHTGYICTVFLQCEFS

SEQ ID NO: 745132 - protein, 354 aa, Homo sapiens
MAAVVLPPTAALSSLFPASQREGHTEGGELVNELLKSWLKGLVTFEDVAVEFTQEEWALLDPAQRTLYRDVMLENCRNLASLGNQVDKPRLISQLEQEDKVMTEERGILSGTCPDVENPFKAKGLTPKLHVFRKEQSRNMKMERNHLGATLNECNQCFKVFSTKSSLTRHRKIHTGERPYGCSECGKSYSSRSYLAVHKRIHNGEKPYECNDCGKTFSSRSYLTVHKRIHNGEKPYECSDCGKTFSNSSYLRPHLRIHTGEKPYKCNQCFREFRTQSIFTRHKRVHTGEGHYVCNQCGKAFGTRSSLSSHYSIHTGEYPYECHDCGRTFRRRSNLTQHIRTHTGEKPYTCNECG

SEQ ID NO: 745133 - protein, 423 aa, Homo sapiens
MAAVVLPPTAASQREGHTEGGELVNELLKSWLKGLVTFEDVAVEFTQEEWALLDPAQRTLYRDVMLENCRNLASLGNQVDKPRLISQLEQEDKVMTEERGILSGTCPDVENPFKAKGLTPKLHVFRKEQSRNMKMERNHLGATLNECNQCFKVFSTKSSLTRHRKIHTGERPYGCSECGKSYSSRSYLAVHKRIHNGEKPYECNDCGKTFSSRSYLTVHKRIHNGEKPYECSDCGKTFSNSSYLRPHLRIHTGEKPYKCNQCFREFRTQSIFTRHKRVHTGEGHYVCNQCGKAFGTRSSLSSHYSIHTGEYPYECHDCGRTFRRRSNLTQHIRTHTGEKPYTCNECGKSFTNSFSLTIHRRIHNGEKSYECSDCGKSFNVLSSVKKHMRTHTGKKPYECNYCGKSFTSNSYLSVHTRMHNRQM

SEQ ID NO: 745134 - protein, 149 aa, Homo sapiens [sequence omitted]

SEQ ID NO: 745135 - protein, 149 aa, Homo sapiens [sequence omitted]

SEQ ID NO: 745136 - protein, 114 aa, Homo sapiens [sequence omitted]

SEQ ID NO: 745137 - protein, 232 aa, Homo sapiens
ERFNKLVVRMTKSLAELQRALAGEVGMSNELDDVARSLFIGHIPNIWRRLAPDTLKSLGNWMVYFLRRFSQYMLWVTESEPSVMWLSGLHIPESYLTALVQATCRKNGWPLDRSTLFTQVTKFQDADEVNERAGQGCFVSGLYLEGADWDIEKGCLIKSKPKVLVVDLPILKIIPIEAHRLKLQNTFRTPVYTTSMRRNAMGVGLVFEADLFTTRHISHWVLQGVCLTLNSD

SEQ ID NO: 745138 - protein, 84 aa, Homo sapiens
ERFNKLVVRMTKSLAELQRALAGEVGMSNELDDVARSLFIGHIPNIWRRLAPDTLKSLGNWMVYFLRRFSQYMLWLLLDGSWKG

SEQ ID NO: 745139 - protein, 145 aa, Homo sapiens
MSAARTGYISLNGARKRSPDRLDAAPYIGKRPSQERSGLQPSLAGWLDSESAACPGPVTRERTPRGASPGPGVPSLAGGEAPQSPLLRLPCDARSPRLGARGEREGGVCLRRGPEACARPCALSAARSYLSTPAATLRAPGARVK

SEQ ID NO: 745140 - protein, 218 aa, Homo sapiens
MSAARTGYISLNGARKRSPDRLDAAPYIGKRPSQERSGLQPSLAGWLDSESAACPGPVTRERTPRGASPGPGVPSLAGGEAPQSPLLRLPCDARSPRLGARGEREGGVCLRRGPEACARPCALSAARSYLSTPAATLRAPGARVTRPPAPARGDPPPWKPRAHSAFLASRRQGGAQVWEGAEAEAVPFSAGSVGGRGPHPSREPVPPGPCASVRGRVK

SEQ ID NO: 745141 - protein, 178 aa, Homo sapiens
MSAARTGYISLNGARKRSPDRLDAAPYIGKRPSQERSGLQPSLAGWLDSESAACPGPVTRERTPRGASPGPGVPSLAGGEAPQSPLLRLPCDARSPRLGARGEREGGVCLRRGPEACARPCALSAARSYLSTPAATLRAPGARVTRPPAPARGDPPPWKPRAHSAFLASRRQGGAQVK

SEQ ID NO: 745142 - protein, 117 aa, Homo sapiens
MAYGVPRKNTVKTILRGSCYNVQEPWDIALLAKTWYTNLANIKLPFLEEISFGGSVQLTKCTTIKDGLLPSAESIKLEREYEVKRLCKLKCQENTSKEIQLLLRERPAGLRRPLPSK

SEQ ID NO: 745143 - protein, 110 aa, Homo sapiens
MEREAKDFWLGPGLFGDAFNKWKKIGHRKCRLNGTLRQEQVLLPLPQQQPSPQEGARMGGQEYSGSVGELKSWGTSQAPHTLEIQEAQLGDSARSRRVPMPVHWDLVPCN

SEQ ID NO: 745144 - protein, 94 aa, Homo sapiens
DSRLSNLQRQLALEVIVTLSETATPMLKKHTNIIAQAVPHILAMMVDLQDDEDWVNADEMEEDDFDSNAVAAESALDRLACGLGGKVVLPMTKE

SEQ ID NO: 745145 - protein, 63 aa, Homo sapiens
MRPWALAVTRWPPSRRASAPAGGSPRMLHPATQQSPFMVDLHEQVHQGPVPLSYTVTTVTTQG

SEQ ID NO: 745146 - protein, 74 aa, Homo sapiens
HEQRARGPAPGGQPYPAAASGSTLPGRMRQEPAAASFFSFSSPSCGSGAPGPGRAAALLRAPRAPQPPPDALLG

SEQ ID NO: 745147 - protein, 684 aa, Homo sapiens
MFAEAAKTTRPCGMAEFKEKPEAPTEQLDVACGQENLPVGAWPPGAAPAPFQYTPDHVVGPGADIDPTQITFPGCICVKTPCLPGTCSCLRHGENYDDNSCLRDIGSGGKYAEPVFECNVLCRCSDHCRNRVVQKGLQFHFQVFKTHKKGWGLRTLEFIPKGRFVCEYAGEVLGFSEVQRRIHLQTKSDSNYIIAIREHVYNGQVMETFVDPTYIGNIGRFLNHSCEPNLLMIPVRIDSMVPKLALFAAKDIVPEEELSYDYSGRYLNLTVSEDKERLDHGKLRKPCYCGAKSCTAFLPFDSSLYCPVEKSNISCGNEKEPSMCGSAPSVFPSCKRLTLETMKMMLDKKQIRAIFLFEFKMGRKAAETTRNINNAFGPGTANERTVQWWFKKFCKGDESLEDEERSGRPSEVDNDQLRAIIEADPLTTTREVAEELNVNHSTVVRHLKQIGKVKKLDKWVPHELTENQKNRRFEVSSSLILRNHNEPFLDRIVTCDEKWILYDNRRRSAQWLDQEEAPKHFPKPILHPKKVMVTIWWSAAGLIHYSFLNPGETITSEKYAQEIDEMNQKLQRLQLALVNRKGPILLHDNARPHVAQPTLQKLNELGYEVLPHPPYSPDLLPTNYHVFKHLNNFLQGKRFHNQQDAENAFQEFVESQSTDFYATGINQLISRWQKCVDCNGSYFD

SEQ ID NO: 745148 - protein, 345 aa, Homo sapiens
MFAEAAKTTRPCGMAEFKEKPEAPTEQLDVACGQENLPVGAWPPGAAPAPFQYTPDHVVGPGADIDPTQITFPGCICVKTPCLPGTCSCLRHGENYDDNSCLRDIGSGGKYAEPVFECNVLCRCSDHCRNRVVQKGLQFHFQVFKTHKKGWGLRTLEFIPKGRFVCEYAGEVLGFSEVQRRIHLQTKSDSNYIIAIREHVYNGQVMETFVDPTYIGNIGRFLNHSCEPNLLMIPVRIDSMVPKLALFAAKDIVPEEELSYDYSGRYLNLTVSEDKERLDHGKLRKPCYCGAKSCTAFLPFDSSLYCPVEKSNISCGNEKEPSMCGSAPSVFPSCKRLTLEGESVQ

SEQ ID NO: 745149 - protein, 359 aa, Homo sapiens
MCGSAPSVFPSCKRLTLETMKMMLDKKQIRAIFLFEFKMGRKAAETTRNINNAFGPGTANERTVQWWFKKFCKGDESLEDEERSGRPSEVDNDQLRAIIEADPLTTTREVAEELNVNHSTVVRHLKQIGKVKKLDKWVPHELTENQKNRRFEVSSSLILRNHNEPFLDRIVTCDEKWILYDNRRRSAQWLDQEEAPKHFPKPILHPKKVMVTIWWSAAGLIHYSFLNPGETITSEKYAQEIDEMNQKLQRLQLALVNRKGPILLHDNARPHVAQPTLQKLNELGYEVLPHPPYSPDLLPTNYHVFKHLNNFLQGKRFHNQQDAENAFQEFVESQSTDFYATGINQLISRWQKCVDCNGS

SEQ ID NO: 745150 - protein, 327 aa, Homo sapiens
MAEGKKDQNSGTSSRTNAFGPGTANERTVQWWFKKFCKGDESLEDEERSGRPSEVDNDQLRAIIEADPLTTTREVAEELNVNHSTVVRHLKQIGKVKKLDKWVPHELTENQKNRRFEVSSSLILRNHNEPFLDRIVTCDEKWILYDNRRRSAQWLDQEEAPKHFPKPILHPKKVMVTIWWSAAGLIHYSFLNPGETITSEKYAQEIDEMNQKLQRLQLALVNRKGPILLHDNARPHVAQPTLQKLNELGYEVLPHPPYSPDLLPTNYHVFKHLNNFLQGKRFHNQQDAENAFQEFVESQSTDFYATGINQLISRWQKCVDCNGSYFD

SEQ ID NO: 745151 - protein, 470 aa, Homo sapiens
PPSRDLLSSLTAHPLVRGNRCACPGLGLFLLTHGITLARVLSFSVHSLKRRTGGLVRTWLFVQSCPQNSRRHHGGSHLPPWSQVSLTGSLYCPVEKSNISCGNEKEPSMCGSAPSVFPSCKRLTLETMKMMLDKKQIRAIFLFEFKMGRKAAETTRNINNAFGPGTANERTVQWWFKKFCKGDESLEDEERSGRPSEVDNDQLRAIIEADPLTTTREVAEELNVNHSTVVRHLKQIGKVKKLDKWVPHELTENQKNRRFEVSSSLILRNHNEPFLDRIVTCDEKWILYDNRRRSAQWLDQEEAPKHFPKPILHPKKVMVTIWWSAAGLIHYSFLNPGETITSEKYAQEIDEMNQKLQRLQLALVNRKGPILLHDNARPHVAQPTLQKLNELGYEVLPHPPYSPDLLPTNYHVFKHLNNFLQGKRFHNQQDAENAFQEFVESQSTDFYATGINQLISRWQKCVDCNGSYFD

SEQ ID NO: 745152 - protein, 676 aa, Homo sapiens
MFAEAAKTTRPCGMAEFKEKPEAPTEQLDVACGQENLPVGAWPPGAAPAPFQYTPDHVVGPGADIDPTQITFPGCICVKTPCLPGTCSCLRHGENYDDNSCLRDIGSGGKYAEPVFECNVLCRCSDHCRNRVVQKGLQFHFQVFKTHKKGWGLRTLEFIPKGRFVCEYAGEVLGFSEVQRRIHLQTKSDSNYIIAIREHVYNGQVMETFVDPTYIGNIGRFLNHSCEPNLLMIPVRIDSMVPKLALFAAKDIVPEEELSYDYSGRYLNLTVSEDKERLDHGKLRKPCYCGAKSCTAFLPFDSSLYCPVEKSNISCGNEKEPSMCGSAPSVFPSCKRLTLETMKMMLDKKQIRAIFLFEFKMGRKAAETTRNINNAFGPGTANERTVQWWFKKFCKGDESLEDEERSGRPSEVDNDQLRAIIEADPLTTTREVAEELNVNHSTVVRHLKQIGKVKKLDKWVPHELTENQKNRRFEVSSSLILRNHNEPFLDRIVTCDEKWILYDNRRRSAQWLDQEEAPKHFPKPILHPKKVMVTIWWSAAGLIHYSFLNPGETITSEKYAQEIDEMNQKLQRLQLALVNRKGPILLHDNARPHVAQPTLQKLNELGYEVLPHPPYSPDLLPTNYHVFKHLNNFLQGKRFHNQQDAENAFQEFVESQSTDFYSYRNKPTYFSLAKMC

SEQ ID NO: 745153 - protein, 140 aa, Homo sapiens
METFVDPTYIGNIGRFLNHSCEPNLLMIPVRIDSMVPKLALFAAKDIVPEEELSYDYSGRYLNLTVSEDKERLDHGKLRKPCYCGAKSCTAFLPFDSSLYCPVEKSNISCGNEKEPSMCGSAPSVFPSCKRLTLEGESVQ

SEQ ID NO: 745154 - protein, 396 aa, Homo sapiens
MFAEAAKTTRPCGMAEFKEKPEAPTEQLDVACGQENLPVGAWPPGAAPAPFQTMKMMLDKKQIRAIFLFEFKMGRKAAETTRNINNAFGPGTANERTVQWWFKKFCKGDESLEDEERSGRPSEVDNDQLRAIIEADPLTTTREVAEELNVNHSTVVRHLKQIGKVKKLDKWVPHELTENQKNRRFEVSSSLILRNHNEPFLDRIVTCDEKWILYDNRRRSAQWLDQEEAPKHFPKPILHPKKVMVTIWWSAAGLIHYSFLNPGETITSEKYAQEIDEMNQKLQRLQLALVNRKGPILLHDNARPHVAQPTLQKLNELGYEVLPHPPYSPDLLPTNYHVFKHLNNFLQGKRFHNQQDAENAFQEFVESQSTDFYATGINQLISRWQKCVDCNGSYFD

SEQ ID NO: 745155 - protein, 109 aa, Homo sapiens
KNTKIRSLQIEGGILVKKKEIRDATLLFWHRKHMIKHAQMSWNRYSYLVRVNKNNQGPRVCMLPGGGERGISQNLKTNWKNNQDSQVKQPQGPKQSRSLMCLEMTLCYS

SEQ ID NO: 745156 - protein, 113 aa, Homo sapiens
MSHLVPAKWNLCDWFHTMVPSLMLLLIPEAQPFFSSCSFRKPSLTPPVSSGCPSSCSVKLFFFETESRSVAQAGVQWRDLGSLPSLPPGFKRFSCLSLQVAGTTGAHHATTPS

SEQ ID NO: 745157 - protein, 72 aa, Homo sapiens
FATSPLTFGATDKSRCAGPASLIQGLQCFEAQSLLAFVMKIPVKMSGRGPKGRIGSAMVGWNKKMLAHPQIS

SEQ ID NO: 745158 - protein, 72 aa, Homo sapiens; identical to SEQ ID NO: 745157

SEQ ID NO: 745159 - protein, 679 aa, Homo sapiens
GGAAPRMPRSPGTRLKPAKYIPVATAAALLVGSSTLFFVFTCPWLTRAVSPAVPVYNGIIFLFVLANFSMATFMDPGVFPRADEDEDKEDDFRAPLYKNVDVRGIQVRMKWCATCHFYRPPRCSHCSVCDNCVEVTGKFRGGVNPFTRGCCGNVEHVLCSPLAPRYVVEPPRLPLAVSLKPPFLRPELLDRAAPLKVKLSDNGLKAGLGRSKSKGSLDRLDEKPLDLGPPLPPKIEAGTFSSDLQTPRPGSAESALSVQRTSPPTPAMYKFRPAFPTGPKVPFCGPGEQVPGPDSLTLGDDSIRSLDFVSEPSLDLPDYGPGGLHAAYPPSPPLSASDAFSGALRSLSLKASSRRGGDHVALQPLRSEGGPPTPHRSIFAPHALPNRNGSLSYDSLLNPGSPGGHACPAHPAVGVAGYHSPYLHPGATGDPPRPLPRSFSPVLGPRPREPSPVRYDNLSRTIMASIQERKDREERERLLRSQADSLFGDSGVYDAPSSYSLQQASVLSEGPRGPALRYGSRDDLVAGPGFGGARNPALQTSLSSLSSSVSRAPRTSSSSLQADQASSNAPGPRPSSGSHRSPARQGLPSPPGTPHSPSYAGPKAVAFIHTDLPEPPPSLTVQRDHPQLKTPPSKLNGQSPGLARLGPATGPPGPSASPTRHTLVKKVSGVGGTTYEISV

SEQ ID NO: 745160 - protein, 771 aa, Homo sapiens
GGAAPRMPRSPGTRLKPAKYIPVATAAALLVGSSTLFFVFTCPWLTRAVSPAVPVYNGIIFLFVLANFSMATFMDPGVFPRADEDEDKEDDFRAPLYKNVDVRGIQVRMKWCATCHFYRPPRCSHCSVCDNCVEDFDHHCPWVNNCIGRRNYRYFFLFLLSLSAHMVGVVAFGLVYVLNHAEGLGAAHTTITMAVMCVAGLFFIPVIGLTGFHVVLVTRGRTTNEQVTGKFRGGVNPFTRGCCGNVEHVLCSPLAPRYVVEPPRLPLAVSLKPPFLRPELLDRAAPLKVKLSDNGLKAGLGRSKSKGSLDRLDEKPLDLGPPLPPKIEAGTFSSDLQTPRPGSAESALSVQRTSPPTPAMYKFRPAFPTGPKVPFCGPGEQVPGPDSLTLGDDSIRSLDFVSEPSLDLPDYGPGGLHAAYPPSPPLSASDAFSGALRSLSLKASSRRGGDHVALQPLRSEGGPPTPHRSIFAPHALPNRNGSLSYDSLLNPGSPGGHACPAHPAVGVAGYHSPYLHPGATGDPPRPLPRSFSPVLGPRPREPSPVRYDNLSRTIMASIQERKDREERERLLRSQADSLFGDSGVYDAPSSYSLQQASVLSEGPRGPALRYGSRDDLVAGPGFGGARNPALQTSLSSLSSSVSRAPRTSSSSLQADQASSNAPGPRPSSGSHRSPARQGLPSPPGTPHSPSYAGPKAVAFIHTDLPEPPPSLTVQRDHPQLKTPPSKLNGQSPGLARLGPATGPPGPSASPTRHTLVKKVSGVGGTTYEISV

SEQ ID NO: 745161 - protein, 717 aa, Homo sapiens
GGAAPRMPRSPGTRLKPAKYIPVATAAALLVGSSTLFFVFTCPWLTRAVSPAVPVYNGIIFLFVLANFSMATFMDPGVFPRADEDEDKEDDFRAPLYKNVDVRGIQVRMKWCATCHFYRPPRCSHCSVCDNCVEDFDHHCPWVNNCIGRRNYRYFFLFLLSLSAHMVGVVAFGLVYVLNHAEGLGAAHTTITMAVMCVAGLFFIPVIGLTGFHVVLVTRGRTTNEQVTGKFRGGVNPFTRGCCGNVEHVLCSPLAPRYVVEPPRLPLAVSLKPPFLRPELLDRAAPLKVKLSDNGLKAGLGRSKSKGSLDRLDEKPLDLGPPLPPKIEAGTFSSDLQTPRPGSAESALSVQRTSPPTPAMYKFRPAFPTGPKVPFCGPGEQVPGPDSLTLGDDSIRSLDFVSEPSLDLPDYGPGGLHAAYPPSPPLSASDAFSGALRSLSLKASSRRGGDHVALQPLRSEGGPPTPHRSIFAPHALPNRNGSLSYDSLLNPGSPGGHACPAHPAVGVAGYHSPYLHPGATGDPPRPLPRSFSPVLGPRPREPSPVRYDNLSRTIMASIQERKDREERERLLRSQADSLFGDSGVYDAPSSYSLQQASVLSEGPRGPALRYGSRDDLVAGPGFGGARNPALQTSLSSLSSSVSRAPRTSSSSLQADQASSNAPGPRPSSGSHRSPARQGLPSPPGTPHSPPGPSASPTRHTLVKKVSGVGGTTYEISV

SEQ ID NO: 745162 - protein, 463 aa, Homo sapiens
GGAAPRMPRSPGTRLKPAKYIPVATAAALLVGSSTLFFVFTCPWLTRAVSPAVPVYNGIIFLFVLANFSMATFMDPGVFPRADEDEDKEDDFRAPLYKNVDVRGIQVRMKWCATCHFYRPPRCSHCSVCDNCVEDFDHHCPWVNNCIGRRNYRYFFLFLLSLSAHMVGVVAFGLVYVLNHAEGLGAAHTTITMAVMCVAGLFFIPVIGLTGFHVVLVTRGRTTNEQVTGKFRGGVNPFTRGCCGNVEHVLCSPLAPRYVVEPPRLPLAVSLKPPFLRPELLDRAAPLKVKLSDNGLKAGLGRSKSKGSLDRLDEKPLDLGPPLPPKIEAGTFSSDLQTPRPGSAESALSVQRTSPPTPAMYKFRPAFPTGPKVPFCGPGEQVQACILTWGTTDRSLDCVELGWTPDMAGLMSYRIHVRLCSRVARLANRGIGLPLQGPPIALSGFYVRWPPRGTRGGQPNQAR

SEQ ID NO: 745163 - protein, 705 aa, Homo sapiens
GGAAPRMPRSPGTRLKPAKYIPVATAAALLVGSSTLFFVFTCPWLTRAVSPAVPVYNGIIFLFVLANFSMATFMDPGVFPRADEDEDKEDDFRAPLYKNVDVRGIQVRMKWCATCHFYRPPRCSHCSVCDNCVEDFDHHCPWVNNCIGRRNYRYFFLFLLSLSAHMVGVVAFGLVYVLNHAEGLGAAHTTITMAVMCVAGLFFIPVIGLTGFHVVLVTRGRTTNEQVTGKFRGGVNPFTRGCCGNVEHVLCSPLAPRYVVEPPRLPLAVSLKPPFLRPELLDRAAPLKVKLSDNGLKAGLGRSKSKGSLDRLDEKPLDLGPPLPPKIEAGTFSSDLQTPRPGSAESALSVQRTSPPTPAMYKFRPAFPTGPKVPFCGPGEQVPGPDSLTLGDDSIRSLDFVSEPSLDLPDYGPGGLHAAYPPSPPLSASDAFSGALRSLSLKASSRRGGDHVALQPLRSEGGPPTPHRSFLPPMHCPTATAACPMTACSILARLVATPALPTQQLAWPDTTHPTCILGQRATRHGPYPAASAPCWGPRGPALRYGSRDDLVAGPGFGGARNPALQTSLSSLSSSVSRAPRTSSSSLQADQASSNAPGPRPSSGSHRSPARQGLPSPPGTPHSPSYAGPKAVAFIHTDLPEPPPSLTVQRDHPQLKTPPSKLNGQSPGLARLGPATGPPGPSASPTRHTLVKKVSGVGGTTYEISV

SEQ ID NO: 745164 - protein, 115 aa, Homo sapiens
MCPVSVCCAAAPCLMCQCSGRRCPFHQSLNLCFMLLWEATGGQAGAGTGVMLPQGAGDTQSPLPSPQALPAKLENPTPRHATSAAPAWLRCSRRGKAHWGGVSASLGVRDLRVST

SEQ ID NO: 745165 - protein, 139 aa, Homo sapiens
MHPLLTIGGRECHASTACPKRSACPSTHLPMGKSAHWDKGHWAGLCLGLSHGWGSEGAQSASLGHPLSARLGPLPSPSTPDHRQASPQWSPYGQVPEMDRGTQGPHRPSDTACGLPDRVSPARLLLTNALPFTDPAGSL

SEQ ID NO: 745166 - protein, 353 aa, Homo sapiens
MLCRLCWLVSYSLAVLLLGCLLFLRKAAKPAGDPTAHQPFWAPPTPRHSRCPPNHTVSSASLSLPSRHRLFLTYRHCRNFSILLEPSGCSKDTFLLLAIKSQPGHVERRAAIRSTWGRVGGWARGRQLKLVFLLGVAGSAPPAQLLAYESREFDDILQWDFTEDFFNLTLKELHLQRWVVAACPQAHFMLKGDDDVFVHVPNVLEFLDGWDPAQDLLVGDVIRQALPNRNTKVKYFIPPSMYRATHYPPYAGGGGYVMSRATVRRLQAIMEDAELFPIDDVFVGMCLRRLGLSPMHHAGFKTFGIRRPLDPLDPCLYRGLLLVHRLSPLEMWTMWALVTDEGLKCAAGPIPQR

SEQ ID NO: 745167 - protein, 132 aa, Homo sapiens
CLKNKNLKKKENNFQSSFEAPCFIAAPLTSFSQIHYHPQASDSFSTNSRVPTMCLVTYEGQRMMNFAEHHRPRDRAPRTDRMVVTSHAPFPLWHLISIPQMRQVLLYHFPAYLILFLSLSLGQSHLAPLQIK

SEQ ID NO: 745168 - protein, 529 aa, Homo sapiens
MQGLFYRPQGSSKERRTSSKERRAPSKDRMIFAATFCAPKAVSAARAHLPAAWKNLPATPETFAPSSSVFPATSQFQPASLNAFKGPSAASETPKSLPYALQDPFACVEALPAVPWVPQPNMNASKASQAVPTFLMATAAAPQATATTQEASKTSVEPPRRSGKATRKKKHLEAQEDSRGHTLAFHDWQGPRPWENLNLSDWEVQSPIQVSGDWEHPNTPRGLSGWEGPSTSRILSGWEGPSASWALSAWEGPSTSRALGLSESPGSSLPVVVSEVASVSPGSSATQDNSKVEAQPLSPLDERANALVQFLLVKDQAKVPVQRSEMVKVILREYKDECLDIINRANNKLECAFGYQLKEIDTKNHAYIIINKLGYHTGNLVASYLDRPKFGLLMVVLSLIFMKGNCVREDLIFNFLFKLGLDVRETNGLFGNTKKLITEVFVRQKYLEYRRIPYTEPAEYEFLWGPRAFLETSKMLVLRFLAKLHKKDPQSWPFHYLEALAECEWEDTDEDEPDTGDSAHGPTSRPPPR

SEQ ID NO: 745169 - protein, 525 aa, Homo sapiens
MQGLFYRPQGSSKERRTSSKERRAPSKDRMIFAATFCAPKAVSAARAHLPAAWKNLPATPETFAPSSSVFPATSQFQPASLNAFKGPSAASETPKSLPYALQDPFACVEALPAVPWVPQPNMNASKASQAVPTFLMATAAAPQATATTQEASKTSVEPPRRSGKATRKKKHLEAQEDSRGHTLAFHDWQGPRPWENLNLSDWEVQSPIQVSGDWEHPNTPRGLSGWEGPSTSRILSGWEGPSASWALSAWEGPSTSRALGLSESPGSSLPVVVSEVASVSPGSSATQDNSKVEAQPLSPLDERANALVQFLLVKDQAKVPVQRSEMVKVILREYKDECLDIINRANNKLECAFGYQLKEIDTKNHAYIIINKLGYHTGNLVASYLDRPKFGLLMVVLSLIFMKGNCVREDLIFNFLFKLGLDVRETNGLFGNTKKLITEVFVRQKYLEYRRIPYTEPAEYEFLWGPRAFLETSKMLVLRFLAKLHKKDPQSWPFHYLEALAECEWEDTDEISDTLICRGHQRPLR

SEQ ID NO: 745170 - protein, 293 aa, Homo sapiens
QRRVAELDVVVGPPGDAGAVERHLDVGPAGLALVPKREGVVEEAVGDGAAGRDGQAGRAALVGGALVDRVAQRAGESAQLRVVAGHAVAPVVLVEVGQLVVEVHWALEELGQREVPGARAGGRQRPALASRGAHRAVAGARVACIVVLQLLDAVGGVVEAQAQADEGQARAEEERQRDAGRQQRLPGGEALLSEGGVVGLVGAPGRGAPGHGGRAGTDARADRVGAPPRGASLSAPRKPGDCSRVGFPASSGGFLPGPLLCLRHSGESLWVCSNLNSCLLRRKNLTKGHKAER

SEQ ID NO: 745171 - protein, 265 aa, Homo sapiens
QRRVAELDVVVGPPGDAGAVERHLDVGPAGLALVPKREGVVEEAVGDGAAGRDGQAGRAALVGGALVDRVAQRAGESAQLRVVAGHAVAPVVLVEVGQLVVEVHWALEELGQREVPGARAGGRQRPALASRGAHRAVAGARVACIVVLQLLDAVGGVVEAQAQADEGQARAEEERQRDAGRQQRLPGGEALLSEGGVVGLVGAPGRGAPGHGGRAGTDARADRVGAPPRGASLSAPRKPGDCSRVGFPASSGGFLPGPLLCLRHR

SEQ ID NO: 745172 - protein, 331 aa, Homo sapiens
MIELGFGRQNFHPLKRKSSLLLKLIAVVFAVLLFCEFLIYYLAIFQCNWPEVKTTASDGEQTTREPVLKAMFLADTHLLGEFLGHWLDKLRREWQMERAFQTALWLLQPEVVFILGDIFDEGKWSTPEAWADDVERFQKMFRHPSHVQLKVVAGNHDIGFHYEMNTYKVERFEKVFSSERLFSWKGINFVMVNSVALNGDGCGICSETEAELIEVSHRLNCSRELLWWLQPRLVLSGHTHSACEVHHGGRVPELSVPSFSWRNRNNPSFIMGSITPTDYTLSKCYLPREDVVLIIYCGVVGFLVVLTLTHFGLLASPFLSGLNLLGKRKTR

SEQ ID NO: 745173 - protein, 254 aa, Homo sapiens
MIELGFGRQNFHPLKRKSSLLLKLIAVVFAVLLFCEFLIYYLAIFQCNWPEVKTTASDGEQTTREPVLKAMFLADTHLLGEFLGHWLDKLRREWQMERAFQTALWLLQPEVVFILGDIFDEGKWSTPEAWADDVERFQKMFRHPSHVQLKVVAGNHDIGFHYEMNTYKVERFEKVFSSERLFSWKGINFVMVNSVALNGDGCGICSETEAELIEVSHRLNCSREVGEHLNATGAFCPVLLRFGCSLSPLALLAL

SEQ ID NO: 745174 - protein, 254 aa, Homo sapiens; identical to SEQ ID NO: 745173

SEQ ID NO: 745175 - protein, 254 aa, Homo sapiens; identical to SEQ ID NO: 745173

SEQ ID NO: 745176 - protein, 254 aa, Homo sapiens; identical to SEQ ID NO: 745173

SEQ ID NO: 745177 - protein, 394 aa, Homo sapiens [sequence omitted]

SEQ ID NO: 745178 - protein, 338 aa, Homo sapiens [sequence omitted]

SEQ ID NO: 745179 - protein, 175 aa, Homo sapiens
MFRHPSHVQLKVVAGNHDIGFHYEMNTYKVERFEKVFSSERLFSWKGINFVMVNSVALNGDGCGICSETEAELIEVSHRLNCSREHYPLYRRSDANCSGEDAAPAEERDIPFKENYDVLSREASQKLLWWLQPRLVLSGHTHSACEVHHGGRVPELSVPSFSWRNRNNPSFIMVT

SEQ ID NO: 745180 - protein, 254 aa, Homo sapiens; identical to SEQ ID NO: 745173

SEQ ID NO: 745181 - protein, 254 aa, Homo sapiens; identical to SEQ ID NO: 745173

SEQ ID NO: 745182 - protein, 254 aa, Homo sapiens; identical to SEQ ID NO: 745173

SEQ ID NO: 745183 - protein, 254 aa, Homo sapiens; identical to SEQ ID NO: 745173

SEQ ID NO: 745184 - protein, 172 aa, Homo sapiens
MPYFFLLASREWQMERAFQTALWLLQPEVVFILGDIFDEGKWSTPEAWADDVERFQKMFRHPSHVQLKVVAGNHDIGFHYEMNTYKVERFEKVFSSERLFSWKGINFVMVNSVALNGDGCGICSETEAELIEVSHRLNCSREVGEHLNATGAFCPVLLRFGCSLSPLALLAL

SEQ ID NO: 745185 - protein, 103 aa, Homo sapiens
MIELGFGRQNFHPLKRKSSLLLKLIAVVFAVLLFCEFLIYYLAIFQCNWPEVKTTASDGEQTTREPVLKAMFLADTHLLGEFLGHWLDKLRRDGVLLCCPCWF

SEQ ID NO: 745186 - protein, 220 aa, Homo sapiens
SDVVKGVYKEKDNEELTISCPVPADEQTECTSAQQLNMSTSSPCAAELTALSTTQQEKDLIEDSSVQKDGLNQTTIPVSPPSTTKPSRASTASPCNNNINAATAVALQEPRKLSYAEVCQKPPKEPSSVLVQPLRELRSNVVSPTKNEDNGAPENSVEKPHEKPEARASKDYSGFRGNIIPRGAAGKIREQRRQFSHRAIPQGVTRRNGKEQYVPPRSPK

SEQ ID NO: 745187 - protein, 220 aa, Homo sapiens; identical to SEQ ID NO: 745186

SEQ ID NO: 745188 - protein, 112 aa, Homo sapiens
EKSFYFKDNEELTISCPVPADEQTECTSAQQLNMSTSSPCAAELTALSTTQQEKDLIEDSSVQKDGLNQTTIPVSPPSTTKPSRASTASPCNNNINAATAVALQAFRSLPSL

SEQ ID NO: 745189 - protein, 220 aa, Homo sapiens; identical to SEQ ID NO: 745186

SEQ ID NO: 745190 - protein, 545 aa, Homo sapiens [sequence omitted]

SEQ ID NO: 745191 - protein, 545 aa, Homo sapiens [sequence omitted]

SEQ ID NO: 745192 - protein, 545 aa, Homo sapiens [sequence omitted]

SEQ ID NO: 745193 - protein, 545 aa, Homo sapiens [sequence omitted]

SEQ ID NO: 745194 - protein, 66 aa, Homo sapiens
MRLISNREVYLLLNLATQVAVPNCALIMTKEENNNVVLGEMGEQAHDINMASSSNTSKGCEETKVH

SEQ ID NO: 745195 - protein, 299 aa, Homo sapiens
MFSLPLSLPLCEDTAFLPSKCCSSHKTIKQARTLIMIFLASGTHFQTMLKSKLNVLTLKKEPLPAVIFHEPEAIELCTTTPLMKTRTHSGCKHFQTMLKSKLNVLTLKKEPLPAVIFHEPEAIELCTTTPLMKTRTHSGCKVTYLGKVSTTGMQFLSGCTEKPVIELWKKHTLAREDVFPANALLEIRPFQVWLHHLDHKGEATVHMDTFQVARIAYCTADHNVSPNIFAWVYREINDDLSYQMDCHAVECESKLEAKKLAHAMMEAFRKTFHSMKSDGRIHSNSSSEEVSQELESDDG

SEQ ID NO: 745196 - protein, 217 aa, Homo sapiens
MWQPATERLQHFQTMLKSKLNVLTLKKEPLPAVIFHEPEAIELCTTTPLMKTRTHSGCKVTYLGKVSTTGMQFLSGCTEKPVIELWKKHTLAREDVFPANALLEIRPFQVWLHHLDHKGEATVHMDTFQVARIAYCTADHNVSPNIFAWVYREINDDLSYQMDCHAVECESKLEAKKLAHAMMEAFRKTFHSMKSDGRIHSNSSSEEVSQELESDDG

SEQ ID NO: 745197 - protein, 250 aa, Homo sapiens
MFSLPLSLPLCEDTAFLPSKCCSSHKTIKQARTLIMIFLASGTHFQTMLKSKLNVLTLKKEPLPAVIFHEPEAIELCTTTPLMKTRTHSGCKVTYLGKVSTTGMQFLSGCTEKPVIELWKKHTLAREDVFPANALLEIRPFQVWLHHLDHKGEATVHMDTFQVARIAYCTADHNVSPNIFAWVYREINDDLSYQMDCHAVECESKLEAKKLAHAMMEAFRKTFHSMKSDGRIHSNSSSEEVSQELESDDG

SEQ ID NO: 745198 - protein, 217 aa, Homo sapiens; identical to SEQ ID NO: 745196

SEQ ID NO: 745199 - protein, 78 aa, Homo sapiens
HNVSPNIFAWVYREINDDLSYQMDCHAVECESKLEAKKLAHAMMEAFRKTFHSMKSDGRIHSNSSSEEVSQELESDDG

SEQ ID NO: 745200 - protein, 314 aa, Homo sapiens
TPSWRMLVRGRDQGSGSRLGPIVRRWAPRPSPLQSLAASLDAEPSSAAVPDGFPAGPTVSPRRLARPPGLEEALSALGLQGEREYAGDIFAEVMEYLGLAGDTLYLAVHLLDSYLSAGRVRLHRLQLLGVACLFVACKMEECVLPEETEVRNLGPFQGREERARIQDSFTSPRIPHLQPAFLCLLSADSFSRAELLRAERRILSRLDFRLHHPGPLLCLGLLAALAGSSPQVMLLATYFLELSLLEAEAAGWEPGRRAAAALSLAHRLLDGAGSRLQPELYRCSLGGGSVWGHRSFRDLPSWSFLRSRRMRDNY

SEQ ID NO: 745201 - protein, 189 aa, Homo sapiens
MEYLGLAGDTLYLAVHLLDSYLSAGRVRLHRLQLLGVACLFVACKMEECVLPEPAFLCLLSADSFSRAELLRAERRILSRLDFRLHHPGPLLCLGLLAALAGSSPQVMLLATYFLELSLLEAEAAGWEPGRRAAAALSLAHRLLDGAGSRLQPELYRCSLGGGSVWGHRSFRDLPSWSFLRSRRMRDNY

SEQ ID NO: 745202 - protein, 243 aa, Homo sapiens
ASRAGAQEKGRGTGVESEASLPQPQVCRVLPLRALPRAVTPEMRALVVDWLVQVHEYLGLAGDTLYLAVHLLDSYLSAGRVRLHRLQLLGVACLFVACKMEECVLPEPAFLCLLSADSFSRAELLRAERRILSRLDFRLHHPGPLLCLGLLAALAGSSPQVMLLATYFLELSLLEAEAAGWEPGRRAAAALSLAHRLLDGAGSRLQPELYRCSLGGGSVWGHRSFRDLPSWSFLRSRRMRDNY

SEQ ID NO: 745203 - protein, 211 aa, Homo sapiens
MEYLGLAGDTLYLAVHLLDSYLSAGRVRLHRLQLLGVACLFVACKMEECVLPEPAFLCLLSADSFSRAELLRAERRILSRLDFRLHHPGPLLCLGLLAALAGSSPQVMLLATYFLELSLLEAEAAGWEPGRRAAAALSLAHRLLDGAGSRLQPELYSPEELGTLEPCMARAALRGPAPGRAAVFLKYARPQRQGTSLAAACLLRRLQSEPP

SEQ ID NO: 745204 - protein, 139 aa, Homo sapiens
DNLEIQCPAEPRRGSWAGMRAESSQSPPDTPPRGCPLEAPQTVPTFPGLSLCPQPSAWHEGKPKDGRELHSWVIEDCCQLENEAHSLPRDKPAEARQPSSCVYFGTGTPGARASSCNSYLQPTPFYLKLTGHPSLTGSA

SEQ ID NO: 745205 - protein, 530 aa, Homo sapiens
MAEHAPRRCCLGWDFSTQQVKVVAVDAELNVFYEESVHFDRDLPEFGMYLMCMTQGGVHVHKDGLTVTSPVLMWVQALDIILEKMKASGFDFSQVLALSGAGQQHGSIYWKAGAQQALTSLSPDLRLHQQLQDCFSISDCPVWMDSSTTAQCRQLEAAVGGAQALSCLTGSRAYERFTGNQIAKIYQQNPEAYSHTERISLVSSFAASLFLGSYSPIDYSDGSGMNLLQIQDKVWSQACLGACAPHLEEKLSPPVPSCSVVGAISSYYVQRYGFPPGCKVVAFTGDNPASLAGMRLEEGDIAVSLGTSDTLFLWLQEPMPALEGHIFCNPVDSQHYMALLCFKNGSLMREKIRNESVSRSWSDFSKALQSTEMGNGGNLGFYFDVMEITPEIIGRHRFNTENHKVAAFPGDVEVRALIEGQFMAKRIHAEGLGYRVMSKTKILATGGASHNREILQVLADVFDAPVYVIDTANSACVGSAYRAFHGLAGGTDVPFSEVVKLAPNPRLAATPSPGASQVRDHQNLFVAFAL

SEQ ID NO: 745206 - protein, 536 aa, Homo sapiens
MAEHAPRRCCLGWDFSTQQVKVVAVDAELNVFYEESVHFDRDLPEFGTQGGVHVHKDGLTVTSPVLMWVQALDIILEKMKASGFDFSQVLALSGAGQQHGSIYWKAGAQQALTSLSPDLRLHQQLQDCFSISDCPVWMDSSTTAQCRQLEAAVGGAQALSCLTGSRAYERFTGNQIAKIYQQNPEAYSHTERISLVSSFAASLFLGSYSPIDYSDGSGMNLLQIQDKVWSQACLGACAPHLEEKLSPPVPSCSVVGAISSYYVQRYGFPPGCKVVAFTGDNPASLAGMRLEEGDIAVSLGTSDTLFLWLQEPMPALEGHIFCNPVDSQHYMALLCFKNGSLMREKIRNESVSRSWSDFSKALQSTEMGNGGNLGFYFDVMEITPEIIGRHRFNTENHKVAAFPGDVEVRALIEGQFMAKRIHAEGLGYRVMSKTKILATGGASHNREILQVLADVFDAPVYVIDTANSACVGSAYRAFHGLAGGTDVPFSEVVKLAPNPRLAATPSPGASQVYEALLPQYAKLEQRILSQTRGPPE

SEQ ID NO: 745207 - protein, 117 aa, Homo sapiens
MAEHAPRRCCLGWDFSTQQVKVVAVDAELNVFYEESVHFDRDLPEFGATLEAHVEHDRATINLVLNDCMEQNSPLPTHVPNHLLIVLYMRRKKLQLYQAIEMCFSLTNIIFSLISFF

SEQ ID NO: 745208 - protein, 536 aa, Homo sapiens; identical to SEQ ID NO: 745206

SEQ ID NO: 745209 - protein, 299 aa, Homo sapiens
MAEHAPRRCCLGWDFSTQQVKVVAVDAELNVFYEESVHFDRDLPEFGTQGGVHVHKDGLTVTSPVLMWVQALDIILEKMKASGFDFSQVLALSGAGQQHGSIYWKAGAQQALTSLSPDLRLHQQLQDCFSISDCPVWMDSSTTAQCRQLEAAVGGAQALSCLTGSRAYERFTGNQIAKIYQQNPEAYSHTERISLVSSFAASLFLGSYSPIDYSDGSGMNLLQIQDKVWSQACLGACAPHLEEKLSPPVPSCSVVVGLLSGDVAHLRAGSYQGSTVAHTHAHTHTHTHTHSAHTLICSS

SEQ ID NO: 745210 - protein, 129 aa, Homo sapiens
HERNGCRLCKSDKYCEPHDYEYCCPCEWHRTEHDRQLNEVENNIKKKACCCEGFPFHEVIQEFLLNKDKLVKVIRYQRPDLLLFQRFTLEKMEWPNHYACEKLLVLLTHYDMIERKLGSRNSNQLQPIR

SEQ ID NO: 745211 - protein, 636 aa, Homo sapiens
HERNGCRLCKSDKYCEPHDYEYCCPCEWHRTEHDRQLNEVENNIKKKACCCEGFPFHEVIQEFLLNKDKLVKVIRYQRPDLLLFQRFTLEKMEWPNHYACEKLLVLLTHYDMIERKLGSRNSNQLQPIRIVKTRIRNGVHCFEIEWEKPEHYAMEDKQHGEFALLTIEEESLFEAAYPEIVAVYQKQKLEIKGKKQKRIKPKENNLPEPDEVMSFQSHMTLKPTCEIFHKQNSKLNSGISPDPTLPQESISASLNSLLLPKNTPCLNAQEQFMSSLRPLAIQQIKAVSKSLISESSQPNTSSHNISVIADLHLSTIDWEGTSFSNSPAIQRNTFSHDLKSEVESELSAIPDGFENIPEQLSCESERYTANIKKVLDEDSDGISPEEHLLSGITDLCLQDLPLKERIFTKLSYPQDNLQPDVNLKTLSILSVKESCIANSGSDCTSHLSKDLPGIPLQNESRDSKILKGDQLLQEDYKVNTSVPYSVSNTVVKTCNVRPPNTALDHSRKVDMQTTRKILMKKSVCLDRHSSDEQSAPVFGKAKYTTQRMKHSSQKHNSSHFKESGHNKLSSPKIHIKETEQCVRSYETAENEESCFPDSTKSSLSSLQCHKKENNSGTCLDSPLPLRQRLKLRFQST

SEQ ID NO: 745212 - protein, 636 aa, Homo sapiens; identical to SEQ ID NO: 745211

SEQ ID NO: 745213 - protein, 115 aa, Homo sapiens
MVIPEDQGPSFPTHIPMHLIRTANGGGRDFKAVTIARRGTALSHFTARLTLFRTLKSGDRLQKQAPVCDDVCVKECNPHAAGSRSLFRGMVSPHAPALCATSIMARPWGSRCELE

SEQ ID NO: 745214 - protein, 104 aa, Homo sapiens
AYTATGYLLKIRANFALLLCIAYIFLKGHSCSFTKKKINKSFSEFRKFGNSRFTLALSCVSVWLCPQALPPFSLGERTWLHILFSFMNLPVTLRQRLGFCFISL

SEQ ID NO: 745215 - protein, 385 aa, Homo sapiens
MSKPAGSTSRILDIPCKVCGDRSSGKHYGVYACDGCSGFFKRSIRRNRTYVCKSGNQGGCPVDKTHRNQCRACRLKKCLEVNMNKDAVQHERGPRTSTIRKQVALYFRGHKEENGAAAHFPSAALPAPAFFTAVTQLEPHGLELAAVSTTPERQTLVSLAQPTPKYPHEVNGTPMYLYEVATESVCESAARLLFMSIKWAKSVPAFSTLSLQDQLMLLEDAWRELFVLGIAQWAIPVDANTLLAVSGMNGDNTDSQKLNKIISEIQALQEVVARFRQLRLDATEFACLKCIVTFKAVPTHSGSELRSFRNAAAIAALQDEAQLTLNSYIHTRYPTQPCRFGKLLLLLPALRSISPSTIEEVFFKKTIGNVPITRLLSDMYKSSDI

SEQ ID NO: 745216 - protein, 61 aa, Homo sapiens
GPLSLPDENLHFNKVLDAAKFEIYWARTLRGHKGSLKTKENRQGVVAHACNPCILGCQGGR

SEQ ID NO: 745217 - protein, 77 aa, Homo sapiens
KLEDGPTFLKSGDAAIVDMVPGKPMCVESFSVYPPLSRFAVCDMRQTVAVGVIEAMDKKAAGAGKVTKSTQKAQKAK

SEQ ID NO: 745218 - protein, 320 aa, Homo sapiens
QEPPTTDSQEAQSPGHSSAGQEGEDTLRRRLLAPEAGSHPQQTQKLEEIKENAQDTMRQINKKGFWSYGPVILVVLVVAVVASSVNSYYSSPAQQVPKNPALEAFLAQFSQLEDKFPGQSSFLWQRGRKFLQKHLNASNPTEPATIIFTAAREGRETLKCLSHHVADAYTSSQKVSPIQIDGAGRTWQDSDTVKLLVDLELSYGFENGQKAAVVHHFESFPAGSTLIFYKYCDHENAAFKDVALVLTVLLEEETLEASVGPRETEEKVRDLLWAKFTNSDTPTSFNHMDSDKLSGLWSRISHLVLPVQPVSSIEEQGCLF

SEQ ID NO: 745219 - protein, 264 aa, Homo sapiens
MRQINKKGFWSYGPVILVVLVVAVVASSVNSYYSSPAQQVPKNPALEAFLAQFSQLEDKFPGQSSFLWQRGRKFLQKHLNASNPTEPATIIFTAAREGRETLKCLSHHVADAYTSSQKVSPIQIDGAGRTWQDSDTVKLLVDLELSYGFENGQKAAVVHHFESFPAGSTLIFYKYCDHENAAFKDVALVLTVLLEEETLEASVGPRETEEKVRDLLWAKFTNSDTPTSFNHMDSDKLSGLWSRISHLVLPVQPVSSIEEQGCLF

SEQ ID NO: 745220 - protein, 320 aa, Homo sapiens; identical to SEQ ID NO: 745218

SEQ ID NO: 745221 - protein, 331 aa, Homo sapiens
QEPPTTDSQEAQSPGHSSAGQEGEDTLRRRLLAPEAGSHPQQTQKLEEIKENAQDTMRQINKKGFWSYGPVILVVLVVAVVASSVNSYYSSPAQQVPKNPALEAFLAQFSQLEDKFPGQSSFLWQRGRKFLQKHLNASNPTEPATIIFTAAREGRETLKCLSHHVADAYTSSQKVSPIQIDGAGRTWQDSDTVKLLVDLELSYGFENGQKAAVVHHFESFPAGSTLIFYKYCDHENAAFKDVALVLTVLLEEETLEASVGPRETEEKVRDLLWAKFTNSDTPTSFNHMDSDKLSGLWSRISHLVLPVQPILDASVTSTKPVLPCITIILAC

SEQ ID NO: 745222 - protein, 331 aa, Homo sapiens; identical to SEQ ID NO: 745221

SEQ ID NO: 745223 - protein, 1081 aa, Homo sapiens
CKTWPAARVSRSHVTLVSWSVQLPPASELPDPNTKQSECRAECKTLKTLQSKVLIPEALQNMEIKDQGAQMEPLLPTRNDEEAVVDRGGTRSILKTHFEKEDLEGHRTLFIGVHVPLGGRKSHRRHRHRGHKHRKRDRERDSGLEDGRESPSFDTPSQRVQFILGTEDDDEEHIPHDLFTELDEICWREGEDAEWRETARWLKFEEDVEDGGERWSKPYVATLSLHSLFELRSCILNGTVLLDMHANTLEEIADMVLDQQVSSGQLNEDVRHRVHEALMKQHHHQNQKKLTNRIPIVRSFADIGKKQSEPNSMDKNAGQVVSPQSAPACVENKNDVSRENSTVDFSKVDLHFMKKIPPGAEASNILVGELEFLDRTVVAFVRLSPAVLLQGLAEVPIPTRFLFILLGPLGKGQQYHEIGRSIATLMTDEVFHDVAYKAKDRNDLVSGIDEFLDQVTVLPPGEWDPSIRIEPPKNVPSQEKRKIPAVPNGTAAHGEAEPHGGHSGPELQRTGRIFGGLILDIKRKAPYFWSDFRDAFSLQCLASFLFLYCACMSPVITFGGLLGEATEGRISAIESLFGASMTGIAYSLFGGQPLTILGSTGPVLVFEKILFKFCKEYGLSYLSLRASIGLWTATLCIILVATDASSLVCYITRFTEEAFASLICIIFIYEALEKLFELSEAYPINMHNDLELLTQYSCNCVEPHNPSNGTLKEWRESNISASDIIWENLTVSECKSLHGEYVGRACGHDHPYVPDVLFWSVILFFSTVTLSATLKQFKTSRYFPTKVRSIVSDFAVFLTILCMVLIDYAIGIPSPKLQVPSVFKPTRDDRGWFVTPLGPNPWWTVIAAIIPALLCTILIFMDQQITAVIINRKEHKLKKGCGYHLDLLMVAVMLGVCSIMGLPWFVAATVLSITHVNSLKLESECSAPGEQPKFLGIREQRVTGLMIFILMGSSVFMTSILKFIPMPVLYGVFLYMGASSLKGIQFFDRIKLFWMPAKHQPDFIYLRHVPLRKVHLFTIIQMSCLGLLWIIKVSRAAIVFPMMVLALVFVRKLMDLLFTKRELSWLDDLMPESKKKKLESS

SEQ ID NO: 745224 - protein, 1081 aa, Homo sapiens; identical to SEQ ID NO: 745223

SEQ ID NO: 745225 - protein, 961 aa, Homo sapiens
LVTLEDPPPNGIHRKRDRERDSGLEDGRESPSFDTPSQRVQFILGTEDDDEEHIPHDLFTELDEICWREGEDAEWRETARWLKFEEDVEDGGERWSKPYVATLSLHSLFELRSCILNGTVLLDMHANTLEEIADMVLDQQVSSGQLNEDVRHRVHEALMKQHHHQNQKKLTNRIPIVRSFADIGKKQSEPNSMDKNAGQVVSPQSAPACVENKNDVSRENSTVDFSKVDLHFMKKIPPGAEASNILVGELEFLDRTVVAFVRLSPAVLLQGLAEVPIPTRFLFILLGPLGKGQQYHEIGRSIATLMTDEVFHDVAYKAKDRNDLVSGIDEFLDQVTVLPPGEWDPSIRIEPPKNVPSQEKRKIPAVPNGTAAHGEAEPHGGHSGPELQRTGRIFGGLILDIKRKAPYFWSDFRDAFSLQCLASFLFLYCACMSPVITFGGLLGEATEGRISAIESLFGASMTGIAYSLFGGQPLTILGSTGPVLVFEKILFKFCKEYGLSYLSLRASIGLWTATLCIILVATDASSLVCYITRFTEEAFASLICIIFIYEALEKLFELSEAYPINMHNDLELLTQYSCNCVEPHNPSNGTLKEWRESNISASDIIWENLTVSECKSLHGEYVGRACGHDHPYVPDVLFWSVILFFSTVTLSATLKQFKTSRYFPTKVRSIVSDFAVFLTILCMVLIDYAIGIPSPKLQVPSVFKPTRDDRGWFVTPLGPNPWWTVIAAIIPALLCTILIFMDQQITAVIINRKEHKLKKGCGYHLDLLMVAVMLGVCSIMGLPWFVAATVLSITHVNSLKLESECSAPGEQPKFLGIREQRVTGLMIFILMGSSVFMTSILKFIPMPVLYGVFLYMGASSLKGIQFFDRIKLFWMPAKHQPDFIYLRHVPLRKVHLFTIIQMSCLGLLWIIKVSRAAIVFPMMVLALVFVRKLMDLLFTKRELSWLDDLMPESKKKKLESS

SEQ ID NO: 745226 - protein, 601 aa, Homo sapiens
PRCSGGSGCRRAGQEQRDPSRAGGARHGTRALLAPRPACGPGSSLPLSHPPSLPLHPLCRRSPVPPALRNPGWAGPWQSARPRVGSRRAVDGEGARRGLCSPSSRRWRPGPPQPHCPGPRAPALSCAAAAPARTRGAMRRAAGMEDFSAEEEESWYDQQDLEQDLHLAAELGKTLLERNKELEGSLQQMYSTNEEQVQEIEYLTKQLDTLRHVNEQHAKVYEQLDLTARDLELTNHRLVLESKAAQQKIHGLTETIERLQAQVEELQAQVEQLRGLEQLRVLREKRERRRTIHTFPCLKELCTSPRCKDAFRLHSSSLETPAAPGAGERAAADPGGALRSQVSQERRKRERAEDEYTAVLQEYSELERHGARMEACRLRVQSLEAELLELQQMKQAKTYLLGPDDHLAEALLAPLTQAPEADDPQPGRGDDLGAQDGVSSPAASPGHVVRKSCSDTALNAIVAKDPASRHAGNLTLHANSVRKRGMSILREVDEQYHALLEKYEELLSKCRQHGAGVRHAGVQTSRPISRDSSWRDLRGGEEGQGEVKAGEKSLSQHVEAVDKRLEQSQPEYKALFKEIFSRIQKTKADINATKVKTHSSK

SEQ ID NO: 745227 - protein, 64 aa, Homo sapiens
MGVLCLCSHARVSPILDLHLAAELGKTLLERNKELEGSLQQMYSTNEEQVQEIEVRALHVLAHT

SEQ ID NO: 745228 - protein, 601 aa, Homo sapiens; identical to SEQ ID NO: 745226

SEQ ID NO: 745229 - protein, 159 aa, Homo sapiens
MSCVGSILTRGLEELPRLWYTVVTGYEVLSLRSTIVDGKPSMSPGGVVGIALGTERHHDRDIKASVTVTMMEESCKTVTETGVQDSHACRSSYAVARSSEDLYSQVIHYYDQMFRYIRQLHDQDAQQQVTLLRPAASPRVEAVGSLRPGRCSFQRASAL

SEQ ID NO: 745230 - protein, 197 aa, Homo sapiens
YEPRAAAAAASSSCSSGSCSSGSSPSLKASLSYEEGHPSHSETDLLQRQSFAASHQLPGYAPTPQPTGLSGIFDTSVNSASSNTKESSVMNFLSTAESRTAQAAASGTTLLPQFRAPSWQTGMHSSAATELFATGPLPSTGTLPPSLSAYQHPTTFSNRNFATTSPLVLQDSTFNTTSNGILSHHDPLLQIKTSQGT

SEQ ID NO: 745231 - protein, 189 aa, Homo sapiens
MLIAVSTPLTTLDATSDKEEENSLSYEEGHPSHSETDLLQRQSFAASHQLPGYAPTPQPTGLSGIFDTSVNSASSNTKESSVMNFLSTAESRTAQAAASGTTLLPQFRAPSWQTGMHSSAATELFATGPLPSTGTLPPSLSAYQHPTTFSNRNFATTSPLVLQDSTFNTTSNGILSHHDPLLQIKTSQG

SEQ ID NO: 745232 - protein, 139 aa, Homo sapiens [sequence omitted]

SEQ ID NO: 745233 - protein, 139 aa, Homo sapiens [sequence omitted]

SEQ ID NO: 745234 - protein, 139 aa, Homo sapiens [sequence omitted]

SEQ ID NO: 745235 - protein, 139 aa, Homo sapiens [sequence omitted]

SEQ ID NO: 745236 - protein, 139 aa, Homo sapiens [sequence omitted]

SEQ ID NO: 745237 - protein, 139 aa, Homo sapiens [sequence omitted]

SEQ ID NO: 745238 - protein, 62 aa, Homo sapiens
MRDPGRSCCCCPRCDSFLLREGSAPRCSQVGPGRPPWPTAQTAKCWSRPLHLHHPFLSSNST

SEQ ID NO: 745239 - protein, 336 aa, Homo sapiens
SGPRSPRSASPGPASTGPRHPQVAEGGGRERAARSREAGEGPASEAAAAAAGAASGSSGENGSAGRQTAAGCHGRHEACEARGRRPRLLNPGRRGGGGGGGQIAARTRRRGGGRMERKGSAAGAKGNPSPPAAGEGQRPPPPLCVPGGGGGAPARGQVGAAAEPAELIRRAHEFKSQGAQCYKDKKFREAIGKYHRALLELKGLLPPPGERERDSRAASPAGALKPGRLSEEQSKTVEAIEIDCYNSLAACLLQAELVNYERVKEYCLKVLKKEGENFKALYRSGVAFYHLGDYDKALYYLKEARTQQPTDTNVIRYIQLTEMKLSRCSQREKEAM

SEQ ID NO: 745240 - protein, 336 aa, Homo sapiens; identical to SEQ ID NO: 745239

SEQ ID NO: 745241 - protein, 723 aa, Homo sapiens
MGSRCALALAVLSALLCQVWSSGVFELKLQEFVNKKGLLGNRNCCRGGAGPPPCACRTFFRVCLKHYQASVSPEPPCTYGSAVTPVLGVDSFSLPDGGGADSAFSNPIRFPFGFTWPGTFSLIIEALHTDSPDDLATENPERLISRLATQRHLTVGEEWSQDLHSSGRTDLKYSYRFVCDEHYYGEGCSVFCRPRDDAFGHFTCGERGEKVCNPGWKGPYCTEPICLPGCDEQHGFCDKPGECKCRVGWQGRYCDECIRYPGCLHGTCQQPWQCNCQEGWGGLFCNQDLNYCTHHKPCKNGATCTNTGQGSYTCSCRPGYTGATCELGIDECDPSPCKNGGSCTDLENSYSCTCPPGFYGKICELSAMTCADGPCFNGGRCSDSPDGGYSCRCPVGYSGFNCEKKIDYCSSSPCSNGAKCVDLGDAYLCRCQAGFSGRHCDDNVDDCASSPCANGGTCRDGVNDFSCTCPPGYTGRNCSAPVSRCEHAPCHNGATCHERGHRYVCECARGYGGPNCQFLLPELPPGPAVVDLTEKLEGQGGPFPWVAVCAGVILVLMLLLGCAAVVVCVRLRLQKHRPPADPCRGETETMNNLANCQREKDISVSIIGATQIKNTNKKADFHGDHSADKNGFKARYPAVDYNLVQDLKGDDTAVRDAHSKRDTKCQPQGSSGEEKGTPTTLRGGEASERKRPDSGCSTSKDTKYQSVYVISEEKDECVIATEV

SEQ ID NO: 745242 - protein, 987 aa, Homo sapiens
SQILCAHPRRPDPAEGRAQGNPGSRGAEPPPTARPLRSCACVLDGIGWIHRKDADLCCDTGDRSPECSRNDRRRRVTPGRDPQGPPRTPAAADRPLSARRWPRIIALPVGFPDRGFLIGSGGSSAALLGIKLNLWTLSLSLSPPPSPAKKLKTKPGSRRPSPPRGLGGRRKTKVAAAALSPESCLSSGIPGAAAGPRRADIKNRGLGKRRRPAFKERSPGSCGLGRGKGAFLPTLPVALDPPRVRRCSKERSGGPPGSRVERSSMGSRCALALAVLSALLCQVWSSGVFELKLQEFVNKKGLLGNRNCCRGGAGPPPCACRTFFRVCLKHYQASVSPEPPCTYGSAVTPVLGVDSFSLPDGGGADSAFSNPIRFPFGFTWPGTFSLIIEALHTDSPDDLATENPERLISRLATQRHLTVGEEWSQDLHSSGRTDLKYSYRFVCDEHYYGEGCSVFCRPRDDAFGHFTCGERGEKVCNPGWKGPYCTEPICLPGCDEQHGFCDKPGECKCRVGWQGRYCDECIRYPGCLHGTCQQPWQCNCQEGWGGLFCNQDLNYCTHHKPCKNGATCTNTGQGSYTCSCRPGYTGATCELGIDECDPSPCKNGGSCTDLENSYSCTCPPGFYGKICELSAMTCADGPCFNGGRCSDSPDGGYSCRCPVGYSGFNCEKKIDYCSSSPCSNGAKCVDLGDAYLCRCQAGFSGRHCDDNVDDCASSPCANGGTCRDGVNDFSCTCPPGYTGRNCSAPVSRCEHAPCHNGATCHERGHRYVCECARGYGGPNCQFLLPELPPGPAVVDLTEKLEGQGGPFPWVAVCAGVILVLMLLLGCAAVVVCVRLRLQKHRPPADPCRGETETMNNLANCQREKDISVSIIGATQIKNTNKKADFHGDHSADKNGFKARYPAVDYNLVQDLKGDDTAVRDAHSKRDTKCQPQGSSGEEKGTPTTLRGGEASERKRPDSGCSTSKDTKYQSVYVISEEKDECVIATEV

SEQ ID NO: 745243 - protein, 1037 aa, Homo sapiens
SQILCAHPRRPDPAEGRAQGNPGSRGAEPPPTARPLRSCACVLDGIGWIHRKDADLCCDTGDRSPECSRNDRRRRVTPGRDPQGPPRTPAAADRPLSARRWPRIIALPVGFPDRGFLIGSGGSSAALLGIKLNLWTLSLSLSPPPSPAKKLKTKPGSRRPSPPRGLGGRRKTKVAAAALSPESCLSSGIPGAAAGPRRADIKNRGLGKRRRPAFKERSPGSCGLGRGKGAFLPTLPVALDPPRVRRCSKERSGGPPGSRVERSSMGSRCALALAVLSALLCQVWSSGVFELKLQEFVNKKGLLGNRNCCRGGAGPPPCACRTFFRVCLKHYQASVSPEPPCTYGSAVTPVLGVDSFSLPDGGGADSAFSNPIRFPFGFTWPGTFSLIIEALHTDSPDDLATENPERLISRLATQRHLTVGEEWSQDLHSSGRTDLKYSYRFVCDEHYYGEGCSVFCRPRDDAFGHFTCGERGEKVCNPGWKGPYCTEPICLPGCDEQHGFCDKPGECKCRVGWQGRYCDECIRYPGCLHGTCQQPWQCNCQEGWGGLFCNQDQGKPSLPEAACSLQSSPGLPWLFDHWKNKVFLHLMSASYLLLFLSPPFTDLNYCTHHKPCKNGATCTNTGQGSYTCSCRPGYTGATCELGIDECDPSPCKNGGSCTDLENSYSCTCPPGFYGKICELSAMTCADGPCFNGGRCSDSPDGGYSCRCPVGYSGFNCEKKIDYCSSSPCSNGAKCVDLGDAYLCRCQAGFSGRHCDDNVDDCASSPCANGGTCRDGVNDFSCTCPPGYTGRNCSAPVSRCEHAPCHNGATCHERGHRYVCECARGYGGPNCQFLLPELPPGPAVVDLTEKLEGQGGPFPWVAVCAGVILVLMLLLGCAAVVVCVRLRLQKHRPPADPCRGETETMNNLANCQREKDISVSIIGATQIKNTNKKADFHGDHSADKNGFKARYPAVDYNLVQDLKGDDTAVRDAHSKRDTKCQPQGSSGEEKGTPTTLRGGEASERKRPDSGCSTSKDTKYQSVYVISEEKDECVIATEV

SEQ ID NO: 745244 - protein, 511 aa, Homo sapiens
SQILCAHPRRPDPAEGRAQGNPGSRGAEPPPTARPLRSCACVLDGIGWIHRKDADLCCDTGDRSPECSRNDRRRRVTPGRDPQGPPRTPAAADRPLSARRWPRIIALPVGFPDRGFLIGSGGSSAALLGIKLNLWTLSLSLSPPPSPAKKLKTKPGSRRPSPPRGLGGRRKTKVAAAALSPESCLSSGIPGAAAGPRRADIKNRGLGKRRRPAFKERSPGSCGLGRGKGAFLPTLPVALDPPRVRRCSKERSGGPPGSRVERSSMGSRCALALAVLSALLCQVWSSGVFELKLQEFVNKKGLLGNRNCCRGGAGPPPCACRTFFRVCLKHYQASVSPEPPCTYGSAVTPVLGVDSFSLPDGGGADSAFSNPIRFPFGFTWPGTFSLIIEALHTDSPDDLATENPERLISRLATQRHLTVGEEWSQDLHSSGRTDLKYSYRFVCDEHYYGEGCSVFCRPRDDAFGHFTCGERGEKVCNPGWKGPYCTERESLGRHRWLTRPRTRTTRRDGAS

SEQ ID NO: 745245 - protein, 723 aa, Homo sapiens; identical to SEQ ID NO: 745241

SEQ ID NO: 745246 - protein, 1026 aa, Homo sapiens
SQILCAHPRRPDPAEGRAQGNPGSRGAEPPPTARPLRSCACVLDGIGWIHRKDADLCCDTGDRSPECSRNDRRRRVTPGRDPQGPPRTPAAADRPLSARRWPRIIALPVGFPDRGFLIGSGGSSAALLGIKLNLWTLSLSLSPPPSPAKKLKTKPGSRRPSPPRGLGGRRKTKVAAAALSPESCLSSGIPGAAAGPRRADIKNRGLGKRRRPAFKERSPGSCGLGRGKGAFLPTLPVALDPPRVRRCSKERSGGPPGSRVERSSMGSRCALALAVLSALLCQVWSSGVFELKLQEFVNKKGLLGNRNCCRGGAGPPPCACRTFFRVCLKHYQASVSPEPPCTYGSAVTPVLGVDSFSLPDGGGADSAFSNPIRFPFGFTWPGTFSLIIEALHTDSPDDLATENPERLISRLATQRHLTVGEEWSQDLHSSGRTDLKYSYRFVCDEHYYGEGCSVFCRPRDDAFGHFTCGERGEKVCNPGWKGPYCTEPICLPGCDEQHGFCDKPGECKCRVGWQGRYCDECIRYPGCLHGTCQQPWQCNCQEGWGGLFCNQDLNYCTHHKPCKNGATCTNTGQGSYTCSCRPGYTGATCELGIDECDPSPCKNGGSCTVSRRLHGISPGSWGALVLNGVCGLLGATLEAFSDLSIVYDLENSYSCTCPPGFYGKICELSAMTCADGPCFNGGRCSDSPDGGYSCRCPVGYSGFNCEKKIDYCSSSPCSNGAKCVDLGDAYLCRCQAGFSGRHCDDNVDDCASSPCANGGTCRDGVNDFSCTCPPGYTGRNCSAPVSRCEHAPCHNGATCHERGHRYVCECARGYGGPNCQFLLPELPPGPAVVDLTEKLEGQGGPFPWVAVCAGVILVLMLLLGCAAVVVCVRLRLQKHRPPADPCRGETETMNNLANCQREKDISVSIIGATQIKNTNKKADFHGDHSADKNGFKARYPAVDYNLVQDLKGDDTAVRDAHSKRDTKCQPQGSSGEEKGTPTTLRGGEASERKRPDSGCSTSKDTKYQSVYVISEEKDECVIATEV

SEQ ID NO: 745247 - protein, 356 aa, Homo sapiens [sequence omitted]

SEQ ID NO: 745248 - protein, 317 aa, Homo sapiens
MHGRAYLLLHRDFCDLKENNYKGITAKPVSEDMMEWEVEIEGLQNSVWQGLVFQLTIHFTSEYNYAPPVVKFITIPFHPNVDPHTGQPCIDFLDNPEKWNTNYTLSSILLALQVMLSNPVLENPVNLEAARILVKDESLYRTILRLFNRPLQMKDDSQELPKDPRKCIRPIKTTSFSDYYQTWSRIATSKATEYYRTPLLKVPNFIGQYYKWKKMDLQHQKEWNLKYSVIKCWLARKRMPHEVTHSMEEIKLCPTLNEIFLESPTAINSITDIYETEEEGWKSDTSLYENDTDEPREEEVEDLISWTNTLNTNTSED

SEQ ID NO: 745249 - protein, 287 aa, Homo sapiens
MHGRAYLLLHRDFCDLKENNYKGITAKPVSEDMMEWEVEIEGLQNSVWQGLVFQLTIHFTSEYNYAPPVVKFITIPFHPNVDPHTGQPCIDFLDNPEKWNTNYTLSSILLALQVMLSNPVLENPVNLEAARILVKDESLYRTILRLFNRPLQMKMTARSYLKTHVNVSVLKVPNFIGQYYKWKKMDLQHQKEWNLKYSVIKCWLARKRMPHEVTHSMEEIKLCPTLNEIFLESPTAINSITDIYETEEEGWKSDTSLYENDTDEPREEEVEDLISWTNTLNTNTSED

SEQ ID NO: 745250 - protein, 226 aa, Homo sapiens
MHGRAYLLLHRDFCDLKENNYKGITAKPVSEDMMEWEVEIEGLQNSVWQGLVFQLTIHFTSEYNYAPPVVKFITIPFHPNVDPHTGQPCIDFLDNPEKWNTNYTLSSILLALQVMLSNPVLENPVNLEAARILVKDESLYRTILRLFNRPLQMKDDSQELPKDPRKCIRPIKTTSFSDYYQTWSRIATSKATEYYRTPLLKVPNFIGQYYKWKKMDLQHQKEWNLK

SEQ ID NO: 745251 - protein, 205 aa, Homo sapiens
MHGRAYLLLHRDFCDLKENNYKGITAKPVSEDMMEWEVEIEGLQNSVWQGLVFQLTIHFTSEYNYAPPVVKFITIPFHPNVDPHTGQPCIDFLDNPEKWNTNYTLSSILLALQVMLSNPVLENPVNLEAARILVKDESLYRTILRLFNRPLQMKDDSQELPKDPRKCISAQSSKFHWTVLQMEENGSTASERMEFKMKNLSLEAA

SEQ ID NO: 745252 - protein, 3460 aa, Homo sapiens
MERSGWARQTFLLALLLGATLRARAAAGYYPRFSPFFFLCTHHGELEGDGEQGEVLISLHIAGNPTYYVPGQEYHVTISTSTFFDGLLVTGLYTSTSVQASQSIGGSSAFGFGIMSDHQFGNQFMCSVVASHVSHLPTTNLSFIWIAPPAGTGCVNFMATATHRGQVIFKDALAQQLCEQGAPTDVTVHPHLAEIHSDSIILRDDFDSYHQLQLNPNIWVECNNCETGEQCGAIMHGNAVTFCEPYGPRELITTGLNTTTASVLQFSIGSGSCRFSYSDPSIIVLYAKNNSADWIQLEKIRAPSNVSTIIHILYLPEDAKGENVQFQWKQENLRVGEVYEACWALDNILIINSAHRQVVLEDSLDPVDTGNWLFFPGATVKHSCQSDGNSIYFHGNEGSEFNFATTRDVDLSTEDIQEQWSEEFESQPTGWDVLGAVIGTECGTIESGLSMVFLKDGERKLCTPSMDTTGYGNLRFYFVMGGICDPGNSHENDIILYAKIEGRKEHITLDTLSYSSYKVPSLVSVVINPELQTPATKFCLRQKNHQGHNRNVWAVDFFHVLPVLPSTMSHMIQFSINLGCGTHQPGNSVSLEFSTNHGRSWSLLHTECLPEICAGPHLPHSTVYSSENYSGWNRITIPLPNAALTRNTRIRWRQTGPILGNMWAIDNVYIGPSCLKFCSGRGQCTRHGCKCDPGFSGPACEMASQTFPMFISESFGSSRLSSYHNFYSIRGAEVSFGCGVLASGKALVFNKDGRRQLITSFLDSSQSRFLQFTLRLGSKSVLSTCRAPDQPGEGVLLHYSYDNGITWKLLEHYSYLSYHEPRIISVELPGDAKQFGIQFRWWQPYHSSQREDVWAIDEIIMTSVLFNSISLDFTNLVEVTQSLGFYLGNVQPYCGHDWTLCFTGDSKLASSMRYVETQSMQIGASYMIQFSLVMGCGQKYTPHMDNQVKLEYSTNHGLTWHLVQEECLPSMPSCQEFTSASIYHASEFTQWRRVIVLLPQKTWSSATRFRWSQSYYTAQDEWALDSIYIGQQCPNMCSGHGSCDHGICRCDQGYQGTECHPEAALPSTIMSDFENQNGWESDWQEVIGGEIVKPEQGCGVISSGSSLYFSKAGKRQLVSWDLDTSWVDFVQFYIQIGGESASCNKPDSREEGVLLQYSNNGGIQWHLLAEMYFSDFSKPRFVYLELPAAAKTPCTRFRWWQPVFSGEDYDQWAVDDIIILSEKQKQIIPVINPTLPQNFYEKPAFDYPMNQMSVWLMLANEGMVKNETFCAATPSAMIFGKSDGDRFAVTRDLTLKPGYVLQFKLNIGCANQFSSTAPVLLQYSHDAGMSWFLVKEGCYPASAGKGCEGNSRELSEPTMYHTGDFEEWTRITIVIPRSLASSKTRFRWIQESSSQKNVPPFGLDGVYISEPCPSYCSGHGDCISGVCFCDLGYTAAQGTCVSNVPNHNEMFDRFEGKLSPLWYKITGAQVGTGCGTLNDGKSLYFNGPGKREARTVPLDTRNIRLVQFYIQIGSKTSGITCIKPRTRNEGLIVQYSNDNGILWHLLRELDFMSFLEPQIISIDLPQDAKTPATAFRWWQPQHGKHSAQWALDDVLIGMNDSSQTGFQDKFDGSIDLQANWYRIQGGQVDIDCLSMDTALIFTENIGKPRYAETWDFHVSASTFLQFEMSMGCSKPFSNSHSVQLQYSLNNGKDWHLVTEECVPPTIGCLHYTESSIYTSERFQNWKRITVYLPLSTISPRTRFRWIQANYTVGADSWAIDNVVLASGCPWMCSGRGICDAGRCVCDRGFGGPYCVPVVPLPSILKDDFNGNLHPDLWPEVYGAERGNLNGETIKSGTSLIFKGEGLRMLISRDLDCTNTMYVQFSLRFIAKSTPERSHSILLQFSISGGITWHLMDEFYFPQTTNILFINVPLPYTAQTNATRFRLWQPYNNGKKEEIWIVDDFIIDGNNVNNPVMLLDTFDFGPREDNWFFYPGGNIGLYCPYSSKGAPEEDSAMVFVSNEVGEHSITTRDLNVNENTIIQFEINVGCSTDSSSADPVRLEFSRDFGATWHLLLPLCYHSSSHVSSLCSTEHHPSSTYYAGTMQGWRREVVHFGKLHLCGSVRFRWYQGFYPAGSQPVTWAIDNVYIGPQCEEMCNGQGSCINGTKCICDPGYSGPTCKISTKNPDFLKDDFEGQLESDRFLLMSGGKPSRKCGILSSGNNLFFNEDGLRMLMTRDLDLSHARFVQFFMRLGCGKGVPDPRSQPVLLQYSLNGGLSWSLLQEFLFSNSSNVGRYIALEIPLKARSGSTRLRWWQPSENGHFYSPWVIDQILIGGNISGNTVLEDDFTTLDSRKWLLHPGGTKMPVCGSTGDALVFIEKASTRYVVSTDVAVNEDSFLQIDFAASCSVTDSCYAIELEYSVDLGLSWHPLVRDCLPTNVECSRYHLQRILVSDTFNKWTRITLPLPPYTRSQATRFRWHQPAPFDKQQTWAIDNVYIGDGCIDMCSGHGRCIQGNCVCDEQWGGLYCDDPETSLPTQLKDNFNRAPSSQNWLTVNGGKLSTVCGAVASGMALHFSGGCSRLLVTVDLNLTNAEFIQFYFMYGCLITPNNRNQGVLLEYSVNGGITWNLLMEIFYDQYSKPGFVNILLPPDAKEIATRFRWWQPRHDGLDQNDWAIDNVLISGSADQRTVMLDTFSSAPVPQHERSPADAGPVGRIAFDMFMEDKTSVNEHWLFHDDCTVERFCDSPDGVMLCGSHDGREVYAVTHDLTPTEGWIMQFKISVGCKVSEKIAQNQIHVQYSTDFGVSWNYLVPQCLPADPKCSGSVSQPSVFFPTKGWKRITYPLPESLVGNPVRFRFYQKYSDMQWAIDNFYLGPGCLDNCRGHGDCLREQCICDPGYSGPNCYLTHTLKTFLKERFDSEEIKPDLWMSLEGGSTCTECGILAEDTALYFGGSTVRQAVTQDLDLRGAKFLQYWGRIGSENNMTSCHRPICRKEGVLLDYSTDGGITWTLLHEMDYQKYISVRHDYILLPEDALTNTTRLRWWQPFVISNGIVVSGVERAQWALDNILIGGAEINPSQLVDTFDDEGTSHEENWSFYPNAVRTAGFCGNPSFHLYWPNKKKDKTHNALSSRELIIQPGYMMQFKIVVGCEATSCGDLHSVMLEYTKDARSDSWQLVQTQCLPSSSNSIGCSPFQFHEATIYNSVNSSSWKRITIQLPDHVSSSATQFRWIQKGEETEKQSWAIDHVYIGEACPKLCSGHGYCTTGAICICDESFQGDDCSVFSHDLPSYIKDNFESARVTEANWETIQGGVIGSGCGQLAPYAHGDSLYFNGCQIRQAATKPLDLTRASKIMFVLQIGSMSQTDSCNSDLSGPHAVDKAVLLQYSVNNGITWHVIAQHQPKDFTQAQRVSYNVPLEARMKGVLLRWWQPRHNGTGHDQWALDHVEVVLVSTRKQNYMMNFSRQHGLRHFYNRRRRSLRRYP

SEQ ID NO: 745253 - protein, 1162 aa, Homo sapiens
MENLGFFKNTFQILIGGNISGNTVLEDDFTTLDSRKWLLHPGGTKMPVCGSTGDALVFIEKASTRYVVSTDVAVNEDSFLQIDFAASCSVTDSCYAIELEYSVDLGLSWHPLVRDCLPTNVECSRYHLQRILVSDTFNKWTRITLPLPPYTRSQATRFRWHQPAPFDKQQTWAIDNVYIGDGCIDMCSGHGRCIQGNCVCDEQWGGLYCDDPETSLPTQLKDNFNRAPSSQNWLTVNGGKLSTVCGAVASGMALHFSGGCSRLLVTVDLNLTNAEFIQFYFMYGCLITPNNRNQGVLLEYSVNGGITWNLLMEIFYDQYSKPGFVNILLPPDAKEIATRFRWWQPRHDGLDQNDWAIDNVLISGSADQRTVMLDTFSSAPVPQHERSPADAGPVGRIAFDMFMEDKTSVNEHWLFHDDCTVERFCDSPDGVMLCGSHDGREVYAVTHDLTPTEGWIMQFKISVGCKVSEKIAQNQIHVQYSTDFGVSWNYLVPQCLPADPKCSGSVSQPSVFFPTKGWKRITYPLPESLVGNPVRFRFYQKYSDMQWAIDNFYLGPGCLDNCRGHGDCLREQCICDPGYSGPNCYLTHTLKTFLKERFDSEEIKPDLWMSLEGGSTCTECGILAEDTALYFGGSTVRQAVTQDLDLRGAKFLQYWGRIGSENNMTSCHRPICRKEGVLLDYSTDGGITWTLLHEMDYQKYISVRHDYILLPEDALTNTTRLRWWQPFVISNGIVVSGVERAQWALDNILIGGAEINPSQLVDTFDDEGTSHEENWSFYPNAVRTAGFCGNPSFHLYWPNKKKDKTHNALSSRELIIQPGYMMQFKIVVGCEATSCGDLHSVMLEYTKDARSDSWQLVQTQCLPSSSNSIGCSPFQFHEATIYNSVNSSSWKRITIQLPDHVSSSATQFRWIQKGEETEKQSWAIDHVYIGEACPKLCSGHGYCTTGAICICDESFQGDDCSVFSHDLPSYIKDNFESARVTEANWETIQGGVIGSGCGQLAPYAHGDSLYFNGCQIRQAATKPLDLTRASKIMFVLQIGSMSQTDSCNSDLSGPHAVDKAVLLQYSVNNGITWHVIAQHQPKDFTQAQRVSYNVPLEARMKGVLLRWWQPRHNGTGHDQWALDHVEVVLVSTRKQNYMMNFSRQHGLRHFYNRRRRSLRRYP

SEQ ID NO: 745254 - protein, 3069 aa, Homo sapiens
MERSGWARQTFLLALLLGATLRARAAAGYYPRFSPFFFLCTHHGELEGDGEQGEVLISLHIAGNPTYYVPGQEYHVTISTSTFFDGLLVTGLYTSTSVQASQSIGGSSAFGFGIMSDHQFGNQFMCSVVASHVSHLPTTNLSFIWIAPPAGTGCVNFMATATHRGQVIFKDALAQQLCEQGAPTDVTVHPHLAEIHSDSIILRDDFDSYHQLQLNPNIWVECNNCETGEQCGAIMHGNAVTFCEPYGPRELITTGLNTTTASVLQFSIGSGSCRFSYSDPSIIVLYAKNNSADWIQLEKIRAPSNVSTIIHILYLPEDAKGENVQFQWKQENLRVGEVYEACWALDNILIINSAHRQVVLEDSLDPVDTGNWLFFPGATVKHSCQSDGNSIYFHGNEGSEFNFATTRDVDLSTEDIQEQWSEEFESQPTGWDVLGAVIGTECGTIESGLSMVFLKDGERKLCTPSMDTTGYGNLRFYFVMGGICDPGNSHENDIILYAKIEGRKEHITLDTLSYSSYKVPSLVSVVINPELQTPATKFCLRQKNHQGHNRNVWAVDFFHVLPVLPSTMSHMIQFSINLGCGTHQPGNSVSLEFSTNHGRSWSLLHTECLPEICAGPHLPHSTVYSSENYSGWNRITIPLPNAALTRNTRIRWRQTGPILGNMWAIDNVYIGPSCLKFCSGRGQCTRHGCKCDPGFSGPACEMASQTFPMFISESFGSSRLSSYHNFYSIRGAEVSFGCGVLASGKALVFNKDGRRQLITSFLDSSQSRFLQFTLRLGSKSVLSTCRAPDQPGEGVLLHYSYDNGITWKLLEHYSYLSYHEPRIISVELPGDAKQFGIQFRWWQPYHSSQREDVWAIDEIIMTSVLFNSISLDFTNLVEVTQSLGFYLGNVQPYCGHDWTLCFTGDSKLASSMRYVETQSMQIGASYMIQFSLVMGCGQKYTPHMDNQVKLEYSTNHGLTWHLVQEECLPSMPSCQEFTSASIYHASEFTQWRRVIVLLPQKTWSSATRFRWSQSYYTAQDEWALDSIYIGQQCPNMCSGHGSCDHGICRCDQGYQGTECHPEAALPSTIMSDFENQNGWESDWQEVIGGEIVKPEQGCGVISSGSSLYFSKAGKRQLVSWDLDTSWVDFVQFYIQIGGESASCNKPDSREEGVLLQYSNNGGIQWHLLAEMYFSDFSKPRFVYLELPAAAKTPCTRFRWWQPVFSGEDYDQWAVDDIIILSEKQKQIIPVINPTLPQNFYEKPAFDYPMNQMSVWLMLANEGMVKNETFCAATPSAMIFGKSDGDRFAVTRDLTLKPGYVLQFKLNIGCANQFSSTAPVLLQYSHDAGMSWFLVKEGCYPASAGKGCEGNSRELSEPTMYHTGDFEEWTRITIVIPRSLASSKTRFRWIQESSSQKNVPPFGLDGVYISEPCPSYCSGHGDCISGVCFCDLGYTAAQGTCVSNVPNHNEMFDRFEGKLSPLWYKITGAQVGTGCGTLNDGKSLYFNGPGKREARTVPLDTRNIRLVQFYIQIGSKTSGITCIKPRTRNEGLIVQYSNDNGILWHLLRELDFMSFLEPQIISIDLPQDAKTPATAFRWWQPQHGKHSAQWALDDVLIGMNDSSQTGFQDKFDGSIDLQANWYRIQGGQVDIDCLSMDTALIFTENIGKPRYAETWDFHVSASTFLQFEMSMGCSKPFSNSHSVQLQYSLNNGKDWHLVTEECVPPTIGCLHYTESSIYTSERFQNWKRITVYLPLSTISPRTRFRWIQANYTVGADSWAIDNVVLASGCPWMCSGRGICDAGRCVCDRGFGGPYCVPVVPLPSILKDDFNGNLHPDLWPEVYGAERGNLNGETIKSGTSLIFKGEGLRMLISRDLDCTNTMYVQFSLRFIAKSTPERSHSILLQFSISGGITWHLMDEFYFPQTTNILFINVPLPYTAQTNATRFRLWQPYNNGKKEEIWIVDDFIIDGNNVNNPVMLLDTFDFGPREDNWFFYPGGNIGLYCPYSSKGAPEEDSAMVFVSNEVGEHSITTRDLNVNENTIIQFEINVGCSTDSSSADPVRLEFSRDFGATWHLLLPLCYHSSSHVSSLCSTEHHPSSTYYAGTMQGWRREVVHFGKLHLCGSVRFRWYQGFYPAGSQPVTWAIDNVYIGPQCEEMCNGQGSCINGTKCICDPGYSGPTCKISTKNPDFLKDDFEGQLESDRFLLMSGGKPSRKCGILSSGNNLFFNEDGLRMLMTRDLDLSHARFVQFFMRLGCGKGVPDPRSQPVLLQYSLNGGLSWSLLQEFLFSNSSNVGRYIALEIPLKARSGSTRLRWWQPSENGHFYSPWVIDQILIGGNISGNTVLEDDFTTLDSRKWLLHPGGTKMPVCGSTGDALVFIEKASTRYVVSTDVAVNEDSFLQIDFAASCSVTDSCYAIELEYSVDLGLSWHPLVRDCLPTNVECSRYHLQRILVSDTFNKWTRITLPLPPYTRSQATRFRWHQPAPFDKQQTWAIDNVYIGDGCIDMCSGHGRCIQGNCVCDEQWGGLYCDDPETSLPTQLKDNFNRAPSSQNWLTVNGGKLSTVCGAVASGMALHFSGGCSRLLVTVDLNLTNAEFIQFYFMYGCLITPNNRNQGVLLEYSVNGGITWNLLMEIFYDQYSKPGFVNILLPPDAKEIATRFRWWQPRHDGLDQNDWAIDNVLISGSADQRTVMLDTFSSAPVPQHERSPADAGPVGRIAFDMFMEDKTSVNEHWLFHDDCTVERFCDSPDGVMLCGSHDGREVYAVTHDLTPTEGWIMQFKISVGCKVSEKIAQNQIHVQYSTDFGVSWNYLVPQCLPADPKCSGSVSQPSVFFPTKGWKRITYPLPESLVGNPVRFRFYQKYSDMQWAIDNFYLGPGCLDNCRGHGDCLREQCICDPGYSGPNCYLTHTLKTFLKERFDSEEIKPDLWMSLEGGSTCTECGILAEDTALYFGGSTVRQAVTQDLDLRGAKFLQYWGRIGSENNMTSCHRPICRKEGVLLDYSTDGGITWTLLHEMDYQKYISVRHDYILLPEDALTNTTRLRWWQPFVISNGIVVSGVERAQWALDNILIGGAEINPSQLVDTFDDVRRYP

SEQ ID NO: 745255 - protein, 2101 aa, Homo sapiens
MERSGWARQTFLLALLLGATLRARAAAGYYPRFSPFFFLCTHHGELEGDGEQGEVLISLHIAGNPTYYVPGQEYHVTISTSTFFDGLLVTGLYTSTSVQASQSIGGSSAFGFGIMSDHQFGNQFMCSVVASHVSHLPTTNLSFIWIAPPAGTGCVNFMATATHRGQVIFKDALAQQLCEQGAPTDVTVHPHLAEIHSDSIILRDDFDSYHQLQLNPNIWVECNNCETGEQCGAIMHGNAVTFCEPYGPRELITTGLNTTTASVLQFSIGSGSCRFSYSDPSIIVLYAKNNSADWIQLEKIRAPSNVSTIIHILYLPEDAKGENVQFQWKQENLRVGEVYEACWALDNILIINSAHRQVVLEDSLDPVDTGNWLFFPGATVKHSCQSDGNSIYFHGNEGSEFNFATTRDVDLSTEDIQEQWSEEFESQPTGWDVLGAVIGTECGTIESGLSMVFLKDGERKLCTPSMDTTGYGNLRFYFVMGGICDPGNSHENDIILYAKIEGRKEHITLDTLSYSSYKVPSLVSVVINPELQTPATKFCLRQKNHQGHNRNVWAVDFFHVLPVLPSTMSHMIQFSINLGCGTHQPGNSVSLEFSTNHGRSWSLLHTECLPEICAGPHLPHSTVYSSENYSGWNRITIPLPNAALTRNTRIRWRQTGPILGNMWAIDNVYIGPSCLKFCSGRGQCTRHGCKCDPGFSGPACEMASQTFPMFISESFGSSRLSSYHNFYSIRGAEVSFGCGVLASGKALVFNKDGRRQLITSFLDSSQSRFLQFTLRLGSKSVLSTCRAPDQPGEGVLLHYSYDNGITWKLLEHYSYLSYHEPRIISVELPGDAKQFGIQFRWWQPYHSSQREDVWAIDEIIMTSVLFNSISLDFTNLVEVTQSLGFYLGNVQPYCGHDWTLCFTGDSKLASSMRYVETQSMQIGASYMIQFSLVMGCGQKYTPHMDNQVKLEYSTNHGLTWHLVQEECLPSMPSCQEFTSASIYHASEFTQWRRVIVLLPQKTWSSATRFRWSQSYYTAQDEWALDSIYIGQQCPNMCSGHGSCDHGICRCDQGYQGTECHPEAALPSTIMSDFENQNGWESDWQEVIGGEIVKPEQGCGVISSGSSLYFSKAGKRQLVSWDLDTSWVDFVQFYIQIGGESASCNKPDSREEGVLLQYSNNGGIQWHLLAEMYFSDFSKPRFVYLELPAAAKTPCTRFRWWQPVFSGEDYDQWAVDDIIILSEKQKQIIPVINPTLPQNFYEKPAFDYPMNQMSVWLMLANEGMVKNETFCAATPSAMIFGKSDGDRFAVTRDLTLKPGYVLQFKLNIGCANQFSSTAPVLLQYSHDAGMSWFLVKEGCYPASAGKGCEGNSRELSEPTMYHTGDFEEWTRITIVIPRSLASSKTRFRWIQESSSQKNVPPFGLDGVYISEPCPSYCSGHGDCISGVCFCDLGYTAAQGTCVSNVPNHNEMFDRFEGKLSPLWYKITGAQVGTGCGTLNDGKSLYFNGPGKREARTVPLDTRNIRLVQFYIQIGSKTSGITCIKPRTRNEGLIVQYSNDNGILWHLLRELDFMSFLEPQIISIDLPQDAKTPATAFRWWQPQHGKHSAQWALDDVLIGMNDSSQTGFQDKFDGSIDLQANWYRIQGGQVDIDCLSMDTALIFTENIGKPRYAETWDFHVSASTFLQFEMSMGCSKPFSNSHSVQLQYSLNNGKDWHLVTEECVPPTIGCLHYTESSIYTSERFQNWKRITVYLPLSTISPRTRFRWIQANYTVGADSWAIDNVVLASGCPWMCSGRGICDAGRCVCDRGFGGPYCVPVVPLPSILKDDFNGNLHPDLWPEVYGAERGNLNGETIKSGTSLIFKGEGLRMLISRDLDCTNTMYVQFSLRFIAKSTPERSHSILLQFSISGGITWHLMDEFYFPQTTNILFINVPLPYTAQTNATRFRLWQPYNNGKKEEIWIVDDFIIDGNNVNNPVMLLDTFDFGPREDNWFFYPGGNIGLYCPYSSKGAPEEDSAMVFVSNEVGEHSITTRDLNVNENTIIQFEINVGCSTDSSSADPVRLEFSRDFGATWHLLLPLCYHSSSHVSSLCSTEHHPSSTYYAGTMQGWRREVVHFGKLHLCG

SEQ ID NO: 745256 - protein, 925 aa, Homo sapiens
MERSGWARQTFLLALLLGATLRARAAAGYYPRFSPFFFLCTHHGELEGDGEQGEVLISLHIAGNPTYYVPGQEYHVTISTSTFFDGLLVTGLYTSTSVQASQSIGGSSAFGFGIMSDHQFGNQFMCSVVASHVSHLPTTNLSFIWIAPPAGTGCVNFMATATHRGQVIFKDALAQQLCEQGAPTDVTVHPHLAEIHSDSIILRDDFDSYHQLQLNPNIWVECNNCETGEQCGAIMHGNAVTFCEPYGPRELITTGLNTTTASVLQFSIGSGSCRFSYSDPSIIVLYAKNNSADWIQLEKIRAPSNVSTIIHILYLPEDAKGENVQFQWKQENLRVGEVYEACWALDNILIINSAHRQVVLEDSLDPVDTGNWLFFPGATVKHSCQSDGNSIYFHGNEGSEFNFATTRDVDLSTEDIQEQWSEEFESQPTGWDVLGAVIGTECGTIESGLSMVFLKDGERKLCTPSMDTTGYGNLRFYFVMGGICDPGNSHENDIILYAKIEGRKEHITLDTLSYSSYKVPSLVSVVINPELQTPATKFCLRQKNHQGHNRNVWAVDFFHVLPVLPSTMSHMIQFSINLGCGTHQPGNSVSLEFSTNHGRSWSLLHTECLPEICAGPHLPHSTVYSSENYSGWNRITIPLPNAALTRNTRIRWRQTGPILGNMWAIDNVYIGPSCLKFCSGRGQCTRHGCKCDPGFSGPACEMASQTFPMFISESFGSSRLSSYHNFYSIRGAEVSFGCGVLASGKALVFNKDGRRQLITSFLDSSQSRFLQFTLRLGSKSVLSTCRAPDQPGEGVLLHYSYDNGITWKLLEHYSYLSYHEPRIISVELPGDAKQFGIQFRWWQPYHSSQREDVWAIDEIIMTSVLFNSISLDFTNLVEVTQSLGFYLGNVQPYCGHDWTLWLECNGAISTHCNLCLPGSNDTFSI

SEQ ID NO: 745257 - protein, 3446 aa, Homo sapiens
MERSGWARQTFLLALLLGATLRARAAAGYYPRFSPFFFLCTHHGELEGDGEQGEVLISLHIAGNPTYYVPGQEYHVTISTSTFFDGLLVTGLYTSTSVQASQSIGGSSAFGFGIMSDHQFGNQFMCSVVASHVSHLPTTNLSFIWIAPPAGTGCVNFMATATHRGQVIFKDALAQQLCEQGAPTDVTVHPHLAEIHSDSIILRDDFDSYHQLQLNPNIWVECNNCETGEQCGAIMHGNAVTFCEPYGPRELITTGLNTTTASVLQFSIGSGSCRFSYSDPSIIVLYAKNNSADWIQLEKIRAPSNVSTIIHILYLPEDAKGENVQFQWKQENLRVGEVYEACWALDNILIINSAHRQVVLEDSLDPVDTGNWLFFPGATVKHSCQSDGNSIYFHGNEGSEFNFATTRDVDLSTEDIQEQWSEEFESQPTGWDVLGAVIGTECGTIESGLSMVFLKDGERKLCTPSMDTTGYGNLRFYFVMGGICDPGNSHENDIILYAKIEGRKEHITLDTLSYSSYKVPSLVSVVINPELQTPATKFCLRQKNHQGHNRNVWAVDFFHVLPVLPSTMSHMIQFSINLGCGTHQPGNSVSLEFSTNHGRSWSLLHTECLPEICAGPHLPHSTVYSSENYSGWNRITIPLPNAALTRNTRIRWRQTGPILGNMWAIDNVYIGPSCLKFCSGRGQCTRHGCKCDPGFSGPACEMASQTFPMFISESFGSSRLSSYHNFYSIRGAEVSFGCGVLASGKALVFNKDGRRQLITSFLDSSQSRFLQFTLRLGSKSVLSTCRAPDQPGEGVLLHYSYDNGITWKLLEHYSYLSYHEPRIISVELPGDAKQFGIQFRWWQPYHSSQREDVWAIDEIIMTSVLFNSISLDFTNLVEVTQSLGFYLGNVQPYCGHDWTLCFTGDSKLASSMRYVETQSMQIGASYMIQFSLVMGCGQKYTPHMDNQVKLEYSTNHGLTWHLVQEECLPSMPSCQEFTSASIYHASEFTQWRRVIVLLPQKTWSSATRFRWSQSYYTAQDEWALDSIYIGQQCPNMCSGHGSCDHGICRCDQGYQGTECHPEAALPSTIMSDFENQNGWESDWQEVIGGEIVKPEQGCGVISSGSSLYFSKAGKRQLVSWDLDTSWVDFVQFYIQIGGESASCNKPDSREEGVLLQYSNNGGIQWHLLAEMYFSDFSKPRFVYLELPAAAKTPCTRFRWWQPVFSGEDYDQWAVDDIIILSEKQKQIIPVINPTLPQNFYEKPAFDYPMNQMSVWLMLANEGMVKNETFCAATPSAMIFGKSDGDRFAVTRDLTLKPGYVLQFKLNIGCANQFSSTAPVLLQYSHDAGMSWFLVKEGCYPASAGKGCEGNSRELSEPTMYHTGDFEEWTRITIVIPRSLASSKTRFRWIQESSSQKNVPPFGLDGVYISEPCPSYCSGHGDCISGVCFCDLGYTAAQGTCVSNVPNHNEMFDRFEGKLSPLWYKITGAQVGTGCGTLNDGKSLYFNGPGKREARTVPLDTRNIRLVQFYIQIGSKTSGITCIKPRTRNEGLIVQYSNDNGILWHLLRELDFMSFLEPQIISIDLPQDAKTPATAFRWWQPQHGKHSAQWALDDVLIGMNDSSQTGFQDKFDGSIDLQANWYRIQGGQVDIDCLSMDTALIFTENIGKPRYAETWDFHVSASTFLQFEMSMGCSKPFSNSHSVQLQYSLNNGKDWHLVTEECVPPTIGCLHYTESSIYTSERFQNWKRITVYLPLSTISPRTRFRWIQANYTVGADSWAIDNVVLASGCPWMCSGRGICDAGRCVCDRGFGGPYCVPVVPLPSILKDDFNGNLHPDLWPEVYGAERGNLNGETIKSGTSLIFKGEGLRMLISRDLDCTNTMYVQFSLRFIAKSTPERSHSILLQFSISGGITWHLMDEFYFPQTTNILFINVPLPYTAQTNATRFRLWQPYNNGKKEEIWIVDDFIIDGNNVNNPVMLLDTFDFGPREDNWFFYPGGNIGLYCPYSSKGAPEEDSAMVFVSNEVGEHSITTRDLNVNENTIIQFEINVGCSTDSSSADPVRLEFSRDFGATWHLLLPLCYHSSSHVSSLCSTEHHPSSTYYAGTMQGWRREVVHFGKLHLCGSVRFRWYQGFYPAGSQPVTWAIDNVYIGPQCEEMCNGQGSCINGTKCICDPGYSGPTCKISTKNPDFLKDDFEGQLESDRFLLMSGGKPSRKCGILSSGNNLFFNEDGLRMLMTRDLDLSHARFVQFFMRLGCGKGVPDPRSQPVLLQYSLNGGLSWSLLQEFLFSNSSNVGRYIALEIPLKARSGSTRLRWWQPSENGHFYSPWVIDQILIGGNISGNTVLEDDFTTLDSRKWLLHPGGTKMPVCGSTGDALVFIEKASTRYVVSTDVAVNEDSFLQIDFAASCSVTDSCYAIELEYSVDLGLSWHPLVRDCLPTNVECSRYHLQRILVSDTFNKWTRITLPLPPYTRSQATRFRWHQPAPFDKQQTWAIDNVYIGDGCIDMCSGHGRCIQGNCVCDEQWGGLYCDDPETSLPTQLKDNFNRAPSSQNWLTVNGGKLSTVCGAVASGMALHFSGGCSRLLVTVDLNLTNAEFIQFYFMYGCLITPNNRNQGVLLEYSVNGGITWNLLMEIFYDQYSKPGFVNILLPPDAKEIATRFRWWQPRHDGLDQNDWAIDNVLISGSADQRTVMLDTFSSAPVPQHERSPADAGPVGRIAFDMFMEDKTSVNEHWLFHDDCTVERFCDSPDGVMLCGSHDGREVYAVTHDLTPTEGWIMQFKISVGCKVSEKIAQNQIHVQYSTDFGVSWNYLVPQCLPADPKCSGSVSQPSVFFPTKGWKRITYPLPESLVGNPVRFRFYQKYSDMQWAIDNFYLGPGCLDNCRGHGDCLREQCICDPGYSGPNCYLTHTLKTFLKERFDSEEIKPDLWMSLEGGSTCTECGILAEDTALYFGGSTVRQAVTQDLDLRGAKFLQYWGRIGSENNMTSCHRPICRKEGVLLDYSTDGGITWTLLHEMDYQKYISVRHDYILLPEDALTNTTRLRWWQPFVISNGIVVSGVERAQWALDNILIGGAEINPSQLVDTFDDEGTSHEENWSFYPNAVRTAGFCGNPSFHLYWPNKKKDKTHNALSSRELIIQPGYMMQFKIVVGCEATSCGDLHSVMLEYTKDARSDSWQLVQTQCLPSSSNSIGCSPFQFHEATIYNSVNSSSWSTQFRWIQKGEETEKQSWAIDHVYIGEACPKLCSGHGYCTTGAICICDESFQGDDCSVFSHDLPSYIKDNFESARVTEANWETIQGGVIGSGCGQLAPYAHGDSLYFNGCQIRQAATKPLDLTRASKIMFVLQIGSMSQTDSCNSDLSGPHAVDKAVLLQYSVNNGITWHVIAQHQPKDFTQAQRVSYNVPLEARMKGVLLRWWQPRHNGTGHDQWALDHVEVVLVSTRKQNYMMNFSRQHGLRHFYNRRRRSLRRYP

SEQ ID NO: 745258 - protein, 414 aa, Homo sapiens
SNFPQENNMPYCFQFSLTEGTSHEENWSFYPNAVRTAGFCGNPSFHLYWPNKKKDKTHNALSSRELIIQPGYMMQFKIVVGCEATSCGDLHSVMLEYTKDARSDSWQLVQTQCLPSSSNSIGCSPFQFHEATIYNSVNSSSWKRITIQLPDHVSSSATQFRWIQKGEETEKQSWAIDHVYIGEACPKLCSGHGYCTTGAICICDESFQGDDCSVFSHDLPSYIKDNFESARVTEANWETIQGGVIGSGCGQLAPYAHGDSLYFNGCQIRQAATKPLDLTRASKIMFVLQIGSMSQTDSCNSDLSGPHAVDKAVLLQYSVNNGITWHVIAQHQPKDFTQAQRVSYNVPLEARMKGVLLRWWQPRHNGTGHDQWALDHVEVVLVSTRKQNYMMNFSRQHGLRHFYNRRRRSLRRYP

SEQ ID NO: 745259 - protein, 3460 aa, Homo sapiens; identical to SEQ ID NO: 745252

SEQ ID NO: 745260 - protein, 187 aa, Homo sapiens
RISLEKLFVTACWLGLEDCLQLSKELFAKWVDHPENEIPYPIKDVVLCYGIALGSDKEWDILLNTYTNTTNKEEKIQLAYAMSCSKDPWILNRYMEYAISTSPFTSNETNIIEVVASSEVGRYVAKDFLVNNWQAVSKRAFMGICLTVTCRQAHRHRLHTKAHVGVEYIANSSAGTAAPFSQAQNSS

SEQ ID NO: 745261 - protein, 184 aa, Homo sapiens
RISLEKLFVTACWLGLEDCLQLSKELFAKWVDHPENEIPYPIKDVVLCYGIALGSDKEWDILLNTYTNTTNKEEKIQLAYAMSCSKDPWILNRYMEYAISTSPFTSNETNIIEVVASSEVGRYVAKDFLVNNWQAVSKRYGTQSLINLIYTIGRTVTTDLQIVEAEFLLGSLFPCGEKHSSPLI

SEQ ID NO: 745262 - protein, 150 aa, Homo sapiens
RISLEKLFVTACWLGLEDCLQLSKELFAKWVDHPENEIPYPIKDVVLCYGIALGSDKEWDILLNTYTNTTNKEEKIQLAYAMSCSKDPWILNRYMEYAISTSPFTSNETNIIEVVASSEVGRYVAKDFLVNNWQAVSKSLLFTFLTTATL

SEQ ID NO: 745263 - protein, 117 aa, Homo sapiens
MCHYSSLGSELKRVTWFLHALMSPTCKIEAANQKGSRWPSLLWRGKSHFLLSRALLLLPGTCSQPGGRYGRTWGSSQCQYSSWPGHLDSYREVPFPTLLGDLLLRPSSKAFITLIHN

SEQ ID NO: 745264 - protein, 485 aa, Homo sapiens
ARGRGGRSLPARCSRRRSEAALSSQRDLFSSPFFLNSSSRERLVVTGRAGWMGMGRGAGRSALGFWPTLAFLLCSFPAATSPCKILKCNSEFWSATSGSHAPASDDTPEFCAALRSYALCTRRTARTCRGDLAYHSAVHGIEDLMSQHNCSKDGPTSQPRLRTLPPAGDSQERSDSPEICHYEKSFHKHSATPNYTHCGLFGDPHLRTFTDRFQTCKVQGAWPLIDNNYLNVQVTNTPVLPGSAATATSKLTIIFKNFQECVDQKVYQAEMDELPAAFVDGSKNGGDKHGANSLKITEKVSGQHVEIQAKYIGTTIVVRQVGRYLTFAVRMPEEVVNAVEDWDSQGLYLCLRGCPLNQQIDFQAFHTNAEGTGARRLAAASPAPTAPETFPYETAVAKCKEKLPVEDLYYQACVFDLLTTGDVNFTLAAYYALEDVKMLHSNKDKLHLYERTRDLPGRAAAGLPLAPRPLLGALVPLLALLPVFC

SEQ ID NO: 745265 - protein, 74 aa, Homo sapiens
QEASGADGEGGSGNQVLTQGQALLGFRRPNAQLHTLPTHRQPLCCSPGTSHTLARRLQNVLPLPAGFSWSLCWK

SEQ ID NO: 745266 - protein, 485 aa, Homo sapiens; identical to SEQ ID NO: 745264

SEQ ID NO: 745267 - protein, 485 aa, Homo sapiens; identical to SEQ ID NO: 745264

SEQ ID NO: 745268 - protein, 537 aa, Homo sapiens
ERWLRRPSRWAGEALAVRSRAGSARRSQACSPGAGGAPRAAAEPAGAAGTSASGAPPTLPRGRRAAPRHPLFSRSPASATPRGPQGLMQPPRERLVVTGRAGWMGMGRGAGRSALGFWPTLAFLLCSFPAATSPCKILKCNSEFWSATSGSHAPASDDTPEFCAALRSYALCTRRTARTCRGDLAYHSAVHGIEDLMSQHNCSKDGPTSQPRLRTLPPAGDSQERSDSPEICHYEKSFHKHSATPNYTHCGLFGDPHLRTFTDRFQTCKVQGAWPLIDNNYLNVQVTNTPVLPGSAATATSKLTIIFKNFQECVDQKVYQAEMDELPAAFVDGSKNGGDKHGANSLKITEKVSGQHVEIQAKYIGTTIVVRQVGRYLTFAVRMPEEVVNAVEDWDSQGLYLCLRGCPLNQQIDFQAFHTNAEGTGARRLAAASPAPTAPETFPYETAVAKCKEKLPVEDLYYQACVFDLLTTGDVNFTLAAYYALEDVKMLHSNKDKLHLYERTRDLPGRAAAGLPLAPRPLLGALVPLLALLPVFC

SEQ ID NO: 745269 - protein, 485 aa, Homo sapiens; identical to SEQ ID NO: 745264

SEQ ID NO: 745270 - protein, 326 aa, Homo sapiens
ARGRGGRSLPARCSRRRSEAALSSQRDLFSSPFFLNSSSRERLVVTGRAGWMGMGRGAGRSALGFWPTLAFLLCSFPAATSPCKILKCNSEFWSATSGSHAPASDDTPEFCAALRSYALCTRRTARTCRGDLAYHSAVHGIEDLMSQHNCSKDGPTSQPRLRTLPPAGDSQERSDSPEICHYEKSFHKHSATPNYTHCGLFGDPHLRTFTDRFQTCKVQGAWPLIDNNYLNVQVTNTPVLPGSAATATSKLTIIFKNFQECVDQKVYQAEMDELPAAFVDGSKNVSPPPSKRSCSLCQNRVWAGGRALGARPLPLPAGFSWSLCWK

SEQ ID NO: 745271 - protein, 727 aa, Homo sapiens
MQLKSLVEPSSQAWCGQDFTYVPVSDCPLGIIRLVSLMVAKVTAAVPDVTSVLRNIQNKRKYRDPVSQNSSKSPESHCELNKITCPPLNQQLVARVVYWLSQIMYLTLRTGEIGEGESRISFPETTWIPDGNCDFGEGESSPDPEDVTNRNPAQLNTLNCVDKQGLQELEGNERRLHQSEQGGFMEENERLEPNPEEIKDLGNGVGRWKGRNIAHVLCQTSSKPSVCRAWWLTPVIPTLWEAETGGSPEVRSSRQDWPTWRNPVSTKIQKLVRHGGALLQSQLLRRLRWGHCLNPGGRGCGEPRLCLCTAAWVIKQNSISKKKKKFSVCIISVNPYNDLQVWYHHYPHFTVEKLKPRGHTVSVEVETWTQLVWLEKLVPGAMTLVSKVDSGHLGSLHECEVSGLTSGHHRGSAECEVLPSAVLFLGQRGSEPKHNSFESLPNFDLNHVKPCAFPAHQMDSSDKARCWFCSLLGGLECIIHSLLSLSFPICKIDTVIPHLLIEQIYSCLIFAGPGRPRNKDEGDSACPQGPPSLAEEMDIKSERLMESSGKHRSGSDQLSLSGSGKASKKGTSEPHLEWLEEFARQPLGAEFCENQISCVKEMFYKLGCLSLLGSYLSLHCCCRKHKKCPRNPSLELRVPRIRGRGRVLNACYSLGSSSCHTRPVWLHLSLNFMLTQNNHLEFHEIITSLFLLLCLLLLHTHLATSNLFPGNVIDPHSTHAASAPFYL

SEQ ID NO: 745272 - protein, 81 aa, Homo sapiens
FQASEGSRHLEIQTSKTPVAIFRNEAGPPGMKGTWRFKSMTAPGPLWLENIIRAKLVIPYSELKCSLHILLGEVTGQSALT

SEQ ID NO: 745273 - protein, 242 aa, Homo sapiens
MGKAKISLQSGRRQTLRESLHLIVLLTDLLPHLPVQVDLNRQAVQEDLRLPQVLPHHPFPKITIQIPKGTVMVGKPSSHSQYTSSGSVSSSGSKSHHSHSSSSSSSASTSGKMKSSKSEGSSSSKLSSSMYSSQGSSGSSQSKNSSQSGGKPGSSPITKHGLSSGSSSTKMKPQGKPSSLMNPSLSKPNISPSSFKATWEALTSFASPMKPVPGTPPSSKAKSPISSGSGGSHMSGTSSSSG

SEQ ID NO: 745274 - protein, 211 aa, Homo sapiens
MASKVALAKLPRVAVQPRADGVAVIIPAIMSSFLGTGAETMPVPLGAGMRRTSSGSVSSSGSKSHHSHSSSSSSSASTSGKMKSSKSEGSSSSKLSSSMYSSQGSSGSSQSKNSSQSGGKPGSSPITKHGLSSGSSSTKMKPQGKPSSLMNPSLSKPNISPSSFKATWEALTSFASPMKPVPGTPPSSKAKSPISSGSGGSHMSGTSSSSG

SEQ ID NO: 745275 - protein, 111 aa, Homo sapiens
PFQGSQIWPVFLPFPLRVAPRPGPSPAPGLSVFFLRACSFLHTRKQIARGKDHSAARQFPSTWTKHLLRPVCLNRTCTWQSSLVHTRFLGIATDLKIPATAPSPQGLALSD

SEQ ID NO: 745276 - protein, 104 aa, Homo sapiens
MALTQGPLTFRDVAIEFSQEEWKSLDPVQKALYWDVMLENYRNLVFLGILPKCMTKELPPIGNSNTGEKCQTVTLERHECYDVENFYLREIQKNLQDLEFQWKD

SEQ ID NO: 745277 - protein, 111 aa, Homo sapiens; identical to SEQ ID NO: 745275

SEQ ID NO: 745278 - protein, 112 aa, Homo sapiens
AFQLQWDTELEMSRGERSNKMKTKGQGNNGLSPHLWEGACVFRQIKMMTPFTPTPWDSFPTLLRSCSPTMQTQPLQAALFPVGTYLIKWFESPGFHQKHISLMFFCVLLTKL

SEQ ID NO: 745279 - protein, 270 aa, Homo sapiens
PGPWVGPAGAPGDGEAAGENSLREPCADPASPGQALAPPPPAAGRAGASSRAAPPPVFVLEYYLDTLWKGMLLFIISVVLVSFSSLREVWAPGPDPHRPPPLRAGPAPLRLSAWRPQVQKQETWVFLVYGVGVGLWLVISSLPRRRLVLNHTRGVYHFSIQGRTVCQGPLHLVYVRLALSSDAHGRCFFHLVLGGHRLEPLVLVQLSEHYEQMEYLGRYIARKLNINYFDYLATSYRHVVRHWPPPGAGTVMGKSPMGHKPSSSQSSLEV

SEQ ID NO: 745280 - protein, 242 aa, Homo sapiens
MTEVVPSSALSEVSLRLLCHDDIDTVKHLCGDWFPIEYPDSWYRDITSNKKFFSLAATYRGAIVGMIVAEIKNRTKIHKEDGDILASNFSVDTQVAYILSLGVVKEFRKHGIGSLLLESLKDHISTTAQDHCKAIYLHVLTTNNTAINFYENRDFKQHHYLPYYYSIRGVLKDGFTYVLYINGGHPPWTILDYIQHLGSALASLSPCSIPHRVYRQAHSLLCSFLPWSGISSKSGIEYSRTM

SEQ ID NO: 745281 - protein, 205 aa, Homo sapiens
MTEVVPSSALSEVSLRLLCHDDIDTVKHLCGDWFPIEYPDSWYRDITSNKKFFSLAATYRGAIVGMIVAEIKNRTKIHKEDGDILASNFSVDTQVAYILSLGVVKEFRKHGIGSLLLESLKDHISTTAQDHCKAIYLHVLTTNNTAINFYENRDFKQHHYLPYYYSIPKGFLQKGFHPNVPPYIQTGGGATPPLGIFGELNIPKP

SEQ ID NO: 745282 - protein, 242 aa, Homo sapiens; identical to SEQ ID NO: 745280

SEQ ID NO: 745283 - protein, 242 aa, Homo sapiens; identical to SEQ ID NO: 745280

SEQ ID NO: 745284 - protein, 242 aa, Homo sapiens; identical to SEQ ID NO: 745280

SEQ ID NO: 745285 - protein, 242 aa, Homo sapiens; identical to SEQ ID NO: 745280

SEQ ID NO: 745286 - protein, 213 aa, Homo sapiens
MTEVVPSSALSEVSLRLLCHDDIDTVKHLCGDWFPIEYPDSWYRDITSNKKFFSLAATYRGAIVGMIVAEIKNRTKIHKEDGDILASNFSVDTQVAYILSLGVVKEFRKHGIGSLLLESLKDHISTTAQDHCKAIYLHVLTTNNTAINFYENRDFKQHHYLPYYYSIRGVLKDGFTYVLYINGGHPPWTILDYIQHLGSALASLSPCSIPHRV

SEQ ID NO: 745287 - protein, 242 aa, Homo sapiens; identical to SEQ ID NO: 745280

SEQ ID NO: 745288 - protein, 220 aa, Homo sapiens
TFTNCILLGAVLFTRYPDSWYRDITSNKKFFSLAATYRGAIVGMIVAEIKNRTKIHKEDGDILASNFSVDTQVAYILSLGVVKEFRKHGIGSLLLESLKDHISTTAQDHCKAIYLHVLTTNNTAINFYENRDFKQHHYLPYYYSIRGVLKDGFTYVLYINGGHPPWTILDYIQHLGSALASLSPCSIPHRVYRQAHSLLCSFLPWSGISSKSGIEYSRTM

SEQ ID NO: 745289 - protein, 177 aa, Homo sapiens
MIVAEIKNRTKIHKEDGDILASNFSVDTQVAYILSLGVVKEFRKHGIGSLLLESLKDHISTTAQDHCKAIYLHVLTTNNTAINFYENRDFKQHHYLPYYYSIRGVLKDGFTYVLYINGGHPPWTILDYIQHLGSALASLSPCSIPHRVYRQAHSLLCSFLPWSGISSKSGIEYSRTM

SEQ ID NO: 745290 - protein, 177 aa, Homo sapiens
MTEVVPSSALSEVSLRLLCHDDIDTVKHLCGDWFPIEYPDSWYRDITSNKKFFSLAATYRGAIVGMIVAEIKNRTKIHKEDGDILASNFSVDTQVAYILSLGVVKEFRKHGIAARPTACSAASCHGRASLPRVASSTAGPCDVGWAAATRPHPSAARRARLPVHLTPSVFCKELPAI

SEQ ID NO: 745291 - protein, 242 aa, Homo sapiens; identical to SEQ ID NO: 745280

SEQ ID NO: 745292 - protein, 242 aa, Homo sapiens; identical to SEQ ID NO: 745280

SEQ ID NO: 745293 - protein, 242 aa, Homo sapiens; identical to SEQ ID NO: 745280

SEQ ID NO: 745294 - protein, 242 aa, Homo sapiens; identical to SEQ ID NO: 745280

SEQ ID NO: 745295 - protein, 158 aa, Homo sapiens
MTEVVPSSALSEVSLRLLCHDDIDTVKHLCGDWFPIEYPDSWYRDITSNKKFFSLAATYRGAIVGMIVAEIKNRTKIHKEDGDILASNFSVDTQVAYILSLGVVKEFRKHGIGSLLLESLKDHISTTAQDHCKAIYLHVLMLPQAAAPRPGHMQTGGS

SEQ ID NO: 745296 - protein, 193 aa, Homo sapiens
MTEVVPSSALSEVSLRLLCHDDIDTVKHLCGDWFPIEYPDSWYRDITSNKKFFSLAATYRGAIVGMIVAEIKNRTKIHKEDGDILASNFSVDTQVAYILSLGVVKEFRKHGIGSLLLESLKDHISTTAQDHCKAIYLHVLTTNNTAINFYENRDFKQHHYLPYYYSIRGVLKDGFTYVLYINGGHPPWTILYP

SEQ ID NO: 745297 - protein, 202 aa, Homo sapiens
MTEVVPSSALSEVSLRLLCHDDIDTVKHLCGDWFPIEYPDSWYRDITSNKKFFSLAATYRGAIVGMIVAEIKNRTKIHKEDGDILASNFSVDTQVAYILSLGVVKEFRKHGIGSLLLESLKDHISTTAQDHCKAIYLHVLTTNNTSHSTPSLTSLITTTKSTPHNASSFTSVSATTGITSRSTPIFTSSIPPPTHLTHTPTH

SEQ ID NO: 745298 - protein, 103 aa, Homo sapiens
GNDTIWGGGPKRVFVKLRSHHVTPEQSCVHRTESHPQYRVQVLDPAPPPSSPSPSCPPAPAPTICRTPVCHTMAPLHLLFPHPGAPLPSFHPLLYSGSPRRHS

SEQ ID NO: 745299 - protein, 91 aa, Homo sapiens
MEWNGMNLKTMEWNPMEWKGHEWNGMEWNGLEWKRLEFSGMESNGMEWNGFECNRMESNGKECSVMEWNGMEWNRMQWNLKDSIAMECTRM

SEQ ID NO: 745300 - protein, 370 aa, Homo sapiens
MLPRLICINDYEQHAKSVLPKSIYDYYRSGANDEETLADNIAAFSRWKLYPRMLRNVAETDLSTSVLGQRVSMPICVGATAMQRMAHVDGELATVRACQSLGTGMMLSSWATSSIEEVAEAGPEALRWLQLYIYKDREVTKKLVRQAEKMGYKAIFVTVDTPYLGNRLDDVRNRFKLPPQLRMKNFETSTLSFSPEENFGDDSGLAAYVAKAIDPSISWEDIKWLRRLTSLPIVAKGILRGDDAREAVKHGLNGILVSNHGARQLDGVPATIDVLPEIVEAVEGKVEVFLDGGVRKGTDVLKALALGAKAVFVGRPIVWGLAFQGEKGVQDVLEILKEEFRLAMALSGCQNVKVIDKTLVRKNPLAVSKI

SEQ ID NO: 745301 - protein, 174 aa, Homo sapiens
LSPHLRMRNFETSTLSFSPEDHWEDIKWLRRLTSLPIVAKGILRGDDAREAVKHGLNGILVSNHGARQLDGVPATIDVLPEIVEAVEGKVEVFLDGGVRKGTDVLKALALGAKAVFVGRPIVWGLAFQGEKGVQDVLEILKEEFRLAMALSGCQNVKVIDKTLVRKNPLAVSKI

SEQ ID NO: 745302 - protein, 370 aa, Homo sapiens; identical to SEQ ID NO: 745300

SEQ ID NO: 745303 - protein, 370 aa, Homo sapiens; identical to SEQ ID NO: 745300

SEQ ID NO: 745304 - protein, 1012 aa, Homo sapiens
MPFGLKLRRTRRYNVLSKNCFVTRIRLLDSNVIECTLSVESTGQECLEAVAQRLELRETHYFGLWFLSKSQQARWVELEKPLKKHLDKFANEPLLFFGVMFYVPNVSWLQQEATRYQYYLQVKKDVLEGRLRCTLDQVIRLAGLAVQADFGDYNQFDSQDFLREYVLFPMDLALEEAVLEELTQKVAQEHKAHSGILPAEAELMYINEVERLDGFGQEIFPVKDNHGNCVHLGIFFMGIFVRNRIGRQAVIYRWNDMGNITHNKSTILVELINKEETALFHTDDIENAKYISRLFATRHKFYKQNKICTEQSNSPPPIRRQPTWSRSSLPRQQPYILPPVHVQCGEHYSETHTSQDSIFHGNEEALYCNSHNSLDLNYLNGTVTNGSVCSVHSVNSLNCSQSFIQASPVSSNLSIPGSDIMRADYIPSHRHSAIIVPSYRPTPDYETVMRQMKRGILHTDSQSQSLRNLNIINTHAYNQPEDLVYSQPEMRERHPYTVPYGPQGVYSNKLVSPSDQRNPKNNVVPSKPGASAISHTVSTPELANMQLQGSHNYSTAHMLKNYLFRPPPPYPRPRPATSTPDLASHRHKYVSGSSPDLVTRKVQLSVKTFQEDSSPVVHQSLQEVSEPLTATKHHGTVNKRHSLEVMNSMVRGMEAMTLKSLHLPMARRNTLREQGPPEEGSGSHEVPQLPQYHHKKTFSDATMLIHSSESEEEEEEAPESVPQIPMLREKMEYSAQLQAALARIPNKPPPEYPGPRKSVSNGALRQDQASLPPAMARARVLRHGPAKAISMSRTDPPAVNGASLGPSISEPDLTSVKERVKKEPVKERPVSEMFSLEDSIIEREMMIRNLEKQKMAGLEAQKRPLMLAALNGLSVARVSGREENRVDATRVPMDERFRTLKKKLEEGMVFTEYEQIPKKKANGIFSTAALPENAERSRIREVVPYEENRVELIPTKENNTGYINASHIKVVVGGAEWHYIATQGPLPHTCHDFWQMVWEQGVNVIAMVTAEE

SEQ ID NO: 745305 - protein, 122 aa, Homo sapiens
AFSCTWTWAVGECFLNEGMRNAQREASCLRTLCFLSFLAEGGSAHDAEAPQGAEDVHDPDYRSVQVCLPSPHPVPPKLQTHLITPIQLLEEGPSSIALEESHLQTTSAPPTGVQVAGSKQAL

SEQ ID NO: 745306 - protein, 1187 aa, Homo sapiens
MPFGLKLRRTRRYNVLSKNCFVTRIRLLDSNVIECTLSVESTGQECLEAVAQRLELRETHYFGLWFLSKSQQARWVELEKPLKKHLDKFANEPLLFFGVMFYVPNVSWLQQEATRYQYYLQVKKDVLEGRLRCTLDQVIRLAGLAVQADFGDYNQFDSQDFLREYVLFPMDLALEEAVLEELTQKVAQEHKAHSGILPAEAELMYINEVERLDGFGQEIFPVKDNHGNCVHLGIFFMGIFVRNRIGRQAVIYRWNDMGNITHNKSTILVELINKEETALFHTDDIENAKYISRLFATRHKFYKQNKICTEQSNSPPPIRRQPTWSRSSLPRQQPYILPPVHVQCGEHYSETHTSQDSIFHGNEEALYCNSHNSLDLNYLNGTVTNGSVCSVHSVNSLNCSQSFIQASPVSSNLSIPGSDIMRADYIPSHRHSAIIVPSYRPTPDYETVMRQMKRGILHTDSQSQSLRNLNIINTHAYNQPEDLVYSQPEMRERHPYTVPYGPQGVYSNKLVSPSDQRNPKNNVVPSKPGASAISHTVSTPELANMQLQGSHNYSTAHMLKNYLFRPPPPYPRPRPATSTPDLASHRHKYVSGSSPDLVTRKVQLSVKTFQEDSSPVVHQSLQEVSEPLTATKHHGTVNKRHSLEVMNSMVRGMEAMTLKSLHLPMARRNTLREQGPPEEGSGSHEVPQLPQYHHKKTFSDATMLIHSSESEEEEEEAPESVPQIPMLREKMEYSAQLQAALARIPNKPPPEYPGPRKSVSNGALRQDQASLPPAMARARVLRHGPAKAISMSRTDPPAVNGASLGPSISEPDLTSVKERVKKEPVKERPVSEMFSLEDSIIEREMMIRNLEKQKMAGLEAQKRPLMLAALNGLSVARVSGREENRVDATRVPMDERFRTLKKKLEEGMVFTEYEQIPKKKANGIFSTAALPENAERSRIREVVPYEENRVELIPTKENNTGYINASHIKVVVGGAEWHYIATQGPLPHTCHDFWQMVWEQGVNVIAMVTAEEEGGRTKSHRYWPKLGSKHSSATYGKFKVTTKFRTDSVCYATTGLKVKHLLSGQERTVWHLQYTDWPDHGCPEDVQGFLSYLEEIQSVRRHTNSMLEGTKNRHPPIVVHCSAGVGRTGVLILSELMIYCLEHNEKVEVPMMLRLLREQRMFMIQTIAQYKFVYQVLIQFLQNSRLI

SEQ ID NO: 745307 - protein, 137 aa, Homo sapiens
MEYSAQLQAALARIPNKPPPEYPGPRKSVSNGALRQDQASLPPAMARARVLRHGPAKAISMSRTDPPAVNGASLGPSISEPDLTSVKERVKKEPVKERPVSEMFSLEDSIIEREMMIRVSVLLSQGIFQCESTCFRH

SEQ ID NO: 745308 - protein, 1268 aa, Homo sapiens
CPSLDIRSEVAELRQLENCSVVEGHLQILLMFTATGEDFRGLSFPRLTQVTDYLLLFRVYGLESLRDLFPNLAVIRGTRLFLGYALVIFEMPHLRDVALPALGAVLRGAVRVEKNQELCHLSTIDWGLLQPAPGANHIVGNKLGEECADVCPGVLGAAGEPCAKTTFSGHTDYRCWTSSHCQRVCPCPHGMACTARGECCHTECLGGCSQPEDPRACVACRHLYFQGACLWACPPGTYQYESWRCVTAERCASLHSVPGRASTFGIHQGSCLAQCPSGFTRNSSSIFCHKCEGLCPKECKVGTKTIDSIQAAQDLVGCTHVEGSLILNLRQGYNLEPQLQHSLGLVETITGFLKIKHSFALVSLGFFKNLKLIRGDAMVDGNYTLYVLDNQNLQQLGSWVAAGLTIPVGKIYFAFNPRLCLEHIYRLEEVTGTRGRQNKAEINPRTNGDRAACQTRTLRFVSNVTEADRILLRWERYEPLEARDLLSFIVYYKESPFQNATEHVGPDACGTQSWNLLDVELPLSRTQEPGVTLASLKPWTQYAVFVRAITLTTEEDSPHQGAQSPIVYLRTLPAAPTVPQDVISTSNSSSHLLVRWKPPTQRNGNLTYYLVLWQRLAEDGDLYLNDYCHRGLRLPTSNNDPRFDGEDGDPEAEMESDCCPCQHPPPGQVLPPLEAQEASFQKKFENFLHNAITIPISPWKVTSINKSPQRDSGRHRRAAGPLRLGGNSSDFEIQEDKVPRERAVLSGLRHFTEYRIDIHACNHAAHTVGCSAATFVFARTMPHREADGIPGKVAWEASSKNSVLLRWLEPPDPNGLILKYEIKYRRLGEEATVLCVSRLRYAKFGGVHLALLPPGNYSARVRATSLAGNGSWTDSVAFYILGPEEEDAGGLHVLLTATPVGLTLLIVLAALGFFYGKKRNRTLYASVNPEYFSASDMYVPDEWEVPREQISIIRELGQGSFGMVYEGLARGLEAGEESTPVALKTVNELASPRECIEFLKEASVMKAFKCHHVVRLLGVVSQGQPTLVIMELMTRGDLKSHLRSLRPEAENNPGLPQPALGEMIQMAGEIADGMAYLAANKFVHRDLAARNCMVSQDFTVKIGDFGMTRDVYETDYYRKGGKGLLPVRWMAPESLKDGIFTTHSDVWSFGVVLWEIVTLAEQPYQGLSNEQVLKFVMDGGVLEELEGCPLQLQELMSRCWQPNPRLRPSFTHILDSIQEELRPSFRLLSFYYSPECRGARGSLPTTDAEPDSSPTPRDCSPQNGGPGH

SEQ ID NO: 745309 - protein, 1345 aa, Homo sapiens
CPSLDIRSEVAELRQLENCSVVEGHLQILLMFTATGEDFRGLSFPRLTQVTDYLLLFRVYGLESLRDLFPNLAVIRGTRLFLGYALVIFEMPHLRDVALPALGAVLRGAVRVEKNQELCHLSTIDWGLLQPAPGANHIVGNKLGEECADVCPGVLGAAGEPCAKTTFSGHTDYRCWTSSHCQRVCPCPHGMACTARGECCHTECLGGCSQPEDPRACVACRHLYFQGACLWACPPGTYQYESWRCVTAERCASLHSVPGRASTFGIHQGSCLAQCPSGFTRNSSSIFCHKCEGLCPKECKVGTKTIDSIQAAQDLVGCTHVEGSLILNLRQGYNLEPQLQHSLGLVETITGFLKIKHSFALVSLGFFKNLKLIRGDAMVDGNYTLYVLDNQNLQQLGSWVAAGLTIPVGKIYFAFNPRLCLEHIYRLEEVTGTRGRQNKAEINPRTNGDRAACQTRTLRFVSNVTEADRILLRWERYEPLEARDLLSFIVYYKESPFQNATEHVGPDACGTQSWNLLDVELPLSRTQEPGVTLASLKPWTQYAVFVRAITLTTEEDSPHQGAQSPIVYLRTLPAAPTVPQDVISTSNSSSHLLVRWKPPTQRNGNLTYYLVLWQRLAEDGDLYLNDYCHRGLRLPTSNNDPRFDGEDGDPEAEMESDCCPCQHPPPGQVLPPLEAQEASFQKKFENFLHNAITIPISPWKVTSINKSPQRDSGRHRRAAGPLRLGGNSSDFEIQEDKVPRERAVLSGLRHFTEYRIDIHACNHAAHTVGCSAATFVFARTMPHRGDPHTHLLPPSPTPRTLCKGLGFDFSLTPEPRFAVPLSVPIIPKLSPPPSSAQFSLGLNKGEMNHFWPGCWMPLPAGEADGIPGKVAWEASSKNSVLLRWLEPPDPNGLILKYEIKYRRLGEEATVLCVSRLRYAKFGGVHLALLPPGNYSARVRATSLAGNGSWTDSVAFYILGPEEEDAGGLHVLLTATPVGLTLLIVLAALGFFYGKKRNRTLYASVNPEYFSASDMYVPDEWEVPREQISIIRELGQGSFGMVYEGLARGLEAGEESTPVALKTVNELASPRECIEFLKEASVMKAFKCHHVVRLLGVVSQGQPTLVIMELMTRGDLKSHLRSLRPEAENNPGLPQPALGEMIQMAGEIADGMAYLAANKFVHRDLAARNCMVSQDFTVKIGDFGMTRDVYETDYYRKGGKGLLPVRWMAPESLKDGIFTTHSDVWSFGVVLWEIVTLAEQPYQGLSNEQVLKFVMDGGVLEELEGCPLQLQELMSRCWQPNPRLRPSFTHILDSIQEELRPSFRLLSFYYSPECRGARGSLPTTDAEPDSSPTPRDCSPQNGGPGH

SEQ ID NO: 745310 - protein, 861 aa, Homo sapiens
MTPQLWGWVFSPFQNATEHVGPDACGTQSWNLLDVELPLSRTQEPGVTLASLKPWTQYAVFVRAITLTTEEDSPHQGAQSPIVYLRTLPAAPTVPQDVISTSNSSSHLLVRWKPPTQRNGNLTYYLVLWQRLAEDGDLYLNDYCHRGLRLPTSNNDPRFDGEDGDPEAEMESDCCPCQHPPPGQVLPPLEAQEASFQKKFENFLHNAITIPISPWKVTSINKSPQRDSGRHRRAAGPLRLGGNSSDFEIQEDKVPRERAVLSGLRHFTEYRIDIHACNHAAHTVGCSAATFVFARTMPHRGDPHTHLLPPSPTPRTLCKGLGFDFSLTPEPRFAVPLSVPIIPKLSPPPSSAQFSLGLNKGEMNHFWPGCWMPLPAGEADGIPGKVAWEASSKNSVLLRWLEPPDPNGLILKYEIKYRRLGEEATVLCVSRLRYAKFGGVHLALLPPGNYSARVRATSLAGNGSWTDSVAFYILGPEEEDAGGLHVLLTATPVGLTLLIVLAALGFFYGKKRNRTLYASVNPEYFSASDMYVPDEWEVPREQISIIRELGQGSFGMVYEGLARGLEAGEESTPVALKTVNELASPRECIEFLKEASVMKAFKCHHVVRLLGVVSQGQPTLVIMELMTRGDLKSHLRSLRPEAENNPGLPQPALGEMIQMAGEIADGMAYLAANKFVHRDLAARNCMVSQDFTVKIGDFGMTRDVYETDYYRKGGKGLLPVRWMAPESLKDGIFTTHSDVWSFGVVLWEIVTLAEQPYQGLSNEQVLKFVMDGGVLEELEGCPLQLQELMSRCWQPNPRLRPSFTHILDSIQEELRPSFRLLSFYYSPECRGARGSLPTTDAEPDSSPTPRDCSPQNGGPGH

SEQ ID NO: 745311 - protein, 149 aa, Homo sapiens
MWVAPLQGSQASREVGATALPPASLGLAGLCSDNTAVAGPLQLSRAQFPCWPHYGIGPCVDTDELTPQMPPGRSPRLQWPNSCCVRNQLKESFLLSQTLQEFLVTGRGSDSGPQPLAGKGATSWVGMPSSSVGPARPSLRGSSEHHPRT

SEQ ID NO: 745312 - protein, 108 aa, Homo sapiens
MGAISRAARGWGGGGRRAPGGRSGRGRGLGDPAAHAGTRRPRPGPLPSFVFVLRGRPQPRATGSAGLRGRPGSHRLLRKPRTGLALTPGRPPLPTQLWAPRSDLPVAL

SEQ ID NO: 745313 - protein, 115 aa, Homo sapiens
MPSSSVGPARPSLRGSSEQLAWLRGIFSYRSSPPPSPQQSSPNQTRSRQVGLGFCQPPGQQGWVGRLGPVSAVLPGPRPGWEGTLVLISRLHFCASLCCHKQRSQPHFLDGESGH

SEQ ID NO: 745314 - protein, 115 aa, Homo sapiens; identical to SEQ ID NO: 745313

SEQ ID NO: 745315 - protein, 100 aa, Homo sapiens
VPLLPQGREDGLRSDPRGSMEPPAFAPSLFPGLNLDGEKKLKCFGDGGLKTLGSLIAQPWAHFPFDREDSAPRSRLLGAPGRACAGNAKEDKRPASMLAP

SEQ ID NO: 745316 - protein, 215 aa, Homo sapiens
MGQTIPTDNNKNKPIKTQTNHPQRKTKNKNKTNTSPQPLAGKGATSWVGMPSSSVGPARPSLRGSSEQLAWLRGIFSVEEDQRPHQQHNKQNQNKHTPNKKTKNNQPPTNKKKQTKTRTRKQPKIPKFSVVIESIYSKIGKSARADRRRKAKPEDSVQKGRKKTEVPGGKGEMRSEDRRNGQKAVKMNGSKKVYERCGQGEHGQQGDRAGVELLS

SEQ ID NO: 745317 - protein, 115 aa, Homo sapiens; identical to SEQ ID NO: 745313

SEQ ID NO: 745318 - protein, 241 aa, Homo sapiens
MWVAPLQGSQASREVGATALPPASLGLAGLCSDNTAVAGPLQLSRAQFPCWPHYGIGPCVDTDELTPQMPPGRSPRLQWPNSCCVRNQLKESFLLSQTLQEFLVTGRGSDSGPQPLAGKGATSWVGMPSSSVGPARPSLRGSSEQLAWLRGIFSYRSSPPPSPQQSSPNQTRSRQVGLGFCQPPGQQGWVGRLGPVSAVLPGPRPGWEGTLVLISRLHFCASLCCHKQRSQPHFLDGESGH

SEQ ID NO: 745319 - protein, 633 aa, Homo sapiens
MSAGSERGAAATPGGLPAPCASKVELRLSCRHLLDRDPLTKSDPSVALLQQAQGQWVQVGRTEVVRSSLHPVFSKVFTVDYYFEEVQRLRFEVYDTHGPSGFSCQEDDFLGGMECTLGQPAQKWLLQVVMRVSVDVLGPAGHCAKHFLCCTESSHLARTGPSFLLRYDDLCLPWATAGAVRWWTCRGGHTQGWQIVAQKKVTRPLLLKFGRNAGKSTITVIAEDISGNNGYVELSFRARKLDDKDLFSKSDPFLELYRVNDDQGLQLVYRTEVVKNNLNPVWEAFKVSLSSLCSCEETRPLKCLVWDYDSRGKHDFIGEFSTTFEEMQKAFEEGQAQWDCVNPKYKQKRRSYKNSGVVVLADLKFHRVYSFLDYIMGGCQIHFTVAIDFTASNGDPRNSCSLHYINPYQPNEYLKALVSVGEICQDYDSDKRFSALGFGARIPPKYEVSHDFAINFNPEDDECEGIQGVVEAYQNCLPRVQLYGPTNVAPIISKVARVAAAEESTGKASQYYILLILTDGVVTDMADTREAIVRASRLPMSIIIVGVGNADFTDMQVLDGDDGVLRSPRGEPALRDIVQFVPFRELKNASPAALAKCVLAEVPKQVVEYYSHRGLPPRSLGVPAGEASPGCTP

SEQ ID NO: 745320 - protein, 558 aa, Homo sapiens
MSAGSERGAAATPGGLPAPCASKVELRLSCRHLLDRDPLTKSDPSVALLQQAQGQWVQVGRTEVVRSSLHPVFSKVFTVDYYFEEVQRLRFEVYDTHGPSGFSCQEDDFLGGMECTLGQIVAQKKVTRPLLLKFGRNAGKSTITVIAEDISGNNGYVELSFRARKLDDKDLFSKSDPFLELYRVNDDQGLQLVYRTEVVKNNLNPVWEAFKVSLSSLCSCEETRPLKCLVWDYDSRGKHDFIGEFSTTFEEMQKAFEEGQAQWDCVNPKYKQKRRSYKNSGVVVLADLKFHRVYSFLDYIMGGCQIHFTVAIDFTASNGDPRNSCSLHYINPYQPNEYLKALVSVGEICQDYDSDKRFSALGFGARIPPKYEVSHDFAINFNPEDDECEGIQGVVEAYQNCLPRVQLYGPTNVAPIISKVARVAAAEESTGKASQYYILLILTDGVVTDMADTREAIVRASRLPMSIIIVGVGNADFTDMQVLDGDDGVLRSPRGEPALRDIVQFVPFRELKNASPAALAKCVLAEVPKQVVEYYSHRGLPPRSLGVPAGEASPGCTP

SEQ ID NO: 745321 - protein, 109 aa, Homo sapiens [sequence omitted]

SEQ ID NO: 745322 - protein, 143 aa, Homo sapiens
TSPTAPTSPTGPHAWPCLSQVGGGREIMRDLEGAGSSSTGDPAPMRRGRDWGLCFASNLCGGGPARQSPHARESLGDPDTCPHSQSLGTQTSCPHSQPPVPAGAPTPTYPVLFAVGPLHLGPWGLRGLRGLPGLWVLPVGLQE

SEQ ID NO: 745323 - protein, 169 aa, Homo sapiens
VQGGRAHPLPPTGIQGVVEAYQNCLPRVQLYGPTNVAPIISKVARVAAAEESTGKASVGARGVWCMLGVGSAVCAPARGRQGGTWQREQPAQRPPGRTELRRAGAQLVDYVSLKGAGVSGTGLSIASHGHGHGCSEAAPLLFLWAPQGRAHVYCLAVCVSSFCLHVSFL

SEQ ID NO: 745324 - protein, 42 aa, Homo sapiens
MAAARLPLSSSSGHHKAAHMSTVWLCVYRHFVYMCLSFAQMI

SEQ ID NO: 745325 - protein, 513 aa, Homo sapiens
MSAGSERGAAATPGGLPAPCASKVELRLSCRHLLDRDPLTKSDPSVALLQQAQGQWVQVGRTEVVRSSLHPVFSKVFTVDYYFEEVQRLRFEVYDTHGPSGFSCQEDDFLGGMECTLGQIVAQKKVTRPLLLKFGRNAGKSTITVIAEDISGNNGYVELSFRARKLDDKDLFSKSDPFLELYRVNDDQGLQLVYRTEVVKNNLNPVWEAFKVSLSSLCSCEETRPLKCLVWDYDSRGKHDFIGEFSTTFEEMQKAFEEGQAQWDCVNPKYKQKRRSYKNSGVVVLADLKFHRVYSFLDYIMGGCQIHFTVAIDFTASNGDPRNSCSLHYINPYQPNEYLKALVSVGEICQDYDSDKRFSALGFGARIPPKYEVSHDFAINFNLRTMSVKQYYILLILTDGVVTDMADTREAIVRASRLPMSIIIVGVGNADFTDMQVLDGDDGVLRSPRGEPALRDIVQFVPFRELKNASPAALAKCVLAEVPKQVVEYYSHRGLPPRSLGVPAGEASPGCTP

SEQ ID NO: 745326 - protein, 321 aa, Homo sapiens
MSAGSERGAAATPGGLPAPCASKVELRLSCRHLLDRDPLTKSDPSVALLQQAQGQWVQVGRTEVVRSSLHPVFSKVFTVDYYFEEVQRLRFEVYDTHGPSGFSCQEDDFLGGMECTLGQIVAQKKVTRPLLLKFGRNAGKSTITVIAEDISGNNGYVELSFRARKLDDKDLFSKSDPFLELYRVNDDQGLQLVYRTEVVKNNLNPVWEAFKVSLSSLCSCEETRPLKCLVWDYDSRGKHDFIGEFSTTFEEMQKAFEEGQAQWDCVNPKYKQKRRSYKNSGVVVLADLKFHRVYSFLDYIMGGCQIHFTTKRERGETGVSV

SEQ ID NO: 745327 - protein, 220 aa, Homo sapiens
PKYKQKRRSYKNSGVVVLADLKFHRVYSFLDYIMGGCQIHFTTKRERGETGDERLNQPQSLRVIQGARHRPRVTPMSPADPASPIDTHTPCHPHVTRVSPTDTRPPCHPRVTHRYTAPVSPRVTHRYTAPVSPACHTHRYTAPVSPACHPQIHGPRVTRVLFADALVRVLLNEPQNGFGRSQQVGNVGGPRPGLVHLGPAGEGGRGVGRPLRRMGGAPTR

SEQ ID NO: 745328 - protein, 151 aa, Homo sapiens [sequence omitted]

SEQ ID NO: 745329 - protein, 348 aa, Homo sapiens
QTLPSWRLKGTRMLKEILKIDGSNTVDHKNEIKQIANEIPVSSNRRDEYGLPSQPKQNKKLASYMNKPHSANEYHNVQSMDNMCWPAPSQIPPVSTPVTELSRICSLVGMPQPDFSFLRMPQTMTVCQVKLSNGLLVHGPQCHSENEAKEKAALFALQQLGSLGMNFPLPSQVFANYPSAVPPGTIPPAFPPPTANIMPSSSHLFGSMPWGPSVPVPGKPFHHTLYSGTMPMAGGIPGGVHNQFIPLQVTKKRVANKKNFENKEAQSSQATPVQTSQPDSSNIVKVSPRESSSASLKSSPIAQPASSFQVETASQGHSISHHKSTPISSSRRKSRKLAVNFGVSKPSE

SEQ ID NO: 745330 - protein, 528 aa, Homo sapiens
VLEDPRYTVEAVSDGETKFYLEEPPGTQKLYSGRTAPPSKVVHLGDKEQSNWAKEVQGISEHYLRRKGIIINETSAVVYAQLLTGRKYQINQNGEVRLEKQWSKQVVPFVYQTIVKDIRAFDSRFSNIKTLDDLFPLRSMVFMLGTPYYGCTGEVQDSGDVITEGRIRVIFSIPCEPNLDALIQNQHKYSIKYNPGYVLASRLGVSGYLVSRFTGSIFIGRGSRRNPHGDHKANVGLNLKFNKKNEEVPGYTKKVGSEWMYSSAAEQLLAEYLERAPELFSYIAKNSQEDVFYEDDIWPGENENGAEKVQEIITWLKGHPVSTLSRSSCDLQILDAAIVEKIEEEVEKCKQRKNNKKVRVTVKPHLLYRPLEQQHGVIPDRDAEFCLFDRVVNVRENFSVPVGLRGTIIGIKGANREADVLFEVLFDEEFPGGLTIRCSPGRGYRLPTSALVNLSHGSRSETGNQKLTAIVKPQPAVHQHSSSSSVSSGHLGALNHSPQSLFVPTQVRLSVFNFSSTPFTNHKSQQTL

SEQ ID NO: 745331 - protein, 485 aa, Homo sapiens
VLEDPRYTVEAVSDGETKFYLEEPPGTQKLYSGRTAPPSKVVHLGDKEQSNWAKEVQGISEHYLRRKGIIINETSAVVYAQLLTGRKYQINQNGEVRLEKQWSKQVVPFVYQTIVKDIRAFDSRFSNIKTLDDLFPLRSMVFMLGTPYYGCTGEVQDSGDVITEGRIRVIFSIPCEPNLDALIQNQHKYSIKYNPGYVLASRLGVSGYLVSRFTGSIFIGRGSRRNPHGDHKANVGLNLKFNKKNEEVPGYTKKVGSEWMYSSAAEQLLAEYLERAPELFSYIAKNSQEDVFYEDDIWPGENENGAEKVQEIITWLKGHPVSTLSRSSCDLQILDAAIVEKIEEEVEKCKQRKNNKKVRVTVKPHLLYRPLEQQHGVIPDRDAEFCLFDRVVNVRENFSVPVGLRGTIIGIKGANREADVLFEVLFDEEFPGGLTIRCSPGRGYRLPTSALVNLSHGSRSETGNQKLTAIVKPQPAVHQHSSSTY

SEQ ID NO: 745332 - protein, 431 aa, Homo sapiens
HFGFMLKAVQWILHYYYHGVQSWSWYYPYHYAPFLSDIHNISTLKIHFELGKPFKPFEQLLAVLPAASKNLLPACYQHLMTNEDSPIIEYYPPDFKTDLNGKQQEWEAVVLIPFIDEERLLEAMETCNHSLKKEERKRNQHSECLMCWYDRDTEFIYPSPWPEKFPAIERCCTRYKIISLDAWRVDINKNKITRIDQKALYFCGFPTLKHIRHKFFLKKSGVQVFQQSSRGENMMLEILVDAESDELTVENVASSVLGKSVFVNWPHLEEARVVAVSDGETKFYLEEPPGTQKLYSGRTAPPSKVVHLGDKEQSNWAKEVQGISEHYLRRKGIIINETSAVVYAQLLTGRKYQINQNGEVRLEKQWSKQVVPFVYQTIVKDIRAFDSRFSNIKTLDDLFPLRSMVFMLGTPYYGCTGEVQDSGDVSRGDPL

SEQ ID NO: 745333 - protein, 1240 aa, Homo sapiens
HFGFMLKAVQWILHYYYHGVQSWSWYYPYHYAPFLSDIHNISTLKIHFELGKPFKPFEQLLAVLPAASKNLLPACYQHLMTNEDSPIIEYYPPDFKTDLNGKQQEWEAVVLIPFIDEERLLEAMETCNHSLKKEERKRNQHSECLMCWYDRDTEFIYPSPWPEKFPAIERCCTRYKIISLDAWRVDINKNKITRIDQKALYFCGFPTLKHIRHKFFLKKSGVQVFQQSSRGENMMLEILVDAESDELTVENVASSVLGKSVFVNWPHLEEARVVAVSDGETKFYLEEPPGTQKLYSGRTAPPSKVVHLGDKEQSNWAKEVQGISEHYLRRKGIIINETSAVVYAQLLTGRKYQINQNGEVRLEKQWSKQVVPFVYQTIVKDIRAFDSRFSNIKTLDDLFPLRSMVFMLGTPYYGCTGEVQDSGDVITEGRIRVIFSIPCEPNLDALIQNQHKYSIKYNPGYVLASRLGVSGYLVSRFTGSIFIGRGSRRNPHGDHKANVGLNLKFNKKNEEVPGYTKKVGSEWMYSSAAEQLLAEYLERAPELFSYIAKNSQEDVFYEDDIWPGENENGAEKVQEIITWLKGHPVSTLSRSSCDLQILDAAIVEKIEEEVEKCKQRKNNKKVRVTVKPHLLYRPLEQQHGVIPDRDAEFCLFDRVVNVRENFSVPVGLRGTIIGIKGANREADVLFEVLFDEEFPGGLTIRCSPGRGYRLPTSALVNLSHGSRSETGNQKLTAIVKPQPAVHQHSSSSSVSSGHLGALNHSPQSLFVPTQVPTKDDDEFCNIWQSLQGSGKMQYFQPTIQEKGAVLPQEISQVNQHHKSGFNDNSVKYQQRKHDPHRKFKEECKSPKAECWSQKMSNKQPNSGIENFLASLNISKENEVQSSHHGEPPSEEHLSPQSFAMKGTRMLKEILKIDGSNTVDHKNEIKQIANEIPVSSNRRDEYGLPSQPKQNKKLASYMNKPHSANEYHNVQSMDNMCWPAPSQIPPVSTPVTELSRICSLVGMPQPDFSFLRMPQTMTVCQVKLSNGLLVHGPQCHSENEAKEKAALFALQQLGSLGMNFPLPSQVFANYPSAVPPGTIPPAFPPPTANIMPSSSHLFGSMPWGPSVPVPGKPFHHTLYSGTMPMAGGIPGGVHNQFIPLQVTKKRVANKKNFENKEAQSSQATPVQTSQPDSSNIVKVSPRESSSASLKSSPIAQPASSFQVETASQGHSISHHKSTPISSSRRKSRKLAVNFGVSKPSE

SEQ ID NO: 745334 - protein, 1307 aa, Homo sapiens
MNYTSVSNNKHFLHYHSGIITWSMKFGPPYNLLNVDFISLFNDVRKLSGEWLLFMCVLTYALLPLRVFRPAVKGSHLLWCCQFCFILNFVPKQLLNNQNISSNCLELVNSILNLSKYNFLGYSRTSISNFYKIVSKSTGYNDYKLIFYKIKYEILVMLINKLYYFDSFLFAYLTFYESFIVGRYVVLLGTEEILIVVKFQGVLQYRRHSHQFVTYIIYCLFHSDSIFLVYAELFNDAGILSLHVICECVVQAVTVEIILEFMTISQQGLCLYIYIYLFFSFCDMLIFLRKYVIAYFFKSRNHNLYMEQLVISDFHELIGNSAMTLKVVLLVFENAGIKLNGLLSLTADFRVEMLAGYLCISSAFSIREKYSLSVIYHSRISFHDFIFCYFHKFQMFISSQHCFFICSGILSNEAQVNLNVYNYCLINSLFVFKGNIYYGEYKEKLNCDSNVILTLPTLKCEMFHLSCTNSSIENLPHSLLLCDSYINSMQLTSVLEHRRSGTCHLLKTPKGNFSRHSALKPIRILDQYLSTAADSSIQIGSERVLFSSQAQWLKSQHFGRLRQADHLRSGVPDKPGQHDEALSLLKIQKLAGRDGTCLQSQLLGRLRHENHLNPRGRVCSEPRLHHCTPAWRAEQDSVSKKRKKFYYPYFFFNIIILKVKTEKRLRRRELHNGWIVVRHSLFFSPCRPILNVGLEVNGRCALPMEDVRSRGHFCPMLRKQSVDRPGIQSISEKQLDFKKFKILSLRWGGLRPPPKFKNMLIQLESSEDFFVKMVDCLGHRTDSPNCFMLPHNYEHFNLFKPLSPNWNIISKYFYSISFFFFEQLKRILKIAPSSLVPFHIFLHYLIITSALEFECINLFKHHVDYSLKHLRLSCSCRKKLKSPLLNLGFNLRFFLLFKGVTNKDVKGFFPDWWRNEELLMQVFLLFLSMIRYLLFILDCYFQTKLDFLVLMRGGREREADGRRKTVKEDIPSHCIFGLYRIFLAQGNRQTVRSFLLTFYLCVLFVLVITVYSGCLIFTLLYEIELCRSSLKLVLSRFFPLFRAQFFKATVQFLSLMSLLYFLVSCCFQILFYCRRQLIYCQRSGCESRSLSLKINCRSSFVIFLEINYSTQTGSAQYIHFVSFVSETISFAGASFPSQDKALKFQKLMSFGLTLFIFPSNFSNTVRDSVEPASSLQKHGRADRPLSFTDIIDPFLKEEKHVENSFSESKMSTICSCFCVCVSEQIIMPCSINAFSHLKCNLRRRLWFPKDTFFYKVKPVKSLFFFPSSLHQLHLVVSAVGILLNCPGQIGFCSCFSNLKPNSHAVSH

SEQ ID NO: 745335 - protein, 638 aa, Homo sapiens
VLEDPRYTVEAVSDGETKFYLEEPPGTQKLYSGRTAPPSKVVHLGDKEQSNWAKEVQGISEHYLRRKGIIINETSAVVYAQLLTGRKYQINQNGEVRLEKQWSKQVVPFVYQTIVKDIRAFDSRFSNIKTLDDLFPLRSMVFMLGTPYYGCTGEVQDSGDVITEGRIRVIFSIPCEPNLDALIQNQHKYSIKYNPGYVLASRLGVSGYLVSRFTGSIFIGRGSRRNPHGDHKANVGLNLKFNKKNEEVPGYTKKVGSEWMYSSAAEQLLAEYLERAPELFSYIAKNSQEDVFYEDDIWPGENENGAEKVQEIITWLKGHPVSTLSRSSCDLQILDAAIVEKIEEEVEKCKQRKNNKKVRVTVKPHLLYRPLEQQHGVIPDRDAEFCLFDRVVNVRENFSVPVGLRGTIIGIKGANREADVLFEVLFDEEFPGGLTIRCSPGRGYRLPTSALVNLSHGSRSETGNQKLTAIVKPQPAVHQHSSSSSVSSGHLGALNHSPQSLFVPTQVPTKDDDEFCNIWQSLQGSGKMQYFQPTIQEKGAVLPQEISQVNQHHKSGFNDNSVKYQQRKHDPHRKFKEECKSPKAECWSQKMSNKQPNSGIENFLASLNISKENEVQSSHHGEPPSEEHLSPQSFAMKR

SEQ ID NO: 745336 - protein, 751 aa, Homo sapiens
VLEDPRYTVEAVSDGETKFYLEEPPGTQKLYSGRTAPPSKVVHLGDKEQSNWAKEVQGISEHYLRRKGIIINETSAVVYAQLLTGRKYQINQNGEVRLEKQWSKQVVPFVYQTIVKDIRAFDSRFSNIKTLDDLFPLRSMVFMLGTPYYGCTGEVQDSGDVITEGRIRVIFSIPCEPNLDALIQNQHKYSIKYNPGYVLASRLGVSGYLVSRFTGSIFIGRGSRRNPHGDHKANVGLNLKFNKKNEEVPGYTKKVGSEWMYSSAAEQLLAEYLERAPELFSYIAKNSQEDVFYEDDIWPGENENGAEKVQEIITWLKGHPVSTLSRSSCDLQILDAAIVEKIEEEVEKCKQRKNNKKVRVTVKPHLLYRPLEQQHGVIPDRDAEFCLFDRVVNVRENFSVPVGLRGTIIGIKGANREADVLFEVLFDEEFPGGLTIRCSPGRGYRLPTSALVNLSHGSRSETGNQKLTAIVKPQPAVHQHSSSSSVSSGHLGALNHSPQSLFVPTQVPTKDDDEFCNIWQSLQGSGKMQYFQPTIQEKGAVLPQEISQVNQHHKSGFNDNSVKYQQRKHDPHRKFKEECKSPKAECWSQKMSNKQPNSGIENFLASLNISKENEVQSSHHGEPPSEEHLSPQSFAMKGTRMLKEILKIDGSNTVDHKNEIKQIANEIPVSSNRRDEYGLPSQPKQNKKLASYMNKPHSANEYHNVQSMDNMCWPAPSQIPPVSTPVTELSRICSLVGMPQPDFSFLRMPQV

SEQ ID NO: 745337 - protein, 302 aa, Homo sapiens
VLEDPRYTVEAVSDGETKFYLEEPPGTQKLYSGRTAPPSKVVHLGDKEQSNWAKEVQGISEHYLRRKGIIINETSAVVYAQLLTGRKYQINQNGEVRLEKQWSKQVVPFVYQTIVKDIRAFDSRFSNIKTLDDLFPLRSMVFMLGTPYYGCTGEVQDSGDVITEGRIRVIFSIPCEPNLDALIQNQHKYSIKYNPGYVLASRLGVSGYLVSRFTGSIFIGRGSRRNPHGDHKANVGLNLKFNKKNEEVPGYTKKVGSEWMYSSAAEQLLAEYLERAPELFSYIAKNSQERLTGQERLTGRAT

SEQ ID NO: 745338 - protein, 179 aa, Homo sapiens
MPSKSLVMEYLAHPSTLGLAVGVACGMCLGWSLRVCFGMLPKSKTSKTHTDTESEASILGDSGEYKMILVVRNDLKMGKGKVAAQCSHAAVSAYKQIQRRNPEMLKQWEYCGQPKVVVKAPDEETLIALLAHAKMLGLTVSLIQDAGRTQIAPGSQTVLGIGPGPADLIDKVTGHLKLY

SEQ ID NO: 745339 - protein, 179 aa, Homo sapiens; identical to SEQ ID NO: 745338

SEQ ID NO: 745340 - protein, 181 aa, Homo sapiens
MVIAFVHRGFTFVHDGLGSYLQEEVACGMCLGWSLRVCFGMLPKSKTSKTHTDTESEASILGDSGEYKMILVVRNDLKMGKGKVAAQCSHAAVSAYKQIQRRNPEMLKQWEYCGQPKVVVKAPDEETLIALLAHAKMLGLTVSLIQDAGRTQIAPGSQTVLGIGPGPADLIDKVTGHLKLY

SEQ ID NO: 745341 - protein, 179 aa, Homo sapiens; identical to SEQ ID NO: 745338

SEQ ID NO: 745342 - protein, 432 aa, Homo sapiens
MEKLLVMWMEDQIQKRIPLSLLMIQAKARSLFNMLKDRASDPTYTQMFKASHGWFQRFKRRHNFHNVKITGEAARAGNEGAIAFKEQLHRIIMAKDLCNKELIALEEERGKGVEAVEEVTPTAPRKFTAKKLAEAFAAISSGLHVRRNGRQLREIRHSVTGQIQDALACYREIYSEKKKQAVRSKLGIFLKNNTMLAKPSTSVDVPMPSTTYSRCSSEEREIEDPVASPHPAINSISVLQTFFRTTVLSAVYIMPSKSLVMEYLAHPSTLGLAVGVACGMCLGWSLRVCFGMLPKSKTSKTHTDTESEASILGDSGEYKMILVVRNDLKMGKGKVAAQCSHAAVSAYKQIQRRNPEMLKQWEYCGQPKVVVKAPDEETLIALLAHAKMLGLTVSLIQDAGRTQIAPGSQTVLGIGPGPADLIDKVTGHLKLY

SEQ ID NO: 745343 - protein, 179 aa, Homo sapiens; identical to SEQ ID NO: 745338

SEQ ID NO: 745344 - protein, 418 aa, Homo sapiens
MAKLLQPPPKFLPSEWHIANKNQYHRADAQRSRSERLVAESQRLVDEIEKTTRKSQSDVNKKLEQRLEEVQFWKKELDDKLEQLVNVTDDLLIYKIRLEKALETLKEPLHITETCLAYREKRIGIDLVHDTVEHELIKEAEIIQGIMALLTRTLEEASEQIRMNRSAKYNLEKDLKDKFVALTIDDICFSLNNNSPNIRYSENAVRIEPNSVSLEDWLDFSSTNVEKADKQRNNSLMLKALVDRILSQTANDLRKQCDVVDTAFKNGLKDTKDARDKLADHLAKVMEEIASQEKNITALEKAILDQEGPAKVAHTRLETRTHRPNVELCRDVAQYRLMKEVQEITHNVARLKETLAQAQAELKGLHRRQLALQEEIQVKENTIYIDEVLCMQMRKSIPLRDGEDHGVWAGGLRPDAVC

SEQ ID NO: 745345 - protein, 102 aa, Homo sapiens
CCHGDRVVYLSVLQELEAPVGVRRLPSRACVVVLCGAEEFGNLKWLNYYNLHPSSCPQSGTLLTRTSTTEQTLKGPDQNAWSQKARGLWMKLKRPQENLKAM

SEQ ID NO: 745346 - protein, 322 aa, Homo sapiens
MAKLLQPPPKFLPSEWHIANKNQYHRADAQRSRSERLVAESQRLVDEIEKTTRKSQSDVNKKLEQRLEEVQFWKKELDDKLEQLVNVTDDLLIYKIRLEKALETLKEPLHITETCLAYREKRIGIDLVHDTVEHELIKEAEIIQGIMALLTRTLEEASEQIRMNRSAKYNLEKDLKDKFVALTIDDICFSLNNNSPNIRYSENAVRIEPNSVSLEDWLDFSSTNVEKADKQRNNSLMLKALVDRILSQTANDLRKQCDIEGNFSPSSGRAERAASQTACPAGGDPGQREHHLYRRSAVYADEEIHPTSGWGRPWGLGWGPPP

SEQ ID NO: 745347 - protein, 102 aa, Homo sapiens; identical to SEQ ID NO: 745345

SEQ ID NO: 745348 - protein, 272 aa, Homo sapiens
MALLTRTLEEASEQIRMNRSAKYNLEKDLKDKFVALTIDDICFSLNNNSPNIRYSENAVRIEPNSVSLEDWLDFSSTNVEKADKQRNNSLMLKALVDRILSQTANDLRKQCDVVDTAFKNGLKDTKDARDKLADHLAKVMEEIASQEKNITALEKAILDQEGPAKVAHTRLETRTHRPNVELCRDVAQYRLMKEVQEITHNVARLKETLAQAQAELKGLHRRQLALQEEIQVKENTIYIDEVLCMQMRKSIPLRDGEDHGVWAGGLRPDAVC

SEQ ID NO: 745349 - protein, 585 aa, Homo sapiens
MAKLWFKFQRYFRRKPVRFFTFLALYLTAGSLVFLHSGFVGQPAVSGNQANPAAAGGPAEGAELSFLGDMHLGRGFRDTGEASSIARRYGPWFKGKDGNERAKLGDYGGAWSRALKGRVVREKEEERAKYIGCYLDDTQSRALRGVSFFDYKKMTIFRCQDNCAERGYLYGGLEFGAECYCGHKIQATNVSEAECDMECKGERGSVCGGANRLSVYRLQLAQESARRYGSAVFRGCFRRPDNLSLALPVTAAMLNMSVDKCVDFCTEKEYPLAALAGTACHCGFPTTRFPLHDREDEQLCAQKCSAEEFESCGTPSYFIVYQTQVQDNRCMDRRFLPGKSKQLIALASFPGAGNTWARHLIELATGFYTGSYYFDGSLYNKGFKGERDHWRSGRTICIKTHESGQKEIEAFDAAILLIRNPYKALMAEFNRKYGGHIGFAAHAHWKGKGAVPGSLQILFRSICTASVGEWPEFVRNYAPWWATHTLDWLKFGKKVLVVHFEDLKQDLFVQLGRMVSLLGVAVREDRLLCVESQKDGNFKRSGLRKLEYDPYTADMQKTISAYIKMVDAALKGRNLTGVPDDYYPR

SEQ ID NO: 745350 - protein, 565 aa, Homo sapiens
MAKLWFKFQRYFRRKPVRFFTFLALYLTAGSLVFLHSGFVGQPAVSGNQANPAAAGGPAEGAELSFLGDMHLGRGFRDTGEASSIARRYGPWFKGKDGNERAKLGDYGGAWSRALKGRVVREKEEERAKYIGCYLDDTQSRALRGVSFFDYKKMTIFRCQDNCAERGYLYGGLEFGAECYCGHKIQATNVSEAECDMECKGERGSVCGGANRLSVYRLQLAQESARRYGSAVFRGCFRRPDNLSLALPVTAAMLNMSVDKCVDFCTEKEYPLAALAGTACHCGFPTTRFPLHDREDEQLCAQKCSAEEFESCGTPSYFIVYQTQVQDNRCMDRRFLPGKSKQLIALASFPGAGNTWARHLIELATGFYTGSYYFDGSLYNKGFKGERDHWRSGRTICIKTHESGQKEIEAFDAAILLIRNPYKALMAEFNRKYGGHIGFAAHAHWKGKEWPEFVRNYAPWWATHTLDWLKFGKKVLVVHFEDLKQDLFVQLGRMVSLLGVAVREDRLLCVESQKDGNFKRSGLRKLEYDPYTADMQKTISAYIKMVDAALKGRNLTGVPDDYYPR

SEQ ID NO: 745351 - protein, 369 aa, Homo sapiens
MAKLWFKFQRYFRRKPVRFFTFLALYLTAGSLVFLHSGFVGQPAVSGNQANPAAAGGPAEGAELSFLGDMHLGRGFRDTGEASSIARRYGPWFKGKDGNERAKLGDYGGAWSRALKGRVVREKEEERAKYIGCYLDDTQSRALRGVSFFDYKKMTIFRCQDNCAERGYLYGGLEFGAECYCGHKIQATNVSEAECDMECKGERGSVCGGANRLSVYRLQLAQESARRYGSAVFRGCFRRPDNLSLALPVTAAMLNMSVDKCVDFCTEKEYPLAALAGTACHCGFPTTRFPLHDREDEQLCAQKCSAEEFESCGTPSYFIVYQTQVQGELGPSPVDPRCTPSGFPPRRVPASPSHTACSKEKTMQARGQG

SEQ ID NO: 745352 - protein, 945 aa, Homo sapiens
TAYDGFVQYIPFDDPRLRHFKLAQPQGFCEDIKLDDKSYNSSPVTAQEPAHGGMQPDGAIWNPQSLIPPSGDERGLVLADSSPRWLWGQPPGDGENSGLPNQRDRCVARGQWPDVRGSQHGHTGRQVSSPYSQGESTCETQTKLKKFQTGTRTKKSSKKKMNETIFCLVSIPVKSESHLPDRDMDNNDLKPSADQKNGSDKSPALQEQSLLSMSSTDLELQALTGSMGGRTEFQKQDLGEPEEDRQTNDLSFIHLTKHRELKHSGSWPGHRYRDQQTQTSFSEEPQSSQLLPGAKLGGPSRAALSPKCSDPAASEAQTHTAFPTGDHKQRPSARNLKGHRSLSPSSNSAFSRTSLSVDQAPTPKAGRSQPCVDVHGLGAHPGPKREVVKGEPTGPCNSKQLFGQFLLKPVSRRPWDLISQLESFNKELQEEEESSSSSSSSSSSSEESEAEPQQENRAHCRQEDVGFRGNSPEMRVEPQPRMWVPESPVCRSGRGESKSESWSEELQPGHPRAWPPSPGRFRVEEGGGAPFCSADGSTSAEKGHLEVSNGMDELAGSPFPVTRMSSRSSDAKPLPASYPAEPREPQESPKITSAFSSVKPSEAVPRKFDSGGERGAGLPLSLSNKNRGLSAPDLRSVGLTPGQEQGASELEGSLGEASTIEIPPGESLQARAARILGIEVAVESLLPGIRRAGQNQPAEPDASACTPESPQEELLSRPAPADVPRVSTDAFYGRRKCGWTKSPLFVGDRDSARRAPQAFEHSDVDGVVTSTDPVPEPEPSPLESKFFEQKDVETKPPFRSTLFHFVERTPSVAGSEKRLRSPSKVIESLQEKLASPPRRADPDRLMRMKEVSSVSRMRVLSFRNADSQEDAEELKATTRGQAGLPGGLVSPGSGDRAQRLGHSLSVSKDSISREEKEHPAAQKEKSMDQDFWCPDSYDPSRVERV

SEQ ID NO: 745353 - protein, 683 aa, Homo sapiens
TAYDGFVQYIPFDDPRLRHFKLAQPQGFCEDIKLDDKSYNSSPVTAQEPAHGGMQPDGAIWNPQSLIPPSGDERGLVLADSSPRWLWGQPPGDGENSGLPNQRDRCVARGQWPDVRGSQHGHTGRQVSSPYSQGESTCETQTKLKKFQTGTRTKKSSKKKMNETIFCLVSIPVKSESHLPDRDMDNNDLKPSADQKNGSDKSPALQEQSLLSMSSTDLELQALTGSMGGRTEFQKQDLGEPEEDRQTNDLSFIHLTKHRELKHSGSWPGHRYRDQQTQTSFSEEPQSSQLLPGAKLGGPSRAALSPKCSDPAASEAQTHTAFPTGDHKQRPSARNLKGHRSLSPSSNSAFSRTSLSVDQAPTPKAGRSQPCVDVHGLGAHPGPKREVVKGEPTGPCNSKQLFGQFLLKPVSRRPWDLISQLESFNKELQEEEESSSSSSSSSSSSEESEAEPQQENRAHCRQEDVGFRGNSPEMRVEPQPRMWVPESPVCRRAPQAFEHSDVDGVVTSTDPVPEPEPSPLESKFFEQKDVETKPPFRSTLFHFVERTPSVAGSEKRLRSPSKVIESLQEKLASPPRRADPDRLMRMKEVSSVSRMRVLSFRNADSQEDAEELKATTRGQAGLPGGLVSPGSGDRAQRLGHSLSVSKDSISREEKEHPAAQKEKSMDQDFWCPDSYDPSRVERV

SEQ ID NO: 745354 - protein, 945 aa, Homo sapiens; identical to SEQ ID NO: 745352

SEQ ID NO: 745355 - protein, 842 aa, Homo sapiens
TAYDGFVQYIPFDDPRLRHFKLAQPQGFCEDIKLDDKSYNSSPVTAQEPAHGGMQPDGAIWNPQSLIPPSGDERGLVLADSSPRWLWGQPPGDGENSGLPNQRDRCVARGQWPDVRGSQHGHTGRQVSSPYSQGESTCETQTKLKKFQTGTRTKKSSKKKMNETIFCLVSIPVKSESHLPDRDMDNNDLKPSADQKNGSDKSPALQEQSLLSMSSTDLELQALTGSMGGRTEFQKQDLGEPEEDRQTNDLSFIHLTKHRELKHSGSWPGHRYRDQQTQTSFSEEPQSSQLLPGAKLGGPSRAALSPKCSDPAASEAQTHTAFPTGDHKQRPSARNLKGHRSLSPSSNSAFSRTSLSVDQAPTPKAGRSQPCVDVHGLGAHPGPKREVVKGEPTGPCNSKQLFGQFLLKPVSRRPWDLISQLESFNKELQEEEESSSSSSSSSSSSEESEAEPQQENRAHCRQEDVGFRGNSPEMRVEPQPRMWVPESPVCRSGRGESKSESWSEELQPGHPRAWPPSPGRFRVEEGGGAPFCSADGSTSAEKGASELEGSLGEASTIEIPPGESLQARAARILGIEVAVESLLPGIRRAGQNQPAEPDASACTPESPQEELLSRPAPADVPRVSTDAFYGRRKCGWTKSPLFVGDRDSARRAPQAFEHSDVDGVVTSTDPVPEPEPSPLESKFFEQKDVETKPPFRSTLFHFVERTPSVAGSEKRLRSPSKVIESLQEKLASPPRRADPDRLMRMKEVSSVSRMRVLSFRNADSQEDAEELKATTRGQAGLPGGLVSPGSGDRAQRLGHSLSVSKDSISREEKEHPAAQKEKSMDQDFWCPDSYDPSRVERV

SEQ ID NO: 745356 - protein, 945 aa, Homo sapiens; identical to SEQ ID NO: 745352

SEQ ID NO: 745357 - protein, 392 aa, Homo sapiens
MLKVLNYIFKGPFSMYSNIFNGSGDMDLEPLFYLQQLVLDFIIFYHSCNRERTISLGVASHNVCVGICVGVYLHSLNNCMIRKFLSLFQMFHVVIIVLQNPKGYVLLMKMSSLGGGEQVIMCRFFLAEVCFLWEQPSRINLFCFLFWELRPILRCPKSPSILFDLLIHIDLIAKYDHIDVVKLNTFVQIESLHLLSVKQWKTVMEKQTCFDRFICVKKVSILWNAADQIMSCRLCSKQHSSTTVLLSIPSLAVTEMKNISIDLCFALVQETICREPNIATEDLISCQKIQNLFPFKHDTLSFLVDLAKRKNIALNSPIPSVESLRIFSNELCMVLWYFMFPKENGYMKNLSSVIIFLTKILLVMVVLINLIVIMITQCLPISNHHIVYLKYI

SEQ ID NO: 745358 - protein, 114 aa, Homo sapiens
VRNRSLTEMMATGTPESQARFGQSVKGLLTEKVTTCGTDVIALTKQVLKGSRSSELLGQAARNMVLQEDAILHSEDSLRKMAIITTHLQYQQEAIQKNVEQSSDLQDQLNHLLK

SEQ ID NO: 745359 - protein, 114 aa, Homo sapiens; identical to SEQ ID NO: 745358

SEQ ID NO: 745360 - protein, 161 aa, Homo sapiens
MAGSEPRSGTNSPPPPFSDWGRLEAAILSGWKTFWQSVSKERVARTTSREEVDEAASTLTRLPVSVGRRPRRTVGPARAGGTSPGAPRGLGNSRAPAWVWLRPCSHSWQCSHREATVDQKRLGVDPGAPQGARTSQGSTFMGPLGTLPIALRFSTRQNRHM

SEQ ID NO: 745361 - protein, 361 aa, Homo sapiens
MAGSEPRSGTNSPPPPFSDWGRLEAAILSGWKTFWQSIDVQLYILSFLSPHDLCQLGSTNHYWNETVRDPILWRYFLLRDLPSWSSVDWKSLPDLEILKKPISEVTDGAFFDYMAVYRMCCPYTRRASKSSRPMYGAVTSFLHSLIIQNEPRFAMFGPGLEELNTSLVLSLMSSEELCPTAGLPQRQIDGIGSGVNFQLNNQHKFNILILYSTTRKERDRAREEHTSAVNKMFSRHNEGDDQQGSRYSVIPQIQKVCEVVDGFIYVANAEAHKRHEWQDEFSHIMAMTDPAFGSSGRPLLVLSCISQGDVKRMPCFYLAHELHLNLLNHPWLVQDTEAETLTGFLNGIEWILEEVESKRAR

SEQ ID NO: 745362 - protein, 253 aa, Homo sapiens
MKKLKFRLYRMCCPYTRRASKSSRPMYGAVTSFLHSLIIQNEPRFAMFGPGLEELNTSLVLSLMSSEELCPTAGLPQRQIDGIGSGVNFQLNNQHKFNILILYSTTRKERDRAREEHTSAVNKMFSRHNEGDDQQGSRYSVIPQIQKVCEVVDGFIYVANAEAHKRHEWQDEFSHIMAMTDPAFGSSGRPLLVLSCISQGDVKRMPCFYLAHELHLNLLNHPWLVQDTEAETLTGFLNGIEWILEEVESKRAR

SEQ ID NO: 745363 - protein, 305 aa, Homo sapiens
MAGSEPRSGTNSPPPPFSDWGRLEAAILSGWKTFWQSVSKERVARTTSREEVDEAASTLTRLPIDVQLYILSFLSPHDLCQLGSTNHYWNETVRDPILWRYFLLRDLPSWSSVDWKSLPDLEILKKPISEVTDGAFFDYMAVYRMCCPYTRRASKSSRPMYGAVTSFLHSLIIQNEPRFAMFGPGLEELNTSLVLSLMSSEELCPTAGLPQRQIDGIGSGVNFQLNNQHKFNILILYSTTRKERDRAREEHTSAVNKMFSRHNEGDDQQGSRYSVIPQIQKVCEVVDGFIYVANAEAHKSPGYRG

SEQ ID NO: 745364 - protein, 161 aa, Homo sapiens; identical to SEQ ID NO: 745360

SEQ ID NO: 745365 - protein, 387 aa, Homo sapiens
MAGSEPRSGTNSPPPPFSDWGRLEAAILSGWKTFWQSVSKERVARTTSREEVDEAASTLTRLPIDVQLYILSFLSPHDLCQLGSTNHYWNETVRDPILWRYFLLRDLPSWSSVDWKSLPDLEILKKPISEVTDGAFFDYMAVYRMCCPYTRRASKSSRPMYGAVTSFLHSLIIQNEPRFAMFGPGLEELNTSLVLSLMSSEELCPTAGLPQRQIDGIGSGVNFQLNNQHKFNILILYSTTRKERDRAREEHTSAVNKMFSRHNEGDDQQGSRYSVIPQIQKVCEVVDGFIYVANAEAHKRHEWQDEFSHIMAMTDPAFGSSGRPLLVLSCISQGDVKRMPCFYLAHELHLNLLNHPWLVQDTEAETLTGFLNGIEWILEEVESKRAR

SEQ ID NO: 745366 - protein, 307 aa, Homo sapiens
MAGSEPRSGTNSPPPPFSDWGRLEAAILSGWKTFWQSVSKERVARTTSREEVDEAASTLTRLPIDVQLYILSFLSPHDLCQLGSTNHYWNETVRDPILWRYFLLRDLPSWSSVDWKSLPDLEILKKPISEVTDGAFFDYMAVYRMCCPYTRRASKSSRPMYGAVTSFLHSLIIQNEPRFAMFGPGLEELNTSLVLSLMSSEELCPTAGLPQRQIDGIGSGVNFQLNNQHKFNILILYSTTRKERDRAREEHTSAVNKMFSRHNEGDDQQGSRYSVIPQIQKVCEVVDGFIYVANAEAHKSKYSYVHF

SEQ ID NO: 745367 - protein, 154 aa, Homo sapiens
MAGSEPRSGTNSPPPPFSDWGRLEAAILSGWKTFWQSVSKERVARTTSREEVDEAASTLTRLPIDVQLYILSFLSPHDLCQLGSTNHYWNETVRDPILWRYFLLRDLPSWSSVDWKSLPDLEILKKPISEVTDGAFFDYMAVRDGVSPCYPGWS

SEQ ID NO: 745368 - protein, 309 aa, Homo sapiens
MAGSEPRSGTNSPPPPFSDWGRLEAAILSGWKTFWQSVSKERVARTTSREEVDEAASTLTRLPIDVQLYILSFLSPHDLCQLGSTNHYWNETVRDPILWRYFLLRDLPSWSSVDWKSLPDLEILKKPISEVTDGAFFDYMAVYRMCCPYTRRASKSSRPMYGAVTSFLHSLIIQNEPRFAMFGPGLEELNTSLVLSLMSSEELCPTAGLPQRQIDGIGSGVNFQLNNQHKFNILILYSTTRKERDRAREEHTSAVNKMFSRHNEGDDQQGSRYSVIPQIQKVCEVVDGFIYVANAEAHKRQNSAVMLEH

SEQ ID NO: 745369 - protein, 114 aa, Homo sapiens
MKGLFFFFFFFFWHRWTNGGCDCGHRARRRRLIWFPPSVPLDAPGFSPTGVPAWSPPWCELWLSKWGKREWVSPLWLPGGSGGFDTRIVVGSRSREGAFAIITLSLSLPEGREQ

SEQ ID NO: 745370 - protein, 684 aa, Homo sapiens
MQKLASQYLKRDWPGVKADDRNDYRSMYPVWKSFLEGTMQVAQSRMNICENYKNFISEPARTVRSLKEQQLKRCVDQLTKIQTELQETVKDLAKGKKKYFETEQMAHAVREKADIEAKSKLSLFQSRISLQKASVKLKARRSECNSKATHARNDYLLTLAAANAHQDRYYQTDLVNIMKALDGNVYDHLKDYLIAFSRTELETCQAVQNTFQFLLENSSKVVRDYNLQLFLQENAVFHKPQPFQFQPCDSDTSRQLESETGTTEEHSLNKEARKWATRVAREHKNIVHQQRVLNDLECHGAAVSEQSRAELEQKIDEARENIRKAEIIKLKAEARLDLLKQIGVSVDTWLKSAMNQVMEELENERWARPPAVTSNGTLHSLNADTEREEGEEFEDNMDVFDDSSSSPSGTLRNYPLTCKVVYSYKASQPDELTIEEHEVLEVIEDGDMEDWVKARNKVGQVGYVPEKYLQFPTSNSLLSMLQSLAALDSRSHTSSNSTEAELVSGSLNGDASVCFVKALYDYEGQTDDELSFPEGAIIRILNKENQDDDGFWEGEFNGRIGVFPSVLVEELSASENGDTPWMREIQISPSPKPHASLPPLPLYDQPPSSPYPSPDKRSSLYFPRSPSANEKSLHAESPGFSQASRHTPETSYGKLRPVRAAPPPPTQNHRRPAEKIEDVEITLV

SEQ ID NO: 745371 - protein, 699 aa, Homo sapiens
MDIPQFIHFPVDGHGMQKLASQYLKRDWPGVKADDRNDYRSMYPVWKSFLEGTMQVAQSRMNICENYKNFISEPARTVRSLKEQQLKRCVDQLTKIQTELQETVKDLAKGKKKYFETEQMAHAVREKADIEAKSKLSLFQSRISLQKASVKLKARRSECNSKATHARNDYLLTLAAANAHQDRYYQTDLVNIMKALDGNVYDHLKDYLIAFSRTELETCQAVQNTFQFLLENSSKVVRDYNLQLFLQENAVFHKPQPFQFQPCDSDTSRQLESETGTTEEHSLNKEARKWATRVAREHKNIVHQQRVLNDLECHGAAVSEQSRAELEQKIDEARENIRKAEIIKLKAEARLDLLKQIGVSVDTWLKSAMNQVMEELENERWARPPAVTSNGTLHSLNADTEREEGEEFEDNMDVFDDSSSSPSGTLRNYPLTCKVVYSYKASQPDELTIEEHEVLEVIEDGDMEDWVKARNKVGQVGYVPEKYLQFPTSNSLLSMLQSLAALDSRSHTSSNSTEAELVSGSLNGDASVCFVKALYDYEGQTDDELSFPEGAIIRILNKENQDDDGFWEGEFNGRIGVFPSVLVEELSASENGDTPWMREIQISPSPKPHASLPPLPLYDQPPSSPYPSPDKRSSLYFPRSPSANEKSLHAESPGFSQASRHTPETSYGKLRPVRAAPPPPTQNHRRPAEKIEDVEITLV

SEQ ID NO: 745372 - protein, 556 aa, Homo sapiens
MDIPQFIHFPVDGHGMQKLASQYLKRDWPGVKADDRNDYRSMYPVWKSFLEGTMQVAQSRMNICENYKNFISEPARTVRSLKEQQLKRCVDQLTKIQTELQETVKDLAKGKKKYFETEQMAHAVREKADIEAKSKLSLFQSRISLQKASVKLKARRSECNSKATHARNDYLLTLAAANAHQDRYYQTDLVNIMKALDGNVYDHLKDYLIAFSRTELETCQAVQNTFQFLLENSSKVVRDYNLQLFLQENAVFHKPQPFQFQPCDSDTSRQLESETGTTEEHSLNKEARKWATRVAREHKNIVHQQRVLNDLECHGAAVSEQSRAELEQKIDEARENIRKAEIIKLKAEARLDLLKQIGVSVDTWLKSAMNQVMEELENERWARPPAVTSNGTLHSLNADTEREEGEEFEDNMDVFDDSSSSPSGTLRNYPLTCKVVYSYKASQPDELTIEEHEVLEVIEDGDMEDWVKARNKVGQVGYVPEKYLQFPTSNSLLSMLQSLAALDSRSHTSSNSTEAELVSGSLNGDASDLSFPQATRLPASTAVVRPASQQPLPQPR

SEQ ID NO: 745373 - protein, 462 aa, Homo sapiens
AIFTGQSLKAAQLVDIELSPVSALRMTIAESRQLESETGTTEEHSLNKEARKWATRVAREHKNIVHQQRVLNDLECHGAAVSEQSRAELEQKIDEARENIRKAEIIKLKAEARLDLLKQIGVSVDTWLKSAMNQVMEELENERWARPPAVTSNGTLHSLNADTEREEGEEFEDNMDVFDDSSSSPSGTLRNYPLTCKVVYSYKASQPDELTIEEHEVLEVIEDGDMEDWVKARNKVGQVGYVPEKYLQFPTSNSLLSMLQSLAALDSRSHTSSNSTEAELVSGSLNGDASVCFVKALYDYEGQTDDELSFPEGAIIRILNKENQDDDGFWEGEFNGRIGVFPSVLVEELSASENGDTPWMREIQISPSPKPHASLPPLPLYDQPPSSPYPSPDKRSSLYFPRSPSANEKSLHAESPGFSQASRHTPETSYGKLRPVRAAPPPPTQNHRRPAEKIEDVEITLV

SEQ ID NO: 745374 - protein, 699 aa, Homo sapiens; identical to SEQ ID NO: 745371

SEQ ID NO: 745375 - protein, 699 aa, Homo sapiens; identical to SEQ ID NO: 745371

SEQ ID NO: 745376 - protein, 699 aa, Homo sapiens; identical to SEQ ID NO: 745371

SEQ ID NO: 745377 - protein, 699 aa, Homo sapiens; identical to SEQ ID NO: 745371

SEQ ID NO: 745378 - protein, 627 aa, Homo sapiens
MDIPQFIHFPVDGHGMQKLASQYLKRDWPGVKADDRNDYRSMYPVWKSFLEGTMQVAQSRMNICENYKNFISEPARTVRSLKEQQLKRCVDQLTKIQTELQETVKDLAKGKKKYFETEQMAHAVREKADIEAKSKLSLFQSRISLQKASVKLKARRSECNSKATHARNDYLLTLAAANAHQDRYYQTDLVNIMKALDGNVYDHLKDYLIAFSRTELETCQAVQNTFQFLLENSSKVVRDYNLQLFLQENAVFHKPQPFQFQPCDSDTSRQLESETGTTEEHSLNKEARKWATRVAREHKNIVHQQRVLNDLECHGAAVSEQSRAELEQKIDEARENIRKAEIIKLKAEARLDLLKQIGVSVDTWLKSAMNQVMEELENERWARPPAVTSNGTLHSLNADTEREEGEEFEDNMDVFDDSSSSPSGTLRNYPLTCKVVYSYKASQPDELTIEEHEVLEVIEDGDMEDWVKARNKVGQVGYVPEKYLQFPTSNSLLSMLQSLAALDSRSHTSSNSTEAELVSGSLNGDASVCFVKALYDYEGQTDDELSFPEGAIIRILNKENQDDDGFWEGEFNGRIGVFPSVLVEELSASENGDTPWMREIQISPSPKPHASLPPLPLYDQPPSSPIC

SEQ ID NO: 745379 - protein, 186 aa, Homo sapiens
MQKLASQYLKRDWPGVKADDRNDYRSMYPVWKSFLEGTMQVAQSRMNICENYKNFISEPARTVRSLKEQQLKRCVDQLTKIQTELQETVKDLAKGKKKYFETEQMAHAVREKADIEAKSKLSLFQSRISLQKASVKLKARRSECNSKATHARNDYLLTLAAANAHQDRYYQTDLVNIMKVRQTFVI

SEQ ID NO: 745380 - protein, 530 aa, Homo sapiens
MDIPQFIHFPVDGHGMQKLASQYLKRDWPGVKADDRNDYRSMYPVWKSFLEGTMQVAQSRMNICENYKNFISEPARTVRSLKEQQLKRCVDQLTKIQTELQETVKDLAKGKKKYFETEQMAHAVREKADIEAKSKLSLFQSRISLQKASVKLKARRSECNSKATHARNDYLLTLAAANAHQDRYYQTDLVNIMKALDGNVYDHLKDYLIAFSRTELETCQAVQNTFQFLLENSSKVVRDYNLQLFLQENAVFHKPQPFQFQPCDSDTSRQLESETGTTEEHSLNKEARKWATRVAREHKNIVHQQRVLNDLECHGAAVSEQSRAELEQKIDEARENIRKAEIIKLKAEARLDLLKQIGVSVDTWLKSAMNQVMEELENERWARPPAVTSNGTLHSLNADTEREEGEEFEDNMDVFDDSSSSPSGTLRNYPLTCKVVYSYKASQPDELTIEEHEVLEVIEDGDMEDWVKARNKVGQVGYVPEKYLQFPTSNSLLSMLQSLAALDSRSHTSSNSTEAELVSGSLNGDASGKD

SEQ ID NO: 745381 - protein, 653 aa, Homo sapiens
GKGPKVLRGTAHFIIGLKKHYKNFISEPARTVRSLKEQQLKRCVDQLTKIQTELQETVKDLAKGKKKYFETEQMAHAVREKADIEAKSKLSLFQSRISLQKASVKLKARRSECNSKATHARNDYLLTLAAANAHQDRYYQTDLVNIMKALDGNVYDHLKDYLIAFSRTELETCQAVQNTFQFLLENSSKVVRDYNLQLFLQENAVFHKPQPFQFQPCDSDTSRQLESETGTTEEHSLNKEARKWATRVAREHKNIVHQQRVLNDLECHGAAVSEQSRAELEQKIDEARENIRKAEIIKLKAEARLDLLKQIGVSVDTWLKSAMNQVMEELENERWARPPAVTSNGTLHSLNADTEREEGEEFEDNMDVFDDSSSSPSGTLRNYPLTCKVVYSYKASQPDELTIEEHEVLEVIEDGDMEDWVKARNKVGQVGYVPEKYLQFPTSNSLLSMLQSLAALDSRSHTSSNSTEAELVSGSLNGDASVCFVKALYDYEGQTDDELSFPEGAIIRILNKENQDDDGFWEGEFNGRIGVFPSVLVEELSASENGDTPWMREIQISPSPKPHASLPPLPLYDQPPSSPYPSPDKRSSLYFPRSPSANEKSLHAESPGFSQASRHTPETSYGKLRPVRAAPPPPTQNHRRPAEKIEDVEITLV

SEQ ID NO: 745382 - protein, 493 aa, Homo sapiens
MDIPQFIHFPVDGHGMQKLASQYLKRDWPGVKADDRNDYRSMYPVWKSFLEGTMQVAQSRMNICENYKNFISEPARTVRSLKEQQLKRCVDQLTKIQTELQETVKDLAKGKKKYFETEQMAHAVREKADIEAKSKLSLFQSRISLQKASVKLKARRSECNSKATHARNDYLLTLAAANAHQDRYYQTDLVNIMKALDGNVYDHLKDYLIAFSRTELETCQAVQNTFQFLLENSSKVVRDYNLQLFLQENAVFHKPQPFQFQPCDSDTSRQLESETGTTEEHSLNKEARKWATRVAREHKNIVHQQRVLNDLECHGAAVSEQSRAELEQKIDEARENIRKAEIIKLKAEARLDLLKQIGVSVDTWLKSAMNQVMEELENERWARPPAVTSNGTLHSLNADTEREEGEEFEDNMDVFDDSSSSPSGTLRNYPLTCKVVYSYKASQPDELTIEEHEVLEVIEDGDMEDWVKVYSFAHIALSCDIFRSLFWSLLCPV

SEQ ID NO: 745383 - protein, 403 aa, Homo sapiens
PRVAHASQQRVLNDLECHGAAVSEQSRAELEQKIDEARENIRKAEIIKLKAEARLDLLKQIGVSVDTWLKSAMNQVMEELENERWARPPAVTSNGTLHSLNADTEREEGEEFEDNMDVFDDSSSSPSGTLRNYPLTCKVVYSYKASQPDELTIEEHEVLEVIEDGDMEDWVKARNKVGQVGYVPEKYLQFPTSNSLLSMLQSLAALDSRSHTSSNSTEAELVSGSLNGDASVCFVKALYDYEGQTDDELSFPEGAIIRILNKENQDDDGFWEGEFNGRIGVFPSVLVEELSASENGDTPWMREIQISPSPKPHASLPPLPLYDQPPSSPYPSPDKRSSLYFPRSPSANEKSLHAESPGFSQASRHTPETSYGKLRPVRAAPPPPTQNHRRPAEKIEDVEITLV

SEQ ID NO: 745384 - protein, 699 aa, Homo sapiens; identical to SEQ ID NO: 745371

SEQ ID NO: 745385 - protein, 699 aa, Homo sapiens; identical to SEQ ID NO: 745371

SEQ ID NO: 745386 - protein, 699 aa, Homo sapiens; identical to SEQ ID NO: 745371

SEQ ID NO: 745387 - protein, 699 aa, Homo sapiens; identical to SEQ ID NO: 745371

SEQ ID NO: 745388 - protein, 106 aa, Homo sapiens
MEPPIPQSAPLTPNSVMVQPLLDSRMSHSRLQHPLTILPIDQVKTSHVENDYIDNPSLALTTGPKRTRGGAPELAPTPARCDQDVTHHWISFSGRPCSATCLPPAA

SEQ ID NO: 745389 - protein, 148 aa, Homo sapiens
MEPPIPQSAPLTPNSVMVQPLLDSRMSHSRLQHPLTILPIDQVKTSHVENDYIDNPSLALTTGPKRTRGGAPELAPTPARCDQDVTHHVDLLQRAPLLCYLPATGCVKLAQRGYDRLRRPGCRCKHTNSVICKAASGDAKTSRPDKPF

SEQ ID NO: 745390 - protein, 148 aa, Homo sapiens; identical to SEQ ID NO: 745389

SEQ ID NO: 745391 - protein, 322 aa, Homo sapiens
MLSPLPTGPLEACFSVQSRTSSPMEPPIPQSAPLTPNSVMVQPLLDSRMSHSRLQHPLTILPIDQVKTSHVENDYIDNPSLALTTGPKRTRGGAPELAPTPARCDQDVTHHWISFSGRPSSVSSSSSTSSDQRLLDHMAPPPVADQASPRAVRIQPKVVHCQPLDLKGPAVPPELDKHFLLCEACGKCKCKECASPRTLPSCWVCNQECLCSAQTLVNYGTCMCLVQGIFYHCTNEDDEGSCADHPCSCSRSNCCARWSFMGALSVVLPCLLCYLPATGCVKLAQRGYDRLRRPGCRCKHTNSVICKAASGDAKTSRPDKPF

SEQ ID NO: 745392 - protein, 330 aa, Homo sapiens
MATKESRDAKAQLALSSSANQSKEVPENPNYALKCTLVGHTEAVSSVKFSPNGEWLASSSADRLIIIWGAYDGKYEKTLYGHNLEISDVAWSSDSSRLVSASDDKTLKLWDVRSGKCLKTLKGHSNYVFCCNFNPPSNLIISGSFDETVKIWEVKTGKCLKTLSAHSDPVSAVHFNCSGSLIVSGSYDGLCRIWDAASGQCLKTLVDDDNPPVSFVKFSPNGKYILTATLDNTLKLWDYSRGRCLKTYTGHKNEKYCIFANFSVTGGKWIVSGSEDNLVYIWNLQTKEIVQKLQGHTDVVISAACHPTENLIASAALENDKTIKLWMSNH

SEQ ID NO: 745393 - protein, 312 aa, Homo sapiens
MATKESRDAKAQLALSSSANQSKEVPENPNYALKCTLVGHTEAVSSVKFSPNGEWLASSSADRLIIIWGAYDGKYEKTLYGHNLEISDVAWSSDSSRLVSASDDKTLKLWDVRSGKCLKTLKGHSNYVFCCNFNPPSNLIISGSFDETVKIWEVKTGKCLKTLSAHSDPVSAVHFNCSGSLIVSGSYDGLCRIWDAASGQCLKTLVDDDNPPVSFVKFSPNGKYILTATLDNTLKLWDYSRGRCLITGGKWIVSGSEDNLVYIWNLQTKEIVQKLQGHTDVVISAACHPTENLIASAALENDKTIKLWMSNH

SEQ ID NO: 745394 - protein, 330 aa, Homo sapiens; identical to SEQ ID NO: 745392

SEQ ID NO: 745395 - protein, 577 aa, Homo sapiens
MCICHLPCRPVKPNIIGEQITSKMGAHYHCIICSATITRRTDMLGHVRRHMNKGETKSSYIAASTAKPPKEILKEADTDVQVCPNYSIPQKTDSYFNPKMKLNRQLIFCTLAALAEERKPLECLDAFGATGIMGLQWAKHLGNAVKVTINDLNENSVTLIQENCHLNKLKVVVDSKEKEKSDDILEEGEKNLGNIKVTKMDANVLMHLRSFDFIHLDPFGTSVNYLDSAFRNIRNLGIVSVTSTDISSLYAKAQHVARRHYGCNIVRTEYYKELAARIVVAAVARAAARCNKGIEVLFAVALEHFVLVVVRVLRGPTSADETAKKIQYLIHCQWCEERIFQKDGNMVEENPYRQLPCNCHGSMPGKTAIELGPLWSSSLFNTGFLKRMLFESLHHGLDDIQTLIKTLIFESECTPQSQFSIHASSNVNKQEENGVFIKTTDDTTTDNYIAQGKRKSNEMITNLGKKQKTDVSTEHPPFYYNIHRHSIKGMNMPKLKKFLCYLSQAGFRVSRTHFDPMGVRTDAPLMQFKSILLKYSTPTYTGGQSESHVQSASEDTVTERVEMSVNDKAEASGCRRW

SEQ ID NO: 745396 - protein, 733 aa, Homo sapiens
MENMAEEELLPLEKEEVEVAQVQVPTPARDSAGVPAPAPDSALDSAPTPASAPAPAPALAQAPALSPSLASAPEEAKSKRHISIQRQLADLENLAFVTDGNFDSASSLNSDNLDAGNRQACPLCPKEKFRACNSHKLRRHLQNLHWKVSVEFEGYRMCICHLPCRPVKPNIIGEQITSKMGAHYHCIICSATITRRTDMLGHVRRHMNKGETKSSYIAASTAKPPKEILKEADTDVQVCPNYSIPQKTDSYFNPKMKLNRQLIFCTLAALAEERKPLECLDAFGATGIMGLQWAKHLGNAVKVTINDLNENSVTLIQENCHLNKLKVVVDSKEKEKSDDILEEGEKNLGNIKVTKMDANVLMHLRSFDFIHLDPFGTSVNYLDSAFRNIRNLGIVSVTSTDISSLYAKAQHVARRHYGCNIVRTEYYKELAARIVVAAVARAAARCNKGIEVLFAVALEHFVLVVVRVLRGPTSADETAKKIQYLIHCQWCEERIFQKDGNMVEENPYRQLPCNCHGSMPGKTAIELGPLWSSSLFNTGFLKRMLFESLHHGLDDIQTLIKTLIFESECTPQSQFSIHASSNVNKQEENGVFIKTTDDTTTDNYIAQGKRKSNEMITNLGKKQKTDVSTEHPPFYYNIHRHSIKGMNMPKLKKFLCYLSQAGFRVSRTHFDPMGVRTDAPLMQFKSILLKYSTPTYTGGQSESHVQSASEDTVTERVEMSVNDKAEASGCRRW

SEQ ID NO: 745397 - protein, 588 aa, Homo sapiens [sequence omitted]

SEQ ID NO: 745398 - protein, 649 aa, Homo sapiens
MISAAWSIFLIGTKIGLFLQVAPLSVMAKSCPSVCRCDAGFIYCNDRFLTSIPTGIPEDATTLYLQNNQINNAGIPSDLKNLLKVERIYLYHNSLDEFPTNLPKYVKELHLQENNIRTITYDSLSKIPYLEELHLDDNSVSAVSIEEGAFRDSNYLRLLFLSRNHLSTIPWGLPRTIEELRLDDNRISTISSPSLQGLTSLKRLVLDGNLLNNHGLGDKVFFNLVNLTELSLVRNSLTAAPVNLPGTNLRKLYLQDNHINRVPPNAFSYLRQLYRLDMSNNNLSNLPQGIFDDLDNITQLILRNNPWYCGCKMKWVRDWLQSLPVKVNVRGLMCQAPEKVRGMAIKDLNAELFDCKDSGIVSTIQITTAIPNTVYPAQGQWPAPVTKQPDIKNPKLTKDHQTTGSPSRKTITITVKSVTSDTIHISWKLALPMTALRLSWLKLGHSPAFGSITETIVTGERSEYLVTALEPDSPYKVCMVPMETSNLYLFDETPVCIETETAPLRMYNPTTTLNREQEKEPYKNPNLPLAAIIGGAVALVTIALLALVCWYVHRNGSLFSRNCAYSKGRRRKDDYAEAGTKKDNSILEIRETSFQMLPISNEPISKEEFVIHTIFPPNGMNLYKNNHSESSSNRSYRDSGIPDSDHSHS

SEQ ID NO: 745399 - protein, 631 aa, Homo sapiens
MISAAWSIFLIGSPSVCRCDAGFIYCNDRFLTSIPTGIPEDATTLYLQNNQINNAGIPSDLKNLLKVERIYLYHNSLDEFPTNLPKYVKELHLQENNIRTITYDSLSKIPYLEELHLDDNSVSAVSIEEGAFRDSNYLRLLFLSRNHLSTIPWGLPRTIEELRLDDNRISTISSPSLQGLTSLKRLVLDGNLLNNHGLGDKVFFNLVNLTELSLVRNSLTAAPVNLPGTNLRKLYLQDNHINRVPPNAFSYLRQLYRLDMSNNNLSNLPQGIFDDLDNITQLILRNNPWYCGCKMKWVRDWLQSLPVKVNVRGLMCQAPEKVRGMAIKDLNAELFDCKDSGIVSTIQITTAIPNTVYPAQGQWPAPVTKQPDIKNPKLTKDHQTTGSPSRKTITITVKSVTSDTIHISWKLALPMTALRLSWLKLGHSPAFGSITETIVTGERSEYLVTALEPDSPYKVCMVPMETSNLYLFDETPVCIETETAPLRMYNPTTTLNREQEKEPYKNPNLPLAAIIGGAVALVTIALLALVCWYVHRNGSLFSRNCAYSKGRRRKDDYAEAGTKKDNSILEIRETSFQMLPISNEPISKEEFVIHTIFPPNGMNLYKNNHSESSSNRSYRDSGIPDSDHSHS

SEQ ID NO: 745400 - protein, 649 aa, Homo sapiens; identical to SEQ ID NO: 745398

SEQ ID NO: 745401 - protein, 802 aa, Homo sapiens
SQEPLVSHEQMQVFQMITKSQRIFSHAQVAAVSSQLPAPEGKPAALRPLQGPWPQQPPPLAPAVDSLHAGPGNPEAEGSPARRRKTTPGVPREASPGSTRRDAKGGLKVAAVPTPLAAPSLDPSRNPDISSLAKQLRSSKGTLDLEDIFPSTGQRQTQLGGEEPPGASLPGKQAPAENGAASRITKGEKGPACSRGGGYRLLGNPRAPRFSGFRKEKAKMDMCCAASPSQVAMASFSSAGPPADPSKSKLTIFSRIQGGNIYRLPHPVKEENVAGRGNQQNGSPTDWTKPRSTFVCKNCSQMFYTEKGLSSHMCFHSDQWPSPRGKQEPQVFGTEFCKPLRQVLRPEGDRHSPPGTKKPLDPTAAAPLVVPQSIPVVPVTRHIGSMAMGQEKDGEERDSKESSQQRKRKKRPPPSTAGEPGPAGCHQSRLRSPMFLVDCLLKGLFQCSPYTPPPMLSPIREGSGVYFNTLCSTSTQASPDQLISSMLDQVDGSFGICVVKDDTKISIEPHINIGSRFQAEIPELQERSLAGTDEHVASLVWKPWGDMMISSETQDRVTELCNVACSSVMPGGGTNLELALHCLHEAQGNVQVALETLLLRGPHKPRTHLLADYRYTGSDVWTPIEKRLFKKAFYAHKKDFYLIHKMIQTKTVAQCVEYYYIWKKMIKFDCGRAPGLEKRVKREPEEVERTEEKVPCSPRERPSHHPTPKLKTKSYRRESILSSSPNAGSKRTPELLGSAESQGIFPCRECERVFDKIKSRNAHMKRHRLQDHVEPIIRVKWPVKPFQLKEEELGADIGPLQW

SEQ ID NO: 745402 - protein, 165 aa, Homo sapiens
MLPPSTHLQVPIGQHVYLKLPITGTEIVKPYTPVSGSLLSEFKEPVLPNNKYIYFLIKIYPTGLFTPELDRLQIGDFVSVSSPEGNFKISKFQELEDLFLLAAGTGFTPMVKILNYALTDIPSLRKSEAECSFIKPGRWLYLENPLRELALGIKTGCDFVSQPYF

SEQ ID NO: 745403 - protein, 557 aa, Homo sapiens
LRQNAPHPWRPRKWVGGLASARPQSRSWRCCPVWRRSPGRARGRGLKMLNVPSQSFPAPRSQQRVASGGRSKVPLKQGRSLMDWIRLTKSGKDLTGLKGRLIEVTEEELKKHNKKDDCWICIRGFVYNVSPYMEYHPGGEDELMRAAGSDGTELFDQVHRWVNYESMLKECLVGRMAIKPAVLKGMLPKSQVTDTLAKEGPSYPSYDWFQTDSLVTIAIYTKQKDINLDSIIVDHQNDSFRAETIIKDCLYLIHIGLSHEVQEDFSVRVVESVGKIEIVLQKKENTSWDFLGHPLKNHNSLIPRKDTGLYYRKCQLISKEDVTHDTRLFCLMLPPSTHLQVPIGQHVYLKLPITGTEIVKPYTPVSGSLLSEFKEPVLPNNKYIYFLIKIYPTGLFTPELDRLQIGDFVSVSSPEGNFKISKFQELEDLFLLAAGTGFTPMVKILNYALTDIPSLRKVKLMFFNKTEDDIIWRSQLEKLAFKDKRLDVEFVLSAPISEWNGKQGHISPALLSEFLKRNLDKSKVLVCICGPVPFTEQGVRLLHDLNFSKNEIHSFTA

SEQ ID NO: 745404 - protein, 190 aa, Homo sapiens
LRQNAPHPWRPRKWVGGLASARPQSRSWRCCPVWRRSPGRARGRGLKMLNVPSQSFPAPRSQQRVASGGRSKVPLKQGRSLMDWIRLTKSGKDLTGLKGRLIEVTEEELKKHNKKDDCWICIRGFVYNVSPYMEYHPGGEDELMRAAGSDGTELFDQVHRWVNYESMLKECLVGRMAIKPAVLKGKLWHL

SEQ ID NO: 745405 - protein, 568 aa, Homo sapiens
LRQNAPHPWRPRKWVGGLASARPQSRSWRCCPVWRRSPGRARGRGLKMLNVPSQSFPAPRSQQRVASGGRSKVPLKQGRSLMDWIRLTKSGKDLTGLKGRLIEVTEEELKKHNKKDDCWICIRGFVYNVSPYMEYHPGGEDELMRAAGSDGTELFDQVHRWVNYESMLKECLVGRMAIKPAVLKDYREEEKKVLNGMLPKSQVTDTLAKEGPSYPSYDWFQTDSLVTIAIYTKQKDINLDSIIVDHQNDSFRAETIIKDCLYLIHIGLSHEVQEDFSVRVVESVGKIEIVLQKKENTSWDFLGHPLKNHNSLIPRKDTGLYYRKCQLISKEDVTHDTRLFCLMLPPSTHLQVPIGQHVYLKLPITGTEIVKPYTPVSGSLLSEFKEPVLPNNKYIYFLIKIYPTGLFTPELDRLQIGDFVSVSSPEGNFKISKFQELEDLFLLAAGTGFTPMVKILNYALTDIPSLRKVKLMFFNKTEDDIIWRSQLEKLAFKDKRLDVEFVLSAPISEWNGKQGHISPALLSEFLKRNLDKSKVLVCICGPVPFTEQGVRLLHDLNFSKNEIHSFTA

SEQ ID NO: 745406 - protein, 242 aa, Homo sapiens
LRQNAPHPWRPRKWVGGLASARPQSRSWRCCPVWRRSPGRARGRGLKMLNVPSQSFPAPRSQQRVASGGRSKVPLKQGRSLMDWIRLTKSGKDLTGLKGRLIEVTEEELKKHNKKDDCWICIRGFVYNVSPYMEYHPGGEDELMRAAGSDGTELFDQVHRWVNYESMLKECLVGRMAIKPAVLKDYREEEKKVLNGMLPKSQVTDTLAKEGPSYPSYDWFQTDSLVTIAIYTKQKVNMSLKS

SEQ ID NO: 745407 - protein, 1113 aa, Homo sapiens
YDVVLDAIDTMQRVAWHINDMKRKHEHAVRLQEIQSLLTNWKGPDLTSYGELVLEGTFRIQRAKNERTLFLFDKLLLITKKRDDTFTYKAHILCGNLMLVEVIPKEPLSFSVFHYKNPKLQHTVQAKSQQDKRLWVLHLKRLILENHAAKIPAKAKQAILEMDAIHHPGFCYSPEGGTKALFGSKEGSAPYRLRRKSEPSSRSHKVLKTSETAQDIQKVSREEGSPQLSSARPSPAQRNSQPSSSTMISVLRAGGALRNIWTDHQIRQALFPSRRSPQENEDDEDDYQMFVPSFSSSDLNSTRLCEDSTSSRPCSWHMGQMESTETSSSGHRIVRRASSAGESNTCPPEIGTSDRTRELQNSPKTEGQEEMTPFGSSIELTIDDIDHVYDNISYEDLKLMVAKREEAESTPSKSARDSVRPKSTPELAFTKRQAGHSKGSLYAQTDGTLSGGEASSQSTHELQAVEENIYDTIGLPDPPSLGFKCSSLKRAKRSTFLGLEADFVCCDSLRPFVSQDSLQLSEDEAPYHQATPDHGYLSLLYDSPSGNLSMPHKPVSDKLSEEVDEIWNDLENYIKKNEDKARDRLLAAFPVSKDDVPDRLHAESTPELSRDVGRSVSTLSLPESQALLTPVKSRAGRASRANCPFEEDLISKEGSFMSLNRLSLASEMPLMDNPYDLANSGLSQTDPENPDLGMEATDKTKSRVFMMARQYSQKIKKANQLLKVKSLELEQPPASQHQKSMHKDLAAILEEKKQGGPAIGARIAEYSQLYDQIVFRESPLKIQKDGWASPQESSLLRSVSPSQVHHGSGDWLLHSTYSNGELADFCLPPEQDLRSRYPTFEINTKSTPRQLSAACSVPSLQTSDPLPGSVQRCSVVVSQPNKENWCQDHLYNSLGRKGISAKSQPYHRSQSSSSVLINKSMDSINYPSDVGKQQLLSLHRSSRCESHQDLLPDIADSHQQGTEKLSDLTLQDSQKVVVVNRNLPLNAQIATQNYFSNFKETDGDEDDYVEIKSEEDESELELSHNRRRKSDSKFVDADFSDNVCSGNTLHSLNSPRTPKKPVNSKLGLSPYLTPYNDSDKLNDYLWRGPSPNQQNIVQSLREKFQCLSSSSFA

SEQ ID NO: 745408 - protein, 1113 aa, Homo sapiens; identical to SEQ ID NO: 745407

SEQ ID NO: 745409 - protein, 1113 aa, Homo sapiens; identical to SEQ ID NO: 745407

SEQ ID NO: 745410 - protein, 1113 aa, Homo sapiens; identical to SEQ ID NO: 745407

SEQ ID NO: 745411 - protein, 89 aa, Homo sapiens
VAAGPWPLRKAPLCNDECCVPCGFLRAFWPHGHFPSHQRVLWVVESSCLTVYISSWQAKSQQDKRLWVLHLKRLILENHAAKIPAKVGH

SEQ ID NO: 745412 - protein, 70 aa, Homo sapiens
CPSPCHWVCFQPARGGKGGQQHDPPSGCMLETAQIICSQILLTRTWFHDQHLVQSMLGNPAFLLGSRVPR

SEQ ID NO: 745413 - protein, 254 aa, Homo sapiens
IKRQAADSEELGAAQREGSPSRSASVSTTCLDTTKMPPVGGKKAKKGILERLNAGEIVIGDGGFVFALEKRGYVKAGPWTPEAAVEHPEAVRQLHREFLRAGSNVMQTFTFYASEDKLENRGNYVLEKISGQEVNEAACDIARQVADEGDALVAGGVSQTPSYLSCKSETEVKKVFLQQLEVFMKKNVDFLIAEYFEHVEEAVWAVETLIASGKPVAATMCIGPRRRFAWRAPRRVCSAPGESRSIHHWCELPL

SEQ ID NO: 745414 - protein, 41 aa, Homo sapiens
MQTFTFYASEDKLENRGNYVLEKISGQEVNGCFDIGPRHPP

SEQ ID NO: 745415 - protein, 303 aa, Homo sapiens
SGLDMHTKPWVRARARKEYWENLRIASGRPYNPSMSKPDGWGVTKGTAELMQQKEAMKEGLEAAQLKAHLMSQPLAYHTPDCNKQGFIDLPEFPFGLEPRVATRWDIQKYAREAYNLGVRYIGGVLGFEPYHIRAIAEAVRQLHREFLRAGSNVMQTFTFYASEDKLENRGNYVLEKISGQEVNEAACDIARQVADEGDALVAGGVSQTPSYLSCKSETEVKKVFLQQLEVFMKKNVDFLIAEYFEHVEEAVWAVETLIASGKPVAATMCIGPRRRFAWRAPRRVCSAPGESRSIHHWCELPL

SEQ ID NO: 745416 - protein, 187 aa, Homo sapiens
IKRQAADSEELGAAQREGSPSRSASVSTTCLDTTKMPPVGGKKAKKGILERLNAGEIVIGDGGFVFALEKRGYVKAGPWTPEAAVEHPEAVRQLHREFLRAGSNVMQTFTFYASEDKLENRGNYVLEKISGQEVNEAACDIARQVADEGDALVAGGVSQTPSYLSCKSETEVNILNTLKKLCGQLKP

SEQ ID NO: 745417 - protein, 127 aa, Homo sapiens
IKRQAADSEELGAAQREGSPSRSASVSTTCLDTTKMPPVGGKKAKKGILERLNAGEIVIGDGGFVFALEKRGYVKAGPWTPEAAVEHPEAVRQLHREFLRAGSNVMQTFTFYASEDKLENREHPSLV

SEQ ID NO: 745418 - protein, 254 aa, Homo sapiens; identical to SEQ ID NO: 745413

SEQ ID NO: 745419 - protein, 90 aa, Homo sapiens
ECIMPNGIMPLITGLEPRVATRWDIQKYAREAYNLGVRYIGGCCGFEPYHIRAIAEELAPERGFLPPASEKHGSWGSGLDMHTKPWVRAR

SEQ ID NO: 745420 - protein, 149 aa, Homo sapiens
MQTFTFYASEDKLENRGNYVLEKISGQEVNEAACDIARQVADEGDALVAGGVSQTPSYLSCKSETEVKKVFLQQLEVFMKKNVDFLIAEYFEHVEEAVWAVETLIASGKPVAATMCIGPRRRFAWRAPRRVCSAPGESRSIHHWCELPL

SEQ ID NO: 745421 - protein, 176 aa, Homo sapiens
MKEGLEAARLKAHLMSQPLAYHTPDCNKQGFIDLPEFPFGLEPRVATRWDIQKYAREAYNLGVRYIGGCCGFEPYHIRAIAEELAPERGFLPPASEKHGSWGSGLDMHTKPWVRARARKEYWENLRIASGRPYNPSMSKPDGWGVTKGTAELMQQKEATTEQQLKELFEKQKFKSQ

SEQ ID NO: 745422 - protein, 254 aa, Homo sapiens; identical to SEQ ID NO: 745413

SEQ ID NO: 745423 - protein, 370 aa, Homo sapiens
SRLRQNRCLAPGSGGSTRSAAGSGCPEAAAFAEFARWPPITMSAFDTNPFADPVDVNPFQDPSVTQLTNAPQGGLAEFNPFSETNAATTVPVTQLPGSSQPAVLQPSVEPTQPTPQAVVSAAQAGLLRQQEELDRKAAELERKERELQNTVANLHVRQNNWPPLPSWCPVKPCFYQDFSTEIPADYQRICKMLYYLWMLHSVTLFLNLLACLAWFSGNSSKGVDFGLSILWFLIFTPCAFLCWYRPIYKAFRSDNSFSFFVFFFVFFCQIGIYIIQLVGIPGLGDSGWIAALSTLDNHSLAISVIMMVVAGFFTLCAVLSVFLLQRVHSLYRRTGASFQQAQEEFSQGIFSSRTFHRAASSAAQGAFQGN

SEQ ID NO: 745424 - protein, 379 aa, Homo sapiens
QAGTPSGYRRPRRRGRVGAPGSGGSTRSAAGSGCPEAAAFAEFARWPPITMSAFDTNPFADPVDVNPFQDPSVTQLTNAPQGGLAEFNPFSETNAATTVPVTQLPGSSQPAVLQPSVEPTQPTPQAVVSAAQAGLLRQQEELDRKAAELERKERELQNTVANLHVRQNNWPPLPSWCPVKPCFYQDFSTEIPADYQRICKMLYYLWMLHSVTLFLNLLACLAWFSGNSSKGVDFGLSILWFLIFTPCAFLCWYRPIYKAFRSDNSFSFFVFFFVFFCQIGIYIIQLVGIPGLGDSGWIAALSTLDNHSLAISVIMMVVAGFFTLCAVLSVFLLQRVHSLYRRTGASFQQAQEEFSQGIFSSRTFHRAASSAAQGAFQGN

SEQ ID NO: 745425 - protein, 370 aa, Homo sapiens; identical to SEQ ID NO: 745423

SEQ ID NO: 745426 - protein, 370 aa, Homo sapiens; identical to SEQ ID NO: 745423

SEQ ID NO: 745427 - protein, 370 aa, Homo sapiens; identical to SEQ ID NO: 745423

SEQ ID NO: 745428 - protein, 370 aa, Homo sapiens; identical to SEQ ID NO: 745423

SEQ ID NO: 745429 - protein, 370 aa, Homo sapiens; identical to SEQ ID NO: 745423

SEQ ID NO: 745430 - protein, 347 aa, Homo sapiens
SRLRQNRCLAPGSGGSTRSAAGSGCPEAAAFAEFARWPPITMSAFDTNPFADPVDVNPFQTNAATTVPVTQLPGSSQPAVLQPSVEPTQPTPQAVVSAAQAGLLRQQEELDRKAAELERKERELQNTVANLHVRQNNWPPLPSWCPVKPCFYQDFSTEIPADYQRICKMLYYLWMLHSVTLFLNLLACLAWFSGNSSKGVDFGLSILWFLIFTPCAFLCWYRPIYKAFRSDNSFSFFVFFFVFFCQIGIYIIQLVGIPGLGDSGWIAALSTLDNHSLAISVIMMVVAGFFTLCAVLSVFLLQRVHSLYRRTGASFQQAQEEFSQGIFSSRTFHRAASSAAQGAFQGN

SEQ ID NO: 745431 - protein, 179 aa, Homo sapiens
MLYYLWMLHSVTLFLNLLACLAWFSGNSSKGVDFGLSILWFLIFTPCAFLCWYRPIYKAFRSDNSFSFFVFFFVFFCQIGIYIIQLVGIPGLGDSGWIAALSTLDNHSLAISVIMMVVAGFFTLCAVLSVFLLQRVHSLYRRTGASFQQAQEEFSQGIFSSRTFHRAASSAAQGAFQGN

SEQ ID NO: 745432 - protein, 264 aa, Homo sapiens
MSLYLPCSLQAVVSAAQAGLLRQQEELDRKAAELERKERELQNTVANLHVRQNNWPPLPSWCPVKPCFYQDFSTEIPADYQRICKMLYYLWMLHSVTLFLNLLACLAWFSGNSSKGVDFGLSILWFLIFTPCAFLCWYRPIYKAFRSDNSFSFFVFFFVFFCQIGIYIIQLVGIPGLGDSGWIAALSTLDNHSLAISVIMMVVAGFFTLCAVLSVFLLQRVHSLYRRTGASFQQAQEEFSQGIFSSRTFHRAASSAAQGAFQGN

SEQ ID NO: 745433 - protein, 106 aa, Homo sapiens
AQYPLIRLRSSSWFGIPGLGDSGWIAALSTLDNHSLAISVIMMVVAGFFTLCAVLSVFLLQRVHSLYRRTGASFQQAQEEFSQGIFSSRTFHRAASSAAQGAFQGN

SEQ ID NO: 745434 - protein, 175 aa, Homo sapiens
VLVGPGLNRARSFPGHISHHDGGGWLLHPLCRALSLPPAAGALPLPTDRGQLPAGPGGVFPGHLQQQNLPQSCFICCPRSLPGELVLLSSLPLSLSLACLLSCTFRGCLMWWWLCPAQTWQGSCRGSSSSLSDQLSLEREGQGIFSPSMYKKKQSSLSFSGDGLVGFFCLWKQWD

SEQ ID NO: 745435 - protein, 146 aa, Homo sapiens
WEYNLDGWLPGGPKGQASLTPPLFARCTPSTDGQGPASSRPRRSFPRASSAAEPSTELLHLLPKEPSRGISPPLFSPPQPFSRLPSELHFPWVPYVVVVVPSTDLAGFLPWLFLLPQRPALPGTGGTGNFFPLYVQKKTKLSFLLW

SEQ ID NO: 745436 - protein, 286 aa, Homo sapiens
SRLRQNRCLAPGSGGSTRSAAGSGCPEAAAFAEFARWPPITMSAFDTNPFADPVDVNPFQDPSVTQLTNAPQGGLAEFNPFSETNAATTVPVTQLPGSSQPAVLQPSVEPTQPTPQAVVSAAQAGLLRQQEELDRKAAELERKERELQNTVANLHVRQNNWPPLPSWCPVKPCFYQDFSTEIPADYQRICKMLYYLWMLHSVTLFLNLLACLAWFSGNSSKGVDFGLSILWFLIFTPCAFLCWYRPIYKAFRSDNSFSFFVFFFVFFCQIGIYIIQLVGIPGLGDR

SEQ ID NO: 745437 - protein, 139 aa, Homo sapiens
SRLRQNRCLAPGSGGSTRSAAGSGCPEAAAFAEFARWPPITMSAFDTNPFADPVDVNPFQDPSVTQLTNAPQGGLAEFNPFSETNAATTVPVTQLPGSSQPAVLQPSVEPTQPTPQVVLTKNSGLFSPVRESSRPVAEP

SEQ ID NO: 745438 - protein, 413 aa, Homo sapiens
SRLRQNRCLAPGSGGSTRSAAGSGCPEAAAFAEFARWPPITMSAFDTNPFADPVDVNPFQDPSVTQLTNAPQGGLAEFNPFSETNAATTVPVTQLPGSSQPAVLQPSVEPTQPTPQLLLRQASKFPPAQFLAVSELSERQMLLGGESILRDSYMRKLPKAVVSAAQAGLLRQQEELDRKAAELERKERELQNTVANLHVRQNNWPPLPSWCPVKPCFYQDFSTEIPADYQRICKMLYYLWMLHSVTLFLNLLACLAWFSGNSSKGVDFGLSILWFLIFTPCAFLCWYRPIYKAFRSDNSFSFFVFFFVFFCQIGIYIIQLVGIPGLGDSGWIAALSTLDNHSLAISVIMMVVAGFFTLCAVLSVFLLQRVHSLYRRTGASFQQAQEEFSQGIFSSRTFHRAASSAAQGAFQGN

SEQ ID NO: 745439 - protein, 277 aa, Homo sapiens
SRLRQNRCLAPGSGGSTRSAAGSGCPEAAAFAEFARWPPITMSAFDTNPFADPVDVNPFQDPSVTQLTNAPQGGLAEFNPFSETNAATTVPVTQLPGSSQPAVLQPSVEPTQPTPQAVVSAAQAGLLRQQEELDRKAAELERKERELQNTVANLHVRQNNWPPLPSWCPVKPCFYQDFSTEIPADYQRICKMLYYLWMLHSVTLFLNLLACLAWFSGNSSKGVDFGLSILWFLIFTPCAFLCWYRPIYKAFRDLHHPVGWHPWPGGQRLDCSPVYTG

SEQ ID NO: 745440 - protein, 155 aa, Homo sapiens
MRRGWEVRRFGLSILWFLIFTPCAFLCWYRPIYKAFRSDNSFSFFVFFFVFFCQIGIYIIQLVGIPGLGDSGWIAALSTLDNHSLAISVIMMVVAGFFTLCAVLSVFLLQRVHSLYRRTGASFQQAQEEFSQGIFSSRTFHRAASSAAQGAFQGN

SEQ ID NO: 745441 - protein, 232 aa, Homo sapiens
MGPPGVQVNEDRSACRVHVLLPWRGGEEEAIEEAAAEVLKGKFVGQQRKVAREQVEEDVAKGQVAKGLHQPGQQAEERVLVPLLGDVQDVVQPHLAGHALLLQKLSEAFGKCVWICDWGFLLSRKFLIHIESVVTTRKDMSIGRNLVMSSTSILGSLKNHSLAISVIMMVVAGFFTLCAVLSVFLLQRVHSLYRRTGASFQQAQEEFSQGIFSSRTFHRAASSAAQGAFQGN

SEQ ID NO: 745442 - protein, 340 aa, Homo sapiens
SRLRQNRCLAPGSGGSTRSAAGSGCPEAAAFAEFARWPPITMSAFDTNPFADPVDVNPFQDPSVTQLTNAPQGGLAEFNPFSETNAATTVPVTQLPGSSQPAVLQPSVEPTQPTPQAVVSAAQAGLLRQQEELDRKAAELERKERELQNTVANLHVRQNNWPPLPSWCPVKPCFYQDFSTEIPADYQRICKMLYYLWMLHSVTLFLNLLACLAWFSGNSSKGVDFGLSILWFLIFTPCAFLCWYRPIYKAFRSDNSFSFFVFFFVFFCQIGIYIIQLVGIPGLGDSGWIAALSTLDNHSLAISVIMMVVAGFFTLCAVLSVFLLQRVHSLYRRRVSMVPT

SEQ ID NO: 745443 - protein, 88 aa, Homo sapiens
EDPPRPPPAQGISPPLFSPPQPFSRLPSELHFPWVPYVVVVVPSTDLAGFLPWLFLLPQRPALPGTGGTGNFFPLYVQKKTKLSFLLW

SEQ ID NO: 745444 - protein, 122 aa, Homo sapiens
RLELPAIPAQIFLGGSRILLSLEAVGLKFSSSCAHTDTPTQLGSQADLGPSQLELSARVLGLDSPTLQAWPESGFLDTAQSFLPGLGISLSQVLVDRSVPQVTPVVSRLPEKAGCLKLFSAS

SEQ ID NO: 745445 - protein, 132 aa, Homo sapiens
LVGFFSPTASRDKRILPNHHQRRKESRILLSLEAVGLKFSSSCAHTDTPTQLGSQADLGPSQLELSARVLGLDSPTLQAWPESGFLDTAQSFLPGLGISLSQVLVDRSVPQVTPVVSRLPEKAGCLKLFSAS

SEQ ID NO: 745446 - protein, 275 aa, Homo sapiens
MSAEVKVTGQNQEQFLLLAKSAKGAALATLIHQVLEAPGVYVFGELLDMPNVRELAESDFASTFRLLTVFAYGTYADYLAEARNLPPLTEAQKNKLRHLSVVTLAAKVKCIPYAVLLEALALRNVRQLEDLVIEAVYADVLRGSLDQRNQRLEVDYSIGRDIQRQDLSAIARTLQEWCVGCEVVLSGIEEQVSRANQHKEQQLGLKQQIESEVANLKKTIKVTTAAAAAATSQDPEQHLTELREPAPGTNQRQPSKKASKGKGLRGSAKIWSKSN

SEQ ID NO: 745447 - protein, 275 aa, Homo sapiens; identical to SEQ ID NO: 745446

SEQ ID NO: 745448 - protein, 275 aa, Homo sapiens; identical to SEQ ID NO: 745446

SEQ ID NO: 745449 - protein, 275 aa, Homo sapiens; identical to SEQ ID NO: 745446

SEQ ID NO: 745450 - protein, 302 aa, Homo sapiens
AGQQWRAEGASSGSGHPEPKSPTLSAVMSAEVKVTGQNQEQFLLLAKSAKGAALATLIHQVLEAPGVYVFGELLDMPNVRELAESDFASTFRLLTVFAYGTYADYLAEARNLPPLTEAQKNKLRHLSVVTLAAKVKCIPYAVLLEALALRNVRQLEDLVIEAVYADVLRGSLDQRNQRLEVDYSIGRDIQRQDLSAIARTLQEWCVGCEVVLSGIEEQVSRANQHKEQQLGLKQQIESEVANLKKTIKVTTAAAAAATSQDPEQHLTELREPAPGTNQRQPSKKASKGKGLRGSAKIWSKSN

SEQ ID NO: 745451 - protein, 656 aa, Homo sapiens
QRANPIYWNFTDNKLRGRLPPPLKHAILSALRAQHRDKTPTPHVPRGQHSRGVGGRGGVLYARLGSWDRREDVHPHLLAQSLSPGPGAAPSPWGGLADRAHATMSRQEVARKRGLGAPWRGREDKGAMLWPQRVQMEVSAVYIQEGWREASFSLGCAWGQERGEVQLALPCQGQGPGQPCHLSGHSELELGYSLARPMMVRMYRKMLMMSVYRFSAANTYSSGLRDSCLFPSSSWVSTARKQVKSRAPSEAYTISRMRFRMKMQRMAKMKSTTMLTRSTPMHEVKSVAGLHGEDDDGEADGCGDAHGHDDCLGVVEAGDHPHHVRQAGGQDRQCNKVPGVLSPEVPTTAEDDERDEEDSIGDIVVQTFSRTKPFTSATKVNTDTVDRVTDSCKVSTRNTLRMKACRMLLYPSWWQGSPGCHSRMGDPPPGSFHAGVSQGLVLGRPVAVHRGWGGRGSGDMAPGGSPLGGRGPVGSPLVGRGPVGSPLGGRDPVGSPLGGRGWGHGGTLADRRGRAGKGAVGKGPQGREAEHRGAWVAGAPPDIQGWGEDSCPQTPKNSFHGTWPRVPRSAPVAGRRRPVRTVSAARPRGDGQMRPHPHPLGATLQGGGRKGLEQLPEVTERRPRPVRWRSKLPGSGPQSLTQALDILSPSPPHSVQ

SEQ ID NO: 745452 - protein, 670 aa, Homo sapiens
QRANPIYWNFTDNKLRGRLPPPLKHAILSALRAQHRDKTPTPHVPRGQHSRGVGGRGGVLYARLGSWDRREDVHPHLLAQSLSPGPGAAPSPWGGLADRAHATMSRQEVARKRGLGAPWRGREDKGAMLWPQRVQMEVSAVYIQEGWREASFSLGCAWGQERGEVQLALPCQGQGPGQPCHLSGHSELELGYSLARPMMVRMYRKMLMMSVYRFSAANTYSSGLRDSCLFPSSSWVSTARKQVKSRAPSEAYTISRMRFRMKMQRMAKMKSTTMLTRSTPMHEVKSVAGLHGEDDDGEADGCGDAHGHDDCLGVVEAGDHPHHVRQAGGQDRQCNKVPGVLSPEVPTTAEDDERDEEDSIGDIVVQTFSRTKPFTSATKVNTDTVDRVTDSCKVSTRNTLRMKACRMLLYPSWWQGSPGCHSRMGDPPPGSFHAGVSQGLVLGRPVAVHRGWGGRGSGDMAPGGSPLGGRGPVGSPLVGRGPVGSPLGGRDPVGSPLGGRGWGHGGTLADRRGRAGKGAVGKGPQGREAEHRGAWVAGAPPDIQGWGEDSCPQTPKNSFHGTWPRVPRSAPVAGRRRPVRTVSAARPRGDGQMRPHPHPLGATLQGGGRKGLEQLPEVTERRPRPVRWRSKLPGSGPQSLTQGTTKQSAGAHGRWAVSLREGAEPRLWTS

SEQ ID NO: 745453 - protein, 104 aa, Homo sapiens
VRGSNGELRERRQGGHHATPISPLHPVSSGHPEPKSPTLSAVMSAEVKVTGQNQEQFLLLAKSAKGAALATLIHQVLEAPGVYVFGELLDMPNVRELKPGIFLH

SEQ ID NO: 745454 - protein, 263 aa, Homo sapiens
MSAEVKVTGQNQEQFLLLAKSAKGAALATLIHQVLEAPGVYVFGELLDMPNVRELAESDFASTFRLLTVFAYGTYADYLAEARNLPPLTEAQKNKLRHLSVVTLAAKVKCIPYAVLLEALALRNVRQLEDLVIEAVYADVLRGSLDQRNQRLEVDYSIGRDIQRQDLSAIARTLQEWCVGCEVVLSGIEEQVSRANQHKEQQLGLKQQIESEVANLKKTIKVTTAAAAAATSQDPEQHLTELREPAPGTNQRQPSKKASKGKG

SEQ ID NO: 745455 - protein, 829 aa, Homo sapiens
QRANPIYWNFTDNKLRGRLPPPLKHAILSALRAQHRDKTPTPHVPRGQHSRGVGGRGGVLYARLGSWDRREDVHPHLLAQSLSPGPGAAPSPWGGLADRAHATMSRQEVARKRGLGAPWRGREDKGAMLWPQRVQMEVSAVYIQEGWREASFSLGCAWGQERGEVQLALPCQGQGPGQPCHLSGHSELELGYSLARPMMVRMYRKMLMMSVYRFSAANTYSSGLRDSCLFPSSSWVSTARKQVKSRAPSEAYTISRMRFRMKMQRMAKMKSTTMLTRSTPMHEVKSVAGLHGEDDDGEADGCGDAHGHDDCLGVVEAGDHPHHVRQAGGQDRQCNKVPGVLSPEVPTTAEDDERDEEDSIGDIVVQTFSRTKPFTSATKVNTDTVDRVTDSCKVSTRNTLRMKACRMLLYPSWWQGSPGCHSRMGDPPPGSFHAGVSQGLVLGRPVAVHRGWGGRGSGDMAPGGSPLGGRGPVGSPLVGRGPVGSPLGGRDPVGSPLGGRGWGHGGTLADRRGRAGKGAVGKGPQGREAEHRGAWVAGAPPDIQGWGEDSCPQTPKNSFHGTWPRVPRSAPVAGRRRPVRTVSAARPRGDGQMRPHPHPLGATLQGGGRKGLEQLPEVTERRPRPVRWRSKLPAEARNLPPLTEAQKNKLRHLSVVTLAAKVKCIPYAVLLEALALRNVRQLEDLVIEAVYADVLRGSLDQRNQRLEVDYSIGRDIQRQDLSAIARTLQEWCVGCEVVLSGIEEQVSRANQHKEQQLGLKQQIESEVANLKKTIKVTTAAAAAATSQDPEQHLTELREPAPGTNQRQPSKKASKGKGLRGSAKIWSKSN

SEQ ID NO: 745456 - protein, 275 aa, Homo sapiens; identical to SEQ ID NO: 745446

SEQ ID NO: 745457 - protein, 904 aa, Homo sapiens
QRANPIYWNFTDNKLRGRLPPPLKHAILSALRAQHRDKTPTPHVPRGQHSRGVGGRGGVLYARLGSWDRREDVHPHLLAQSLSPGPGAAPSPWGGLADRAHATMSRQEVARKRGLGAPWRGREDKGAMLWPQRVQMEVSAVYIQEGWREASFSLGCAWGQERGEVQLALPCQGQGPGQPCHLSGHSELELGYSLARPMMVRMYRKMLMMSVYRFSAANTYSSGLRDSCLFPSSSWVSTARKQVKSRAPSEAYTISRMRFRMKMQRMAKMKSTTMLTRSTPMHEVKSVAGLHGEDDDGEADGCGDAHGHDDCLGVVEAGDHPHHVRQAGGQDRQCNKVPGVLSPEVPTTAEDDERDEEDSIGDIVVQTFSRTKPFTSATKVNTDTVDRVTDSCKVSTRNTLRMKACRMLLYPSWWQGSPGCHSRMGDPPPGSFHAGVSQGLVLGRPVAVHRGWGGRGSGDMAPGGSPLGGRGPVGSPLVGRGPVGSPLGGRDPVGSPLGGRGWGHGGTLADRRGRAGKGAVGKGPQGREAEHRGAWVAGAPPDIQGWGEDVVPRHQKTLFMGHGLGFRGPPRWPGAAGRYARCPLRGRAVMADAPAPAPARSDSSGRWQERLGTAAGGDGAAAPPGALEVEASSSGHPEPKSPTLSAVMSAEVKVTGQNQEQFLLLAKSAKGAALATLIHQVLEAPGVYVFGELLDMPNVRELAESDFASTFRLLTVFAYGTYADYLAEARNLPPLTEAQKNKLRHLSVVTLAAKVKLEDLVIEAVYADVLRGSLDQRNQRLEVDYSIGRDIQRQDLSAIARTLQEWCVGCEVVLSGIEEQVSRANQHKEQQLGLKQQIESEVANLKKTIKVTTAAAAAATSQDPEQHLTELREPAPGTNQRQPSKKASKGKGLRGSAKIWSKSN

SEQ ID NO: 745458 - protein, 656 aa, Homo sapiens; identical to SEQ ID NO: 745451

SEQ ID NO: 745459 - protein, 670 aa, Homo sapiens; identical to SEQ ID NO: 745452

SEQ ID NO: 745460 - protein, 275 aa, Homo sapiens; identical to SEQ ID NO: 745446

SEQ ID NO: 745461 - protein, 275 aa, Homo sapiens; identical to SEQ ID NO: 745446

SEQ ID NO: 745462 - protein, 275 aa, Homo sapiens; identical to SEQ ID NO: 745446

SEQ ID NO: 745463 - protein, 275 aa, Homo sapiens; identical to SEQ ID NO: 745446

SEQ ID NO: 745464 - protein, 317 aa, Homo sapiens
VRGSNGELRERRQGGHHATPISPLHPVSSGHPEPKSPTLSAVMSAEVKVTGQNQEQFLLLAKSAKGAALATLIHQVLEAPGVYVFGELLDMPNVRELAESDFASTFRLLTVFAYGTYADYLAEARNLPPLTEAQKNKLRHLSVVTLAAKVKCIPYAVLLEALALRNVRQLEDLVIEAVYADVLRGSLDQRNQRLEVDYSIGRDIQRQDLSAIARTLQEWCVGCEVVLSGIEEQVSRANQHKEQQLGLKQQIESEVANLKKTIKVTTAAAAAATSQDPEQHLTELREPAPGTNQRQPSKKASKGKGLRGSAKIWSKSN

SEQ ID NO: 745465 - protein, 269 aa, Homo sapiens
MEPILWIHILEVSTNGESSHAPKFIHQVLEAPGVYVFGELLDMPNVRELAESDFASTFRLLTVFAYGTYADYLAEARNLPPLTEAQKNKLRHLSVVTLAAKVKCIPYAVLLEALALRNVRQLEDLVIEAVYADVLRGSLDQRNQRLEVDYSIGRDIQRQDLSAIARTLQEWCVGCEVVLSGIEEQVSRANQHKEQQLGLKQQIESEVANLKKTIKVTTAAAAAATSQDPEQHLTELREPAPGTNQRQPSKKASKGKGLRGSAKIWSKSN

SEQ ID NO: 745466 - protein, 345 aa, Homo sapiens
AGQQWRAEGASSGSGHPEPKSPTLSAVMSAEVKVTGQNQEQFLLLAKSAKGAALATLIHQVLEAPGVYVFGELLDMPNVREGRNWMSMEQEGIVVWENSVNKSLKVEMSPSYVKSDQRGRELLLLAESDFASTFRLLTVFAYGTYADYLAEARNLPPLTEAQKNKLRHLSVVTLAAKVKCIPYAVLLEALALRNVRQLEDLVIEAVYADVLRGSLDQRNQRLEVDYSIGRDIQRQDLSAIARTLQEWCVGCEVVLSGIEEQVSRANQHKEQQLGLKQQIESEVANLKKTIKVTTAAAAAATSQDPEQHLTELREPAPGTNQRQPSKKASKGKGLRGSAKIWSKSN

SEQ ID NO: 745467 - protein, 257 aa, Homo sapiens
MSAEVKVTGQNQEQFLLLAKSAKGAALATLIHQVLEAPGVYVFGELLDMPNVRELAESDFASTFRLLTVFAYGTYADYLAEARNLPPLTEAQKNKLRHLSVVTLAAKVKLEDLVIEAVYADVLRGSLDQRNQRLEVDYSIGRDIQRQDLSAIARTLQEWCVGCEVVLSGIEEQVSRANQHKEQQLGLKQQIESEVANLKKTIKVTTAAAAAATSQDPEQHLTELREPAPGTNQRQPSKKASKGKGLRGSAKIWSKSN

SEQ ID NO: 745468 - protein, 238 aa, Homo sapiens
MFVLVEETLVLERGTKVQEKKAENKRRGEDEDTADLAESDFASTFRLLTVFAYGTYADYLAEARNLPPLTEAQKNKLRHLSVVTLAAKVKLEDLVIEAVYADVLRGSLDQRNQRLEVDYSIGRDIQRQDLSAIARTLQEWCVGCEVVLSGIEEQVSRANQHKEQQLGLKQQIESEVANLKKTIKVTTAAAAAATSQDPEQHLTELREPAPGTNQRQPSKKASKGKGLRGSAKIWSKSN

SEQ ID NO: 745469 - protein, 142 aa, Homo sapiens
DLEDPFRLALTLKLLDMPNVRELAESDFASTFRLLTVFAYGTYADYLAEARNLPPLTEAQKNKLRHLSVVTLAAKVKCIPYAVLLEALALRNVRQLEDLVIEAVYADVLRGSLDQRNQRLEVDYSIGRDIQRQDLSAIVCGL

SEQ ID NO: 745470 - protein, 228 aa, Homo sapiens
MSAEVKVTGQNQEQFLLLAKSAKGAALATLIHQVLEAPGVYVFGELLDMPNVRELAESDFASTFRLLTVFAYGTYADYLAEARNLPPLTEAQKNKLRHLSVVTLAAKVKCIPYAVLLEALALRNVRQLEDLVIEAVYADVLRGSLDQRNQRLEVDYSIGRDIQRQDLSAIARTLQEWCVGCEVVLSGIEEQVSRANQHKEQQLGLKQQIESEVPPLRNPKDTGAAARP

SEQ ID NO: 745471 - protein, 219 aa, Homo sapiens
MSAEVKVTGQNQEQFLLLAKSAKGAALATLIHQVLEAPGVYVFGELLDMPNVRELAESDFASTFRLLTVFAYGTYADYLAEARNLPPLTEAQKNKLRHLSVVTLAAKVKCIPYAVLLEALALRNVRQLEDLVIEAVYADVLRGSLDQRNQRLEVDYSIGRDIQRQDLSAIARTLQEWCVGCEVVLSGIEEQVSRANQHKEQQLGLKQQIESEGANLKKP

SEQ ID NO: 745472 - protein, 1258 aa, Homo sapiens
MITSELPVLQDSTNETTAHSDAGSELEETEVKGKRKRGRPGRPPSTNKKPRKSPGEKSRIEAGIRGAGRGRANGHPQQNGEGEPVTLFEVVKLGKSAMQSVVDDWIESYKQDRDIALLDLINFFIQCSGCRGTVRIEMFRNMQNAEIIRKMTEEFDEDSGDYPLTMPGPQWKKFRSNFCEFIGVLIRQCQYSIIYDEYMMDTVISLLTGLSDSQVRAFRHTSTLAAMKLMTALVNVALNLSIHQDNTQRQYEAERNKMIGKRANERLELLLQKRKELQENQDEIENMMNSIFKGIFVHRYRDAIAEIRAICIEEIGVWMKMYSDAFLNDSYLKYVGWTLHDRQGEVRLKCLKALQSLYTNRELFPKLELFTNRFKDRIVSMTLDKEYDVAVEAIRLVTLILHGSEEALSNEDCENVYHLVYSAHRPVAVAAGEFLHKKLFSRHDPQAEEALAKRRGRNSPNGNLIRMLVLFFLESELHEHAAYLVDSLWESSQELLKDWECMTELLLEEPVQGEEAMSDRQESALIELMVCTIRQAAEAHPPVGRGTGKRVLTAKERKTQIDDRNKLTEHFIITLPMLLSKYSADAEKVANLLQIPQYFDLEIYSTGRMEKHLDALLKQIKFVVEKHVESDVLEACSKTYSILCSEEYTIQNRVDIARSQLIDEFVDRFNHSVEDLLQEGEEADDDDIYNVLSTLKRLTSFHNAHDLTKWDLFGNCYRLLKTGIEHGAMPEQIVVQALQCSHYSILWQLVKITDGSPSKEDLLVLRKTVKSFLAVCQQCLSNVNTPVKEQAFMLLCDLLMIFSHQLMTGGREGLQPLVFNPDTGLQSELLSFVMDHVFIDQDEENQSMEGDEEDEANKIEALHKRRNLLAAFSKLIIYDIVDMHAAADIFKHYMKYYNDYGDIIKETLSKTRQIDKIQCAKTLILSLQQLFNELVQEQGPNLDRTSAHVSGIKELARRFALTFGLDQIKTREAVATLHKDGIEFAFKYQNQKGQEYPPPNLAFLEVLSEFSSKLLRQDKKTVHSYLEKFLTEQMMERREDVWLPLISYRNSLVTGGEDDRMSVNSGSSSSKTSSVRNKKGRPPLHKKRVEDESLDNTWLNRTDTMIQTPGPLPAPQLTSTVLRENSRPMGDQIQEPESEHGSEPDFLHNPQMQISWLGQPKLEDLNRKDRTGMNYMKVRTGVRHAVRGLMEEDAEPIFEDVMMSSRSQLEDMNEEFEDTMVIDLPPSRNRRERAELRPDFFDSAAIIEDDSGFGMPMF

SEQ ID NO: 745473 - protein, 1258 aa, Homo sapiens; identical to SEQ ID NO: 745472

SEQ ID NO: 745474 - protein, 1258 aa, Homo sapiens; identical to SEQ ID NO: 745472

SEQ ID NO: 745475 - protein, 482 aa, Homo sapiens
MITSELPVLQDSTNETTAHSDAGSELEETEVKGKRKRGRPGRPPSTNKKPRKSPGEKSRIEAGIRGAGRGRANGHPQQNGEGEPVTLFEVVKLGKSAMQSVVDDWIESYKQDRDIALLDLINFFIQCSGCRGTVRIEMFRNMQNAEIIRKMTEEFDEDSGDYPLTMPGPQWKKFRSNFCEFIGVLIRQCQYSIIYDEYMMDTVISLLTGLSDSQVRAFRHTSTLAAMKLMTALVNVALNLSIHQDNTQRQYEAERNKMIGKRANERLELLLQKRKELQENQDEIENMMNSIFKGIFVHRYRDAIAEIRAICIEEIGVWMKMYSDAFLNDSYLKYVGWTLHDRQGEVRLKCLKALQSLYTNRELFPKLELFTNRFKDRIVSMTLDKEYDVAVEAIRLVTLILHGSEEALSNEDCENVYHLVYSAHRPVAVAAGEFLHKKLFSRHDPQAEEALAKRRGRNSPNGNLIRMLVLFFLESEVKNVLR

SEQ ID NO: 745476 - protein, 232 aa, Homo sapiens
MITSELPVLQDSTNETTAHSDAGSELEETEVKGKRKRGRPGRPPSTNKKPRKSPGEKSRIEAGIRGAGRGRANGHPQQNGEGEPVTLFEVVKLGKSAMQSVVDDWIESYKQDRDIALLDLINFFIQCSGCRGTVRIEMFRNMQNAEIIRKMTEEFDEDSGDYPLTMPGPQWKKFRSNFCEFIGVLIRQCQYSIIYDEYMMDTVISLLTGLSDSQVRAFRHTSTLAGQVLGTR

SEQ ID NO: 745477 - protein, 105 aa, Homo sapiens
MITSELPVLQDSTNETTAHSDAGSELEETEVKGKRKRGRPGRPPSTNKKPRKSPGEKSRIEAGIRGAGRGRANGHPQQNGEGEPVTLFEVVKLGKSAMQRCGPFK

SEQ ID NO: 745478 - protein, 1258 aa, Homo sapiens; identical to SEQ ID NO: 745472

SEQ ID NO: 745479 - protein, 1258 aa, Homo sapiens; identical to SEQ ID NO: 745472

SEQ ID NO: 745480 - protein, 940 aa, Homo sapiens
MKMYSDAFLNDSYLKYVGWTLHDRQGEVRLKCLKALQSLYTNRELFPKLELFTNRFKDRIVSMTLDKEYDVAVEAIRLVTLILHGSEEALSNEDCENVYHLVYSAHRPVAVAAGEFLHKKLFSRHDPQAEEALAKRRGRNSPNGNLIRMLVLFFLESELHEHAAYLVDSLWESSQELLKDWECMTELLLEEPVQGEEAMSDRQESALIELMVCTIRQAAEAHPPVGRGTGKRVLTAKERKTQIDDRNKLTEHFIITLPMLLSKYSADAEKVANLLQIPQYFDLEIYSTGRMEKHLDALLKQIKFVVEKHVESDVLEACSKTYSILCSEEYTIQNRVDIARSQLIDEFVDRFNHSVEDLLQEGEEADDDDIYNVLSTLKRLTSFHNAHDLTKWDLFGNCYRLLKTGIEHGAMPEQIVVQALQCSHYSILWQLVKITDGSPSKEDLLVLRKTVKSFLAVCQQCLSNVNTPVKEQAFMLLCDLLMIFSHQLMTGGREGLQPLVFNPDTGLQSELLSFVMDHVFIDQDEENQSMEGDEEDEANKIEALHKRRNLLAAFSKLIIYDIVDMHAAADIFKHYMKYYNDYGDIIKETLSKTRQIDKIQCAKTLILSLQQLFNELVQEQGPNLDRTSAHVSGIKELARRFALTFGLDQIKTREAVATLHKDGIEFAFKYQNQKGQEYPPPNLAFLEVLSEFSSKLLRQDKKTVHSYLEKFLTEQMMERREDVWLPLISYRNSLVTGGEDDRMSVNSGSSSSKTSSVRNKKGRPPLHKKRVEDESLDNTWLNRTDTMIQTPGPLPAPQLTSTVLRENSRPMGDQIQEPESEHGSEPDFLHNPQMQISWLGQPKLEDLNRKDRTGMNYMKVRTGVRHAVRGLMEEDAEPIFEDVMMSSRSQLEDMNEEFEDTMVIDLPPSRNRRERAELRPDFFDSAAIIEDDSGFGMPMF

SEQ ID NO: 745481 - protein, 836 aa, Homo sapiens
MVHALSFALESFFTAKLFSRHDPQAEEALAKRRGRNSPNGNLIRMLVLFFLESELHEHAAYLVDSLWESSQELLKDWECMTELLLEEPVQGEEAMSDRQESALIELMVCTIRQAAEAHPPVGRGTGKRVLTAKERKTQIDDRNKLTEHFIITLPMLLSKYSADAEKVANLLQIPQYFDLEIYSTGRMEKHLDALLKQIKFVVEKHVESDVLEACSKTYSILCSEEYTIQNRVDIARSQLIDEFVDRFNHSVEDLLQEGEEADDDDIYNVLSTLKRLTSFHNAHDLTKWDLFGNCYRLLKTGIEHGAMPEQIVVQALQCSHYSILWQLVKITDGSPSKEDLLVLRKTVKSFLAVCQQCLSNVNTPVKEQAFMLLCDLLMIFSHQLMTGGREGLQPLVFNPDTGLQSELLSFVMDHVFIDQDEENQSMEGDEEDEANKIEALHKRRNLLAAFSKLIIYDIVDMHAAADIFKHYMKYYNDYGDIIKETLSKTRQIDKIQCAKTLILSLQQLFNELVQEQGPNLDRTSAHVSGIKELARRFALTFGLDQIKTREAVATLHKDGIEFAFKYQNQKGQEYPPPNLAFLEVLSEFSSKLLRQDKKTVHSYLEKFLTEQMMERREDVWLPLISYRNSLVTGGEDDRMSVNSGSSSSKTSSVRNKKGRPPLHKKRVEDESLDNTWLNRTDTMIQTPGPLPAPQLTSTVLRENSRPMGDQIQEPESEHGSEPDFLHNPQMQISWLGQPKLEDLNRKDRTGMNYMKVRTGVRHAVRGLMEEDAEPIFEDVMMSSRSQLEDMNEEFEDTMVIDLPPSRNRRERAELRPDFFDSAAIIEDDSGFGMPMF

SEQ ID NO: 745482 - protein, 1028 aa, Homo sapiens
MITSELPVLQDSTNETTAHSDAGSELEETEVKGKRKRGRPGRPPSTNKKPRKSPGEKSRIEAGIRGAGRGRANGHPQQNGEGEPVTLFEVVKLGKSAMQSVVDDWIESYKQDRDIALLDLINFFIQCSGCRGTVRIEMFRNMQNAEIIRKMTEEFDEDSGDYPLTMPGPQWKKFRSNFCEFIGVLIRQCQYSIIYDEYMMDTVISLLTGLSDSQVRAFRHTSTLAAMKLMTALVNVALNLSIHQDNTQRQYEAERNKMIGKRANERLELLLQKRKELQENQDEIENMMNSIFKGIFVHRYRDAIAEIRAICIEEIGVWMKMYSDAFLNDSYLKYVGWTLHDRQGEVRLKCLKALQSLYTNRELFPKLELFTNRFKDRIVSMTLDKEYDVAVEAIRLVTLILHGSEEALSNEDCENVYHLVYSAHRPVAVAAGEFLHKKLFSRHDPQAEEALAKRRGRNSPNGNLIRMLVLFFLESELHEHAAYLVDSLWESSQELLKDWECMTELLLEEPVQGEEAMSDRQESALIELMVCTIRQAAEAHPPVGRGTGKRVLTAKERKTQIDDRNKLTEHFIITLPMLLSKYSADAEKVANLLQIPQYFDLEIYSTGRMEKHLDALLKQIKFVVEKHVESDVLEACSKTYSILCSEEYTIQNRVDIARSQLIDEFVDRFNHSVEDLLQEGEEADDDDIYNVLSTLKRLTSFHNAHDLTKWDLFGNCYRLLKTGIEHGAMPEQIVVQALQCSHYSILWQLVKITDGSPSKEDLLVLRKTVKSFLAVCQQCLSNVNTPVKEQAFMLLCDLLMIFSHQLMTGGREGLQPLVFNPDTGLQSELLSFVMDHVFIDQDEENQSMEGDEEDEANKIEALHKRRNLLAAFSKLIIYDIVDMHAAADIFKHYMKYYNDYGDIIKETLSKTRQIDKIQCAKTLILSLQQLFNELVQEQGPNLDRTSAHVSGIKELARRFALTFGLDQIKTREAVATLHKDGIEFAFKYQNQKGQEYPPPNLAFLEVLSEFSSTSFCVNSCFQFSWVYI

SEQ ID NO: 745483 - protein, 720 aa, Homo sapiens
MITSELPVLQDSTNETTAHSDAGSELEETEVKGKRKRGRPGRPPSTNKKPRKSPGEKSRIEAGIRGAGRGRANGHPQQNGEGEPVTLFEVVKLGKSAMQSVVDDWIESYKQDRDIALLDLINFFIQCSGCRGTVRIEMFRNMQNAEIIRKMTEEFDEDSGDYPLTMPGPQWKKFRSNFCEFIGVLIRQCQYSIIYDEYMMDTVISLLTGLSDSQVRAFRHTSTLAAMKLMTALVNVALNLSIHQDNTQRQYEAERNKMIGKRANERLELLLQKRKELQENQDEIENMMNSIFKGIFVHRYRDAIAEIRAICIEEIGVWMKMYSDAFLNDSYLKYVGWTLHDRQGEVRLKCLKALQSLYTNRELFPKLELFTNRFKDRIVSMTLDKEYDVAVEAIRLVTLILHGSEEALSNEDCENVYHLVYSAHRPVAVAAGEFLHKKLFSRHDPQAEEALAKRRGRNSPNGNLIRMLVLFFLESELHEHAAYLVDSLWESSQELLKDWECMTELLLEEPVQGEEAMSDRQESALIELMVCTIRQAAEAHPPVGRGTGKRVLTAKERKTQIDDRNKLTEHFIITLPMLLSKYSADAEKVANLLQIPQYFDLEIYSTGRMEKHLDALLKQIKFVVEKHVESDVLEACSKTYSILCSEEYTIQNRVDIARSQLIDEFVDRFNHSVEDLLQEGEEADDDDIYNVLSTLKRLTSFHKYVILFKVKATRWLMPVT

SEQ ID NO: 745484 - protein, 301 aa, Homo sapiens [sequence omitted]

SEQ ID NO: 745485 - protein, 108 aa, Homo sapiens
MITSELPVLQDSTNETTAHSDAGSELEETEVKGKRKRGRPGRPPSTNKKPRKSPGEKSRIEAGIRGAGRGRANGHPQQNGEGEPVTLFEVVKLGKSAMQVNFKFLFHV

SEQ ID NO: 745486 - protein, 101 aa, Homo sapiens
EFSFLNHLLNWQKLKKMDKLTAGRDVGKGTVMHCFWTCVLCVVTAFLENNLAISTISKLNTRFDPEILLQELYCREIKLQCVRTCMYIPPPRMFIVVFFWK

SEQ ID NO: 745487 - protein, 161 aa, Homo sapiens
CLGLVGRASAPAEPDSACCMELPAAAGDAVRSPAAAAALIFPGGSGELELALEEELALLAAGERPSDPGEHPQAEPGSLAEGAGPQPPPSQDPELLSVIRQKEKDLVLAARLGKALLERNQDMSRQYEQMHKELTDKLETRSHSIPQAAVEWLIMAYCTLK

SEQ ID NO: 745488 - protein, 104 aa, Homo sapiens
MTALKEERDRLRVTSEDKEPKEQLQKAIRDRDEAIAKKNAVELELAKCRMDMMSLNSQLLDAIQQKLNLSQQLEAWQFASSGLFTIWLLWFLISGLSQFPYQQL

SEQ ID NO: 745489 - protein, 222 aa, Homo sapiens
ESSETSSAKDVPAGSLRTALNELKRLIQSIVDGMEPTGSRRLDDDSLEEQIRQTSEDSRALRELMEGERGKLRQSLEELQRLHSQVTLLSVEMTALKEERDRLRVTSEDKEPKEQLQKAIRDRDEAIAKKNAVELELAKCRMDMMSLNSQLLDAIQQKLNLSQQLEAWQDDMHRVIDRQLMDTHLKERSQPAAALCRGHSAGRGDEPSIAEGKRLFSFFRKI

SEQ ID NO: 745490 - protein, 338 aa, Homo sapiens
MSWRGSRFICGKQIEKNHGLSRNCRNRTKGYWISSAGKLRLGFTILPQPFLYIENKTTNSSVTGGKRTSLISSLSTDVLMGAVPCLHVFQASEVERQLSMQVHALREDFREKNSSTNQHIIRLESLQAEIKMLSDRKRELEHRLSATLEENDLLQGTVEELQDRVLILERQGHDKDLQLHQSQLELQEVRLSCRQLQVKVEELTEERSLQSSAATSTSLLSEIEQSMEAEELEQEREQVTLLSVEMTALKEERDRLRVTSEDKEPKEQLQKAIRDRDEAIAKKNAVELELAKCRMDMMSLNSQLLDAIQQKLNLSQQLEAWQFASSGLFTIWLLWFLI

SEQ ID NO: 745491 - protein, 549 aa, Homo sapiens
CLGLVGRASAPAEPDSACCMELPAAAGDAVRSPAAAAALIFPGGSGELELALEEELALLAAGERPSDPGEHPQAEPGSLAEGAGPQPPPSQDPELLSVIRQKEKDLVLAARLGKALLERNQDMSRQYEQMHKELTDKLEHLEQEKHELRRRFENREGEWEGRVSELESDVKQLQDELERQQIHLREADREKSRAVQELSEQNQRLLDQLSRKIKTWIYYSPQPFLYIENKTTNSSVTGGKRTSLISSLSTDVLMGAVPCLHVFQASEVERQLSMQVHALREDFREKNSSTNQHIIRLESLQAEIKMLSDRKRELEHRLSATLEENDLLQGTVEELQDRVLILERQGHDKDLQLHQSQLELQEVRLSCRQLQVKVEELTEERSLQSSAATSTSLLSEIEQSMEAEELEQEREQVTLLSVEMTALKEERDRLRVTSEDKEPKEQLQKAIRDRDEAIAKKNAVELELAKCRMDMMSLNSQLLDAIQQKLNLSQQLEAWQDDMHRVIDRQLMDTHLKERSQPAAALCRGHSAGRGDEPSIAEGKRLFSFFRKI

SEQ ID NO: 745492 - protein, 462 aa, Homo sapiens
CLGLVGRASAPAEPDSACCMELPAAAGDAVRSPAAAAALIFPGGSGELELALEEELALLAAGERPSDPGEHPQAEPGSLAEGAGPQPPPSQDPELLSVIRQKEKDLVLAARLGKALLERNQDMSRQYEQMHKELTDKLEHLEQEKHELRRRFENREGEWEGRVSELESDVKQLQDELERQQIHLREADREKSRAVQELSEQNQRLLDQLSRCFRHQKLRDNSPCRSTPSEKTFGRKTHQPTSTVIRLESLQAEIKMLSDRKRELEHRLSATLEENDLLQGTVEELQDRVLILERQGHDKDLQLHQSQLELQEVRLSCRQLQVKVEELTEERSLQSSAATSTSLLSEIEQSMEAEELEQEREQVTLLSVEMTALKEERDRLRVTSEDKEPKEQLQKAIRDRDEAIAKKNAVELELAKCRMDMMSLNSQLLDAIQQKLNLSQQLEAWQFASSGLFTIWLLWFLI

SEQ ID NO: 745493 - protein, 116 aa, Homo sapiens
ESSETSSAKDVPAGSLRTALNELKRLIQSIVDGMEPTGSRRLDDDSLEEQIRQTSEDSRALRELMEGERGKLRQSLEELQRLHSQVSTPTFSSVQGMCTCPWLSWDPFEFLSPISV

SEQ ID NO: 745494 - protein, 96 aa, Homo sapiens
VGPTTDLRVGSGWKKPHRVPPPRNTEDSSNKFHVLPIRPSQKRPKGMTMESSNYSQHSSLWERTWNEVTANNRTPRSPSKAQTPDNKDTSGSESRQ

SEQ ID NO: 745495 - protein, 86 aa, Homo sapiens
RRLQLPVGRAANHSPRPMGVSAGLAFDQWKHYGRWPMGAPTRWPLANGSTQLRLVGAVLLGAAMPLRLRATRGLTRGQEARADPER

SEQ ID NO: 745496 - protein, 86 aa, Homo sapiens; identical to SEQ ID NO: 745495

SEQ ID NO: 745497 - protein, 86 aa, Homo sapiens; identical to SEQ ID NO: 745495

SEQ ID NO: 745498 - protein, 784 aa, Homo sapiens
MPHTLWMVWVLGVIISLSKEESSNQASLSCDRNGICKGSSGSLNSIPSGLTEAVKSLDLSNNRITYISNSDLQRCVNLQALVLTSNGINTIEEDSFSSLGSLEHLDLSYNYLSNLSSSWFKPLSSLTFLNLLGNPYKTLGETSLFSHLTKLQILRVGNMDTFTKIQRKDFAGLTFLEELEIDASDLQSYEPKSLKSIQNVSHLILHMKQHILLLEIFVDVTSSVECLELRDTDLDTFHFSELSTGETNSLIKKFTFRNVKITDESLFQVMKLLNQISGLLELEFDDCTLNGVGNFRASDNDRVIDPGKVETLTIRRLHIPRFYLFYDLSTLYSLTERVKRITVENSKVFLVPCLLSQHLKSLEYLDLSENLMVEEYLKNSACEDAWPSLQTLILRQNHLASLEKTGETLLTLKNLTNIDISKNSFHSMPETCQWPEKMKYLNLSSTRIHSVTGCIPKTLEILDVSNNNLNLFSLNLPQLKELYISRNKLMTLPDASLLPMLLVLKISRNAITTFSKEQLDSFHTLKTLEAGGNNFICSCEFLSFTQEQQALAKVLIDWPANYLCDSPSHVRGQQVQDVRLSVSECHRTALVSGMCCALFLLILLTGVLCHRFHGLWYMKMMWAWLQAKRKPRKAPSRNICYDAFVSYSERDAYWVENLMVQELENFNPPFKLCLHKRDFIPGKWIIDNIIDSIEKSHKTVFVLSENFVKSEWCKYELDFSHFRLFDENNDAAILILLEPIEKKAIPQRFCKLRKIMNTKTYLEWPMDEAQREGFWVNLRAAIKS

SEQ ID NO: 745499 - protein, 784 aa, Homo sapiens; identical to SEQ ID NO: 745498

SEQ ID NO: 745500 - protein, 784 aa, Homo sapiens; identical to SEQ ID NO: 745498

SEQ ID NO: 745501 - protein, 784 aa, Homo sapiens; identical to SEQ ID NO: 745498

SEQ ID NO: 745502 - protein, 518 aa, Homo sapiens
PSSLLHLSFVSTSNMSRQFTCKSGAAAKGGFSGFSGGFGSRSLYSLGGVRSLNVASGSGKSGGYGFGRGRASGFAGSMFGSVALGPVCPTVCPPGGIHQVTVNESLLAPLNVELDPEIQKVRAQEREQIKALNNKFASFIDKVRFLEQQNQVLETKWELLQQLDLNNCKNNLEPILEGYISNLRKQLETLSGDRVRLDSELRNVRDVVEDYKKRYEEEINKRTAAENEFVLLKKDVDAAYANKVELQAKVESMDQEIKFFRCLFEAEITQIQSHISDMSVILSMDNNRNLDLDSIIDEVRTQYEEIALKSKAEAEALYQTKFQELQLAAGRHGDDLKNTKNEISELTRLIQRIRSEIENVKKQASNLETAIADAEQRGDNALKDARAKLDELEGALHQAKEELARMLREYQELMSLKLALDMEIATYRKLLESEECRMSGEFPSPVSISIISSTSGGSVYGFRPSMVSGGYVANSSNCISGVCSVRGGEGRSRGSANDYKDTLGKGSSLSAPSKKTSR

SEQ ID NO: 745503 - protein, 432 aa, Homo sapiens
PSSLLHLSFVSTSNMSRQFTCKSGAAAKGGFSGCSAVLSGGSSSSFRAGSKGLSGGFGSRSLYSLGGVRSLNVASGSGKSGGYGFGRGRASGFAGSMFGSVALGPVCPTVCPPGGIHQVTVNESLLAPLNVELDPEIQKVRAQEREQIKALNNKFASFIDKVRFLEQQNQVLETKWELLQQLDLNNCKNNLEPILEGYISNLRKQLETLSGDRVRLDSELRNVRDVVEDYKKRYEEEINKRTAAENEFVLLKKDVDAAYANKVELQAKVESMDQEIKFFRCLFEAEITQIQSHISDMSVILSMDNNRNLDLDSIIDEVRTQYEEIALKSKAEAEALYQTKFQELQLAAGRHGDDLKNTKLGEIPPCTHPINSLAVVPQLHHQPRSWLPAFLLCPASSAVANYSAGLPGSLPKAPHTLGPSIVPAYARSWLCV

SEQ ID NO: 745504 - protein, 537 aa, Homo sapiens
PSSLLHLSFVSTSNMSRQFTCKSGAAAKGGFSGCSAVLSGGSSSSFRAGSKGLSGGFGSRSLYSLGGVRSLNVASGSGKSGGYGFGRGRASGFAGSMFGSVALGPVCPTVCPPGGIHQVTVNESLLAPLNVELDPEIQKVRAQEREQIKALNNKFASFIDKVRFLEQQNQVLETKWELLQQLDLNNCKNNLEPILEGYISNLRKQLETLSGDRVRLDSELRNVRDVVEDYKKRYEEEINKRTAAENEFVLLKKDVDAAYANKVELQAKVESMDQEIKFFRCLFEAEITQIQSHISDMSVILSMDNNRNLDLDSIIDEVRTQYEEIALKSKAEAEALYQTKFQELQLAAGRHGDDLKNTKNEISELTRLIQRIRSEIENVKKQASNLETAIADAEQRGDNALKDARAKLDELEGALHQAKEELARMLREYQELMSLKLALDMEIATYRKLLESEECRMSGEFPSPVSISIISSTSGGSVYGFRPSMVSGGYVANSSNCISGVCSVRGGEGRSRGSANDYKDTLGKGSSLSAPSKKTSR

SEQ ID NO: 745505 - protein, 147 aa, Homo sapiens
MSQTRDLQGGKAFGLLKAQQEERLDEINKQFLDDPKYSSDEDLPSKLEGFKEKYMEFDLNGNGDIDIMSLKRMLEKLGVPKTHLELKKLIGEVSSGSGETFSYPDFLRMMLGKRSAILKMILMYEEKAREKEKPTGPPAKKAISELP

SEQ ID NO: 745506 - protein, 147 aa, Homo sapiens; identical to SEQ ID NO: 745505

SEQ ID NO: 745507 - protein, 147 aa, Homo sapiens; identical to SEQ ID NO: 745505

SEQ ID NO: 745508 - protein, 130 aa, Homo sapiens
MSQTRDLQGGKAFGLLKAQQEERLDEINKQFLDDPKYSSDEDLPSKLEGFKEKYMEFDLNGNGDIDIMSLKRMLEKLGVPKTHLELKKLIGEVSSGSGETFSYPDFLRMMLGKRSAILKITSIYEKNQKE

SEQ ID NO: 745509 - protein, 167 aa, Homo sapiens
EGKGKFGRKASEKTGGREGEPADRGLQLGGKAFGLLKAQQEERLDEINKQFLDDPKYSSDEDLPSKLEGFKEKYMEFDLNGNGDIDIMSLKRMLEKLGVPKTHLELKKLIGEVSSGSGETFSYPDFLRMMLGKRSAILKMILMYEEKAREKEKPTGPPAKKAISELP

SEQ ID NO: 745510 - protein, 132 aa, Homo sapiens
MEFDLNGNGDIGEKRVICGGRVVCRPKKTEVSPTCSIPHDLGGGPPTTVGGRRMGMRKWERRERVSPPSPHPHPLPPDIMSLKRMLEKLGVPKTHLELKKLIGEVSSGSGETFSYPDFLRMMLGKRSAILKM

SEQ ID NO: 745511 - protein, 147 aa, Homo sapiens; identical to SEQ ID NO: 745505

SEQ ID NO: 745512 - protein, 147 aa, Homo sapiens; identical to SEQ ID NO: 745505

SEQ ID NO: 745513 - protein, 147 aa, Homo sapiens; identical to SEQ ID NO: 745505

SEQ ID NO: 745514 - protein, 167 aa, Homo sapiens; identical to SEQ ID NO: 745509

SEQ ID NO: 745515 - protein, 129 aa, Homo sapiens
FAAADTAARRRHGRSPAENPPVSAYPFLLSPLTQKYMEFDLNGNGDIDIMSLKRMLEKLGVPKTHLELKKLIGEVSSGSGETFSYPDFLRMMLGKRSAILKMILMYEEKAREKEKPTGPPAKKAISELP

SEQ ID NO: 745516 - protein, 100 aa, Homo sapiens
EGKGKFGRKASEKTGGREGEPADRGLQLGGKAFGLLKAQQEERLDEINKQFLDDPKYSSDEDLPSKLEGFKGEGETVGGGDRAGGRRVRISTRTRQEQQR

SEQ ID NO: 745517 - protein, 200 aa, Homo sapiens
PSLDLSVLISLKQEVATLASLIPPSTGWDSMASNVTHISLAPKESALPQITNPYPAPCHPLCSFPGADLTAVDPVRGKTALEWAVLTDSFDTVWRIRQLLRRPQVEQLSQHYKPEWPALSGLVAQAQAQAQVAPSLLERLQATLSLPFAPSPQEGGVLDHLVTATTSLASPFVTTACHTLCPDHPPSLGTRSKSVPELLG

SEQ ID NO: 745518 - protein, 99 aa, Homo sapiens
RTSWDRSFCDTCCITRLGERTQLPELTEEKYQHRNLTGKMLLSRFAAARPSNYNISSSPGLQLQDPQTRTSVPPRVFICMTLKLEHQLLSESSAARPSN

SEQ ID NO: 745519 - protein, 99 aa, Homo sapiens; identical to SEQ ID NO: 745518

SEQ ID NO: 745520 - protein, 232 aa, Homo sapiens
CWPLLFSVSSLPSVALLRTGGFSQLLAQTNTSMLSSSPASCTSPSPDGENPCKKVHWASGRRRTSSTDSESKSHPDSSKIPRSRRPSRLTVKYDRGQLQRWLEMEQWVDAQVQELFQSLALSPRLECSGVIHSLQLLPPGFNRFSCLSSWSSWDYGIKQPLLSLRLTWKLSWIYPQRSRRLSWRPFLGTAPAPQRLLSLSCSVNSRNSGDSAGLRNKPERPSLAASALPGLP

SEQ ID NO: 745521 - protein, 177 aa, Homo sapiens
CWPLLFSVSSLPSVALLRTGGFSQLLAQTNTSMLSSSPASCTSPSPDGENPCKKVHWASGRRRTSSTDSESKSHPDSSKIPRSRRPSRLTVKYDRGQLQRWLEMEQWVDAQVQELFQDQATPSEPEIDLEALMDLSTEEQKTQLEAILGNCPRPTEAFISELLSQLKKLRRLSRPQK

SEQ ID NO: 745522 - protein, 103 aa, Homo sapiens
GAQSRQWRVQWAVLFTPGLNNARGLGGPFGWALSQGGHAELLTPKPSSPAPFHHHRECSFKLSKTHANKNKENDLLVVIYMVNLLWGDFFSSPACNNFLRKIK

SEQ ID NO: 745523 - protein, 461 aa, Homo sapiens
GQGNTEVIHTGTLHRQASHHIGEFCFHEIEKDIHGFEFQWKEDETNGHAAPMTEIKELAGSTGQHDQRHAGNKRIKDQLGSSFHLHLPEPHIFQSEGKIGNQVEKSINNASSVSTSQRICCRPKTHISNKYGNNSLHSSLLTQKWEVHMREKSFECIQSFKSFNCSSLLKKHQIIHLEEKQCKCDVCGKVFNQKRYLACHRRCHTGEKPYKCNECGKTFGHNSSLFIHKALHTGEKPYECEECDKVFSRKSHLERHKRIHTGEKPYKCKVRDEAFAYNSYLAKHTILHTGEKPYTCNECGKVFNRLSTLARHHRLHTGEKPYKCEECDKVFSRKSHLERHRRIHSGEKPYKCEECCKVFSRKSNLERHRRIHTGEKPYKCKVCDKAFQRDSHLAQHQRVHTGEKPYKCNECGKTFGQTSSLIIHRRLHTGEKPYKCNECGKTFSQMSSLVYHHRLHSGEKP

SEQ ID NO: 745524 - protein, 461 aa, Homo sapiens; identical to SEQ ID NO: 745523

SEQ ID NO: 745525 - protein, 461 aa, Homo sapiens; identical to SEQ ID NO: 745523

SEQ ID NO: 745526 - protein, 461 aa, Homo sapiens; identical to SEQ ID NO: 745523

SEQ ID NO: 745527 - protein, 505 aa, Homo sapiens
IEFLGHRAPAPLGCQSEAAWRSLGAVAACRELSYSCDFCPARPHTSWLTRFVKMEFQAVVMAVGGGSRMTDLTSSIPKPLLPVGNKPLIWYPLNLLERVGFEEVIVVTTRDVQKALCAEFKMKMKPDIVCIPDDADMGTADSLRYIYPKLKTDVLVLSCDLITDVALHEVVDLFRAYDASLAMLMRKGQDSIEPVPGQKGKKKAVEQRDFIGVDSTGKRLLFMANEADLDEELVIKGSILQKHPRIRFHTGLVDAHLYCLKKYIVDFLMENGSITSIRSELIPYLVRKQFSSASSQQGQEEKEEDLKKKELKSLDIYSFIKEANTLNLAPYDACWNACRGDRWEDLSRSQVRCYVHIMKEGLCSRVSTLGLYMEANRQVPKLLSALCPEEPPVHSSAQIVSKHLVGVDSLIGPETQIGEKSSIKRSVIGSSCLIKDRVTITNCLLMNSVTVEEGSNIQGSVICNNAVIEKGADIKDCLIGSGQRIEAKAKRVNEVIVGNDQLMEI

SEQ ID NO: 745528 - protein, 251 aa, Homo sapiens
IEFLGHRAPAPLGCQSEAAWRSLGAVAACRELSYSCDFCPARPHTSWLTRFVKMEFQAVVMAVGGGSRMTDLTSSIPKPLLPVGNKPLIWYPLNLLERVGFEEVIVVTTRDVQKALCAEFKMKMKPDIVCIPDDADMGTADSLRYIYPKLKTDVLVLSCDLITDVALHEVVDLFRAYDASLAMLMRKGQDSIEPVPGQKGKKKADGDSLCCQAGVQWHHLGSLQSPPPGFKHFTCLSLPSSWDYMHMPPHP

SEQ ID NO: 745529 - protein, 66 aa, Homo sapiens
TTTKFSGRVDLWRKRSNIQGSVICNNAVIEKGADIKDCLIGSGQRIEAKAKRVNEVIVGNDQLMEI

SEQ ID NO: 745530 - protein, 505 aa, Homo sapiens; identical to SEQ ID NO: 745527

SEQ ID NO: 745531 - protein, 481 aa, Homo sapiens
IEFLGHRAPAPLGCQSEAAWRSLGAVAACRELSYSCDFCPARPHTSWLTRFVKMEFQAVVMAVGGGSRMTDLTSSIPKPLLPVGNKPLIWYPLNLLERVGFEEVIVVTTRDVQKALCAEFKMKMKPDIVCIPDDADMGTADSLRYIYPKLKTDVLVLSCDLITDVALHEVVDLFRAYDASLAMLMRKGQDSIEPVPGQKGKKKAVEQRDFIGVDSTGKRLLFMANEADLDEELVIKGSILQKHPRIRFHTGLVDAHLYCLKKYIVDFLMENGSITSIRSELIPYLVRKQFSSASSQQGQEEKEEDLKKKELKSLDIYSFIKEANTLNLAPYDACWNACRGDRWEDLSRSQVRCYVHIMKEGLCSRVSTLGLYMEANRQVPKLLSALCPEEPPVHSSAQIVSKHLVGVDSLIGPETQIGEKSSIKRSVIGSSCLIKDRVTITNCLLMNSVTVEEGVCFPLYPLEAKIMEKCLQNSEGRLILT

SEQ ID NO: 745532 - protein, 506 aa, Homo sapiens
IEFLGHRAPAPLGCQSEAAWRSLGAVAACRELSYSCDFCPARPHTSWLTRFVKMEFQAVVMAVGGGSRMTDLTSSIPKPLLPVGNKPLIWYPLNLLERVGFEEVIVVTTRDVQKALCAEFKMKMKPDIVCIPDDADMGTADSLRYIYPKLKTDVLVLSCDLITDVALHEVVDLFRAYDASLAMLMRKGQDSIEPVPGQKGKKKAVEQRDFIGVDSTGKRLLFMANEADLDEELVIKGSILQKHPRIRFHTGLVDAHLYCLKKYIVDFLMENGSITSIRSELIPYLVRKQFSSASSQQGQEEKEEDLKKKELKSLDIYSFIKEANTLNLAPYDACWNACRGDRWEDLSRSQVRCYVHIMKEGLCSRVSTLGLYMEANRQVPKLLSALCPEEPPVHSSAQIVSKHLVGVDSLIGPETQIGEKSSIKRSVIGSSCLIKDRVTITNCLLMNSVTVEEGVMSSLESLSTHQKRKEPPHPQLLRSFMALCRIFSKSISEAGARDTVECHFRP

SEQ ID NO: 745533 - protein, 461 aa, Homo sapiens
IEFLGHRAPAPLGCQSEAAWRSLGAVAACRELSYSCDFCPARPHTSWLTRFVKMEFQAVVMAVGGGSRMTDLTSSIPKPLLPVGNKPLIWYPLNLLERVGFEEVIVVTTRDVQKALCAEFKMKMKPDIVCIPDDADMGTADSLRYIYPKLKTDVLVLSCDLITDVALHEVVDLFRAYDASLAMLMRKGQDSIEPVPGQKGKKKAVEQRDFIGVDSTGKRLLFMANEADLDEELVIKGSILQKHPRIRFHTGLVDAHLYCLKKYIVDFLMENGSITSIRSELIPYLVRKQFSSASSQQGQEEKEEDLKKKELKSLDIYSFIKEANTLNLAPYDACWNACRGDRWEDLSRSQVRCYVHIMKEGLCSRVSTLGLYMEANRQVPKLLSALCPEEPPVHSSAQIVSKHLVGVDSLIGPETQIGEKSSIKRSVIGSSCLIKDRVTITNCLLMNSVTVEEGESTNSKA

SEQ ID NO: 745534 - protein, 407 aa, Homo sapiens
IEFLGHRAPAPLGCQSEAAWRSLGAVAACRELSYSCDFCPARPHTSWLTRFVKMEFQAVVMAVGGGSRMTDLTSSIPKPLLPVGNKPLIWYPLNLLERVGFEEVIVVTTRDVQKALCAEFKMKMKPDIVCIPDDADMGTADSLRYIYPKLKTDVLVLSCDLITDVALHEVVDLFRAYDASLAMLMRKGQDSIEPVPGQKGKKKAVEQRDFIGVDSTGKRLLFMANEADLDEELVIKGSILQKHPRIRFHTGLVDAHLYCLKKYIVDFLMENGSITSIRSELIPYLVRKQFSSASSQQGQEEKEEDLKKKELKSLDIYSFIKEANTLNLAPYDACWNACRGDRWEDLSRSQVRCYVHIMKEGLCSRVSTLGLYMEANRQVPKLLSALCPEEPPVHSSAQIVSKHLLNE

SEQ ID NO: 745535 - protein, 558 aa, Homo sapiens
IEFLGHRAPAPLGCQSEAAWRSLGAVAACRELSYSCDFCPARPHTSWLTRFVKMEFQAVVMAVGGGSRMTDLTSSIPKPLLPVGNKPLIWYPLNLLERVGFEEVIVVTTRDVQKALCAEFKMKMKPDIVCIPDDADMGTADSLRYIYPKLKLPKPLSLTYQERLWFIHSPRPWTDVLVLSCDLITDVALHEVVDLFRAYDASLAMLMRKGQDSIEPVPGQKGKKKAAPGPVMSHGEQSINIIEWPAYKGSSSCPPPQVEQRDFIGVDSTGKRLLFMANEADLDEELVIKGSILQKHPRIRFHTGLVDAHLYCLKKYIVDFLMENGSITSIRSELIPYLVRKQFSSASSQQGQEEKEEDLKKKELKSLDIYSFIKEANTLNLAPYDACWNACRGDRWEDLSRSQVRCYVHIMKEGLCSRVSTLGLYMEANRQVPKLLSALCPEEPPVHSSAQIVSKHLVGVDSLIGPETQIGEKSSIKRSVIGSSCLIKDRVTITNCLLMNSVTVEEGSNIQGSVICNNAVIEKGADIKDCLIGSGQRIEAKAKRVNEVIVGNDQLMEI

SEQ ID NO: 745536 - protein, 242 aa, Homo sapiens
IEFLGHRAPAPLGCQSEAAWRSLGAVAACRELSYSCDFCPARPHTSWLTRFVKMEFQAVVMAVGGGSRMTDLTSSIPKPLLPVGNKPLIWYPLNLLERVGFEEVIVVTTRDVQKALCAEFKMKMKPDIVCIPDDADMGTADSLRYIYPKLKTDVLVLSCDLITDVALHEVVDLFRAYDASLAMLMRKGQDSIEPVPGQKGKKKAVEQRDFIGVDSTGKRLLFMANEADLDEELVIKGSILQK

SEQ ID NO: 745537 - protein, 505 aa, Homo sapiens; identical to SEQ ID NO: 745527

SEQ ID NO: 745538 - protein, 199 aa, Homo sapiens
IEFLGHRAPAPLGCQSEAAWRSLGAVAACRELSYSCDFCPARPHTSWLTRFVKMEFQAVVMAVGGGSRMTDLTSSIPKPLLPVGNKPLIWYPLNLLERVGFEEVIVVTTRDVQKALCAEFKMKMKPDIVCIPDDADMGTADSLRYIYPKLKMALSLDEIVFLIEMFLMYLICPEAHCSGANVQHDLLSQSCQYHSFIFL

SEQ ID NO: 745539 - protein, 162 aa, Homo sapiens
IEFLGHRAPAPLGCQSEAAWRSLGAVAACRELSYSCDFCPARPHTSWLTRFVKMEFQAVVMAVGGGSRMTDLTSSIPKPLLPVGNKPLIWYPLNLLERVGFEEVIVVTTRDVQKALCAEFKMKMKPDIVCIPDDADMGTADSLRYIYPKLKVKSNFLTLLVY

SEQ ID NO: 745540 - protein, 495 aa, Homo sapiens
QADLRKTPATHEMFELVLRRELSYSCDFCPARPHTSWLTRFVKMEFQAVVMAVGGGSRMTDLTSSIPKPLLPVGNKPLIWYPLNLLERVGFEEVIVVTTRDVQKALCAEFKMKMKPDIVCIPDDADMGTADSLRYIYPKLKTDVLVLSCDLITDVALHEVVDLFRAYDASLAMLMRKGQDSIEPVPGQKGKKKAVEQRDFIGVDSTGKRLLFMANEADLDEELVIKGSILQKHPRIRFHTGLVDAHLYCLKKYIVDFLMENGSITSIRSELIPYLVRKQFSSASSQQGQEEKEEDLKKKELKSLDIYSFIKEANTLNLAPYDACWNACRGDRWEDLSRSQVRCYVHIMKEGLCSRVSTLGLYMEANRQVPKLLSALCPEEPPVHSSAQIVSKHLVGVDSLIGPETQIGEKSSIKRSVIGSSCLIKDRVTITNCLLMNSVTVEEGSNIQGSVICNNAVIEKGADIKDCLIGSGQRIEAKAKRVNEVIVGNDQLMEI

SEQ ID NO: 745541 - protein, 454 aa, Homo sapiens
IEFLGHRAPAPLGCQSEAAWRSLGAVAACRELSYSCDFCPARPHTSWLTRFVKMEFQAVVMAVGGGSRMTDLTSSIPKPLLPVGNKPLIWYPLNLLERVGFEEVIVVTTRDVQKALCAEFKMKMKPDIVCIPDDADMGTADSLRYIYPKLKTDVLVLSCDLITDVALHEVVDLFRAYDASLAMLMRKGQDSIEPVPGQKGKKKAVEQRDFIGVDSTGKRLLFMANEADLDEELVIKGSILQKHPRIRFHTGLVDAHLYCLKKYIVDFLMENGSITSIRSELIPYLVRKQFSSASSQQGQEEKEEDLKKKELKSLDIYSFIKEANTLNLAPYDACWNACRGDRWEDLSRSQVRCYVHIMKEGLCSRVSTLGLYMEANRQVPKLLSALCPEEPPVHSSAQIVSKHLVGVDSLIGPETQIGEKSSIKRSVIGSSCLIKDRVTITNCLLMNSVTVEEG

SEQ ID NO: 745542 - protein, 470 aa, Homo sapiens
MMGHTERSYTSTKCQYQAAGFEAVVMAVGGGSRMTDLTSSIPKPLLPVGNKPLIWYPLNLLERVGFEEVIVVTTRDVQKALCAEFKMKMKPDIVCIPDDADMGTADSLRYIYPKLKTDVLVLSCDLITDVALHEVVDLFRAYDASLAMLMRKGQDSIEPVPGQKGKKKAVEQRDFIGVDSTGKRLLFMANEADLDEELVIKGSILQKHPRIRFHTGLVDAHLYCLKKYIVDFLMENGSITSIRSELIPYLVRKQFSSASSQQGQEEKEEDLKKKELKSLDIYSFIKEANTLNLAPYDACWNACRGDRWEDLSRSQVRCYVHIMKEGLCSRVSTLGLYMEANRQVPKLLSALCPEEPPVHSSAQIVSKHLVGVDSLIGPETQIGEKSSIKRSVIGSSCLIKDRVTITNCLLMNSVTVEEGSNIQGSVICNNAVIEKGADIKDCLIGSGQRIEAKAKRVNEVIVGNDQLMEI

SEQ ID NO: 745543 - protein, 527 aa, Homo sapiens
IEFLGHRAPAPLGCQSEAAWRSLGAVAACRELSYSCDFCPARPHTSWLTRFVKMEFQAVVMAVGGGSRMTDLTSSIPKPLLPVGNKPLIWYPLNLLERVGFEEVIVVTTRDVQKALCAEFKMKMKPDIVCIPDDADMGTADSLRYIYPKLKLPKPLSLTYQERLLVHSFSQALTDVLVLSCDLITDVALHEVVDLFRAYDASLAMLMRKGQDSIEPVPGQKGKKKAVEQRDFIGVDSTGKRLLFMANEADLDEELVIKGSILQKHPRIRFHTGLVDAHLYCLKKYIVDFLMENGSITSIRSELIPYLVRKQFSSASSQQGQEEKEEDLKKKELKSLDIYSFIKEANTLNLAPYDACWNACRGDRWEDLSRSQVRCYVHIMKEGLCSRVSTLGLYMEANRQVPKLLSALCPEEPPVHSSAQIVSKHLVGVDSLIGPETQIGEKSSIKRSVIGSSCLIKDRVTITNCLLMNSVTVEEGSNIQGSVICNNAVIEKGADIKDCLIGSGQRIEAKAKRVNEVIVGNDQLMEI

SEQ ID NO: 745544 - protein, 421 aa, Homo sapiens
IEFLGHRAPAPLGCQSEAAWRSLGAVAACRELSYSCDFCPARPHTSWLTRFVKMEFQAVVMAVGGGSRMTDLTSSIPKPLLPVGNKPLIWYPLNLLERVGFEEVIVVTTRDVQKALCAEFKMKMKPDIVCIPDDADMGTADSLRYIYPKLKTDVLVLSCDLITDVALHEVVDLFRAYDASLAMLMRKGQDSIEPVPGQKGKKKAVEQRDFIGVDSTGKRLLFMANEADLDEELVIKGSILQKHPRIRFHTGLVDAHLYCLKKYIVDFLMENGSITSIRSELIPYLVRKQFSSASSQQGQEEKEEDLKKKELKSLDIYSFIKEANTLNLAPYDACWNACRGDRWEDLSRSQVRCYVHIMKEGLCSRVSTLGLYMEANRQVPKLLSALCPEEPPVHSSAQIVSKHLHFGRLRQVHHLRSGVRD

SEQ ID NO: 745545 - protein, 290 aa, Homo sapiens
IEFLGHRAPAPLGCQSEAAWRSLGAVAACRELSYSCDFCPARPHTSWLTRFVKMEFQAVVMAVGGGSRMTDLTSSIPKPLLPVGNKPLIWYPLNLLERVGFEEVIVVTTRDVQKALCAEFKMKMKPDIVCIPDDADMGTADSLRYIYPKLKTDVLVLSCDLITDVALHEVVDLFRAYDASLAMLMRKGQDSIEPVPGQKGKKKAVEQRDFIGVDSTGKRLLFMANEADLDEELVIKGSILQKHLSCCHLLAIVNSAAVNVGVQTSLQDLAFSSFGYIFRSGITGSYGREL

SEQ ID NO: 745546 - protein, 320 aa, Homo sapiens
ASAPAVSQPTAPAPSCLPKAGQVIPTLLREAPFSSVIAPTLLCGFLFLAWVAAEVPEESSRMAGSGARSEEGRRQHAFVPEPFDGANVVPNLWLHSFEVINDLNHWDHITKLRFLKESLRGEALGVYNRLSPQDQGDYGTVKEALLKAFGVPGAAPSHLPKEIVFANSMGKGYYLKGKIGKVPVRFLVDSGAQVSVVHPNLWEEVTDGDLDTLQPFENVVKVANGAEMKILGVWDTAVSLGKLKLKAQFLVANASAEEAIIGTDVLQDHNAILDFEHRTCTLKGKKFRLLPVGGSLEDEFDLELIEEDPSSEEGRQELSH

SEQ ID NO: 745547 - protein, 38 aa, Homo sapiens
MAHPTLSSSPSSWAPILVAVRAVALVHAHTVLPVCMCA

SEQ ID NO: 745548 - protein, 222 aa, Homo sapiens
KDSGVPQMSSTGTVHITVIDQNDNPSQSRTVEIFVNYYGNLFPGGILGSVKPQDPDVLDSFHCSLTSGVTSLFSIPGGTCDLNSQPRSTDGTFDLTVLSNDGVHSTVTSNIRVFFAGFSNATVDNSILLRLGVPTVKDFLTNHYLHFLRIASSQLTGLGTAVQLYSAYEENNRTFLLAAVKRNHNQYVNPSGVATFFESIKEILLRQSGVKVESVDHDSCVH

SEQ ID NO: 745549 - protein, 212 aa, Homo sapiens
PCDLSGRCHATGEAQKALECFCQAASEVGKEEFLDRLIRSEDGEIVSTPRLQYYDKVLRLLDVIGLPELVIQLATSAITEAGDDWKSQATLRTCIFKHHLDLGHNSQAYEALTQIPDSSRQLDCLRQLVVVLCERSQLQDLVEFPYVNLHNEVVGIIESRARAVDLMTHNYYELLYAFHIYRHNYRKAGTVMLYVWMRLPESRLSGTAPAYG

SEQ ID NO: 745550 - protein, 1394 aa, Homo sapiens
PATGRFPQIESASPAPFSSGFLAAHPHSPGGSLATKGRSRLSAPGMLHLSAAPPAPPPEVTATARPCLCSVGRRGDGGKMAAAGALERSFVELSGAERERPRHFREFTVCSIGTANAVAGAVKYSESAGGFYYVESGKLFSVTRNRFIHWKTSGDTLELMEESLDINLLNNAIRLKFQNCSVLPGGVYVSETQNRVIILMLTNQTVHRLLLPHPSRMYRSELVVDSQMQSIFTDIGKVDFTDPCNYQLIPAVPGISPNSTASTAWLSSDGEALFALPCASGGIFVLKLPPYDIPGMVSVVELKQSSVMQRLLTGWMPTAIRGDQSPSDRPLSLAVHCVEHDAFIFALCQDHKLRMWSYKEQMCLMVADMLEYVPVKKDLRLTAGTGHKLRLAYSPTMGLYLGIYMHAPKRGQFCIFQLVSTESNRYSLDHISSLFTSQETLIDFALTSTDIWALWHDAENQTVVKYINFEHNVAGQWNPVFMQPLPEEEIVIRDDQDPREMYLQSLFTPGQFTNEALCKALQIFCRGTERNLDLSWSELKKEVTLAVENELQGSVTEYEFSQEEFRNLQQEFWCKFYACCLQYQEALSHPLALHLNPHTNMVCLLKKGYLSFLIPSSLVDHLYLLPYENLLTEDETTISDDVDIARDVICLIKCLRLIEESVTVDMSVIMEMSCYNLQSPEKAAEQILEDMITIDVENVMEDICSKLQEIRNPIHAIGLLIREMDYETEVEMEKGFNPAQPLNIRMNLTQLYGSNTAGYIVCRGVHKIASTRFLICRDLLILQQLLMRLGDAVIWGTGQLFQAQQDLLHRTAPLLLSYYLIKWGSECLATDVPLDTLESNLQHLSVLELTDSGALMANRFVSSPQTIVELFFQEVARKHIISHLFSQPKAPLSQTGLNWPEMITAITSYLLQLLWPSNPGCLFLECLMGNCQYVQLQDYIQLLHPWCQVNVGSCRFMLGRCYLVTGEGQKALECFCQAASEVGKEEFLDRLIRSEDGEIVSTPRLQYYDKVLRLLDVIGLPELVIQLATSAITEAGDDWKSQATLRTCIFKHHLDLGHNSQAYEALTQIPDSSRQLDCLRQLVVVLCERSQLQDLVEFPYVNLHNEVVGIIESRARAVDLMTHNYYELLYAFHIYRHNYRKAGTVMFEYGMRLGREVRTLRGLEKQGNCYLAALNCLRLIRPEYAWIVQPVSGAVYDRPGASPKRNHDGECTAAPTNRQIEILELEDLEKECSLARIRLTLAQHDPSAVAVAGSSSAEEMVTLLVQAGLFDTAISLCQTFKLPLTPVFEGLAFKCIKLQFGGEAAQAEAWAWLAANQLSSVITTKESSATDEAWRLLSTYLERYKVQNNLYHHCVINKLLSHGVPLPNWLINSYKDYQQKVDKATRDLLYRRTL

SEQ ID NO: 745551 - protein, 1254 aa, Homo sapiens
MQSIFTDIGKVDFTDPCNYQLIPAVPGISPNSTASTAWLSSDGEALFALPCASGGIFVLKLPPYDIPGMVSVVELKQSSVMQRLLTGWMPTAIRGDQSPSDRPLSLAVHCVEHDAFIFALCQDHKLRMWSYKEQMCLMVADMLEYVPVKKDLRLTAGTGHKLRLAYSPTMGLYLGIYMHAPKRGQFCIFQLVSTESNRYSLDHISSLFTSQETLIDFALTSTDIWALWHDAENQTVVKYINFEHNVAGQWNPVFMQPLPEEEIVIRDDQDPREMYLQSLFTPGQFTNEALCKALQIFCRGTERNLDLSWSELKKEVTLAVENELQGSVTEYEFSQEEFRNLQQEFWCKFYACCLQYQEALSHPLALHLNPHTNMVCLLKKGYLSFLIPSSLVDHLYLLPYENLLTEDETTISDDVDIARDVICLIKCLRLIEESVTVDMSVIMEMSCYNLQSPEKAAEQILEDMITIDVENVMEDICSKLQEIRNPIHAIGLLIREMDYETEVEMEKGFNPAQPLNIRMNLTQLYGSNTAGYIVCRGVHKIASTRFLICRDLLILQQLLMRLGDAVIWGTGQLFQAQQDLLHRTAPLLLSYYLIKWGSECLATDVPLDTLESNLQHLSVLELTDSGALMANRFVSSPQTIVELFFQEVARKHIISHLFSQPKAPLSQTGLNWPEMITAITSYLLQLLWPSNPGCLFLECLMGNCQYVQLQDYIQLLHPWCQVNVGSCRFMLGRCYLVTGEGQKALECFCQAASEVGKEEFLDRLIRSEDGEIVSTPRLQYYDKVLRLLDVIGLPELVIQLATSAITEAGDDWKSQATLRTCIFKHHLDLGHNSQAYEALTQIPDSSRQLDCLRQLVVVLCERSQLQDLVEFPYVNLHNEVVGIIESRARAVDLMTHNYYELLYAFHIYRHNYRKAGTVMFEYGMRLGREVRTLRGLEKQGNCYLAALNCLRLIRPEYAWIVQPVSGAVYDRPGASPKRNHDGECTAAPTNRQIEILELEDLEKECSLARIRLTLAQHDPSAVAVAGSSSAEEMVTLLVQAGLFDTAISLCQTFKLPLTPVFEGLAFKCIKLQFGGEAAQAEAWAWLAANQLSSVITTKESSATDEAWRLLSTYLERYKVQNNLYHHCVINKLLSHGVPLPNWLINSYKKVDAAELLRLYLNYDLLEEAVDLVSEYVDAVLGKGHQYFGIEFPLSATAPMVWLPYSSIDQLLQALGENSANSHNIALSQKILDKLEDYQQKVDKATRDLLYRRTL

SEQ ID NO: 745552 - protein, 1268 aa, Homo sapiens
MQSIFTDIGKVDFTDPCNYQLIPAVPGISPNSTASTAWLSSDGEALFALPCASGGIFVLKLPPYDIPGMVSVVELKQSSVMQRLLTGWMPTAIRGDQSPSDRPLSLAVHCVEHDAFIFALCQDHKLRMWSYKEQMCLMVADMLEYVPVKKDLRLTAGTGHKLRLAYSPTMGLYLGIYMHAPKRGQFCIFQLVSTESNRYSLDHISSLFTSQETLIDFALTSTDIWALWHDAENQTVVKYINFEHNVAGQWNPVFMQPLPEEEIVIRDDQDPREMYLQSLFTPGQFTNEALCKALQIFCRGTERNLDLSWSELKKEVTLAVENELQGSVTEYEFSQEEFRNLQQEFWCKFYACCLQYQEALSHPLALHLNPHTNMVCLLKKGYLSFLIPSSLVDHLYLLPYENLLTEDETTISDDVDIARDVICLIKCLRLIEESVTVDMSVIMEMSCYNLQSPEKAAEQILEDMITIDVENVMEDICSKLQEIRNPIHAIGLLIREMDYETEVEMEKGFNPAQPLNIRMNLTQLYGSNTAGYIVCRGVHKIASTRFLICRDLLILQQLLMRLGDAVIWGTGQLFQAQQDLLHRTAPLLLSYYLIKWGSECLATDVPLDTLESNLQHLSVLELTDSGALMANRFVSSPQTIVELFFQEVARKHIISHLFSQPKAPLSQTGLNWPEMITAITSYLLQLLWPSNPGCLFLECLMGNCQYVQLQDYIQLLHPWCQVNVGSCRFMLGRCYLVTGEGQKALECFCQAASEVGKEEFLDRLIRSEDGEIVSTPRLQYYDKVLRLLDVIGLPELVIQLATSAITEAGDDWKSQATLRTCIFKHHLDLGHNSQAYEALTQIPDSSRQLDCLRQLVVVLCERSQLQDLVEFPYVNLHNEVVGIIESRARAVDLMTHNYYELLYAFHIYRHNYRKAGTVMFEYGMRLGREVRTLRGLEKQGNCYLAALNCLRLIRPEYAWIVQPVSGAVYDRPGASPKRNHDGECTAAPTNRQIEILELEDLEKECSLARIRLTLAQHDPSAVAVAGSSSAEEMVTLLVQAGLFDTAISLCQTFKLPLTPVFEGLAFKCIKLQFGGEAAQAEAWAWLAANQLSSVITTKESSATDEAWRLLSTYLERYKVQNNLYHHCVINKLLSHGVPLPNWLINSYKKKLWIWCQNMWMLYWEKDINTSELSFHCPQQPQWCGFHTPLLISFSKLWERTVPTVTTSHCPRKYLTNWRTTSKKLIRQHGIYYIVGPCDLDCHLAFVTAWCLLGLKTTLQEPCTQGRFL

SEQ ID NO: 745553 - protein, 1001 aa, Homo sapiens
MQSIFTDIGKVDFTDPCNYQLIPAVPGISPNSTASTAWLSSDGEALFALPCASGGIFVLKLPPYDIPGMVSVVELKQSSVMQRLLTGWMPTAIRGDQSPSDRPLSLAVHCVEHDAFIFALCQDHKLRMWSYKEQMCLMVADMLEYVPVKKDLRLTAGTGHKLRLAYSPTMGLYLGIYMHAPKRGQFCIFQLVSTESNRYSLDHISSLFTSQETLIDFALTSTDIWALWHDAENQTVVKYINFEHNVAGQWNPVFMQPLPEEEIVIRDDQDPREMYLQSLFTPGQFTNEALCKALQIFCRGTERNLDLSWSELKKEVTLAVENELQGSVTEYEFSQEEFRNLQQEFWCKFYACCLQYQEALSHPLALHLNPHTNMVCLLKKGYLSFLIPSSLVDHLYLLPYENLLTEDETTISDDVDIARDVICLIKCLRLIEESVTVDMSVIMEMSCYNLQSPEKAAEQILEDMITIDVENVMEDICSKLQEIRNPIHAIGLLIREMDYETEVEMEKGFNPAQPLNIRMNLTQLYGSNTAGYIVCRGVHKIASTRFLICRDLLILQQLLMRLGDAVIWGTGQLFQAQQDLLHRTAPLLLSYYLIKWGSECLATDVPLDTLESNLQHLSVLELTDSGALMANRFVSSPQTIVELFFQEVARKHIISHLFSQPKAPLSQTGLNWPEMITAITSYLLQLLWPSNPGCLFLECLMGNCQYVQLQDYIQLLHPWCQVNVGSCRFMLGRCYLVTGEGQKALECFCQAASEVGKEEFLDRLIRSEDGEIVSTPRLQYYDKVLRLLDVIGLPELVIQLATSAITEAGDDWKSQATLRTCIFKHHLDLGHNSQAYEALTQIPDSSRQLDCLRQLVVVLCERSQLQDLVEFPYVNLHNEVVGIIESRARAVDLMTHNYYELLYAFHIYRHNYRKAGTVMFEYGMRLGREVRTLRGLEKQGNCYLAALNCLRLIRPEYAWIVQPVSGAVYDRPGASPKRNHDGECTAAPSESGVSHWFFARQ

SEQ ID NO: 745554 - protein, 969 aa, Homo sapiens
MQSIFTDIGKVDFTDPCNYQLIPAVPGISPNSTASTAWLSSDGEALFALPCASGGIFVLKLPPYDIPGMVSVVELKQSSVMQRLLTGWMPTAIRGDQSPSDRPLSLAVHCVEHDAFIFALCQDHKLRMWSYKEQMCLMVADMLEYVPVKKDLRLTAGTGHKLRLAYSPTMGLYLGIYMHAPKRGQFCIFQLVSTESNRYSLDHISSLFTSQETLIDFALTSTDIWALWHDAENQTVVKYINFEHNVAGQWNPVFMQPLPEEEIVIRDDQDPREMYLQSLFTPGQFTNEALCKALQIFCRGTERNLDLSWSELKKEVTLAVENELQGSVTEYEFSQEEFRNLQQEFWCKFYACCLQYQEALSHPLALHLNPHTNMVCLLKKGYLSFLIPSSLVDHLYLLPYENLLTEDETTISDDVDIARDVICLIKCLRLIEESVTVDMSVIMEMSCYNLQSPEKAAEQILEDMITIDVENVMEDICSKLQEIRNPIHAIGLLIREMDYETEVEMEKGFNPAQPLNIRMNLTQLYGSNTAGYIVCRGVHKIASTRFLICRDLLILQQLLMRLGDAVIWGTGQLFQAQQDLLHRTAPLLLSYYLIKWGSECLATDVPLDTLESNLQHLSVLELTDSGALMANRFVSSPQTIVELFFQEVARKHIISHLFSQPKAPLSQTGLNWPEMITAITSYLLQLLWPSNPGCLFLECLMGNCQYVQLQDYIQLLHPWCQVNVGSCRFMLGRCYLVTGEGQKALECFCQAASEVGKEEFLDRLIRSEDGEIVSTPRLQYYDKVLRLLDVIGLPELVIQLATSAITEAGDDWKSQATLRTCIFKHHLDLGHNSQAYEALTQIPDSSRQLDCLRQLVVVLCERSQLQDLVEFPYVNLHNEVVGIIESRARAVDLMTHNYYELLYAFHIYRHNYRKAGTVMFEYGMRLGREVRTLRGLEKQGNCYLAALNCLRLIRPEYAWIVQPVSGAVV

SEQ ID NO: 745555 - protein, 728 aa, Homo sapiens
MQSIFTDIGKVDFTDPCNYQLIPAVPGISPNSTASTAWLSSDGEALFALPCASGGIFVLKLPPYDIPGMVSVVELKQSSVMQRLLTGWMPTAIRGDQSPSDRPLSLAVHCVEHDAFIFALCQDHKLRMWSYKEQMCLMVADMLEYVPVKKDLRLTAGTGHKLRLAYSPTMGLYLGIYMHAPKRGQFCIFQLVSTESNRYSLDHISSLFTSQETLIDFALTSTDIWALWHDAENQTVVKYINFEHNVAGQWNPVFMQPLPEEEIVIRDDQDPREMYLQSLFTPGQFTNEALCKALQIFCRGTERNLDLSWSELKKEVTLAVENELQGSVTEYEFSQEEFRNLQQEFWCKFYACCLQYQEALSHPLALHLNPHTNMVCLLKKGYLSFLIPSSLVDHLYLLPYENLLTEDETTISDDVDIARDVICLIKCLRLIEESVTVDMSVIMEMSCYNLQSPEKAAEQILEDMITIDVENVMEDICSKLQEIRNPIHAIGLLIREMDYETEVEMEKGFNPAQPLNIRMNLTQLYGSNTAGYIVCRGVHKIASTRFLICRDLLILQQLLMRLGDAVIWGTGQLFQAQQDLLHRTAPLLLSYYLIKWGSECLATDVPLDTLESNLQHLSVLELTDSGALMANRFVSSPQTIVELFFQEVARKHIISHLFSQPKAPLSQTGLNWPEMITAITSYLLQLLWPSNPGCLFLECLMGNCQYVQLQVSSCEHFMSTHSCKAWDC

SEQ ID NO: 745556 - protein, 269 aa, Homo sapiens
PATGRFPQIESASPAPFSSGFLAAHPHSPGGSLATKGRSRLSAPGMLHLSAAPPAPPPEVTATARPCLCSVGRRGDGGKMAAAGALERSFVELSGAERERPRHFREFTVCSIGTANAVAGAVKYSESAGGFYYVESGKLFSVTRNRFIHWKTSGDTLELMEESLDINLLNNAIRLKFQNCSVLPGGVYVSETQNRVIILMLTNQTVHRLLLPHPSRMYRSVSWLSAISFISQITLGVTNVVLERCLLELKEIWILVIPHQAYFDSYRLK

SEQ ID NO: 745557 - protein, 1254 aa, Homo sapiens; identical to SEQ ID NO: 745551

SEQ ID NO: 745558 - protein, 1394 aa, Homo sapiens; identical to SEQ ID NO: 745550

SEQ ID NO: 745559 - protein, 108 aa, Homo sapiens
YSESYRDAIVSRGFHCPQQPQWCGFHTPLLISFSKLWERTVPTVTTSHCPRKYLTNWRTTSKKLIRQHGIYYIVGPCDLDCHLAFVTAWCLLGLKTTLQEPCTQGRFL

SEQ ID NO: 745560 - protein, 896 aa, Homo sapiens
MQSIFTDIGKVDFTDPCNYQLIPAVPGISPNSTASTAWLSSDGEALFALPCASGGIFVLKLPPYDIPGMVSVVELKQSSVMQRLLTGWMPTAIRGDQSPSDRPLSLAVHCVEHDAFIFALCQDHKLRMWSYKEQMCLMVADMLEYVPVKKDLRLTAGTGHKLRLAYSPTMGLYLGIYMHAPKRGQFCIFQLVSTESNRYSLDHISSLFTSQETLIDFALTSTDIWALWHDAENQTVVKYINFEHNVAGQWNPVFMQPLPEEEIVIRDDQDPREMYLQSLFTPGQFTNEALCKALQIFCRGTERNLDLSWSELKKEVTLAVENELQGSVTEYEFSQEEFRNLQQEFWCKFYACCLQYQEALSHPLALHLNPHTNMVCLLKKGYLSFLIPSSLVDHLYLLPYENLLTEDETTISDDVDIARDVICLIKCLRLIEESVTVDMSVIMEMSCYNLQSPEKAAEQILEDMITIDVENVMEDICSKLQEIRNPIHAIGLLIREMDYETEVEMEKGFNPAQPLNIRMNLTQLYGSNTAGYIVCRGVHKIASTRFLICRDLLILQQLLMRLGDAVIWGTGQLFQAQQDLLHRTAPLLLSYYLIKWGSECLATDVPLDTLESNLQHLSVLELTDSGALMANRFVSSPQTIVELFFQEVARKHIISHLFSQPKAPLSQTGLNWPEMITAITSYLLQLLWPSNPGCLFLECLMGNCQYVQLQDYIQLLHPWCQVNVGSCRFMLGRCYLVTGEGQKALECFCQAASEVGKEEFLDRLIRSEDGEIVSTPRLQYYDKVLRLLDVIGLPELVIQLATSAITEAGDDWKSQATLRTCIFKHHLDLGHNSQAYEALTQIPDSSRQLDCLRQLVVVLCERSQLQDLVEFPYVNLHNEVVGIIESRARAVQVNPH

SEQ ID NO: 745561 - protein, 269 aa, Homo sapiens; identical to SEQ ID NO: 745556

SEQ ID NO: 745562 - protein, 107 aa, Homo sapiens
LYLLQECCAENMEGTTKFINSFNCLPSPFSMSSTRLGDGSKTLQINLASALKDLHVQMYSILAMVGWQNMPQQTFPLWHKDYFVLKAIEKKKIQEKLSVLLSSKSRT

SEQ ID NO: 745563 - protein, 462 aa, Homo sapiens
MAQVSINNDYSEWDLSTDAGERARLLQSPCVDTAPKSEWEASPGGLDRGTTSTLGAIFIVVNACLGAGLLNFPAAFSTAGGVAAGIALQMGMLVFIISGLVILAYCSQASNERTYQEVVWAVCGKLTGVLCEVAIAVYTFGTCIAFLIIIGDQQDKIIAVMAKEPEGASGPWYTDRKFTISLTAFLFILPLSIPREIGFQKYASFLSVVGTWYVTAIVIIKYIWPDKEMTPGNILTRPASWMAVFNAMPTICFGFQCHVSSVPVFNSMQQPEVKTWGGVVTAAMVIALAVYMGTGICGFLTFGAAVDPDVLLSYPSEDMAVAVARAFIILSVLTSYPILHFCGRAVVEGLWLRYQGVPVEEDVGRERRRRVLQTLVWFLLTLLLALFIPDIGKVISVIGGLAACFIFVFPGLCLIQAKLSEMEEVKPASWWVLVSYGVLLVTLGAFIFGQTTANAIFVDLLA

SEQ ID NO: 745564 - protein, 177 aa, Homo sapiens
MPCPPSASDFRCQCQLQGPCCPLRSPHPGMEPSKEEEPRQNGGNPGGKDGTGASGLAPCSWGLCSQGTFLWKLGLRSFPHHDGALHLEQCHVSSVPVFNSMQQPEVKTWGGVVTAAMVIALAVYMGTGICGFLTFGAAVDPDVLLSYPSEDMAVAVARAFIILSVLTSYPILHFCGR

SEQ ID NO: 745565 - protein, 505 aa, Homo sapiens
MAQVSINNDYSEWDLSTDAGERARLLQSPCVDTAPKSEWEASPGGLDRGTTSTLGAIFIVVNACLGAGLLNFPAAFSTAGGVAAGIALQMGMLVFIISGLVILAYCSQASNERTYQEVVWAVCGKLTGVLCEVAIAVYTFGTCIAFLIIIGDQQDKIIAVMAKEPEGASGPWYTDRKFTISLTAFLFILPLSIPREIGFQKYASFLSVVGTWYVTAIVIIKYIWPDKEMTPGNILTRPASWMAVFNAMPTICFGFQCHVSSVPVFNSMQQPEVKTWGGVVTAAMVIALAVYMGTAETRSHYVAQPGLEFLGSSNSPASASQSAGVTGMSHQPSQNGEGICGFLTFGAAVDPDVLLSYPSEDMAVAVARAFIILSVLTSYPILHFCGRAVVEGLWLRYQGVPVEEDVGRERRRRVLQTLVWFLLTLLLALFIPDIGKVISVIGGLAACFIFVFPGLCLIQAKLSEMEEVKPASWWVLVSYGVLLVTLGAFIFGQTTANAIFVDLLA

SEQ ID NO: 745566 - protein, 462 aa, Homo sapiens; identical to SEQ ID NO: 745563

SEQ ID NO: 745567 - protein, 462 aa, Homo sapiens; identical to SEQ ID NO: 745563

SEQ ID NO: 745568 - protein, 462 aa, Homo sapiens; identical to SEQ ID NO: 745563

SEQ ID NO: 745569 - protein, 1294 aa, Homo sapiens
VQSFYAVRHTESWKLMSTDDQQKIQAAAFDKGDDRRLGKKPIFSSSQQRKQVSDSGDIKIKSWRGNNKKECWSYLSTNKKMKSDGLGASGHSSSTNRNSINKTLKQDDVKEKDGTKIASKITKELKTGGKNVSGKPKTVTKSKTENGDKARLENMSPRQVVERSATAAAAATGQKNLLNGKGVRNQEGQISGARPKVLTGNLNVQAKAKPLKKATGKDSPCLSIAGPSSRSTDSSMEFSISTECLDEPKENGSTEEEKPSGHKLSFCDSPGQMMKNSVDSVKNSTVAIKSRPVSRVTNGTSNKKSIHEQDTNVNNSVLKKVSGKGCSEPVPQAILKKRGTSNGCTAAQQRTKSTPSNLTKTQGSQGESPNSVKSSVSSRQSDENVAKLDHNTTTEKQAPKRKMVKQVHTALPKVNAKIVAMPKNLNQSKKGETLNNKDSKQKMPPGQVISKTQPSSQRPLKHETSTVQKSMFHDVRDNNNKDSVSEQKPHKPLINLASEISDAEALQSSCRPDPQKPLNDQEKEKLALECQNISKLDKSLKHELESKQICLDKSETKFPNHKETDDCDAANICCHSVGSDNVNSKFYSTTALKYMVSNPNENSLNSNPVCDLDSTSAGQIHLISDRENQVGRKDTNKQSSIKCVEDVSLCNPERTNGTLNSAQEDKKSKVPVEGLTIPSKLSDESAMDEDKHATADSDVSSKCFSGQLSEKNSPKNMETSESPESHETPETPFVGHWNLSTGVLHQRESPESDTGSATTSSDDIKPRSEDYDAGGSQDDDGSNDRGISKCGTMLCHDFLGRSSSDTSTPEELKIYDSNLRIEVKMKKQSNNDLFQVNSTSDDEIPRKRPEIWSRSAIVHSRERENIPRGSVQFAQEIDQVSSSADETEDERSEAENVAENFSISNPAPQQFQGIINLAFEDATENECREFSANKKFKRSVLLSVDECEELGSDEGEVHTPFQASVDSFSPSDVFDGISHEHHGRTCYSRFSRESEDNILECKQNKGNSVCKNESTVLDLSSIDSSRKNKQSVSATEKKNTIDVLSSRSRQLLREDKKVNNGSNVENDIQQRSKFLDSDVKSQERPCHLDLHQREPNSDIPKNSSTKSLDSFRSQVLPQEGPVKESHSTTTEKANIALSAGDIDDCDTLAQTRMYDHRPSKTLSPIYEMDVIEAFEQKVESETHVTDMDFEDDQHFAKQDWTLLKQLLSEQDSNLDVTNSVPEDLSLAQYLINQTLLLARDSSKPQGITHIDTLNRWSELTSPLDSSASITMASFSSEDCSPQGEWTILELETQH

SEQ ID NO: 745570 - protein, 285 aa, Homo sapiens
ADSRGSTSGCSVQFAQEIDQVSSSADETEDERSEAENVAENFSISNPAPQQFQGIINLAFEDATENECREFSANKKFKRSVLLSVDECEELGSDEGEVHTPFQASVDSFSPSDVFDGISHEHHGRTCYSRFSRESEDNILECKQNKGNSVCKNESTVLDLSSIDSSRKNKQSVSATEKKNTIDVLSSRSRQLLREDKKVNNGSNVENDIQQRSKFLDSDVKSQERPCHLDLHQREPNSDIPKNSSTKSLDSFRSQVLPQEGPVKESHSTTTEKANIALSAGNVQK

SEQ ID NO: 745571 - protein, 1144 aa, Homo sapiens
VQSFYAVRHTESWKLMSTDDQQKIQAAAFDKGDDRRLGKKPIFSSSQQRKQVSDSGDIKIKSWRGNNKKECWSYLSTNKKMKSDGLGASGHSSSTNRNSINKTLKQDDVKEKDGTKIASKITKELKTGGKNVSGKPKTVTKSKTENGDKARLENMSPRQVVERSATAAAAATGQKNLLNGKGVRNQEGQISGARPKVLTGNLNVQAKAKPLKKATGKDSPCLSIAGPSSRSTDSSMEFSISTECLDEPKENGSTEEEKPSGHKLSFCDSPGQMMKNSVDSVKNSTVAIKSRPVSRVTNGTSNKKSIHEQDTNVNNSVLKKVSGKGCSEPVPQAILKKRGTSNGCTAAQQRTKSTPSNLTKTQGSQGESPNSVKSSVSSRQSDENVAKLDHNTTTEKQAPKRKMVKQVHTALPKVNAKIVAMPKNLNQSKKGETLNNKDSKQKMPPGQVISKTQPSSQRPLKHETSTVQKSMFHDVRDNNNKDSVSEQKPHKPLINLASEISDAEALQSSCRPDPQKPLNDQEKEKLALECQNISKLDKSLKHELESKQICLDKSETKFPNHKETDDCDAANICCHSVGSDNVNSKFYSTTALKYMVSNPNENSLNSNPVCDLDSTSAGQIHLISDRENQVGRKDTNKQSSIKCVEDVSLCNPERTNGTLNSAQEDKKSKVPVEGLTIPSKLSDESAMDEDKHATADSDVSSKCFSGQLSEKNSPKNMETSESPESHETPETPFVGHWNLSTGVLHQRESPESDTGSATTSSDDIKPRSEDYDAGGSQDDDGSNDRGISKCGTMLCHDFLGRSSSDTSTPEELKIYDSNLRIEVKMKKQSNNDLFQVNSTSDDEIPRKRPEIWSRSAIVHSRERENIPRGSVQFAQEIDQVSSSADETEDERSEAENVAENFSISNPAPQQFQGIINLAFEDATENECREFSANKKFKRSVLLSVDECEELGSDEGEVHTPFQASVDSFSPSDVFDGISHEHHGRTCYSRFSRESEDNILECKQNKGNSVCKNESTVLDLSSIDSSRKNKQSVSATEKKNTIDVLSSRSRQLLREDKKVNNGSNVENDIQQRSKFLDSDVKSQERPCHLDLHQREPNSDIPKNSSTKSLDSFRSQVLPQEGPVKESHSTTTEKANIALSAGNVQK

SEQ ID NO: 745572 - protein, 144 aa, Homo sapiens
MAGSGAKRSRDGELETSLNTQGCTTEGDLLFAQKCKELQGFIPPLTDLLNGLKMGRFERGLSSFQQSVAMDRIQRIVGVLQKPQMGERYLGTLLQVEGMLKTWFPQIAAQKSSLGGGKHQLTKHFFQGHPQVNLSLLFLFPGIF

SEQ ID NO: 745573 - protein, 385 aa, Homo sapiens
MDSPSSVSSYSSYSLSSSFPTSPVNSDFGFPSDSEREDKGAHGPRPDTVGQRGGSRPSPGPIRCRHRSKVSGNQHTPSHPKQRGSASPMAGSGAKRSRDGELETSLNTQGCTTEGDLLFAQKCKELQGFIPPLTDLLNGLKMGRFERGLSSFQQSVAMDRIQRIVGVLQKPQMGERYLGTLLQVEGMLKTWFPQIAAQKSSLGGGKHQLTKHFPSHHSDSAASSPASPMEKMDQTQLGHLALKPKQPWHLTQWPAMNLTWIHTTPICNPPLSSPGTISFSHGPLGTGTGIGVILFLQHGVQPFTHSAPTTPVPPTTASPVIPGEPMKLSGEGPRCYSLPVTLPSDWSYTLSPPSLPTLARKMTIGHREQQRSHPPVAADAHLLNL

SEQ ID NO: 745574 - protein, 385 aa, Homo sapiens; identical to SEQ ID NO: 745573

SEQ ID NO: 745575 - protein, 228 aa, Homo sapiens
MDRIQRIVGVLQKPQMGERYLGTLLQVEGMLKTWFPQIAAQKSSLGGGKHQLTKHFPSHHSDSAASSPASPMEKMDQTQLGHLALKPKQPWHLTQWPAMNLTWIHTTPICNPPLSSPGTISFSHGPLGTGTGIGVILFLQHGVQPFTHSAPTTPVPPTTASPVIPGEPMKLSGEGPRCYSLPVTLPSDWSYTLSPPSLPTLARKMTIGHREQQRSHPPVAADAHLLNL

SEQ ID NO: 745576 - protein, 297 aa, Homo sapiens
MAGSGAKRSRDGELETSLNTQGCTTEGDLLFAQKCKELQGFIPPLTDLLNGLKMGRFERGLSSFQQSVAMDRIQRIVGVLQKPQMGERYLGTLLQVEGMLKTWFPQIAAQKSSLGGGKHQLTKHFPSHHSDSAASSPASPMEKMDQTQLGHLALKPKQPWHLTQWPAMNLTWIHTTPICNPPLSSPGTISFSHGPLGTGTGIGVILFLQHGVQPFTHSAPTTPVPPTTASPVIPGEPMKLSGEGPRCYSLPVTLPSDWSYTLSPPSLPTLARKMTIGHREQQRSHPPVAADAHLLNL

SEQ ID NO: 745577 - protein, 297 aa, Homo sapiens; identical to SEQ ID NO: 745576

SEQ ID NO: 745578 - protein, 297 aa, Homo sapiens; identical to SEQ ID NO: 745576

SEQ ID NO: 745579 - protein, 131 aa, Homo sapiens
MEKMDQTQLGHLALKPKQPWHLTQWPAMNLTWIHTTPICNPPLSSPGTISFSHGPLGTGTGIGVILFLQHGVQPFTHSAPTTPVPPTTASPVIPGEPMKLSGEGPRCYSLPVTLPSDWSYTLSPPSLPTLA

SEQ ID NO: 745580 - protein, 340 aa, Homo sapiens
GETTKEAGTRARSDTWMMTRHRSKVSGNQHTPSHPKQRGSASPMAGSGAKRSRDGELETSLNTQGCTTEGDLLFAQKCKELQGFIPPLTDLLNGLKMGRFERGLSSFQQSVAMDRIQRIVGVLQKPQMGERYLGTLLQVEGMLKTWFPQIAAQKSSLGGGKHQLTKHFPSHHSDSAASSPASPMEKMDQTQLGHLALKPKQPWHLTQWPAMNLTWIHTTPICNPPLSSPGTISFSHGPLGTGTGIGVILFLQHGVQPFTHSAPTTPVPPTTASPVIPGEPMKLSGEGPRCYSLPVTLPSDWSYTLSPPSLPTLARKMTIGHREQQRSHPPVAADAHLLNL

SEQ ID NO: 745581 - protein, 380 aa, Homo sapiens
MLRRKPSNASEKEPTQKKKLSLQRSSSFKDFAKSKPSSPVVSEKEFNLDDNIPEDDSGVPTPEDAGKSGKKLGKKWRAVISRTMNRKMGKMMVKALSEEMADTLEEGSASPTSPDYSLDSPGPEKMALAFSEQEEHELPVLSRQASTGSELCSPSPGSGSFGEEPPAPQYTGPFCGRARVHTDFTPSPYDHDSLKLQKGDVIQIIEKPPVGTWLGLLNGKVGSFKFIYVDVLPEEAVGHARPSRRQSKGKRPKPKTLHELLERIGLEEHTSTLLLNGYQTLEDFKELRETHLNELNIMDPQHRAKLLTAAELLLDYDTGSEEAEEGAESSQEPVAHTVSEPKVDIPRDSGCFEGSESGRDDAELAGTEEQLQGLSLAGAP

SEQ ID NO: 745582 - protein, 380 aa, Homo sapiens; identical to SEQ ID NO: 745581

SEQ ID NO: 745583 - protein, 380 aa, Homo sapiens; identical to SEQ ID NO: 745581

SEQ ID NO: 745584 - protein, 380 aa, Homo sapiens; identical to SEQ ID NO: 745581

SEQ ID NO: 745585 - protein, 104 aa, Homo sapiens
GGSPYPASPLLGRPLYYTSPFYGNYTNYGNLNAALQGQGLLRYNSAAAAPGEALHTAPKAASDAGKAGAHPLESHYRSPGGGYEPKKDASEGCTVVGGGVQPYL

SEQ ID NO: 745586 - protein, 104 aa, Homo sapiens; identical to SEQ ID NO: 745585

SEQ ID NO: 745587 - protein, 104 aa, Homo sapiens; identical to SEQ ID NO: 745585

SEQ ID NO: 745588 - protein, 104 aa, Homo sapiens; identical to SEQ ID NO: 745585

SEQ ID NO: 745589 - protein, 104 aa, Homo sapiens; identical to SEQ ID NO: 745585

SEQ ID NO: 745590 - protein, 130 aa, Homo sapiens
GGSPYPASPLLGRPLYYTSPFYGNYTNYGNLNAALQGQGLLRYNSAAAAPGEALHTAPKAASDAGKAGAHPLESHYRSPGGGYEPKKGRRPAAGGAREGRESQPRGGGAPGRPEGGSGKKIQGATPGTQN

SEQ ID NO: 745591 - protein, 130 aa, Homo sapiens
MASDLIRTILVVALISKLGTAVDAELMPSGAILQNKRENLPRVCHALAFLGMARCQDLFLVRLQGWKLGTRFQDGPRSTPQEEGGSPQRKRGMPVQIHFLLKSFLSSPITFAFISLARTVSLATAICKIV

SEQ ID NO: 745592 - protein, 261 aa, Homo sapiens
SLLGKSLASSRAPERISAKRKALVPAGRVCAGFPQLLGAFPRSRGRQSTDPGVGAHSGTPSRGAGVRESRAAALDWCSGDHSCNDSLGLQKEGWNNGRWKLSANAAPLVSMNLTCPSFFLDKRLLKSQGVQNGFRSYQDNLGVALISKLGTAVDAELMPSGAILQNKRENLPRVCHALAFLGMARCQDLFLVRLQGWKLGTRFQDGPRSTPQEEGGSPQRKRGMPVQIHFLLKSFLSSPITFAFISLARTVSLATAICKIV

SEQ ID NO: 745593 - protein, 234 aa, Homo sapiens
SLLGKSLASSRAPERISAKRKALVPAGRVCAGFPQLLGAFPRSRGRQSTDPGVGAHSGTPSRGAGVRERGCAGGALALQLQPAPSAQGSERRRLQHGVGTQLAALPGALLLPALLTFPPALRGHQAAEELRGQHGRGAPARAPLGAPRALGLLPRASGVTRVRALAGGHRAARALGWVSASILRPRGLPASRAELLPLTGAQGTTAAMTVWACKKKAGTTGDGSFLQMQHHWYP

SEQ ID NO: 745594 - protein, 234 aa, Homo sapiens; identical to SEQ ID NO: 745593

SEQ ID NO: 745595 - protein, 33 aa, Homo sapiens
TELRGRWAGSPPRFSVLAASQLPGAGLGGSDGS

SEQ ID NO: 745596 - protein, 209 aa, Homo sapiens
TPRDLSRKSHHQLRVDERQPLLVGPPESMREHVVAASKAMKMGDWKTCHSFIINEKMNGKVWDLFPEADKVRTMLVRKIQEESLRTYLFTYSSVYDSISMETLSDMFELDLPTVHSIISKMIINEELMASLDQPTQTVVMHRTEPTAQQNLALQLAEKLGSLVENNERVFDHKQGTYGGYFRDQKDGYRKNEGYMRRGGYRQQQSQTAY

SEQ ID NO: 745597 - protein, 143 aa, Homo sapiens
IISKMMECTVGRSSSNMSDSVSMLMEIIDTAVGEEVGPQWLFLDLPTVHSIISKMIINEELMASLDQPTQTVVMHRTEPTAQQNLALQLAEKLGSLVENNERVFDHKQGTYGGYFRDQKDGYRKNEGYMRRGGYRQQQSQTAY

SEQ ID NO: 745598 - protein, 209 aa, Homo sapiens; identical to SEQ ID NO: 745596

SEQ ID NO: 745599 - protein, 163 aa, Homo sapiens
EESLRTYLDLPNQAGADFVSLGEKVRTMLVRKIQEESLRTYLFTYSSVYDSISMETLSDMFELDLPTVHSIISKMIINEELMASLDQPTQTVVMHRTEPTAQQNLALQLAEKLGSLVENNERVFDHKQGTYGGYFRDQKDGYRKNEGYMRRGGYRQQQSQTAY

SEQ ID NO: 745600 - protein, 209 aa, Homo sapiens; identical to SEQ ID NO: 745596

SEQ ID NO: 745601 - protein, 128 aa, Homo sapiens
GIPMENSGAGSLSLLFLVLCLFPSPMLLLFLPFHSPFIFLSSWLPPLPSCLLCSDVLPFWMLVAGYTLPTVPRSVGRQHLEAATATTGSALAPPCPAQGQGPSPPETGSLPLEPQRGKKKKTEVIAAI

SEQ ID NO: 745602 - protein, 520 aa, Homo sapiens
MGKPSSMDTKFKDDLFRKYVQFHESKVDTTTSRQRPGSDECLRVAASTLLSLHKVDPFYRFRLIQFYEVVESSLRSLSSSSLRALHGAFSMLETVGINLFLYPWKKEFRSIKTYTGPFVYYVKSTLLEEDIRAILSCMGYTPELGTAYKLRELVETLQVKMVSFELFLAKVECEQMLEIHSQVKDKGYSELDIVSERKSSAEDVRGCSDALRRRAEGREHLTASMSRVALQKSASERAAKDYYKPRVTKPSRSVDAYDSYWESRKPPLKASLSLRKEPVATDVGDDLKDEIIRPSPSLLTMASSPHGSPDVLPPASPSNGPALLRGTYFSTQDDVDLYTDSEPRATYRRQDALRPDVWLLRNDAHSLYHKRSPPAKESALSKCQSCGLSCSSSLCQRCDSLLTCPPASKPSAFPSKASTHDSLAHGASLREKYPGQTQGLDRLPHLHSKSKPSTTPTSRCGFCNRPGATNTCTQCSKVSCDACLSAYHYDPCYKKSELHKFMPNNQLNYKSTQLSHLVYR

SEQ ID NO: 745603 - protein, 520 aa, Homo sapiens; identical to SEQ ID NO: 745602

SEQ ID NO: 745604 - protein, 520 aa, Homo sapiens; identical to SEQ ID NO: 745602

SEQ ID NO: 745605 - protein, 464 aa, Homo sapiens
MGKPSSMDTKFKDDLFRKYVQFHESKVDTTTSRQRPGSDECLRVAASTLLSLHKVDPFYRFRLIQFYEVVESSLRSLSSSSLRALHGAFSMLETVGINLFLYPWKKEFRSIKTYTGPFVYYVKSTLLEEDIRAILSCMGYTPELGTAYKLRELVETLQVKMVSFELFLAKVECEQMLEIHSQVKDKGYSELDIVSERKSSAEDVRGCSDALRRRAEGREHLTASMSRVALQKSASERAAKDYYKPRVTKPSRSVDAYDSYWESRKPPLKASLSLRKEPVATDVGDDLKDEIIRPSPSLLTMASSPHGSPDVLPPASPSNGPALLRGTYFSTQDDVDLYTDSEPRATYRRQDALRPDVWLLRNDAHSLYHKRSPPAKESALSKCQSCGLSCSSSLCQRCDSLLTCPPASKPSAFPSKASTHDSLAHGASLREKYPGQTQARRSELDQSSLHSHSVCLKRRHKLTW

SEQ ID NO: 745606 - protein, 520 aa, Homo sapiens; identical to SEQ ID NO: 745602

SEQ ID NO: 745607 - protein, 520 aa, Homo sapiens; identical to SEQ ID NO: 745602

SEQ ID NO: 745608 - protein, 458 aa, Homo sapiens
MGKPSSMDTKFKDDLFRKYVQFHESKVDTTTSRQRPGSDECLRVAASTLLSLHKVDPFYRFRLIQFYEVVESSLRSLSSSSLRALHGAFSMLETVGINLFLYPWKKEFRSIKTYTGPFVYYVKSTLLEEDIRAILSCMGYTPELGTAYKLRELVETLQVKMVSFELFLAKVECEQMLEIHSQVKDKGYSELDIVSERKSSAEDVRGCSDALRRRAEGREHLTASMSRVALQKSASERAAKDYYKPRVTKPSRSVDAYDSYWESRKPPLKASLSLRKEPVATDVGDDLKDEIIRPSPSLLTMASSPHGSPDVLPPASPSNGPALLRGTYFSTQDDVDLYTDSEPRATYRRQDALRPDVWLLRNDAHSLYHKRSPPAKESALSKCQSCGLSCSSSLCQRCDSLLTCPPASKPSAFPSKASTHDSLAHGASLREKYPGQTQGLDRLPHLHSKSKPLSRCQR

SEQ ID NO: 745609 - protein, 114 aa, Homo sapiens
MRREPRYQGQVGPDIHTDSERAGQAGTWGPGYPLFPAVAWEAGKGWGLGYHGMCFLNGSFVSLPDFVQPSATASRQHQDGSQRSADQLSYLQCPSCPVRRGCPPGEVRASAGAA

SEQ ID NO: 745610 - protein, 725 aa, Homo sapiens
GRWPRHLPLLLTATTSRSQGLVETTIFEARLVAVTHGPLRRRCKSAQLPTCCALTQCEGNQGTRAKWVQTSTRILKGQVKQTLSSHQPRPLDSTKMEVKGQLISSPTFNAPAALFGEAAPQVKSERLRGLLDRQRTLQEALSLKLQELRKVCLQEAELTGQLPPECPLEPGERPQLVRRRPPTARAYPPPHPNQAHHSLCPAEELALEALEREVSVQQQIAAAARRLALAPDLSTEQRRRRRQVQADALRRLHELEEQLRDVRARLGLPVLPLPQPLPLSTGSVITTQGVCLGMRLAQLSQEDVVLHSESSSLSESGASHDNEEPHGCFSLAERPSPPKAWDQLRAVSGGSPERRTPWKPPPSDLYGDLKSRRNSVASPTSPTRSLPRSASSFEGRSVPATPVLTRGAGPQLCKPEGLHSRQWSGSQDSQMGFPRADPASDRASLFVARTRRSNSSEALLVDRAAGGGAGSPPAPLAPSASGPPVCKSSEVLYERPQPTPAFSSRTAGPPDPPRAARPSSAAPASRGAPRLPPVCGDFLLDYSLDRGLPRSGGGTGWGELPPAAEVPGPLSRRDGLLTMLPGPPPVYAADSNSPLLRTKDPHTRATRTKPCGLPPEAAEGPEVHPNPLLWMPPPTRIPSAGERSGHKNLALEGLRDWYIRNSGLAAGPQRRPVLPSVGPPHPPFLHARCYEVGQALYGAPSQAPLPHSRSFTAPPVSGRYGGCFY

SEQ ID NO: 745611 - protein, 725 aa, Homo sapiens; identical to SEQ ID NO: 745610

SEQ ID NO: 745612 - protein, 630 aa, Homo sapiens
MEVKGQLISSPTFNAPAALFGEAAPQVKSERLRGLLDRQRTLQEALSLKLQELRKVCLQEAELTGQLPPECPLEPGERPQLVRRRPPTARAYPPPHPNQAHHSLCPAEELALEALEREVSVQQQIAAAARRLALAPDLSTEQRRRRRQVQADALRRLHELEEQLRDVRARLGLPVLPLPQPLPLSTGSVITTQGVCLGMRLAQLSQEDVVLHSESSSLSESGASHDNEEPHGCFSLAERPSPPKAWDQLRAVSGGSPERRTPWKPPPSDLYGDLKSRRNSVASPTSPTRSLPRSASSFEGRSVPATPVLTRGAGPQLCKPEGLHSRQWSGSQDSQMGFPRADPASDRASLFVARTRRSNSSEALLVDRAAGGGAGSPPAPLAPSASGPPVCKSSEVLYERPQPTPAFSSRTAGPPDPPRAARPSSAAPASRGAPRLPPVCGDFLLDYSLDRGLPRSGGGTGWGELPPAAEVPGPLSRRDGLLTMLPGPPPVYAADSNSPLLRTKDPHTRATRTKPCGLPPEAAEGPEVHPNPLLWMPPPTRIPSAGERSGHKNLALEGLRDWYIRNSGLAAGPQRRPVLPSVGPPHPPFLHARCYEVGQALYGAPSQAPLPHSRSFTAPPVSGRYGGCFY

SEQ ID NO: 745613 - protein, 319 aa, Homo sapiens [sequence omitted]

SEQ ID NO: 745614 - protein, 69 aa, Homo sapiens
FTYSVKSRDRKMVGDVTGAQAYASTAKCLNIWALILGILMTIGFILLLVFGSVTVSHIMFQIIQEKRGY

SEQ ID NO: 745615 - protein, 88 aa, Homo sapiens
FTYSVKSRDRKMVGDVTGAQAYASTAKCLNIWALILGILMTILLIVIPVLIFQAYDRSGGITEARSSAHDLYATYSNFHSSPCPRSQV

SEQ ID NO: 745616 - protein, 566 aa, Homo sapiens
MNVNQVAENLALSHQEELVDLPKNYPLSENEDEGDSDGERKHQKLLEAIISLDGKNRRKLAERSEASLKVSEFSVSSEGSGEKLGLADLLEPVKTSSSLATVKKQLNRVKSKKVVELPLNKEKIEQIHREVAFSKTSQVLSKWDPIILKNQQAEQLVFPLGKEQPAIAPIEHALSGWKARTPLEQEIFNLLHKNKQPVTDPLLTPMEKASLQAMSLEEAKMHRAELQRARALQSYYEAKARKEKKIKSKKYHKVVKKGKAKKALKEFEQLQKVNPTVALEEMEKIENARMMERMSLKHQNSGKWAKSKAIMAKYDLEARQAMQEQLAKNKELTQKLQVASESEEEEGGTEVEELLVPHVANEVQMNVDGPNPWMFRSCTSDTKEAATQEDPEQVPELAAHEVSASEAEERPVAEEEILLREFEERQSLRKRSELNQDAEPASSQETKDSSSQEVLSELRALSQKLKEKHQSRKQKASSEGTVPQVQREEPAPEEAEPLLLQRSERVQTLEELEELGKEDCFQNKELPRPVLEGQQSERTPNNRPDAPKEKKEKEQLINLQNFLTTQ

SEQ ID NO: 745617 - protein, 566 aa, Homo sapiens; identical to SEQ ID NO: 745616

SEQ ID NO: 745618 - protein, 566 aa, Homo sapiens; identical to SEQ ID NO: 745616

SEQ ID NO: 745619 - protein, 566 aa, Homo sapiens; identical to SEQ ID NO: 745616

SEQ ID NO: 745620 - protein, 500 aa, Homo sapiens
PEFGGRRKMAAGERSWCLCKLLRFFYSLFFPGLIVCGTLCVCLVIVLWGIRLLLQRKKKLVSTSKNGKNQMVIAFFHPYCNAGGGGERVLWCALRALQKKYPEAVYVVYTGDVNVNGQQILEGAFRRFNIRLIHPVQFVFLRKRYLVEDSLYPHFTLLGQSLGSIFLGWEALMQCVPDVYIDSMGYAFTLPLFKYIGGCQVGSYVHYPTISTDMLSVVKNQNIGFNNAAFITRNPFLSKVKLIYYYLFAFIYGLVGSCSDVVMVNSSWTLNHILSLWKVGNCTNIVYPPCDVQTFLDIPLHEKKMTPGHLLVSVGQFRPEKNHPLQIRAFAKLLNKKMVESPPSLKLVLIGGCRNKDDELRVNQLRRLSEDLGVQEYVEFKINIPFDELKNYLSEATIGLHTMWNEHFGIGVVECMAAGTIILAHNSGGPKLDIVVPHEGDITGFLAESEEDYAETIAHILSMSAEKRLQIRKSARASVSRFSDQEFEVTFLSSVEKLFK

SEQ ID NO: 745621 - protein, 191 aa, Homo sapiens
GRIGTAPVYSSQRERRRRRVISAFPSETSDLFYFIVNKLHEYLPESRDKNALQNQSQRVDELVACIEIIQTLVLMFRETETESSRLNTLAAKNYRSLFWSIQILLQHFYMRYFCVFQQGNLGLGSTKFAISWIMSFLQSCPPIITFVASIVTTSGEGSFSFISAAKSLPSSSVVPAILHPQELSAAQKDSS

SEQ ID NO: 745622 - protein, 171 aa, Homo sapiens
GRIGTAPVYSSQRERRRRRVISAFPSETSDLFYFIVNKLHEYLPESRDKNALQNQSQRVDELVACIEIIQTLVLMFRETETESSRLNTLAAKKGALFNLLVILISEPQIPKSCPVFDIQLVADSALVRMSFDAELQKLILEYTNTATALLYEILLCLSAGKSRIGIHKVCY

SEQ ID NO: 745623 - protein, 339 aa, Homo sapiens
SVVFLRRHLPPEVYDAVRAYEPCIVVSNSENHILKYVVLSDRLVYLTENPPKSIRRVVALRDVVAIDLIDDYPEFLSSPDREISQHIRIIYSSTVLKKECKKSNSVRKFLFPFHHTKANNKKVKEEKNGLAFWRSKESRSLKESPLRSEEKIKHFSQLKSELFLKDNSLRRILSLLMELKVAAQKNFILKRLFWKTSDLFYFIVNKLHEYLPESRDKNALQNQSQRVDELVACIEIIQTLVLMFRETETESSRLNTLAAKKGALFNLLVILISEPQIPKSCPVFDIQLVADSALVRMSFDAELQKLILEYTNTATALLYEILLCLSAGKSRIGIHKVCY

SEQ ID NO: 745624 - protein, 171 aa, Homo sapiens; identical to SEQ ID NO: 745622

SEQ ID NO: 745625 - protein, 232 aa, Homo sapiens
LINISALKKSWNNYIIKATLWKIPSMLVSSVLLWKSKAIRSEEKIKHFSQLKSELFLKDNSLRRILSLLMELKVAAQKNFILKRLFWKTSDLFYFIVNKLHEYLPESRDKNALQNQSQRVDELVACIEIIQTLVLMFRETETESSRLNTLAAKKGALFNLLVILISEPQIPKSCPVFDIQLVADSALVRMSFDAELQKLILEYTNTATALLYEILLCLSAGKSRIGIHKVCY

SEQ ID NO: 745626 - protein, 226 aa, Homo sapiens
VAAASDFNRHPGSSAEAHPDDLAACGACAEPRPGPALGVLPSAYLSTATGVCDGTPVLEPQPGEATRLPGPGPTPRTPAQTEVPLPSPAGAAPPCAPRPSPPTHLWRALCTQRGLEMPSGHERERKEQLMPRAGPERRVYVHVPPAAGGTTQPGHSVHWTVHMFLRKAGGRFWNAVRMNFSARVSPSSSSPVYHFVLIGDGNTRSLMALPWAGNTSPTPSSRKASS

SEQ ID NO: 745627 - protein, 138 aa, Homo sapiens
EDDEGDARARARIALYSVFPRDQVDRVMAAFPELSDLARLILLVTEMPERGGAPGQALRDQHALAGNGPASPCVLDGWTCGCQPGPEWAHHGAPFSLKMVREACFLLLSGVVGAWWHLVILTEAGACCGEVHPLPWRE

SEQ ID NO: 745628 - protein, 233 aa, Homo sapiens
GGRNRGRAGSQGGRGGGAQAAARVNRGGGPIRNRPAIARGAAGGGGRNRPAPYSRPKQLPDKWQHDLFDSGFGGGAGVETGGKLLVSNLDFGVSDADIQELFAEFGTLKKAAVHYDRSGRSLGTADVHFERKADALKAMKQYNGVPLDGRPMNIQLVTSQIDAQRRPAQSVNRGGMTRNRGAGGFGGGGGTRRGTRGGARGRGRGAGRNSKQQLSAEELDAQLDAYNARMDTS

SEQ ID NO: 745629 - protein, 233 aa, Homo sapiens; identical to SEQ ID NO: 745628

SEQ ID NO: 745630 - protein, 255 aa, Homo sapiens
RWLGLCGNDGLVAFGGPQDFGPLRGLPSLLGGNIVTPKLLASSPIRPPTHVTRQESEPGTSVSCMFIDNQPGALQAGPKQLPDKWQHDLFDSGFGGGAGVETGGKLLVSNLDFGVSDADIQELFAEFGTLKKAAVHYDRSGRSLGTADVHFERKADALKAMKQYNGVPLDGRPMNIQLVTSQIDAQRRPAQSVNRGGMTRNRGAGGFGGGGGTRRGTRGGARGRGRGAGRNSKQQLSAEELDAQLDAYNARMDTS

SEQ ID NO: 745631 - protein, 146 aa, Homo sapiens
SICINLFPSVLQELFAEFGTLKKAAVHYDRSGRSLGTADVHFERKADALKAMKQYNGVPLDGRPMNIQLVTSQIDAQRRPAQSVNRGGMTRNRGAGGFGGGGGTRRGTRGGARGRGRGAGRNSKQQLSAEELDAQLDAYNARMDTS

SEQ ID NO: 745632 - protein, 149 aa, Homo sapiens
GGRNRGRAGSQGGRGGGAQAAARVNRGGGPIRNRPAIARGAAGGGGRNRPAPYSRPKQLPDKWQHDLFDSGFGGGAGVETGGKLLVSNLDFGVSDADIQELFAEFGTLKKAAVHYDRSGRSLGTADVHFERKADALKAMKQYNGVPLDA

SEQ ID NO: 745633 - protein, 129 aa, Homo sapiens
GRGGTVRPRAGAAAAPEGALAAPFRPDPLRPGRGRVRSSREGQESPGLRLTDLLLLRFFFQPKQLPDKWQHDLFDSGFGGGAGVETGGKLLVSNLDFGVSDADIQVRDEGFSVSRSPCTGRIVILGMWP

SEQ ID NO: 745634 - protein, 233 aa, Homo sapiens; identical to SEQ ID NO: 745628

SEQ ID NO: 745635 - protein, 301 aa, Homo sapiens
GRGGTVRPRAGAAAAPEGALAAPFRPDPLRPGRGRVRSSREGQESPGLRLTDLLLLRFFFQPKQLPDKWQHDLFDSGFGGGAGVETGGKLLVSNLDFGVSDADIQVVSSIHWKPLLVNSSSRCVPAAGVSPHSGFPLQLPACLRSGQFPGQRLTSDFAQAGVGGEGKELFAEFGTLKKAAVHYDRSGRSLGTADVHFERKADALKAMKQYNGVPLDGRPMNIQLVTSQIDAQRRPAQSVNRGGMTRNRGAGGFGGGGGTRRGTRGGARGRGRGAGRNSKQQLSAEELDAQLDAYNARMDTS

SEQ ID NO: 745636 - protein, 165 aa, Homo sapiens
GGRNRGRAGSQGGRGGGAQAAARVNRGGGPIRNRPAIARGAAGGGGRNRPAPYSRPKQLPDKWQHDLFDSGFGGGAGVETGGKLLVSNLDFGVSDADIQELFAEFGTLKKAAVHYDRSGRSLGTADVHFERKADALKAMKQYNGVPLDASYIPPLLQLLPEDSLL

SEQ ID NO: 745637 - protein, 537 aa, Homo sapiens
LQPELEEGEARKKMAAVAAEAAATAASPGEGGAGEAEPEMEPIPGSEAGTDPLPVTATEASVPDGETDGQQSAPQADEPPLPPPPPPPGELARSPEAVGPELEAEEKLSVRVAESAAAAPQGGPELPPSPASPPEQPPAPEEREEPPLPQPVAPALVPPAGGDSTVSQLIPGSEVRVTLDHIIEDALVVSFRFGEKLFSGVLMDLSKRFGPHGIPVTVFPKREYKDKPEAMPLQSNTFQEGTEVKCEANGAVPDDPSPVPHPELSLAESLWTSKPPPLFHEGAPYPPPLFIRDTYNQSIPQPPPRKIKRPKRKMYREEPTSIMNAIKLRPRQVLCDKCKNSVVAEKKEIRKGSSATDSSKYEDKKRRNESVTTVNKKLKTDHKVDGKNQNESQKRNAVVKVSNIAHSRGRVVKVSAQANTSKAQLSTKKVLQSKNMDHAKAREVLKIAKEKAQKKQNETSTSKNAHSKVHFTRRYQNPSSGSLPPRVRLKPQRYRNEENDSSLKTGLEKMRSGKMAPKPQSRCTSTRSAEFIDQEAD

SEQ ID NO: 745638 - protein, 556 aa, Homo sapiens
LQPELEEGEARKKMAAVAAEAAATAASPGEGGAGEAEPEMEPIPGSEAGTDPLPVTATEASVPDGETDGQQSAPQADEPPLPPPPPPPGELARSPEAVGPELEAEEKLSVRVAESAAAAPQGGPELPPSPASPPEQPPAPEEREEPPLPQPVAPALVPPAGGDSTVSQLIPGSEVRVTLDHIIEDALVVSFRFGEKLFSGVLMDLSKRDHETYGAIALLWWEKYTAILVKQFGPHGIPVTVFPKREYKDKPEAMPLQSNTFQEGTEVKCEANGAVPDDPSPVPHPELSLAESLWTSKPPPLFHEGAPYPPPLFIRDTYNQSIPQPPPRKIKRPKRKMYREEPTSIMNAIKLRPRQVLCDKCKNSVVAEKKEIRKGSSATDSSKYEDKKRRNESVTTVNKKLKTDHKVDGKNQNESQKRNAVVKVSNIAHSRGRVVKVSAQANTSKAQLSTKKVLQSKNMDHAKAREVLKIAKEKAQKKQNETSTSKNAHSKVHFTRRYQNPSSGSLPPRVRLKPQRYRNEENDSSLKTGLEKMRSGKMAPKPQSRCTSTRSAAQRH

SEQ ID NO: 745639 - protein, 533 aa, Homo sapiens
LQPELEEGEARKKMAAVAAEAAATAASPGEGGAGEAEPEMEPIPGSEAGTDPLPVTATEASVPDGETDGQQSAPQADEPPLPPPPPPPGELARSPEAVGPELEAEEKLSVRVAESAAAAPQGGPELPPSPASPPEQPPAPEEREEPPLPQPVAPALVPPAGGDSTVSQLIPGSEVRVTLDHIIEDALVVSFRFGEKLFSGVLMDLSKRFGPHGIPVTVFPKREYKDKPEAMPLQSNTFQEGTEVKCEANGAVPDDPSPVPHPELSLAESLWTSKPPPLFHEGAPYPPPLFIRDTYNQSIPQPPPRKIKRPKRKMYREEPTSIMNAIKLRPRQVLCDKCKNSVVAEKKEIRKGSSATDSSKYEDKKRRNESVTTVNKKLKTDHKVDGKNQNESQKRNAVVKVSNIAHSRGRVVKVSAQANTSKAQLSTKKVLQSKNMDHAKAREVLKIAKEKAQKKQNETSTSKNAHSKVHFTRRYQNPSSGSLPPRVRLKPQRYRNEENDSSLKTGLEKMRSGKMAPKPQSRCTSTRSAAQRH

SEQ ID NO: 745640 - protein, 768 aa, Homo sapiens
LQPELEEGEARKKMAAVAAEAAATAASPGEGGAGEAEPEMEPIPGSEAGTDPLPVTATEASVPDGETDGQQSAPQADEPPLPPPPPPPGELARSPEAVGPELEAEEKLSVRVAESAAAAPQGGPELPPSPASPPEQPPAPEEREEPPLPQPVAPALVPPAGGDSTVSQLIPGSEVRVTLDHIIEDALVVSFRFGEKLFSGVLMDLSKRFGPHGIPVTVFPKREYKDKPEAMPLQSNTFQEGTEVKCEANGAVPDDPSPVPHPELSLAESLWTSKPPPLFHEGAPYPPPLFIRDTYNQSIPQPPPRKIKRPKRKMYREEPTSIMNAIKLRPRQVLCDKCKNSVVAEKKEIRKGSSATDSSKYEDKKRRNESVTTVNKKLKTDHKVDGKNQNESQKRNAVVKVSNIAHSRGRVVKVSAQANTSKAQLSTKKVLQSKNMDHAKAREVLKIAKEKAQKKQNETSTSKNAHSKVHFTRRYQNPSSGSLPPRVRLKPQRYRNEENDSSLKTGLEKMRSGKMAPKPQSRCTSTRSAGEAPSENQSPSKGPEEASSEVQDTNEVHVPGDQDEPQTLGKKGSKNNISVYMTLNQKKSDSSSASVCSIDSTDDLKSSNSECSSSESFDFPPGSMHAPSTSSTSSSSKEEKKLSNSLKMKVFSKNVSKCVTPDGRTICVGDIVWAKIYGFPWWPARILTITVSRKDNGLLVRQEARISWFGSPTTSFLALSQLSPFLENFQSRFNKKRKGLYRKAITEAAKAAKQLTPEVRALLTQFET

SEQ ID NO: 745641 - protein, 114 aa, Homo sapiens
MIEYQIPVSFKDVVVGFTQEEWHRLSPAQRALYRDVMLETYSNLVSVGYEGTKPDVILRLEQEEAPWIGEAACPGCHCWEDIWRVNIQRKRRQDMLLRPGAAIKQENIAQGEKL

SEQ ID NO: 745642 - protein, 114 aa, Homo sapiens; identical to SEQ ID NO: 745641

SEQ ID NO: 745643 - protein, 114 aa, Homo sapiens; identical to SEQ ID NO: 745641

SEQ ID NO: 745644 - protein, 147 aa, Homo sapiens
WCATNLMVQGRNGSWVGRKGYMELQELREIEKDSRVERIIPKVLMTFENLSLCGREPESLENLFLDPDMAQEKMKLGFKSLPSSTTADGNILRRVNSAPLINGLGFNSQVLQADMLRIRTNRTTFRNRRSLEITSPTSVEQKPKDLF

SEQ ID NO: 745645 - protein, 195 aa, Homo sapiens
MAQEKMKLGFKSLPSSTTADGNILRRVNSAPLINGLGFNSQVLQADMLRIRTNRTTFRNRRSLLLPPPPFHGSISRLHQIKQEEAMDLINRETMSEWKLQSEIQISHSWEEGLKLVKWHFNINQKRFSKAQPTCFLLILPNCQKIMCIYFQLLLMETTAMLDLLVIRQLKSALSQTLLCHLLILVLICSSRQTFN

SEQ ID NO: 745646 - protein, 101 aa, Homo sapiens
QIDRHLLVGRGPLGRPRSAPNSASAVALRFAVSPGEGGGNEVDPNPEEGEEGAGPLAGGAFPKEEQEMLKTYLKTQDLAKDPRSPKAKQCFEKKNNNNKAL

SEQ ID NO: 745647 - protein, 103 aa, Homo sapiens
MGIWGARVDHVLGALCHVCVLTRGPCVGRVLGASCHACDPGSWPVCRSCAGCILSCVCPGSWPVCRSCAGCILSCVCPASWCVCRLCAGCILSCVCPGSWPVC

SEQ ID NO: 745648 - protein, 604 aa, Homo sapiens
MARISFSYLCPASWYFTVPTVSPFLRQRVAFLGLFFISCLLLLMLIIDFRHWSASLPRDRQYERYLARVGELEATDTEDPNLNYGLVVDCGSSGSRIFVYFWPRHNGNPHDLLDIKQMRDRNSQPVVKKIKPGISAMADTPEHASDYLRPLLSFAAAHVPVKKHKETPLYILCTAGMRLLPERKQLAILADLVKDLPLEFDFLFSQSQAEVISGKQEGVYAWIGINFVLGRFDHEDESDAEATQELAAGRRRTVGILDMGGASLQIAYEVPTSTSVLPAKQEEAAKILLAEFNLGCDVQHTEHVYRVYVTTFLGFGGNFARQRYEDLVLNETLNKNRLLGQKTGLSPDNPFLDPCLPVGLTDVVERNSQVLHVRGRGDWVSCGAMLSPLLARSNTSQASLNGIYQSPIDFNNSEFYGFSEFFYCTEDVLRIGGRYHGPTFAKAAQDYCGMAWSVLTQRFKNGLFSSHADEHRLKYQCFKSAWMYQVLHEGFHFPYDYPNLRTAQLVYDREVQWTLGAILYKTRFLPLRDLRQEGVRQAHGSWFRLSFVYNHYLFFACILVVLLAIFLYLLRLRRIHHRQTRASAPLDLLWLEEVVPMMGVQVGP

SEQ ID NO: 745649 - protein, 220 aa, Homo sapiens
MLSPLLARSNTSQASLNGIYQSPIDFNNSEFYGFSEFFYCTEDVLRIGGRYHGPTFAKAAQDYCGMAWSVLTQRFKNGLFSSHADEHRLKYQCFKSAWMYQVLHEGFHFPYDYPNLRTAQLVYDREVQWTLGAILYKTRFLPLRDLRQEGVRQAHGSWFRLSFVYNHYLFFACILVVLLAIFLYLLRLRRIHHRQTRASAPLDLLWLEEVVPMMGVQVGP

SEQ ID NO: 745650 - protein, 510 aa, Homo sapiens
MAAELVEAKNMVMSFRVSDLQMLLGFVGRSKSGLKHELVTRALQLVQFDCSPELFKKIKELYETRYAKKNSEPAPQPHRPLDPLTMHSTYDRAGAVPRTPLAGPNIDYPVLYGKYLNGLGRLPAKTLKPEVRLVKLPFFNMLDELLKPTELVPQNNEKLQESPCIFALTPRQVELIRNSRELQPGVKAVQVVLRICYSDTSCPQEDQYPPNIAVKVNHSYCSVPGYYPSNKPGVEPKRPCRPINLTHLMYLSSATNRITVTWGNYGKSYSVALYLVRQLTSSELLQRLKTIGVKHPELCKALVKEKLRLDPDSEIATTGVRVSLICPLVKMRLSVPCRAETCAHLQCFDAVFYLQMNEKKPTWMCPVCDKPAPYDQLIIDGLLSKILSECEDADEIEYLVDGSWCPIRAEKERSCSPQGAILVLGPSDANGLLPAPSVNGSGALGSTGGGGPVGSMENGKPGADVVDLTLDSSSSSEDEEEEEEEEEDEDEEGPRPKRRCPFQKGLVPAC

SEQ ID NO: 745651 - protein, 510 aa, Homo sapiens; identical to SEQ ID NO: 745650

SEQ ID NO: 745652 - protein, 180 aa, Homo sapiens
MRLSVPCRAETCAHLQCFDAVFYLQMNEKKPTWMCPVCDKPAPYDQLIIDGLLSKILSECEDADEIEYLVDGSWCPIRAEKERSCSPQGAILVLGPSDANGLLPAPSVNGSGALGSTGGGGPVGSMENGKPGADVVDLTLDSSSSSEDEEEEEEEEEDEDEEGPRPKRRCPFQKGLVPAC

SEQ ID NO: 745653 - protein, 507 aa, Homo sapiens
HASEAKNMVMSFRVSDLQMLLGFVGRSKSGLKHELVTRALQLVQFDCSPELFKKIKELYETRYAKKNSEPAPQPHRPLDPLTMHSTYDRAGAVPRTPLAGPNIDYPVLYGKYLNGLGRLPAKTLKPEVRLVKLPFFNMLDELLKPTELVPQNNEKLQESPCIFALTPRQVELIRNSRELQPGVKAVQVVLRICYSDTSCPQEDQYPPNIAVKVNHSYCSVPGYYPSNKPGVEPKRPCRPINLTHLMYLSSATNRITVTWGNYGKSYSVALYLVRQLTSSELLQRLKTIGVKHPELCKALVKEKLRLDPDSEIATTGVRVSLICPLVKMRLSVPCRAETCAHLQCFDAVFYLQMNEKKPTWMCPVCDKPAPYDQLIIDGLLSKILSECEDADEIEYLVDGSWCPIRAEKERSCSPQGAILVLGPSDANGLLPAPSVNGSGALGSTGGGGPVGSMENGKPGADVVDLTLDSSSSSEDEEEEEEEEEDEDEEGPRPKRRCPFQKGLVPAC

SEQ ID NO: 745654 - protein, 352 aa, Homo sapiens
MRKSPGLSDCLWAWILLLSTLTGRSYGQPSLQDELKDNTTVFTRILDRLLDGYDNRLRPGLGERVTEVKTDIFVTSFGPVSDHDMEYTIDVFFRQSWKDERLKFKGPMTVLRLNNLMASKIRTPDTFMPNKLLRITEDGTLLYTMRLTVRAECPMHLEDFPMDAHACPLKFGSYAYTRAEVVYEWTREPARSVVVAEDGSRLNQYDLLGQTVDSGIVQSSTGEYVVMTTHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGYAWDGKSVVPEKVNALMVTVVHQY

SEQ ID NO: 745655 - protein, 456 aa, Homo sapiens
MRKSPGLSDCLWAWILLLSTLTGRSYGQPSLQDELKDNTTVFTRILDRLLDGYDNRLRPGLGERVTEVKTDIFVTSFGPVSDHDMEYTIDVFFRQSWKDERLKFKGPMTVLRLNNLMASKIRTPDTFFHNGKKSVAHNMTMPNKLLRITEDGTLLYTMRLTVRAECPMHLEDFPMDAHACPLKFGSYAYTRAEVVYEWTREPARSVVVAEDGSRLNQYDLLGQTVDSGIVQSSTGEYVVMTTHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGYAWDGKSVVPEKPKKVKDPLIKKNNTYAPTATSYTPNLARGDPGLATIAKSATIEPKEVKPETKPPEPKKTFNSVSKIDRLSRIAFPLLFGIFNLVYWATYLNREPQLKAPTPHQ

SEQ ID NO: 745656 - protein, 456 aa, Homo sapiens; identical to SEQ ID NO: 745655

SEQ ID NO: 745657 - protein, 770 aa, Homo sapiens [sequence omitted]

SEQ ID NO: 745658 - protein, 770 aa, Homo sapiens [sequence omitted]

SEQ ID NO: 745659 - protein, 770 aa, Homo sapiens [sequence omitted]

SEQ ID NO: 745660 - protein, 770 aa, Homo sapiens [sequence omitted]

SEQ ID NO: 745661 - protein, 585 aa, Homo sapiens
MIMDDRLIANTLHWWYFGPDNTGDIMTLKFLTGLQNFISSMATVHLVTADGSFDCQGNPGEQEALVSSLHYCEVVTALTTLGNGGSFVLKMFTMFEHCSINLMYLLNCCFDQVHVFKPATSKAGNSEVYVVCLHYKGREAIHPLLSKMTLNFGTEMKRKALFPHHVIPDSFLKRHEECCVFFHKYQLETISENIRLFECMGKAEQEKLNNLRDCAIQYFMQKFQLKHLSRSNWLVKKSSIGCSTNTKWFGQRNKYFKTYNERKMLEALSWKDKVAKGYFNSWAEEHGVYHPGQSSILEGTASNLECHLWHILEGKKLPKVKCSPFCNGEILKTLNEAIEKSLGGAFNLDSKFRPKQQYSCSCHVFSEELIFSELCSLTECLQDEQVVVPSNQIKCLLVGFSTLRNIKMHIPLEVRLLESAELTTFSCSLLHDGDPTYQRLFLDCLLHSLRELHTGDVMILPVLSCFTRFMAGLIFVLHSCFRFITFVCPTSSDPLRTCAVLLCVGYQDLPNPVFRYLQSVNELLSTLLNSDSPQQVLQFVPMEVLLKGALLDFLWDLNAAIAKRHLHFIIQREREEIINSLQLQN

SEQ ID NO: 745662 - protein, 770 aa, Homo sapiens [sequence omitted]

SEQ ID NO: 745663 - protein, 770 aa, Homo sapiens [sequence omitted]

SEQ ID NO: 745664 - protein, 585 aa, Homo sapiens; identical to SEQ ID NO: 745661

SEQ ID NO: 745665 - protein, 393 aa, Homo sapiens
MEENNLQCSSVVDGNFEEVPRETAIQFKPPLYRQRYQFVKNLVDQHEPKKVADLGCGDTSLLRLLKVNPCIELLVGVDINEDKLRWRGDSLAPFLGDFLKPRDLNLTITLYHGSVVERDSRLLGFDLITCIELIEHLDSGDLARFPEVVFGYLSPSMIVISTPNSEFNPLFPSVTLRDSDHKFEWTRMEFQTWALYVANRYDYSVEFTGVGEPPAGAENVGYCTQIGIFRKNGGKATESCLSEQHDQHVYKAVFTTSYPSLQQERFFKLVLVNEVSQQVESLRVSHLPRRKEQAGERGDKPKDIGGSKAPVPCFGPVFTEVEKAKIENSPTPFCVGDKFFVPLQRLLAYPKLNRLCANEEMMRSVIADSIPLSSDGSAVVADLRNYFDEQFEF

SEQ ID NO: 745666 - protein, 289 aa, Homo sapiens
MEIVFDKSIRKIGASEARFYYVFLINHFRIEHLDSGDLARFPEVVFGYLSPSMIVISTPNSEFNPLFPSVTLRDSDHKFEWTRMEFQTWALYVANRYDYSVEFTGVGEPPAGAENVGYCTQIGIFRKNGGKATESCLSEQHDQHVYKAVFTTSYPSLQQERFFKLVLVNEVSQQVESLRVSHLPRRKEQAGERGDKPKDIGGSKAPVPCFGPVFTEVEKAKIENSPTPFCVGDKFFVPLQRLLAYPKLNRLCANEEMMRSVIADSIPLSSDGSAVVADLRNYFDEQFEF

SEQ ID NO: 745667 - protein, 393 aa, Homo sapiens; identical to SEQ ID NO: 745665

SEQ ID NO: 745668 - protein, 393 aa, Homo sapiens; identical to SEQ ID NO: 745665

SEQ ID NO: 745669 - protein, 2174 aa, Homo sapiens
MSASFVPNGASLEDCHCNLFCLADLTGIKWKKYVWQGPTSAPILFPVTEEDPILSSFSRCLKADVLGVWRRDQRPGRRELWIFWWGEDPSFADLIHHDLSEEEDGVWENGLSYECRTLLFKAVHNLLERCLMNRNFVRIGKWFVKPYEKDEKPINKSEHLSCSFTFFLHGDSNVCTSVEINQHQPVYLLSEEHITLAQQSNSPFQVILCPFGLNGTLTGQAFKMSDSATKKLIGEWKQFYPISCCLKEMSEEKQEDMDWEDDSLAAVEVLVAGVRMIYPACFVLVPQSDIPTPSPVGSTHCSSSCLGVHQVPASTRDPAMSSVTLTPPTSPEEVQTVDPQSVQKWVKFSSVSDGFNSDSTSHHGGKIPRKLANHVVDRVWQECNMNRAQNKRKYSASSGGLCEEATAAKVASWDFVEATQRTNCSCLRHKNLKSRNAGQQGQAPSLGQQQQILPKHKTNEKQEKSEKPQKRPLTPFHHRVSVSDDVGMDADSASQRLVISAPDSQVRFSNIRTNDVAKTPQMHGTEMANSPQPPPLSPHPCDVVDEGVTKTPSTPQSQHFYQMPTPDPLVPSKPMEDRIDSLSQSFPPQYQEAVEPTVYVGTAVNLEEDEANIAWKYYKFPKKKDVEFLPPQLPSDKFKDDPVGPFGQESVTSVTELMVQCKKPLKVSDELVQQYQIKNQCLSAIASDAEQEPKIDPYAFVEGDEEFLFPDKKDRQNSEREAGKKHKVEDGTSSVTVLSHEEDAMSLFSPSIKQDAPRPTSHARPPSTSLIYDSDLAVSYTDLDNLFNSDEDELTPGSKRSANGSDDKASCKESKTGNLDPLSCISTADLHKMYPTPPSLEQHIMGFSPMNMNNKEYGSMDTTPGGTVLEGNSSSIGAQFKIEVDEGFCSPKPSEIKDFSYVYKPENCQILVGCSMFAPLKTLPSQYLPLIKLPEECIYRQSWTVGKLELLSSGPSMPFIKEGDGSNMDQEYGTAYTPQTHTSCGMPPSSAPPSNSGAGILPSPSTPRFPTPRTPRTPRTPRGAGGPASAQGSVKYENSDLYSPASTPSTCRPLNSVEPATVPSIPEAHSLYVNLILSESVMNLFKDCNSDSCCICVCNMNIKGADVGVYIPDPTQEAQYRCTCGFSAVMNRKFGNNSGLFLEDELDIIGRNTDCGKEAEKRFEALRATSAEHVNGGLKESEKLSDDLILLLQDQCTNLFSPFGAADQDPFPKSGVISNWVRVEERDCCNDCYLALEHGRQFMDNMSGGKVDEALVKSSCLHPWSKRNDVSMQCSQDILRMLLSLQPVLQDAIQKKRTVRPWGVQGPLTWQQFHKMAGRGSYGTDESPEPLPIPTFLLGYDYDYLVLSPFALPYWERLMLEPYGSQRDIAYVVLCPENEALLNGAKSFFRDLTAIYESCRLGQHRPVSRLLTDGIMRVGSTASKKLSEKLVAEWFSQAADGNNEAFSKLKLYAQVCRYDLGPYLASLPLDSSLLSQPNLVAPTSQSLITPPQMTNTGNANTPSATLASAASSTMTVTSGVAISTSVATANSTLTTASTSSSSSSNLNSGVSSNKLPSFPPFGSMNSNAAGSMSTQANTVQSGQLGGQQTSALQTAGISGESSSLPTQPHPDVSESTMDRDKVGIPTDGDSHAVTYPPAIVVYIIDPFTYENTDESTNSSSVWTLGLLRCFLEMVQTLPPHIKSTVSVQIIPCQYLLQPVKHEDREIYPQHLKSLAFSAFTQCRRPLPTSTNVKTLTGFGPGLAMETALRSPDRPECIRLYAPPFILAPVKDKQTELGETFGEAGQKYNVLFVGYCLSHDQRWILASCTDLYGELLETCIINIDVPNRARRKKSSARKFGLQKLWEWCLGLVQMSSLPWRVVIGRLGRIGHGELKDWSCLLSRRNLQSLSKRLKDMCRMCGISAADSPSILSACLVAMEPQGSFVIMPDSVSTGSVFGRSTTLNMQTSQLNTPQDTSCTHILVFPTSASVQVASATYTTENLDLAFNPNNDGADGMGIFDLLDTGDDLDPDIINILPASPTGSPVHSPGSHYPHGGDAGKGQSTDRLLSTEPHEEVPNILQQPLALGYFVSTAKAGPLPDWFWSACPQAQYQCPLFLKASLHLHVPSVQSDELLHSKHSHPLDSNQTSDVLRFVLEQYNALSWLTCDPATQDRRSCLPIHFVVLNQLYNFIMNML

SEQ ID NO: 745670 - protein, 2174 aa, Homo sapiens; identical to SEQ ID NO: 745669

SEQ ID NO: 745671 - protein, 1944 aa, Homo sapiens
RNLALSLLRLECNGVISAHCNLHLPGSSSSPASPSQVAGITAGVRMIYPACFVLVPQSDIPTPSPVGSTHCSSSCLGVHQVPASTRDPAMSSVTLTPPTSPEEVQTVDPQSVQKWVKFSSVSDGFNSDSTSHHGGKIPRKLANHVVDRVWQECNMNRAQNKRKYSASSGGLCEEATAAKVASWDFVEATQRTNCSCLRHKNLKSRNAGQQGQAPSLGQQQQILPKHKTNEKQEKSEKPQKRPLTPFHHRVSVSDDVGMDADSASQRLVISAPDSQVRFSNIRTNDVAKTPQMHGTEMANSPQPPPLSPHPCDVVDEGVTKTPSTPQSQHFYQMPTPDPLVPSKPMEDRIDSLSQSFPPQYQEAVEPTVYVGTAVNLEEDEANIAWKYYKFPKKKDVEFLPPQLPSDKFKDDPVGPFGQESVTSVTELMVQCKKPLKVSDELVQQYQIKNQCLSAIASDAEQEPKIDPYAFVEGDEEFLFPDKKDRQNSEREAGKKHKVEDGTSSVTVLSHEEDAMSLFSPSIKQDAPRPTSHARPPSTSLIYDSDLAVSYTDLDNLFNSDEDELTPGSKRSANGSDDKASCKESKTGNLDPLSCISTADLHKMYPTPPSLEQHIMGFSPMNMNNKEYGSMDTTPGGTVLEGNSSSIGAQFKIEVDEGFCSPKPSEIKDFSYVYKPENCQILVGCSMFAPLKTLPSQYLPLIKLPEECIYRQSWTVGKLELLSSGPSMPFIKEGDGSNMDQEYGTAYTPQTHTSCGMPPSSAPPSNSGAGILPSPSTPRFPTPRTPRTPRTPRGAGGPASAQGSVKYENSDLYSPASTPSTCRPLNSVEPATVPSIPEAHSLYVNLILSESVMNLFKDCNSDSCCICVCNMNIKGADVGVYIPDPTQEAQYRCTCGFSAVMNRKFGNNSGLFLEDELDIIGRNTDCGKEAEKRFEALRATSAEHVNGGLKESEKLSDDLILLLQDQCTNLFSPFGAADQDPFPKSGVISNWVRVEERDCCNDCYLALEHGRQFMDNMSGGKVDEALVKSSCLHPWSKRNDVSMQCSQDILRMLLSLQPVLQDAIQKKRTVRPWGVQGPLTWQQFHKMAGRGSYGTDESPEPLPIPTFLLGYDYDYLVLSPFALPYWERLMLEPYGSQRDIAYVVLCPENEALLNGAKSFFRDLTAIYESCRLGQHRPVSRLLTDGIMRVGSTASKKLSEKLVAEWFSQAADGNNEAFSKLKLYAQVCRYDLGPYLASLPLDSSLLSQPNLVAPTSQSLITPPQMTNTGNANTPSATLASAASSTMTVTSGVAISTSVATANSTLTTASTSSSSSSNLNSGVSSNKLPSFPPFGSMNSNAAGSMSTQANTVQSGQLGGQQTSALQTAGISGESSSLPTQPHPDVSESTMDRDKVGIPTDGDSHAVTYPPAIVVYIIDPFTYENTDESTNSSSVWTLGLLRCFLEMVQTLPPHIKSTVSVQIIPCQYLLQPVKHEDREIYPQHLKSLAFSAFTQCRRPLPTSTNVKTLTGFGPGLAMETALRSPDRPECIRLYAPPFILAPVKDKQTELGETFGEAGQKYNVLFVGYCLSHDQRWILASCTDLYGELLETCIINIDVPNRARRKKSSARKFGLQKLWEWCLGLVQMSSLPWRVVIGRLGRIGHGELKDWSCLLSRRNLQSLSKRLKDMCRMCGISAADSPSILSACLVAMEPQGSFVIMPDSVSTGSVFGRSTTLNMQTSQLNTPQDTSCTHILVFPTSASVQVASATYTTENLDLAFNPNNDGADGMGIFDLLDTGDDLDPDIINILPASPTGSPVHSPGSHYPHGGDAGKGQSTDRLLSTEPHEEVPNILQQPLALGYFVSTAKAGPLPDWFWSACPQAQYQCPLFLKASLHLHVPSVQSDELLHSKHSHPLDSNQTSDVLRFVLEQYNALSWLTCDPATQDRRSCLPIHFVVLNQLYNFIMNML

SEQ ID NO: 745672 - protein, 1741 aa, Homo sapiens
SFNNAYGSILGSVLHQMLLLKDTGFEFDIAALIHQKLLKVSYIATINSVSDDVGMDADSASQRLVISAPDSQVRFSNIRTNDVAKTPQMHGTEMANSPQPPPLSPHPCDVVDEGVTKTPSTPQSQHFYQMPTPDPLVPSKPMEDRIDSLSQSFPPQYQEAVEPTVYVGTAVNLEEDEANIAWKYYKFPKKKDVEFLPPQLPSDKFKDDPVGPFGQESVTSVTELMVQCKKPLKVSDELVQQYQIKNQCLSAIASDAEQEPKIDPYAFVEGDEEFLFPDKKDRQNSEREAGKKHKVEDGTSSVTVLSHEEDAMSLFSPSIKQDAPRPTSHARPPSTSLIYDSDLAVSYTDLDNLFNSDEDELTPGSKRSANGSDDKASCKESKTGNLDPLSCISTADLHKMYPTPPSLEQHIMGFSPMNMNNKEYGSMDTTPGGTVLEGNSSSIGAQFKIEVDEGFCSPKPSEIKDFSYVYKPENCQILVGCSMFAPLKTLPSQYLPLIKLPEECIYRQSWTVGKLELLSSGPSMPFIKEGDGSNMDQEYGTAYTPQTHTSCGMPPSSAPPSNSGAGILPSPSTPRFPTPRTPRTPRTPRGAGGPASAQGSVKYENSDLYSPASTPSTCRPLNSVEPATVPSIPEAHSLYVNLILSESVMNLFKDCNSDSCCICVCNMNIKGADVGVYIPDPTQEAQYRCTCGFSAVMNRKFGNNSGLFLEDELDIIGRNTDCGKEAEKRFEALRATSAEHVNGGLKESEKLSDDLILLLQDQCTNLFSPFGAADQDPFPKSGVISNWVRVEERDCCNDCYLALEHGRQFMDNMSGGKVDEALVKSSCLHPWSKRNDVSMQCSQDILRMLLSLQPVLQDAIQKKRTVRPWGVQGPLTWQQFHKMAGRGSYGTDESPEPLPIPTFLLGYDYDYLVLSPFALPYWERLMLEPYGSQRDIAYVVLCPENEALLNGAKSFFRDLTAIYESCRLGQHRPVSRLLTDGIMRVGSTASKKLSEKLVAEWFSQAADGNNEAFSKLKLYAQVCRYDLGPYLASLPLDSSLLSQPNLVAPTSQSLITPPQMTNTGNANTPSATLASAASSTMTVTSGVAISTSVATANSTLTTASTSSSSSSNLNSGVSSNKLPSFPPFGSMNSNAAGSMSTQANTVQSGQLGGQQTSALQTAGISGESSSLPTQPHPDVSESTMDRDKVGIPTDGDSHAVTYPPAIVVYIIDPFTYENTDESTNSSSVWTLGLLRCFLEMVQTLPPHIKSTVSVQIIPCQYLLQPVKHEDREIYPQHLKSLAFSAFTQCRRPLPTSTNVKTLTGFGPGLAMETALRSPDRPECIRLYAPPFILAPVKDKQTELGETFGEAGQKYNVLFVGYCLSHDQRWILASCTDLYGELLETCIINIDVPNRARRKKSSARKFGLQKLWEWCLGLVQMSSLPWRVVIGRLGRIGHGELKDWSCLLSRRNLQSLSKRLKDMCRMCGISAADSPSILSACLVAMEPQGSFVIMPDSVSTGSVFGRSTTLNMQTSQLNTPQDTSCTHILVFPTSASVQVASATYTTENLDLAFNPNNDGADGMGIFDLLDTGDDLDPDIINILPASPTGSPVHSPGSHYPHGGDAGKGQSTDRLLSTEPHEEVPNILQQPLALGYFVSTAKAGPLPDWFWSACPQAQYQCPLFLKASLHLHVPSVQSDELLHSKHSHPLDSNQTSDVLRFVLEQYNALSWLTCDPATQDRRSCLPIHFVVLNQLYNFIMNML

SEQ ID NO: 745673 - protein, 1688 aa, Homo sapiens
RPRDTAARDDEGISAPDSQVRFSNIRTNDVAKTPQMHGTEMANSPQPPPLSPHPCDVVDEGVTKTPSTPQSQHFYQMPTPDPLVPSKPMEDRIDSLSQSFPPQYQEAVEPTVYVGTAVNLEEDEANIAWKYYKFPKKKDVEFLPPQLPSDKFKDDPVGPFGQESVTSVTELMVQCKKPLKVSDELVQQYQIKNQCLSAIASDAEQEPKIDPYAFVEGDEEFLFPDKKDRQNSEREAGKKHKVEDGTSSVTVLSHEEDAMSLFSPSIKQDAPRPTSHARPPSTSLIYDSDLAVSYTDLDNLFNSDEDELTPGSKRSANGSDDKASCKESKTGNLDPLSCISTADLHKMYPTPPSLEQHIMGFSPMNMNNKEYGSMDTTPGGTVLEGNSSSIGAQFKIEVDEGFCSPKPSEIKDFSYVYKPENCQILVGCSMFAPLKTLPSQYLPLIKLPEECIYRQSWTVGKLELLSSGPSMPFIKEGDGSNMDQEYGTAYTPQTHTSCGMPPSSAPPSNSGAGILPSPSTPRFPTPRTPRTPRTPRGAGGPASAQGSVKYENSDLYSPASTPSTCRPLNSVEPATVPSIPEAHSLYVNLILSESVMNLFKDCNSDSCCICVCNMNIKGADVGVYIPDPTQEAQYRCTCGFSAVMNRKFGNNSGLFLEDELDIIGRNTDCGKEAEKRFEALRATSAEHVNGGLKESEKLSDDLILLLQDQCTNLFSPFGAADQDPFPKSGVISNWVRVEERDCCNDCYLALEHGRQFMDNMSGGKVDEALVKSSCLHPWSKRNDVSMQCSQDILRMLLSLQPVLQDAIQKKRTVRPWGVQGPLTWQQFHKMAGRGSYGTDESPEPLPIPTFLLGYDYDYLVLSPFALPYWERLMLEPYGSQRDIAYVVLCPENEALLNGAKSFFRDLTAIYESCRLGQHRPVSRLLTDGIMRVGSTASKKLSEKLVAEWFSQAADGNNEAFSKLKLYAQVCRYDLGPYLASLPLDSSLLSQPNLVAPTSQSLITPPQMTNTGNANTPSATLASAASSTMTVTSGVAISTSVATANSTLTTASTSSSSSSNLNSGVSSNKLPSFPPFGSMNSNAAGSMSTQANTVQSGQLGGQQTSALQTAGISGESSSLPTQPHPDVSESTMDRDKVGIPTDGDSHAVTYPPAIVVYIIDPFTYENTDESTNSSSVWTLGLLRCFLEMVQTLPPHIKSTVSVQIIPCQYLLQPVKHEDREIYPQHLKSLAFSAFTQCRRPLPTSTNVKTLTGFGPGLAMETALRSPDRPECIRLYAPPFILAPVKDKQTELGETFGEAGQKYNVLFVGYCLSHDQRWILASCTDLYGELLETCIINIDVPNRARRKKSSARKFGLQKLWEWCLGLVQMSSLPWRVVIGRLGRIGHGELKDWSCLLSRRNLQSLSKRLKDMCRMCGISAADSPSILSACLVAMEPQGSFVIMPDSVSTGSVFGRSTTLNMQTSQLNTPQDTSCTHILVFPTSASVQVASATYTTENLDLAFNPNNDGADGMGIFDLLDTGDDLDPDIINILPASPTGSPVHSPGSHYPHGGDAGKGQSTDRLLSTEPHEEVPNILQQPLALGYFVSTAKAGPLPDWFWSACPQAQYQCPLFLKASLHLHVPSVQSDELLHSKHSHPLDSNQTSDVLRFVLEQYNALSWLTCDPATQDRRSCLPIHFVVLNQLYNFIMNML

SEQ ID NO: 745674 - protein, 431 aa, Homo sapiens [sequence omitted]

SEQ ID NO: 745675 - protein, 667 aa, Homo sapiens [sequence omitted]

SEQ ID NO: 745676 - protein, 667 aa, Homo sapiens [sequence omitted]

SEQ ID NO: 745677 - protein, 428 aa, Homo sapiens
MSASFVPNGASLEDCHCNLFCLADLTGIKWKKYVWQGPTSAPILFPVTEEDPILSSFSRCLKADVLGVWRRDQRPGRRELWIFWWGEDPSFADLIHHDLSEEEDGVWENGLSYECRTLLFKAVHNLLERCLMNRNFVRIGKWFVKPYEKDEKPINKSEHLSCSFTFFLHGDSNVCTSVEINQHQPVYLLSEEHITLAQQSNSPFQVILCPFGLNGTLTGQAFKMSDSATKKLIGEWKQFYPISCCLKEMSEEKQEDMDWEDDSLAAVEVLVAGVRMIYPACFVLVPQSDIPTPSPVGSTHCSSSCLGVHQVPASTRDPAMSSVTLTPPTSPEEVQTVDPQSVQKWVKFSSVSDGFNSDSTSHHGGKIPRKLANHVVDRVWQECNMNRAQNKRKYSASSGGLCEEATAAKVASWDFVEATQRTNCSCLR

SEQ ID NO: 745678 - protein, 2174 aa, Homo sapiens; identical to SEQ ID NO: 745669

SEQ ID NO: 745679 - protein, 1756 aa, Homo sapiens
MSASFVPNGASLEDCHCNLFCLADLTGIKWKKYVWQGPTSAPILFPVTEEDPILSSFSRCLKADVLGVWRRDQRPGRRELWIFWWGEDPSFADLIHHDLSEEEDGVWENGLSYECRTLLFKAVHNLLERCLMNRNFVRIGKWFVKPYEKDEKPINKSEHLSCSFTFFLHGDSNVCTSVEINQHQPVYLLSEEHITLAQQSNSPFQVILCPFGLNGTLTGQAFKMSDSATKKLIGEWKQFYPISCCLKEMSEEKQEDMDWEDDSLAAVEVLVAGVRMIYPACFVLVPQSDIPTPSPVGSTHCSSSCLGVHQVPASTRDPAMSSVTLTPPTSPEEVQTVDPQSVQKWVKFSSVSDGFNSDSTSHHGGKIPRKLANHVVDRVWQECNMNRAQNKRKYSASSGGLCEEATAAKVASWDFVEATQRTNCSCLRHKNLKSRNAGQQGQAPSLGQQQQILPKHKTNEKQEKSEKPQKRPLTPFHHRVSVSDDVGMDADSASQRLVISAPDSQVRFSNIRTNDVAKTPQMHGTEMANSPQPPPLSPHPCDVVDEGVTKTPSTPQSQHFYQMPTPDPLVPSKPMEDRIDSLSQSFPPQYQEAVEPTVYVGTAVNLEEDEANIAWKYYKFPKKKDVEFLPPQLPSDKFKDDPVGPFGQESVTSVTELMVQCKKPLKVSDELVQQYQIKNQCLSAIASDAEQEPKIDPYAFVEGDEEFLFPDKKDRQNSEREAGKKHKVEDGTSSVTVLSHEEDAMSLFSPSIKQDVNGGLKESEKLSDDLILLLQDQCTNLFSPFGAADQDPFPKSGVISNWVRVEERDCCNDCYLALEHGRQFMDNMSGGKVDEALVKSSCLHPWSKRNDVSMQCSQDILRMLLSLQPVLQDAIQKKRTVRPWGVQGPLTWQQFHKMAGRGSYGTDESPEPLPIPTFLLGYDYDYLVLSPFALPYWERLMLEPYGSQRDIAYVVLCPENEALLNGAKSFFRDLTAIYESCRLGQHRPVSRLLTDGIMRVGSTASKKLSEKLVAEWFSQAADGNNEAFSKLKLYAQVCRYDLGPYLASLPLDSSLLSQPNLVAPTSQSLITPPQMTNTGNANTPSATLASAASSTMTVTSGVAISTSVATANSTLTTASTSSSSSSNLNSGVSSNKLPSFPPFGSMNSNAAGSMSTQANTVQSGQLGGQQTSALQTAGISGESSSLPTQPHPDVSESTMDRDKVGIPTDGDSHAVTYPPAIVVYIIDPFTYENTDESTNSSSVWTLGLLRCFLEMVQTLPPHIKSTVSVQIIPCQYLLQPVKHEDREIYPQHLKSLAFSAFTQCRRPLPTSTNVKTLTGFGPGLAMETALRSPDRPECIRLYAPPFILAPVKDKQTELGETFGEAGQKYNVLFVGYCLSHDQRWILASCTDLYGELLETCIINIDVPNRARRKKSSARKFGLQKLWEWCLGLVQMSSLPWRVVIGRLGRIGHGELKDWSCLLSRRNLQSLSKRLKDMCRMCGISAADSPSILSACLVAMEPQGSFVIMPDSVSTGSVFGRSTTLNMQTSQLNTPQDTSCTHILVFPTSASVQVASATYTTENLDLAFNPNNDGADGMGIFDLLDTGDDLDPDIINILPASPTGSPVHSPGSHYPHGGDAGKGQSTDRLLSTEPHEEVPNILQQPLALGYFVSTAKAGPLPDWFWSACPQAQYQCPLFLKASLHLHVPSVQSDELLHSKHSHPLDSNQTSDVLRFVLEQYNALSWLTCDPATQDRRSCLPIHFVVLNQLYNFIMNML

SEQ ID NO: 745680 - protein, 1739 aa, Homo sapiens
RAAYYYYFRGRSTQQQILPKHKTNEKQEKSEKPQKRPLTPFHHRVSVSDDVGMDADSASQRLVISAPDSQVRFSNIRTNDVAKTPQMHGTEMANSPQPPPLSPHPCDVVDEGVTKTPSTPQSQHFYQMPTPDPLVPSKPMEDRIDSLSQSFPPQYQEAVEPTVYVGTAVNLEEDEANIAWKYYKFPKKKDVEFLPPQLPSDKFKDDPVGPFGQESVTSVTELMVQCKKPLKVSDELVQQYQIKNQCLSAIASDAEQEPKIDPYAFVEGDEEFLFPDKKDRQNSEREAGKKHKVEDGTSSVTVLSHEEDAMSLFSPSIKQDAPRPTSHARPPSTSLIYDSDLAVSYTDLDNLFNSDEDELTPGSKRSANGSDDKASCKESKTGNLDPLSCISTADLHKMYPTPPSLEQHIMGFSPMNMNNKEYGSMDTTPGGTVLEGNSSSIGAQFKIEVDEGFCSPKPSEIKDFSYVYKPENCQILVGCSMFAPLKTLPSQYLPLIKLPEECIYRQSWTVGKLELLSSGPSMPFIKEGDGSNMDQEYGTAYTPQTHTSCGMPPSSAPPSNSGAGILPSPSTPRFPTPRTPRTPRTPRGAGGPASAQGSVKYENSDLYSPASTPSTCRPLNSVEPATVPSIPEAHSLYVNLILSESVMNLFKDCNSDSCCICVCNMNIKGADVGVYIPDPTQEAQYRCTCGFSAVMNRKFGNNSGLFLEDELDIIGRNTDCGKEAEKRFEALRATSAEHVNGGLKESEKLSDDLILLLQDQCTNLFSPFGAADQDPFPKSGVISNWVRVEERDCCNDCYLALEHGRQFMDNMSGGKVDEALVKSSCLHPWSKRNDVSMQCSQDILRMLLSLQPVLQDAIQKKRTVRPWGVQGPLTWQQFHKMAGRGSYGTDESPEPLPIPTFLLGYDYDYLVLSPFALPYWERLMLEPYGSQRDIAYVVLCPENEALLNGAKSFFRDLTAIYESCRLGQHRPVSRLLTDGIMRVGSTASKKLSEKLVAEWFSQAADGNNEAFSKLKLYAQVCRYDLGPYLASLPLDSSLLSQPNLVAPTSQSLITPPQMTNTGNANTPSATLASAASSTMTVTSGVAISTSVATANSTLTTASTSSSSSSNLNSGVSSNKLPSFPPFGSMNSNAAGSMSTQANTVQSGQLGGQQTSALQTAGISGESSSLPTQPHPDVSESTMDRDKVGIPTDGDSHAVTYPPAIVVYIIDPFTYENTDESTNSSSVWTLGLLRCFLEMVQTLPPHIKSTVSVQIIPCQYLLQPVKHEDREIYPQHLKSLAFSAFTQCRRPLPTSTNVKTLTGFGPGLAMETALRSPDRPECIRLYAPPFILAPVKDKQTELGETFGEAGQKYNVLFVGYCLSHDQRWILASCTDLYGELLETCIINIDVPNRARRKKSSARKFGLQKLWEWCLGLVQMSSLPWRVVIGRLGRIGHGELKDWSCLLSRRNLQSLSKRLKDMCRMCGISAADSPSILSACLVAMEPQGSFVIMPDSVSTGSVFGRSTTLNMQTSQLNTPQDTSCTHILVFPTSASVQVASATYTTENLDLAFNPNNDGADGMGIFDLLDTGDDLDPDIINILPASPTGSPVHSPGSHYPHGGDAGKGQSTDRLLSTEPHEEVPNILQQPLALGYFVSTAKAGPLPDWFWSACPQAQYQCPLFLKASLHLHVPSVQSDELLHSKHSHPLDSNQTSDVLRFVLEQYNALSWLTCDPATQDRRSCLPIHFVVLNQLYNFIMNML

SEQ ID NO: 745681 - protein, 2174 aa, Homo sapiens; identical to SEQ ID NO: 745669

SEQ ID NO: 745682 - protein, 1840 aa, Homo sapiens
MSASFVPNGASLEDCHCNLFCLADLTGIKWKKYVWQGPTSAPILFPVTEEDPILSSFSRCLKADVLGVWRRDQRPGRRELWIFWWGEDPSFADLIHHDLSEEEDGVWENGLSYECRTLLFKAVHNLLERCLMNRNFVRIGKWFVKPYEKDEKPINKSEHLSCSFTFFLHGDSNVCTSVEINQHQPVYLLSEEHITLAQQSNSPFQVILCPFGLNGTLTGQAFKMSDSATKKLIGEWKQFYPISCCLKEMSEEKQEDMDWEDDSLAAVEVLVAGVRMIYPACFVLVPQSDIPTPSPVGSTHCSSSCLGVHQVPASTRDPAMSSVTLTPPTSPEEVQTVDPQSVQKWVKFSSVSDGFNSDSTSHHGGKIPRKLANHVVDRVWQECNMNRAQNKRKYSASSGGLCEEATAAKVASWDFVEATQRTNCSCLRHKNLKSRNAGQQGQAPSLGQQQQILPKHKTNEKQEKSEKPQKRPLTPFHHRVSVSDDVGMDADSASQRLVISAPDSQVRFSNIRTNDVAKTPQMHGTEMANSPQPPPLSPHPCDVVDEGVTKTPSTPQSQHFYQMPTPDPLVPSKPMEDRIDSLSQSFPPQYQEAVEPTVYVGTAVNLEEDEANIAWKYYKFPKKKDVEFLPPQLPSDKFKDDPVGPFGQESVTSVTELMVQCKKPLKVSDELVQQYQIKNQCLSAIASDAEQEPKIDPYAFVEGDEEFLFPDKKDRQNSEREAGKKHKVEDGTSSVTVLSHEEDAMSLFSPSIKQDAPRPTSHARPPSTSLIYDSDLAVSYTDLDNLFNSDEDELTPGSKRSANGSDDKASCKESKTGNLDPLSCISTADLHKMYPTPPSLEQHIMGFSPMNMNNKEYGSMDTTPGGTVLEGNSSSIGAQFKIEVDEGFCSPKPSEIKDFSYVYKPENCQILVGCSMFAPLKTLPSQYLPLIKLPEECIYRQSWTVGKLELLSSGPSMPFIKEGDGSNMDQEYGTAYTPQTHTSCGMPPSSAPPSNSGAGILPSPSTPRFPTPRTPRTPRTPRGAGGPASAQGSVKYENSDLYSPASTPSTCRPLNSVEPATVPSIPEAHSLYVNLILSESVMNLFKDCNSDSCCICVCNMNIKGADVGVYIPDPTQEAQYRCTCGFSAVMNRKFGNNSGLFLEDELDIIGRNTDCGKEAEKRFEALRATSAEHVNGGLKESEKLSDDLILLLQDQCTNLFSPFGAADQDPFPKSGVISNWVRVEERDCCNDCYLALEHGRQFMDNMSGGKVDEALVKSSCLHPWSKRNDVSMQCSQDILRMLLSLQPVLQDAIQKKRTVRPWGVQGPLTWQQFHKMAGRGSYGTDESPEPLPIPTFLLGYDYDYLVLSPFALPYWERLMLEPYGSQRDIAYVVLCPENEALLNGAKSFFRDLTAIYESCRLGQHRPVSRLLTDGIMRVGSTASKKLSEKLVAEWFSQAADGNNEAFSKLKLYAQVCRYDLGPYLASLPLDSSLLSQPNLVAPTSQSLITPPQMTNTGNANTPSATLASAASSTMTVTSGVAISTSVATANSTLTTASTSSSSSSNLNSGVSSNKLPSFPPFGSMNSNAAGSMSTQANTVQSGQLGGQQTSALQTAGISGESSSLPTQPHPDVSESTMDRDKVGIPTDGDSHAVTYPPAIVVYIIDPFTYENTDESTNSSSVWTLGLLRCFLEMVQTLPPHIKSTVSVQIIPCQYLLQPVKHEDREIYPQHLKSLAFSAFTQCRRPLPTSTNVKTLTGFGPGLAMETALRSPDRPECIRLYAPPFILAPVKDKQTELGETFGEAGQKYNVLFVGYCLSHDQRWILASCTDLYGELLETCIINIDVPNRYLYFPKYIISFHL

SEQ ID NO: 745683 - protein, 1991 aa, Homo sapiens
MSASFVPNGASLEDCHCNLFCLADLTGIKWKKYVWQGPTSAPILFPVTEEDPILSSFSRCLKADVLGVWRRDQRPGRRELWIFWWGEDPSFADLIHHDLSEEEDGVWENGLSYECRTLLFKAVHNLLERCLMNRNFVRIGKWFVKPYEKDEKPINKSEHLSCSFTFFLHGDSNVCTSVEINQHQPVYLLSEEHITLAQQSNSPFQVILCPFGLNGTLTGQAFKMSDSATKKLIGEWKQFYPISCCLKEMSEEKQEDMDWEDDSLAAVEVLVAGVRMIYPACFVLVPQSDIPTPSPVGSTHCSSSCLGVHQVPASTRDPAMSSVTLTPPTSPEEVQTVDPQSVQKWVKFSSVSDGFNSDSTSHHGGKIPRKLANHVVDRVWQECNMNRAQNKRKYSASSGGLCEEATAAKVASWDFVEATQRTNCSCLRHKNLKSRNAGQQGQAPSLGQQQQILPKHKTNEKQEKSEKPQKRPLTPFHHRVSVSDDVGMDADSASQRLVISAPDSQVRFSNIRTNDVAKTPQMHGTEMANSPQPPPLSPHPCDVVDEGVTKTPSTPQSQHFYQMPTPDPLVPSKPMEDRIDSLSQSFPPQYQEAVEPTVYVGTAVNLEEDEANIAWKYYKFPKKKDVEFLPPQLPSDKFKDDPVGPFGQESVTSVTELMVQCKKPLKVSDELVQQYQIKNQCLSAIASDAEQEPKIDPYAFVEGDEEFLFPDKKDRQNSEREAGKKHKVEDGTSSVTVLSHEEDAMSLFSPSIKQDAPRPTSHARPPSTSLIYDSDLAVSYTDLDNLFNSDEDELTPGSKRSANGSDDKASCKESKTGNLDPLSCISTADLHKMYPTPPSLEQHIMGFSPMNMNNKEYGSMDTTPGGTVLEGNSSSIGAQFKIEVDEGFCSPKPSEIKDFSYVYKPENCQILVGCSMFAPLKTLPSQYLPLIKLPEECIYRQSWTVGKLELLSSGPSMPFIKEGDGSNMDQEYGTAYTPQTHTSCGMPPSSAPPSNSGAGILPSPSTPRFPTPRTPRTPRTPRGAGGPASAQGSVKYENSDLYSPASTPSTCRPLNSVEPATVPSIPEAHSLYVNLILSESVMNLFKDCNSDSCCICVCNMNIKGADVGVYIPDPTQEAQYRCTCGFSAVMNRKFGNNSGLFLEDELDIIGRNTDCGKEAEKRFEALRATSAEHVNGGLKESEKLSDDLILLLQDQCTNLFSPFGAADQDPFPKSGVISNWVRVEERDCCNDCYLALEHGRQFMDNMSGGKVDEALVKSSCLHPWSKRNDVSMQCSQDILRMLLSLQPVLQDAIQKKRTVRPWGVQGPLTWQQFHKMAGRGSYGTDESPEPLPIPTFLLGYDYDYLVLSPFALPYWERLMLEPYGSQRDIAYVVLCPENEALLNGAKSFFRDLTAIYESCRLGQHRPVSRLLTDGIMRVGSTASKKLSEKLVAEWFSQAADGNNEAFSKLKLYAQVCRYDLGPYLASLPLDSSLLSQPNLVAPTSQSLITPPQMTNTGNANTPSATLASAASSTMTVTSGVAISTSVATANSTLTTASTSSSSSSNLNSGVSSNKLPSFPPFGSMNSNAAGSMSTQANTVQSGQLGGQQTSALQTAGISGESSSLPTQPHPDVSESTMDRDKVGIPTDGDSHAVTYPPAIVVYIIDPFTYENTDESTNSSSVWTLGLLRCFLEMVQTLPPHIKSTVSVQIIPCQYLLQPVKHEDREIYPQHLKSLAFSAFTQCRRPLPTSTNVKTLTGFGPGLAMETALRSPDRPECIRLYAPPFILAPVKDKQTELGETFGEAGQKYNVLFVGYCLSHDQRWILASCTDLYGELLETCIINIDVPNRARRKKSSARKFGLQKLWEWCLGLVQMSSLPWRVVIGRLGRIGHGELKDWSCLLSRRNLQSLSKRLKDMCRMCGISAADSPSILSACLVAMEPQGSFVIMPDSVSTGSVFGRSTTLNMQTSQLNTPQDTSCTHILVFPTSASVQVASATYTTENLDLAFNPNNGT

SEQ ID NO: 745684 - protein, 450 aa, Homo sapiens
MSASFVPNGASLEDCHCNLFCLADLTGIKWKKYVWQGPTSAPILFPVTEEDPILSSFSRCLKADVLGVWRRDQRPGRRELWIFWWGEDPSFADLIHHDLSEEEDGVWENGLSYECRTLLFKAVHNLLERCLMNRNFVRIGKWFVKPYEKDEKPINKSEHLSCSFTFFLHGDSNVCTSVEINQHQPVYLLSEEHITLAQQSNSPFQVILCPFGLNGTLTGQAFKMSDSATKKLIGEWKQFYPISCCLKEMSEEKQEDMDWEDDSLAAVEVLVAGVRMIYPACFVLVPQSDIPTPSPVGSTHCSSSCLGVHQVPASTRDPAMSSVTLTPPTSPEEVQTVDPQSVQKWVKFSSVSDGFNSDSTSHHGGKIPRKLANHVVDRVWQECNMNRAQNKRKYSASSGGLCEEATAAKVASWDFVEATQRTNCSCLRHKTLKSKNVVLQRQASSFRVRR

SEQ ID NO: 745685 - protein, 33 aa, Homo sapiens
MPLTVLPPSRLFIKKGKTPFEDGEVGTISCASW

SEQ ID NO: 745686 - protein, 160 aa, Homo sapiens
MKRNEPMQIYSIRMGTNFRSPTLDRFSPFVQLPLENFPYVYQKRYTSYFLVISICIVLFYKNIFLYIFLKVVISQGFICPLCMKRCITAIDLLEHYQKVHDENETRGQELLNDSSVTVGPVYFVLAAWFWVAQNSWFFLASVLLNFLCYKGIWIALIMHA

SEQ ID NO: 745687 - protein, 56 aa, Homo sapiens
CVVQAFLSSAPSLGFTPHKSAVLQEWLCLSPLRAFETNCCCARWMSCLTNDVLSCL

SEQ ID NO: 745688 - protein, 98 aa, Homo sapiens
MTISKPNLIMLSPGLTSSGAFQGCWDLAPRAQPVQQACGTWGGQGGHPQLLLLLLWSPQHQTLLGITEPGGSASSQAGGGFHESEPWVIQGRGLTEAK

SEQ ID NO: 745689 - protein, 113 aa, Homo sapiens
LSNSIPPQSSTYRSAQESAPHLLQPQFSLLPSALGGSQQTPQAYSSTLFTSSTASIERALLRECSVIKHHQRPSGTQSIQAQLTGSQHSLHSYLSNSSVVNFQETTRAVIFIL

SEQ ID NO: 745690 - protein, 101 aa, Homo sapiens
PHRHTRAHTHHMHTQHVHTHHACNDGTGMGKPFWMILFKKVENGTPQESLVHSINNSEIQPGICHQFLVQGSVLQPRNCSPSLSAPPSWLFLSSESFLPFP

SEQ ID NO: 745691 - protein, 110 aa, Homo sapiens
PNSTALCAVGQRCAVYLSCSISWSPPGLCHHQRVNHIWHARFTYPIFFTNISLISNSLPPRCPLPYISELTEILLSTDPATFSLTISLFPSFPALFIQLRLLLFIINSLM

SEQ ID NO: 745692 - protein, 179 aa, Homo sapiens
VKEPVLVSQCWASQCPHFRTIRSTGRGQDDRAPEVRGDRWLSVHLGRERQNGPLRAAAIPCTPREQEKGQAARKASPAIDFPETGFPVPSPCRQVPRQRNALFGEGGQDLPEAEEGLVGAEGPHQCCHSCVTDGIALQAAERGGALGVAVPGPRGSCPVPVWDSRHWAQQGVGGSRDSG

SEQ ID NO: 745693 - protein, 220 aa, Homo sapiens
MATLTVVQPLTLDRDVARAIELLEKLQESGEVPVHKLQSLKKVLQSEFCTAIREVYQYMHETITVNGCPEFRARATAKATVAAFAASEGHSHPRVVELPKTDEGLGFNVMGGKEQNSPIYISRIIPGGVAERHGGLKRGDQLLSVNGVSVEGEHHEKAVELLKAAKDSVKLVVRYTPKVLEEMEARFEKLRTARRRQQQQLLIQQQQQQQQQQTQQNHMS

SEQ ID NO: 745694 - protein, 230 aa, Homo sapiens
YILILPGFGIISHMYVVQPLTLDRDVARAIELLEKLQESGEVPVHKLQSLKKVLQSEFCTAIREVYQYMHETITVNGCPEFRARATAKATVAAFAASEGHSHPRVVELPKTDEGLGFNVMGGKEQNSPIYISRIIPGGVAERHGGLKRGDQLLSVNGVSVEGEHHEKAVELLKAAKDSVKLVVRYTPKVLEEMEARFEKLRTARRRQQQQLLIQQQQQQQQQQTQQNHMS

SEQ ID NO: 745695 - protein, 220 aa, Homo sapiens; identical to SEQ ID NO: 745693

SEQ ID NO: 745696 - protein, 220 aa, Homo sapiens; identical to SEQ ID NO: 745693

SEQ ID NO: 745697 - protein, 246 aa, Homo sapiens
MATLTVVQPLTLDRDVARAIELLEKLQESGEVPVHKLQSLKKVLQSEFCTAIREVYQYMHETITVNGCPEFRARATAKVFSCVHCEENLDISGSPESRTSTTSQATVAAFAASEGHSHPRVVELPKTDEGLGFNVMGGKEQNSPIYISRIIPGGVAERHGGLKRGDQLLSVNGVSVEGEHHEKAVELLKAAKDSVKLVVRYTPKVLEEMEARFEKLRTARRRQQQQLLIQQQQQQQQQQTQQNHMS

SEQ ID NO: 745698 - protein, 151 aa, Homo sapiens
MATLTVVQPLTLDRDVARAIELLEKLQESGEVPVHKLQSLKKVLQSEFCTAIREVYQYMHETITVNGCPEFRARATAKATVAAFAASEGHSHPRVVELPKTDEGLGFNVMGGKEQNSPIYISRIIPGGVAERHGGLKRGDQLLSVNGVVCL

SEQ ID NO: 745699 - protein, 66 aa, Homo sapiens
QTGGGGGGSVILEAQIRVKQSQTKECRQLPEAGGWRSGFSLRASRGNRPCPTPSFWPSEMNVDCWP

SEQ ID NO: 745700 - protein, 103 aa, Homo sapiens
GEHLGSAGGRVPLAGGLVTRRPCHPRLGRCCPRACGGASLPPGQPHRLDPGQETSQVPSSVQLSGMEPPCLVLKRPALTQRLTSVGSCCLQPRILRSSYVAHT

SEQ ID NO: 745701 - protein, 493 aa, Homo sapiens
MEEPQPPRPPASMALLGSQHSGAPSAAGPPGGTSSAATAAVLSFSTVATAALGNLSDASGGGTAAAPGGGGLGGSGAAREAGAAVRRPLGPEAAPLLSHGAAVAAQALVLLLIFLLSSLGNCAVMGVIVKHRQLRTVTNAFILSLSLSDLLTALLCLPAAFLDLFTPPGGSAPALPAGPWRGFCRPSRFFSSCFGIVYAQRGAHLVGPLLRYRRPPREKIGRRRALQLLAGAWLTALGFSLPWELLGAPRELAAAQSFHGCLYRTSPDPAQLGAAFSVGLVVACYLLPFLLMCFCHYHICKTVRLSDVRVRPVNTYARVLRFFSEVRTATTVLIMIVFVICCWGPYCFLVLLAAARQAQTMQAPSLLSVVAVWLTWANGAINPVIYAIRNPNISMLLGRNREEGYRTRNVDAFLPSQGPGLQARSRSRLRNRYANRLGACNRMSSSNPASGVAGDVAMWARKNPVVLFCREGPPEPVTAVTKQPKSEAGDTSL

SEQ ID NO: 745702 - protein, 54 aa, Homo sapiens
VWGLGSGRSESPPVESSALWEGLTFLALLCPVFENSSKIVIVMEYASTRTHGVP

SEQ ID NO: 745703 - protein, 670 aa, Homo sapiens
CFTARSGTAVAPRPGAGPVPRASALPAQPTDSPAALAHLLLAMESLVFARRSGPTPSAAELARPLAEGLIKSPKPLMKKQAVKRHHHKHNLRHRYEFLETLGKGTYGKVKKARESSGRLVAIKSIRKDKIKDEQDLMHIRREIEIMSSLNHPHIIAIHEVFENSSKIVIVMEYASRGDLYDYISERQQLSEREARHFFRQIVSAVHYCHQNRVVHRDLKLENILLDANGNIKIADFGLSNLYHQGKFLQTFCGSPLYASPEIVNGKPYTGPEVDSWSLGVLLYILVHGTMPFDGHDHKILVKQISNGAYREPPKPSDACGLIRWLLMVNPTRRATLEDVASHWWVNWGYATRVGEQEAPHEGGHPGSDSARASMADWLRRSSRPLLENGAKVCSFFKQHAPGGGSTTPGLERQHSLKKSRKENDMAQSLHSDTADDTAHRPGKSNLKLPKGILKKKVSASAEGVQEDPPELSPIPASPGQAAPLLPKKGILKKPRQRESGYYSSPEPSESGELLDAGDVFVSGDPKEQKPPQASGLLLHRKGILKLNGKFSQTALELAAPTTFGSLDELAPPRPLARASRPSGAVSEDSILSSESFDQLDLPERLPEPPLRGCVSVDNLTGLEEPPSEGPGSCLRRWRQDPLGDSCFSLTDCQEVTATYRQALRVCSKLT

SEQ ID NO: 745704 - protein, 130 aa, Homo sapiens [sequence omitted]

SEQ ID NO: 745705 - protein, 77 aa, Homo sapiens
CTTPAGQDSGQRLVPLGSFRRRRSELIRELKRAARWEVKSVPQLLEEEHWKKEETNVGVYGFSSSLMMWPSKEIILP

SEQ ID NO: 745706 - protein, 130 aa, Homo sapiens [sequence omitted]

SEQ ID NO: 745707 - protein, 130 aa, Homo sapiens [sequence omitted]

SEQ ID NO: 745708 - protein, 130 aa, Homo sapiens [sequence omitted]

SEQ ID NO: 745709 - protein, 130 aa, Homo sapiens [sequence omitted]

SEQ ID NO: 745710 - protein, 130 aa, Homo sapiens [sequence omitted]

SEQ ID NO: 745711 - protein, 130 aa, Homo sapiens [sequence omitted]

SEQ ID NO: 745712 - protein, 130 aa, Homo sapiens [sequence omitted]

SEQ ID NO: 745713 - protein, 130 aa, Homo sapiens [sequence omitted]

SEQ ID NO: 745714 - protein, 137 aa, Homo sapiens
HQSVGCIPSANPAKTMQVSEVVNVFKILMSNLDEVKKEREGLENDLKSVNFDMTSKFLTALAQDGVINEEALSVTELDRVYGGLTTKVQESLKKQEGLLKNIQVSHQEFSKMKQSNNEANLREEVLKNLATAYDNFV

SEQ ID NO: 745715 - protein, 157 aa, Homo sapiens
MAADDVEEYMIERPEPEFQDLNEKARALKQILSKIPDEINDRVRFLQTIKDIASAIKELLDTVNNVFKKYQYQNRRTEALEPKRKMESPQFGTRTDLRARHKGPWCPEYQHNFALKGEGDLKDPERHVEKRGKPQDTGEHTGGHTERRNTPPRRVTR

SEQ ID NO: 745716 - protein, 130 aa, Homo sapiens [sequence omitted]

SEQ ID NO: 745717 - protein, 130 aa, Homo sapiens [sequence omitted]

SEQ ID NO: 745718 - protein, 132 aa, Homo sapiens
GRSRGSRAEEYMIERPEPEFQDLNEKARALKQILSKIPDEINDRVRFLQTIKDIASAIKELLDTVNNVFKKYQYQNRRALEHQKKEFVKYSKSFSDTLKTYFKDGKAINVFVSANRLIHQTNLILQTFKTVA

SEQ ID NO: 745719 - protein, 77 aa, Homo sapiens; identical to SEQ ID NO: 745705

SEQ ID NO: 745720 - protein, 130 aa, Homo sapiens [sequence omitted]

SEQ ID NO: 745721 - protein, 104 aa, Homo sapiens
MAADDVEEYMIERPEPEFQDLNEKARALKQILSKIPDEINDRVRFLQTIKDIASAIKELLDTVNNVFKKYQYQNRRALEHQKKEFVKYSKSFSDTLKTYFKDGK

SEQ ID NO: 745722 - protein, 121 aa, Homo sapiens
MIERPEPEFQDLNEKARALKQILSKIPDEINDRVRFLQTIKDIASAIKELLDTVNNVFKKYQYQNRRALEHQKKEFVKYSKSFSDTLKTYFKDGKAINVFVSANRLIHQTNLILQTFKTVA

SEQ ID NO: 745723 - protein, 31 aa, Homo sapiens
MDHCSAASMGHCYPDLLHALPQNSSKSCLLP

SEQ ID NO: 745724 - protein, 47 aa, Homo sapiens
MTTYRAIPSDGVDLAASCGARVGDVLPGPHTGDYAPLGFWAQNGSMS

SEQ ID NO: 745725 - protein, 320 aa, Homo sapiens
NRLVPAWRLGWRRAEQWSEMWRPVQLCHFHSALLHRRQKPWPSPAVFFRRNVRGLPPRFSSPTPLWRKVLSTAVVGAPLLLGARYVMAEAREKRRMRLVVDGMGRFGRSLKVGLQISLDYWWCTNVVLRGVEENSPGYLEVMSACHQRAADALVAGAISNGGLYVKLGQGLCSFNHLLPPEYTRTLRVLEDRALKRGFQEVDELFLEDFQALPHELFQEFDYQPIAAASLAQVHRAKLHDGTSVAVKVQYIDLRDRFDGDIHTLELLLRLVEVMHPSFGFSWVLQDLKGTLAQELDFENEGRNAERCARELAHFPYVVVP

SEQ ID NO: 745726 - protein, 234 aa, Homo sapiens
MAEAREKRRMRLVVDGMGRFGRSLKVGLQISLDYWWCTNVVLRGVEENSPGYLEVMSACHQRAADALVAGAISNGGLYVKLGQGLCSFNHLLPPEYTRTLRVLEDRALKRGFQEVDELFLEDFQALPHELFQEFDYQPIAAASLAQVHRAKLHDGTSVAVKVQYIDLRDRFDGDIHTLELLLRLVEVMHPSFGFSWVLQDLKGTLAQELDFENEGRNAERCARELAHFPYVVVP

SEQ ID NO: 745727 - protein, 375 aa, Homo sapiens
ETLSGAGREKSGAVVGDVATGWSAVSQSWLTAISAYQDQAILLSQPPNYLGLQVQLCHFHSALLHRRQKPWPSPAVFFRRNVRGLPPRFSSPTPLWRKVLSTAVVGAPLLLGARYVMAEAREKRRMRLVVDGMGRFGRPCLPRPWRPTLLVSSSLPEWTSGCRSLKVGLQISLDYWWCTNVVLRGVEENSPGYLEVMSACHQRAADALVAGAISNGGLYVKLGQGLCSFNHLLPPEYTRTLRVLEDRALKRGFQEVDELFLEDFQALPHELFQEFDYQPIAAASLAQVHRAKLHDGTSVAVKVQYIDLRDRFDGDIHTLELLLRLVEVMHPSFGFSWVLQDLKGTLAQELDFENEGRNAERCARELAHFPYVVVP

SEQ ID NO: 745728 - protein, 301 aa, Homo sapiens
MWRPVQLCHFHSALLHRRQKPWPSPAVFFRRNVRGLPPRFSSPTPLWRKVLSTAVVGAPLLLGARYVMAEAREKRRMRLVVDGMGRFGRSLKVGLQISLDYWWCTNVVLRGVEENSPGYLEVMSACHQRAADALVAGAISNGGLYVKLGQGLCSFNHLLPPEYTRTLRVLEDRALKRGFQEVDELFLEDFQALPHELFQEFDYQPIAAASLAQVHRAKLHDGTSVAVKVQYIDLRDRFDGDIHTLELLLRLVEVMHPSFGFSWVLQDLKGTLAQELDFENEGRNAERCARELAHFPYVVVP

SEQ ID NO: 745729 - protein, 377 aa, Homo sapiens
ETLSGAGREKSGAVVGDVATGWSAVSQSWLTAISAYQDQAILLSQPPNYLGLQVQLCHFHSALLHRRQKPWPSPAVFFRRNVRGLPPRFSSPTPLWRKVLSTAVVGAPLLLGARYVMAEAREKRRMRLVVDGMGRFGRSLKVGLQISLDYWWCTNVVLRGVEENSPGYLEVMSACHQRAADALVAGAISNGGLYVKLGQGLCSFNHLLPPEYTRTLRVLEDRALKRGFQEVDELFLEDFQALPHELFQEFDYQPIAAASLAQVHRAKLHDGTSVAVKVQTSNCGNRLEGKSHLETLLASREGMHPDGQLVFQDLRDLARTDERGEERGAETGTQRGRAGNQAAAMTEQGEGGPEQTTGKDPQAREGGPKQQDAAAGS

SEQ ID NO: 745730 - protein, 80 aa, Homo sapiens
LVETGFHHVDQAGLELLTSGDLPASASQSARITGVSHHAQPAFLNNVFANDFQDFALLEHFPGDVWGKILKSQPYHGQSR

SEQ ID NO: 745731 - protein, 80 aa, Homo sapiens
SHGRALGPPPCAPGPAPRLPPLASLPATCRPAANWSGRRRPEGPGQPREGGEAEQERPGSGHILRVRKRGERPHVSLSPN

SEQ ID NO: 745732 - protein, 80 aa, Homo sapiens; identical to SEQ ID NO: 745731

SEQ ID NO: 745733 - protein, 80 aa, Homo sapiens; identical to SEQ ID NO: 745731

SEQ ID NO: 745734 - protein, 80 aa, Homo sapiens; identical to SEQ ID NO: 745731

SEQ ID NO: 745735 - protein, 80 aa, Homo sapiens; identical to SEQ ID NO: 745731

SEQ ID NO: 745736 - protein, 580 aa, Homo sapiens
MADLVPDLQPILFWMSNSIELLYFIQQKCPLYMQSMEEQLDITGSKESLFSCTLTASEEAMAVLEEVVLYAFQQCVYYVSKSLYICLPALLECPPFQTERRESWSSAPELPEELRRVVSVYQAALDLLRQLQVHPEVASQMLAYLFFFSGTLLLNQLLDRGPSLSCFHWPRGVQACARLQQLLEWMRSAGFGAAGEHFFQKLSCTLNLLATPRAQLIQMSWTALRAAFPALSPAQLHRLLTHYQLASAMGPMSTWEPGAQDSPEAFRSEDVLESYENPPPIVLPSDGFQVDLEANCLDDSIYQHLLYVRHFLWGLRSRASPGSPGRPGSGASQPVCPEGMHHVVLDGHLEAPSCPLAPRDPGPAAREVAPERTLPLRGAPWAQAPPGRQPGRGGSQAGPPHTDSSCLLTPPSTPLGPEPGDPDWPESGGPCGKALPERQRNGLSGLRGAAPEGDSAALAEESPPAPSSRSSSTEDFCYVFTVELERGPSGLGMGLIDGMHTHLGAPGLYIQTLLPGSPAAADGRLSLGDRILEVNGSSLLGLGYLRAVDLIRHGGKKMRFLVAKSDVETAKKIHFRTPPL

SEQ ID NO: 745737 - protein, 312 aa, Homo sapiens
LLGIWRRRLRAPPAPARAPAPAPGADQVPLAPAARPPTCCCRRRAPQALPATRALSPGPDSHGSAAMFAPRLLDFQKTKYARFMNHRVPAHKRYQPTEYEHAANCATHAFWIIPSILGSSNLYFLSDDDWETISAWIYGLGLCGLFVVSTVFHTISWKKSHLRMVEHCLHMFDRMVIYFFIAASYAPWLNLRELGPWASHMRWLVWIMASVGTIYVFFFHERYKLVELLCYVVMGFFPALVILSMPNTEGIWELVTGGVFYCLGMVFFKSDGRIPFAHAIWHLFVAFGAGTHYYAIWRYLYLPSTLQTKVSK

SEQ ID NO: 745738 - protein, 1132 aa, Homo sapiens
RCAAGRRRRGTRGSGRRPQPTASGSSAGTWRRGGLCRRSRPPHILWLKPTVLIHEASPTMFYGTHFIMSPPTKSKLKRQSQLLSSMLSRTLSYKYRDLDSTFSSLGASDDPAELSTQLSAPGVLKVFGDSVCTGTHYKSVLATGTSSARELVKEALERYALDPRQAGQYVLCDVVGQAGDAGQRWQARCFRVFGDSEKPLLIQELWKPREGLSRRFELRKRSDVEELAAKEVDTITAGINAQARRLQRSRAKGTPTPALGDARSSPPPRLRRTVSETSLSPVNALPAAAQGPEEPGPDAMRYSLYQSPHLLLLQGYSQQHPGVCAQPGPAHGGPADPSSKPSISLSAPDILPLHCTIRRQPLPDSGQAAGRLVLEPIPGAHISVNFSEVGHRTVVLHHGDLLSLGLYYLLLFKDPAQAQPLPARALARLRAVPQSCRLCGAALGARGAASPTQAALPRRQQLLLEFEPHLEDTLLQRIMTLIEPGGDDHKLTPAFLLCLCIQHSATHFQPGTFGQLLLKIARLIRETVWEKTKELAEKQAQLQEPISLASCAMADLVPDLQPILFWMSNSIELLYFIQQKCPLYMQSMEEQLDITGSKESLFSCTLTASEEAMAVLEEVVLYAFQQCVYYVSKSLYICLPALLECPPFQTERRESWSSAPELPEELRRVVSVYQAALDLLRQLQVHPEVASQMLAYLFFFSGTLLLNQLLDRGPSLSCFHWPRGVQACARLQQLLEWMRSAGFGAAGEHFFQKLSCTLNLLATPRAQLIQMSWTALRAAFPALSPAQLHRLLTHYQLASAMGPMSTWEPGAQDSPEAFRSEDVLESYENPPPIVLPSDGFQVDLEANCLDDSIYQHLLYVRHFLWGLRSRASPGSPGRPGSGASQPVCPEGMHHVVLDGHLEAPSCPLAPRDPGPAAREVAPERTLPLRGAPWAQAPPGRQPGRGGSQAGPPHTDSSCLLTPPSTPLGPEPGDPDWPESGGPCGKALPERQRNGLSGLRGAAPEGDSAALAEESPPAPSSRSSSTEDFCYVFTVELERGPSGLGMGLIDGMHTHLGAPGLYIQTLLPGSPAAADGRLSLGDRILEVNGSSLLGLGYLRAVDLIRHGGKKMRFLVAKSDVETAKKIHFRTPPL

SEQ ID NO: 745739 - protein, 1176 aa, Homo sapiens
LLGIWRRRLRAPPAPARAPAPAPGADQVPLAPAARPPTCCCRRRAPQALPATRALSPGPDSHGSAAMFAPRLLDFQKTKYARSRPPHILWLKPTVLIHEASPTMFYGTHFIMSPPTKSKLKRQSQLLSSMLSRTLSYKYRDLDSTFSSLGASDDPAELSTQLSAPGVLKVFGDSVCTGTHYKSVLATGTSSARELVKEALERYALDPRQAGQYVLCDVVGQAGDAGQRWQARCFRVFGDSEKPLLIQELWKPREGLSRRFELRKRSDVEELAAKEVDTITAGINAQARRLQRSRAKGTPTPALGDARSSPPPRLRRTVSETSLSPVNALPAAAQGPEEPGPDAMRYSLYQSPHLLLLQGYSQQHPGVCAQPGPAHGGPADPSSKPSISLSAPDILPLHCTIRRQPLPDSGQAAGRLVLEPIPGAHISVNFSEVGHRTVVLHHGDLLSLGLYYLLLFKDPAQAQPLPARALARLRAVPQSCRLCGAALGARGAASPTQAALPRRQQLLLEFEPHLEDTLLQRIMTLIEPGGDDHKLTPAFLLCLCIQHSATHFQPGTFGQLLLKIARLIRETVWEKTKELAEKQAQLQEPISLASCAMADLVPDLQPILFWMSNSIELLYFIQQKCPLYMQSMEEQLDITGSKESLFSCTLTASEEAMAVLEEVVLYAFQQCVYYVSKSLYICLPALLECPPFQTERRESWSSAPELPEELRRVVSVYQAALDLLRQLQVHPEVASQMLAYLFFFSGTLLLNQLLDRGPSLSCFHWPRGVQACARLQQLLEWMRSAGFGAAGEHFFQKLSCTLNLLATPRAQLIQMSWTALRAAFPALSPAQLHRLLTHYQLASAMGPMSTWEPGAQDSPEAFRSEDVLESYENPPPIVLPSDGFQVDLEANCLDDSIYQHLLYVRHFLWGLRSRASPGSPGRPGSGASQPVCPEGMHHVVLDGHLEAPSCPLAPRDPGPAAREVAPERTLPLRGAPWAQAPPGRQPGRGGSQAGPPHTDSSCLLTPPSTPLGPEPGDPDWPESGGPCGKALPERQRNGLSGLRGAAPEGDSAALAEESPPAPSSRSSSTEDFCYVFTVELERGPSGLGMGLIDGMHTHLGAPGLYIQTLLPGSPAAADGRLSLGDRILEVNGSSLLGLGYLRAVDLIRHGGKKMRFLVAKSDVETAKKIHFRTPPL

SEQ ID NO: 745740 - protein, 1132 aa, Homo sapiens; identical to SEQ ID NO: 745738

SEQ ID NO: 745741 - protein, 383 aa, Homo sapiens
MSHRVVGGNSEGMSPRVGPVTVARIPASCVHRAGDSGLNLLAPGFPHRWAGRPGEGGSFSCGHYGHPLSPAEDVLESYENPPPIVLPSDGFQVDLEANCLDDSIYQHLLYVRHFLWGLRSRASPGSPGRPGSGASQPVCPEGMHHVVLDGHLEAPSCPLAPRDPGPAAREVAPERTLPLRGAPWAQAPPGRQPGRGGSQAGPPHTDSSCLLTPPSTPLGPEPGDPDWPESGGPCGKALPERQRNGLSGLRGAAPEGDSAALAEESPPAPSSRSSSTEDFCYVFTVELERGPSGLGMGLIDGMHTHLGAPGLYIQTLLPGSPAAADGRLSLGDRILEVNGSSLLGLGYLRAVDLIRHGGKKMRFLVAKSDVETAKKIHFRTPPL

SEQ ID NO: 745742 - protein, 336 aa, Homo sapiens
LLGIWRRRLRAPPAPARAPAPAPGADQVPLAPAARPPTCCCRRRAPQALPATRALSPGPDSHGSAAMFAPRLLDFQKTKYARFMNHRVPAHKRYQPTEYEHAANCATHAFWIIPSILGSSNLYFLSDDDWETISAWIYGLGLCGLFVVSTVFHTISWKKSHLRMVEHCLHMFDRMVIYFFIAASYAPWLNLRELGPWASHMRWLVWIMASVGTIYVFFFHERTGSCVQFLRGEACPKAGTACLPARYKLVELLCYVVMGFFPALVILSMPNTEGIWELVTGGVFYCLGMVFFKSDGRIPFAHAIWHLFVAFGAGTHYYAIWRYLYLPSTLQTKVSK

SEQ ID NO: 745743 - protein, 1132 aa, Homo sapiens; identical to SEQ ID NO: 745738

SEQ ID NO: 745744 - protein, 118 aa, Homo sapiens
RISCKDLGRGDCEGWLWKKKDAKSYFSQKWKKYWFVLKDASLYWYINEEDEKAEGFISLPEFKIDRASECRKKYAFKACHPKIKSFYFAAEHLDDMNRWALTELICWTAGIWQKGERV

SEQ ID NO: 745745 - protein, 113 aa, Homo sapiens
ANGPARSWLGPRPSQQKGCGWSPQQRGMGRGAPQGHVCWVQIRYGRQVGMLPLPPPLLSWKPASLFPPGSVSWCSGKCHSREVVGGAVTCDIPTHIHHCPLGEHSPGRCLKES

SEQ ID NO: 745746 - protein, 560 aa, Homo sapiens
MEPLQQQQQQQQQQQKQPHLAPLQMDAREKQGQQMREAQFLYAQKLVTQPTLLSATAGRPSGSTPLGPLARVPPTAAVAQVFERGNMNSEPEEEDGGLEDEDGDDEVAEVAEKETQAASKYFHVQKVARQDPRVAPMSNLLPAPGLPPHGQQAKEDHTKDASKASPSVSTAGQPNWNLDEQLKQNGGLAWSDDADGGRGREISRDFAKLYELDGDPERKEFLDDLFVFMQKRGTPINRIPIMAKQILDLYMLYKLVTEKGGLVEIINKKIWREITKGLNLPTSITSAAFTLRTQYMKYLYAYECEKKALSSPAELQAAIDGNRREGRRPSYSSSLFGYSPAAATAAAAAGAPALLSPPKIRFPILGLGSSSGTNTSSPRISPATTLRKGDGAPVTTVPVPNRLAVPVTLASQQAGTRTAALEQLRERLESGEPAEKKASRLSEEEQRLVQQAFQRNFFSMARQLPMKIRINGREDRAEASAAALNLTTSSIGSINMSVDIDGTTYAGVLFAQKPVVHLITGSAPQSLGSSASSSSSSHCSPSPTSSRGTPSAEPSTSWSL

SEQ ID NO: 745747 - protein, 349 aa, Homo sapiens
MVVWPEGKEFRDDLFFFLQKRGTPINRIPIMAKQILDLYMLYKLVTEKGGLVEIINKKIWREITKGLNLPTSITSAAFTLRTQYMKYLYAYECEKKALSSPAELQAAIDGNRREGRRPSYSSSLFGYSPAAATAAAAAGAPALLSPPKIRFPILGLGSSSGTNTSSPRISPATTLRKGDGAPVTTVPVPNRLAVPVTLASQQAGTRTAALEQLRERLESGEPAEKKASRLSEEEQRLVQQAFQRNFFSMARQLPMKIRINGREDRAEASAAALNLTTSSIGSINMSVDIDGTTYAGVLFAQKPVVHLITGSAPQSLGSSASSSSSSHCSPSPTSSRGTPSAEPSTSWSL

SEQ ID NO: 745748 - protein, 560 aa, Homo sapiens; identical to SEQ ID NO: 745746

SEQ ID NO: 745749 - protein, 560 aa, Homo sapiens; identical to SEQ ID NO: 745746

SEQ ID NO: 745750 - protein, 87 aa, Homo sapiens
GRSREDWVRLQGSEAGWGVRGFLALENLIEILSRRFFKQVTMSTDTGVSLPSYEEDQGSKLIRKAKEAPFVPVGIAGFCSNCCIWII

SEQ ID NO: 745751 - protein, 79 aa, Homo sapiens
GRSREDWVRLQGSEAGWGVRGFLALGRFFKQVTMSTDTGVSLPSYEEDQGSKLIRKAKEAPFVPVGIAGFCSNCCIWII

SEQ ID NO: 745752 - protein, 79 aa, Homo sapiens; identical to SEQ ID NO: 745751

SEQ ID NO: 745753 - protein, 79 aa, Homo sapiens; identical to SEQ ID NO: 745751

SEQ ID NO: 745754 - protein, 87 aa, Homo sapiens; identical to SEQ ID NO: 745750

SEQ ID NO: 745755 - protein, 79 aa, Homo sapiens; identical to SEQ ID NO: 745751

SEQ ID NO: 745756 - protein, 72 aa, Homo sapiens
LVLEVSIALATDAKPQAAIVAYGLYKLKSRGNTKMSIHLIHMRVAAQGFVVGAMTVGMGYSMYREFWAKPKP

SEQ ID NO: 745757 - protein, 89 aa, Homo sapiens
SADNKGLPGGYRAVLKETHYQWPLSEVMTVSLINGELLGESRSQDSAPPTKMSIHLIHMRVAAQGFVVGAMTVGMGYSMYREFWAKPKP

SEQ ID NO: 745758 - protein, 102 aa, Homo sapiens
GRSREDWVRLQGSEAGWGVRGFLALGRFFKQVTMSTDTGVSLPSYEEDQGSKLIRKAKEAPFVPVVFGDSPALSPRLECSGRISAHCSLCLLGSSDSPTSAS

SEQ ID NO: 745759 - protein, 79 aa, Homo sapiens; identical to SEQ ID NO: 745751

SEQ ID NO: 745760 - protein, 79 aa, Homo sapiens; identical to SEQ ID NO: 745751

SEQ ID NO: 745761 - protein, 79 aa, Homo sapiens; identical to SEQ ID NO: 745751

SEQ ID NO: 745762 - protein, 79 aa, Homo sapiens; identical to SEQ ID NO: 745751

SEQ ID NO: 745763 - protein, 79 aa, Homo sapiens; identical to SEQ ID NO: 745751

SEQ ID NO: 745764 - protein, 102 aa, Homo sapiens; identical to SEQ ID NO: 745758

SEQ ID NO: 745765 - protein, 109 aa, Homo sapiens
MSTDTGVSLPSYEEDQGSQISSGENANNEEGSHFWYTPIEQVVLEFYIARRYSVSQYRIYNDKLKSRGNTKMSIHLIHMRVAAQGFVVGAMTVGMGYSMYREFWAKPKP

SEQ ID NO: 745766 - protein, 31 aa, Homo sapiens
MSIHLIHMRVAAQGFVVGAMTVTKCKRSGSS

SEQ ID NO: 745767 - protein, 91 aa, Homo sapiens
QFCTQEALDRVYGFVRTSKVPEFDFPVTPRRDKEMAVSFASLKGTHSLVMGYGNTGRGRALRSHQRAVSAAGQRLFIRVTIMYAHEGDSNS

SEQ ID NO: 745768 - protein, 911 aa, Homo sapiens
MDTCGVGYVALGEAGPVGNMTVVDSPGQEVLNQLDVKTSSEMTSAEASVEMSLPTPLPGFEDSPDQRRLPPEQESLSRLEQPDLSSEMSKVSKPRASKPGRKRGGRTRKGPKRPQQPNPPSAPLVPGLLDQSNPLSTPMPKKRGRKSKAELLLLKLSKDLDRPESQSPKRPPEDFETPSGERPRRRAAQVALLYLQELAEELSTALPAPVSCPEGPKVSSPTKPKKIRQPAACPGGEEVDGAPRDEDFFLQVEAEDVEESEGPSESSSEPEPVVPRSTPRGSTSGKQKPHCRGMAPNGLPNHIMAPVWKCLHLTKDFREQKHSYWEFAEWIPLAWKWHLLSELEAAPYLPQEEKSPLFSVQREGLPEDGTLYRINRFSSITAHPERWDVSFFTGGPLWALDWCPVPEGAGASQYVALFSSPDMNETHPLSQLHSGPGLLQLWGLGTLQQESCPGNRAHFVYGIACDNGCIWDLKFCPSGAWELPGTPRKAPLLPRLGLLALACSDGKVLLFSLPHPEALLAQQPPDAVKPAIYKVQCVATLQVGSMQATDPSECGQCLSLAWMPTRPHQHLAAGYYNGMVVFWNLPTNSPLQRIRLSDGSLKLYPFQCFLAHDQAVRTLQWCKANSHFLVSAGSDRKIKFWDLRRPYEPINSIKRFLSTELAWLLPYNGVTVAQDNCYASYGLCGIHYIDAGYLGFKAYFTAPRKGTVWSLSGSDWLGTIAAGDISGELIAAILPDMALNPINVKRPVERRFPIYKADLIPYQDSPEGPDHSSASSGVPNPPKARTYTETVNHHYLLFQDTDLGSFHDLLRREPMLRMQEGEGHSQLCLDRLQLEAIHKVRFSPNLDSYGWLVSGGQSGLVRIHFVRGLASPLGHRMQLESRAHFNAMFQPSSPTRRPGFSPTSHRLLPTP

SEQ ID NO: 745769 - protein, 451 aa, Homo sapiens
TRGSRTRGCIWDLKFCPSGAWELPGTPRKAPLLPRLGLLALACSDGKVLLFSLPHPEALLAQQPPDAVKPAIYKVQCVATLQVGSMQATDPSECGQCLSLAWMPTRPHQHLAAGYYNGMVVFWNLPTNSPLQRIRLSDGSLKLYPFQCFLAHDQAVRTLQWCKANSHFLVSAGSDRKIKFWDLRRPYEPINSIKRFLSTELAWLLPYNGVTVAQDNCYASYGLCGIHYIDAGYLGFKAYFTAPRKGTVWSLSGSDWLGTIAAGDISGELIAAILPDMALNPINVKRPVERRFPIYKADLIPYQDSPEGPDHSSASSGVPNPPKARTYTETVNHHYLLFQDTDLGSFHDLLRREPMLRMQEGEGHSQLCLDRLQLEAIHKVRFSPNLDSYGWLVSGGQSGLVRIHFVRGLASPLGHRMQLESRAHFNAMFQPSSPTRRPGFSPTSHRLLPTP

SEQ ID NO: 745770 - protein, 796 aa, Homo sapiens [sequence omitted]

SEQ ID NO: 745771 - protein, 928 aa, Homo sapiens
MDTCGVGYVALGEAGPVGNMTVVDSPGQEVLNQLDVKTSSEMTSAEASVEMSLPTPLPGFEDSPDQRRLPPEQESLSRLEQPDLSSEMSKVSKPRASKPGRKRGGRTRKGPKRPQQPNPPSAPLVPGLLDQSNPLSTPMPKKRGRKSKAELLLLKLSKDLDRPESQSPKRPPEDFETPSGERPRRRAAQVALLYLQELAEELSTALPAPVSCPEGPKVSSPTKPKKIRQPAACPGGEEVDGAPRDEDFFLQVEAEDVEESEGPSESSSEPEPVVPRSTPRGSTSGKQKPHCRGMAPNGLPNHIMAPVWKCLHLTKDFREQKHSYWEFAEWIPLAWKWHLLSELEAAPYLPQEEKSPLFSVQREGLPEDGTLYRINRFSSITAHPERWDVSFFTGGPLWALDWCPVPEGAGASQYVALFSSPDMNETHPLSQLHSGPGLLQLWGLGTLQQESCPGNRAHFVYGIACDNGCIWDLKFCPSGAWELPGTPRKAPLLPRLGLLALACSDGKVLLFSLPHPEALLAQQPPDAVKPAIYKVQCVATLQVGSMQATDPSECGQCLSLAWMPTRPHQHLAAGYYNGMVVFWNLPTNSPLQRIRLSDGSLKLYPFQCFLAHDQAVRTLQWCKANSHFLVSAGSDRKIKFWDLRRPYEPINSIKRFLSTELAWLLPYNGVTVAQDNCYASYGLCGIHYIDAGYLGFKAYFTAPRKGTVWRCLFEEQEVGLEDGTVWSLSGSDWLGTIAAGDISGELIAAILPDMALNPINVKRPVERRFPIYKADLIPYQDSPEGPDHSSASSGVPNPPKARTYTETVNHHYLLFQDTDLGSFHDLLRREPMLRMQEGEGHSQLCLDRLQLEAIHKVRFSPNLDSYGWLVSGGQSGLVRIHFVRGLASPLGHRMQLESRAHFNAMFQPSSPTRRPGFSPTSHRLLPTP

SEQ ID NO: 745772 - protein, 911 aa, Homo sapiens; identical to SEQ ID NO: 745768

SEQ ID NO: 745773 - protein, 848 aa, Homo sapiens
MDTCGVGYVALGEAGPVGNMTVVDSPGQEVLNQLDVKTSSEMTSAEASVEMSLPTPLPGFEDSPDQRRLPPEQESLSRLEQPDLSSEMSKVSKPRASKPGRKRGGRTRKGPKRPQQPNPPSAPLVPGLLDQSNPLSTPMPKKRGRKSKAELLLLKLSKDLDRPESQSPKRPPEDFETPSGERPRRRAAQVALLYLQELAEELSTALPAPVSCPEGPKVSSPTKPKKIRQPAACPGGEEVDGAPRDEDFFLQVEAEDVEESEGPSESSSEPEPVVPRSTPRGSTSGKQKPHCRGMAPNGLPNHIMAPVWKCLHLTKDFREQKHSYWEFAEWIPLAWKWHLLSELEAAPYLPQEEKSPLFSVQREGLPEDGTLYRINRFSSITAHPERWDVSFFTGGPLWALDWCPVPEGAGASQYVALFSSPDMNETHPLSQLHSGPGLLQLWGLGTLQQESCPGNRAHFVYGIACDNGCIWDLKFCPSGAWELPGTPRKAPLLPRLGLLALACSDGKVLLFSLPHPEALLAQQPPDAVKPAIYKVQCVATLQVGSMQATDPSECGQCLSLAWMPTRPHQHLAAGYYNGMVVFWNLPTNSPLQRIRLSDGSLKLYPFQCFLAHDQAVRTLQWCKANSHFLVSAGSDRKIKFWDLRRPYEPINSIKRFLSTELAWLLPYNGVTVAQDNCYASYGLCGIHYIDAGYLGFKAYFTAPRKGTVWSLSGSDWLGTIAAGDISGELIAAILPDMALNPINVKRPVERRFPIYKADLIPYQDSPEGPDHSSASSGVPNPPKARTYTETVNHHYLLFQDTDLGSFHDLLRREPMLRMQEGEGHSQLCLDRLQLEAIHKGNHHVCPRG

SEQ ID NO: 745774 - protein, 715 aa, Homo sapiens
MDTCGVGYVALGEAGPVGNMTVVDSPGQEVLNQLDVKTSSEMTSAEASVEMSLPTPLPGFEDSPDQRRLPPEQESLSRLEQPDLSSEMSKVSKPRASKPGRKRGGRTRKGPKRPQQPNPPSAPLVPGLLDQSNPLSTPMPKKRGRKSKAELLLLKLSKDLDRPESQSPKRPPEDFETPSGERPRRRAAQVALLYLQELAEELSTALPAPVSCPEGPKVSSPTKPKKIRQPAACPGGEEVDGAPRDEDFFLQVEAEDVEESEGPSESSSEPEPVVPRSTPRGSTSGKQKPHCRGMAPNGLPNHIMAPVWKCLHLTKDFREQKHSYWEFAEWIPLAWKWHLLSELEAAPYLPQEEKSPLFSVQREGLPEDGTLYRINRFSSITAHPERWDVSFFTGGPLWALDWCPVPEGAGASQYVALFSSPDMNETHPLSQLHSGPGLLQLWGLGTLQQESCPGNRAHFVYGIACDNGCIWDLKFCPSGAWELPGTPRKAPLLPRLGLLALACSDGKVLLFSLPHPEALLAQQPPDAVKPAIYKVQCVATLQVGSMQATDPSECGQCLSLAWMPTRPHQHLAAGYYNGMVVFWNLPTNSPLQRIRLSDGSLKLYPFQCFLAHDQAVRTLQWCKANSHFLVSAGSDRRFLSTELAWLLPYNGVTVAQDNCYASYGLCGIHYIDAGYLGFKAYFTAPRKGTVWGTGWSFSDPLAWTMLAVIYANYCV

SEQ ID NO: 745775 - protein, 594 aa, Homo sapiens
MDTCGVGYVALGEAGPVGNMTVVDSPGQEVLNQLDVKTSSEMTSAEASVEMSLPTPLPGFEDSPDQRRLPPEQESLSRLEQPDLSSEMSKVSKPRASKPGRKRGGRTRKGPKRPQQPNPPSAPLVPGLLDQSNPLSTPMPKKRGRKSKAELLLLKLSKDLDRPESQSPKRPPEDFETPSGERPRRRAAQVALLYLQELAEELSTALPAPVSCPEGPKVSSPTKPKKIRQPAACPGGEEVDGAPRDEDFFLQVEAEDVEESEGPSESSSEPEPVVPRSTPRGSTSGKQKPHCRGMAPNGLPNHIMAPVWKCLHLTKDFREQKHSYWEFAEWIPLAWKWHLLSELEAAPYLPQEEKSPLFSVQREGLPEDGTLYRINRFSSITAHPERWDVSFFTGGPLWALDWCPVPEGAGASQYVALFSSPDMNETHPLSQLHSGPGLLQLWGLGTLQQESCPGNRAHFVYGIACDNGCIWDLKFCPSGAWELPGTPRKAPLLPRLGLLALACSDGKVLLFSLPHPEALLAQQPPDAVKPAIYKVQCVATLQVGSMQATDPSECGQCLSLAWMPTRPHQHLAAGYYNGKKTKIKHKELLLFKFF

SEQ ID NO: 745776 - protein, 950 aa, Homo sapiens
MQVFFSLSVRQNPLKSLLKHKVLAPSRIADSGQPFWGVLMDTCGVGYVALGEAGPVGNMTVVDSPGQEVLNQLDVKTSSEMTSAEASVEMSLPTPLPGFEDSPDQRRLPPEQESLSRLEQPDLSSEMSKVSKPRASKPGRKRGGRTRKGPKRPQQPNPPSAPLVPGLLDQSNPLSTPMPKKRGRKSKAELLLLKLSKDLDRPESQSPKRPPEDFETPSGERPRRRAAQVALLYLQELAEELSTALPAPVSCPEGPKVSSPTKPKKIRQPAACPGGEEVDGAPRDEDFFLQVEAEDVEESEGPSESSSEPEPVVPRSTPRGSTSGKQKPHCRGMAPNGLPNHIMAPVWKCLHLTKDFREQKHSYWEFAEWIPLAWKWHLLSELEAAPYLPQEEKSPLFSVQREGLPEDGTLYRINRFSSITAHPERWDVSFFTGGPLWALDWCPVPEGAGASQYVALFSSPDMNETHPLSQLHSGPGLLQLWGLGTLQQESCPGNRAHFVYGIACDNGCIWDLKFCPSGAWELPGTPRKAPLLPRLGLLALACSDGKVLLFSLPHPEALLAQQPPDAVKPAIYKVQCVATLQVGSMQATDPSECGQCLSLAWMPTRPHQHLAAGYYNGMVVFWNLPTNSPLQRIRLSDGSLKLYPFQCFLAHDQAVRTLQWCKANSHFLVSAGSDRKIKFWDLRRPYEPINSIKRFLSTELAWLLPYNGVTVAQDNCYASYGLCGIHYIDAGYLGFKAYFTAPRKGTVWSLSGSDWLGTIAAGDISGELIAAILPDMALNPINVKRPVERRFPIYKADLIPYQDSPEGPDHSSASSGVPNPPKARTYTETVNHHYLLFQDTDLGSFHDLLRREPMLRMQEGEGHSQLCLDRLQLEAIHKVRFSPNLDSYGWLVSGGQSGLVRIHFVRGLASPLGHRMQLESRAHFNAMFQPSSPTRRPGFSPTSHRLLPTP

SEQ ID NO: 745777 - protein, 911 aa, Homo sapiens; identical to SEQ ID NO: 745768

SEQ ID NO: 745778 - protein, 333 aa, Homo sapiens
MVVFWNLPTNSPLQRIRLSDGSLKLYPFQCFLAHDQAVRTLQWCKANSHFLVSAGSDRKIKFWDLRRPYEPINSIKRFLSTELAWLLPYNGVTVAQDNCYASYGLCGIHYIDAGYLGFKAYFTAPRKGTVWSLSGSDWLGTIAAGDISGELIAAILPDMALNPINVKRPVERRFPIYKADLIPYQDSPEGPDHSSASSGVPNPPKARTYTETVNHHYLLFQDTDLGSFHDLLRREPMLRMQEGEGHSQLCLDRLQLEAIHKVRFSPNLDSYGWLVSGGQSGLVRIHFVRGLASPLGHRMQLESRAHFNAMFQPSSPTRRPGFSPTSHRLLPTP

SEQ ID NO: 745779 - protein, 932 aa, Homo sapiens
MDTCGVGYVALGEAGPVGNMTVVDSPGQEVLNQLDVKTSSEMTSAEASVEMSLPTPLPGFEDSPDQRRLPPEQESLSRLEQPDLSSEMSKVSKPRASKPGRKRGGRTRKGPKRPQQPNPPSAPLVPGLLDQSNPLSTPMPKKRGRKSKAELLLLKLSKDLDRPESQSPKRPPEDFETPSGERPRRRAAQVALLYLQELAEELSTALPAPVSCPEGPKVSSPTKPKKIRQPAACPGGEEVDGAPRDEDFFLQVEAEDVEESEGPSESSSEPEPVVPRSTPRGSTSGKQKPHCRGMAPNGLPNHIMAPVWKCLHLTKDFREQKHSYWEFAEWIPLAWKWHLLSELEAAPYLPQEEKSPLFSVQREGLPEDGTLYRINRFSSITAHPERWDVSFFTGGPLWALDWCPVPEGAGASQYVALFSSPDMNETHPLSQLHSGPGLLQLWGLGTLQQESCPGNRAHFVYGIACDNGCIWDLKFCPSGAWELPGTPRKAPLLPRLGLLALACSDGKVLLFSLPHPEALLAQQPPDAVKPAIYKVQCVATLQVGSMQATDPSECGQCLSLAWMPTRPHQHLAAGYYNGMVVFWNLPTNSPLQRIRLSDGSLKLYPFQCFLAHDQAVRTLQWCKANSHFLVSAGSDRKIKFWDLRRPYEPINSIKRFLSTELAWLLPYNGVTVAQDNCYASYGLCGIHYIDAGYLGFKAYFTAPRKGTVWSLSGSDWLGTIAAGDISGELIAAILPDMALNPINVKRPVERRFVRIRTSNSSCWILTHMPSQILPIYKADLIPYQDSPEGPDHSSASSGVPNPPKARTYTETVNHHYLLFQDTDLGSFHDLLRREPMLRMQEGEGHSQLCLDRLQLEAIHKVRFSPNLDSYGWLVSGGQSGLVRIHFVRGLASPLGHRMQLESRAHFNAMFQPSSPTRRPGFSPTSHRLLPTP

SEQ ID NO: 745780 - protein, 911 aa, Homo sapiens; identical to SEQ ID NO: 745768

SEQ ID NO: 745781 - protein, 58 aa, Homo sapiens
MGFEKSVRASYKELQETGLNSRGNLKSRVKGYRGSSLVLAPESLHLMPLQLHNPKTEL

SEQ ID NO: 745782 - protein, 127 aa, Homo sapiens
CFPVLSRNSFRRLRLGPSQECCLSVLNMGGAQGMFTGRCCPPSWPMGDPGNINCLTTFVPQLPVDVVRVTILTLVGDKEQLTQHTGFFCSQNGILQCTKSKKALELTLVSPLFLLNSGNRNFCSSSI

SEQ ID NO: 745783 - protein, 114 aa, Homo sapiens
MALLASNSCFIRCNEAGDIEAKSKTAGEEEMIKIRSCAEKETKKKDDIPEEDKGNVKQCEINYVKKFQSFQDHKLKISKEESKILKKAQKDGFLHETLLDSVAIYLFSLFFSSQ

SEQ ID NO: 745784 - protein, 114 aa, Homo sapiens
MALLASNSCFIRCNEAGDIEAKSKTAGEEEMIKIRSCAEKETKKKDDIPEEDKGNVKQCEINYVKKFQSFQDHKLKISKEESKILKKAQKDGFLHETLLDRSAIYLFSLFFSSQ

SEQ ID NO: 745785 - protein, 183 aa, Homo sapiens
MDEGTYIHALDNGLFTLGAPHKEVDEGPSPPEQFMAVKLSDSRIALKSGYGKYLGINSDELVGHSDAIGPREQWEPVFQNGKMALLASNSCFIRCNEAGDIEAKSKTAGEEEMIKIRSCAEKETKKKDDIPEEDKGNVKQCEINYVKKFQSFQDHKLKISKEESKILKKAQKDGFLHETLLDR

SEQ ID NO: 745786 - protein, 150 aa, Homo sapiens
MALLASNSCFIRCNEAGDIEAKSKTAGEEEMIKIRSCAEKETKKKDDIPEEDKGNVKQCEINYVKKFQSFQDHKLKISKEESKILKKAQKDGFLHETLLDRRSWNCTDDISEIHWKASMTEYYCHSDLAEMTDKEENTPNKHDLVQQYKK

SEQ ID NO: 745787 - protein, 118 aa, Homo sapiens
MALLASNSCFIRCNEAGDIEAKSKTAGEEEMIKIRSCAEKETKKKDDIPEEDKGNVKQCEINYVKKFQSFQDHKLKISKEESKILKKAQKDGFLHETLLDRPKLDCTAAISAHCNLPA

SEQ ID NO: 745788 - protein, 104 aa, Homo sapiens
MALLASNSCFIRCNEAGDIEAKSKTAGEEEMIKIRSCAEKETKKKDDIPEEDKGNVKQCEINYVKKFQSFQDHKLKISKEESKILKKAQKDGFLHETLLDREPN

SEQ ID NO: 745789 - protein, 114 aa, Homo sapiens; identical to SEQ ID NO: 745784

SEQ ID NO: 745790 - protein, 629 aa, Homo sapiens
MLSYVWPKDRPDLRARVAISLGFLGGAKAMNIVVPFMFKYAVDSLNQMSGNMLNLSDAPNTVATMATAVLIGYGVSRAGAAFFNEVRNAVFGKVAQNSIRRIAKNVFLHLHNLDLGFHLSRQTGALSKAIDRGTRGISFVLSALVFNLLPIMFEVMLVSGVLYYKCGAQFALVTLGTLGTYTAFTVAVTRWRTRFRIEMNKADNDAGNAAIDSLLNYETVKYFNNERYEAQRYDGFLKTYETASLKSTSTLAMLNFGQSAIFSVGLTAIMVLASQGIVAGTLTVGDLVMVNGLLFQLSLPLNFLGTVYRETRQALIDMNTLFTLLKVDTQIKDKVMASPLQITPQTATVAFDNVHFEYIEGQKVLSGISFEVPAGKKVAIVGGSGSGKSTIVRLLFRFYEPQKGSIYLAGQNIQDVSLESLRRAVGVVPQDAVLFHNTIYYNLLYGNISASPEEVYAVAKLAGLHDAILRMPHGYDTQVGERGLKLSGGEKQRVAIARAILKDPPVILYDEATSSLDSITEETILGAMKDVVKHRTSIFIAHRLSTVVDADEIIVLDQGKVAERGTHHGLLANPHSIYSEMWHTQSSRVQNHDNPKWEAKKENISKEEERKKLQEEIVNSVKGCGNCSC

SEQ ID NO: 745791 - protein, 108 aa, Homo sapiens
MVGPNHQNLPFSIGHHQIGPTSGLIARMEIHWSLGSRGKVAERGTHHGLLANPHSIYSEMWHTQSSRVQNHDNPKWEAKKENISKEEERKKLQEEIVNSVKGCGNCSC

SEQ ID NO: 745792 - protein, 629 aa, Homo sapiens; identical to SEQ ID NO: 745790

SEQ ID NO: 745793 - protein, 390 aa, Homo sapiens
MLSYVWPKDRPDLRARVAISLGFLGGAKAMNIVVPFMFKYAVDSLNQMSGNMLNLSDAPNTVATMATAVLIGYGVSRAGAAFFNEVRNAVFGKVAQNSIRRIAKNVFLHLHNLDLGFHLSRQTGALSKAIDRGTRGISFVLSALVFNLLPIMFEVMLVSGVLYYKCGAQFALVTLGTLGTYTAFTVAVTRWRTRFRIEMNKADNDAGNAAIDSLLNYETVKYFNNERYEAQRYDGFLKTYETASLKSTSTLAMLNFGQSAIFSVGLTAIMVLASQGIVAGTLTVGDLVMVNGLLFQLSLPLNFLGTVYRETRQALIDMNTLFTLLKVDTQIKDKVMASPLQITPQTATVAFDNVHFEYIEGQKVLSGISFEVPAGKKVAIVGGSGSGWVI

SEQ ID NO: 745794 - protein, 102 aa, Homo sapiens
MKDVVKHRTSIFIAHRLSTVVDADEIIVLDQGKVAERGTHHGLLANPHSIYSEMWHTQSSRVQNHDNPKWEAKKENISKEEERKKLQEEIVNSVKGCGNCSC

SEQ ID NO: 745795 - protein, 629 aa, Homo sapiens; identical to SEQ ID NO: 745790

SEQ ID NO: 745796 - protein, 390 aa, Homo sapiens; identical to SEQ ID NO: 745793

SEQ ID NO: 745797 - protein, 43 aa, Homo sapiens
MPGLVDSNPAPPESQEKKPLKPCCACPETKKARDACISAQPER

SEQ ID NO: 745798 - protein, 158 aa, Homo sapiens
MVAKSTFIFHLDYCFALQCWNLFVGEMSSESEKDKERLIQAAKMFFFHVQDLASVINTLTELFSRSMNTQILLMAVKNNSYIKDFFEQMLKIFKEMQSVVDARHDKIQKESLCSKVAMAMCSVVQKSTNVEELHQSAKEVFKSAHTPVIISVLNSSNI

SEQ ID NO: 745799 - protein, 245 aa, Homo sapiens
MSSESEKDKERLIQAAKMFFFHVQDLASVINTLTELFSRSMNTQILLMAVKNNSYIKDFFEQMLKIFKEMQSVVDARHDKIQKESLCSKVAMAMCSVVQKSTNVEELHQSAKEVFKSAHTPVIISVLNSSNILGSLESSLSHLMKFPIMNLQLSDFYTEDTKEQSDVTTSERTRSPPGSSKTTMIDTLKKLQDVLKTEDSKNPTKSAADLLEQIVKAMGPILEILQKAIKTMEMNISVFKKASDK

SEQ ID NO: 745800 - protein, 123 aa, Homo sapiens
YKQLLDLQNLLDMKCVVMVFCCYSSEVLSVSTIQGETANIYLPVLKHYVQVHTHIIPFHLLRFSKRLHVEQFSSLLSDFSFAIKVRRYMVLGNAHGLSLYILGPTISGMLGKLLNSEVLYFEL

SEQ ID NO: 745801 - protein, 111 aa, Homo sapiens
LPRSRGDFPPNRYDEDQLIISFLPQKCPEALAGGCSWALASGLMVAEAAWSSENGAVGACEMEARRDHREPARLESSSASPQSRPLFHPPANYRQSFPHPLRERPRGGPRP

SEQ ID NO: 745802 - protein, 102 aa, Homo sapiens
KNKNHKILSNNTGNPLNKIQHSFMIKNTRETKNGRKLPQPVIGHLPKNPQLMSYLMVKDSMLSPKIRNQTRISAFNTSIQHCTGVFRQGIRCKRNRKHSEWK

SEQ ID NO: 745803 - protein, 51 aa, Homo sapiens
MDRMDAGAAFHLPQTPTQSSGPPPSNAHMGQGPPLSEEGPLPCSFPSCPRS

SEQ ID NO: 745804 - protein, 238 aa, Homo sapiens
AARSCLRGGTKAGQASTLDRKSSLESIWSQPGLCSHLGGRTLCSSRQKRVGLAGHASLWRGAVGCRGSGSMTTETFVKDIKPGLKNLNLIFIVLETGRVTKTKDGHEVRTCKVADKTGSINISVWDDVGNLIQPGDIIRLTKGYASVFKGCLTLYTGRGGDLQKIGEFCMVYSEVPNFSEPNPEYSTQQAPNKACRTTATFNFPATLDLCASQLWERGMADATGRVPSNNASQPGNGT

SEQ ID NO: 745805 - protein, 236 aa, Homo sapiens
MGAKDPSIEPSSSIPHPVGCRGSGSMTTETFVKDIKPGLKNLNLIFIVLETGRVTKTKDGHEVRTCKVADKTGSINISVWDDVGNLIQPGDIIRLTKGYASVFKGCLTLYTGRGGDLQKIGEFCMVYSEVPNFSEPNPEYSTQQAPNKAVQNDSNPSASQPTTGPSAASPASENQNGNGLSAPPGPGGGPHPPHTPSHPPSTRITRSQPNHTPAGPPGPSSNPVSNGKETRRSSKR

SEQ ID NO: 745806 - protein, 211 aa, Homo sapiens
MTTETFVKDIKPGLKNLNLIFIVLETGRVTKTKDGHEVRTCKVADKTGSINISVWDDVGNLIQPGDIIRLTKGYASVFKGCLTLYTGRGGDLQKIGEFCMVYSEVPNFSEPNPEYSTQQAPNKAVQNDSNPSASQPTTGPSAASPASENQNGNGLSAPPGPGGGPHPPHTPSHPPSTRITRSQPNHTPAGPPGPSSNPVSNGKETRRSSKR

SEQ ID NO: 745807 - protein, 227 aa, Homo sapiens
MRVPEDLAMGCRGSGSMTTETFVKDIKPGLKNLNLIFIVLETGRVTKTKDGHEVRTCKVADKTGSINISVWDDVGNLIQPGDIIRLTKGYASVFKGCLTLYTGRGGDLQKIGEFCMVYSEVPNFSEPNPEYSTQQAPNKAVQNDSNPSASQPTTGPSAASPASENQNGNGLSAPPGPGGGPHPPHTPSHPPSTRITRSQPNHTPAGPPGPSSNPVSNGKETRRSSKR

SEQ ID NO: 745808 - protein, 134 aa, Homo sapiens
MGAKDPSIEPSSSIPHPVGCRGSGSMTTETFVKDIKPGLKNLNLIFIVLETGRVTKTKDGHEVRTCKVADKTGSINISVWDDVGNLIQPGDIIRLTKGYASVFKGCLTLYTGRGGDLQKIGDHCRIRYRARSYQ

SEQ ID NO: 745809 - protein, 254 aa, Homo sapiens
MSALPRSTGQHPAAAEPVAPPAGCSAACTVLPAGLVGCRGSGSMTTETFVKDIKPGLKNLNLIFIVLETGRVTKTKDGHEVRTCKVADKTGSINISVWDDVGNLIQPGDIIRLTKGYASVFKGCLTLYTGRGGDLQKIGEFCMVYSEVPNFSEPNPEYSTQQAPNKAVQNDSNPSASQPTTGPSAASPASENQNGNGLSAPPGPGGGPHPPHTPSHPPSTRITRSQPNHTPAGPPGPSSNPVSNGKETRRSSKR

SEQ ID NO: 745810 - protein, 236 aa, Homo sapiens; identical to SEQ ID NO: 745805

SEQ ID NO: 745811 - protein, 236 aa, Homo sapiens; identical to SEQ ID NO: 745805

SEQ ID NO: 745812 - protein, 152 aa, Homo sapiens
MGAKDPSIEPSSSIPHPVGCRGSGSMTTETFVKDIKPGLKNLNLIFIVLETGRVTKTKDGHEVRTCKVADKTGSINISVWDDVGNLIQPGDIIRLTKGYASVFKGCLTLYTGRGGDLQKIGECRTTATLQLPSLPLDPLLPLQPLRTRMGMD

SEQ ID NO: 745813 - protein, 121 aa, Homo sapiens
MGAKDPSIEPSSSIPHPVGCRGSGSMTTETFVKDIKPGLKNLNLIFIVLETGRVTKTKDGHEVRTCKVADKTGSINISVWDDVGNLIQHFGKPRWADHLRSGVQDQPDQHGETPCLLKIQN

SEQ ID NO: 745814 - protein, 538 aa, Homo sapiens
MERLGEKASRLLEKFGRRKGESSRSGSDGTPGPGKGRLSGLGGPRKSGPRGATGGPGDEPLEPAREQGSLDAERNQRGSFEAPRYEGSFPAGPPPTRALPLPQSLPPDFRLEPTAPALSPRSSFASSSASDASKPSSPRGSLLLDGAGAGGAGGSRPCSNRTSGISMGYDQRHGSPLPAGPCLFGPPLAGAPAGYSPGGVPSAYPELHAALDRLYAQRPAGFGCQESRHSYPPALGSPGALAGAGVGAAGPLERRGAQPGRHSVTGYGDCAVGARYQDELTALLRLTVGTGGREAGARGEPSGIEPSGLEEPPGPFVPEAARARMREPEAREDYFGTCIKCNKGIYGQSNACQALDSLYHTQCFVCCSCGRTLRCKAFYSVNGSVYCEEDYLFSGFQEAAEKCCVCGHLILEKILQAMGKSYHPGCFRCIVCNKCLDGIPFTVDFSNQVYCVTDYHKNYAPKCAACGQPILPSEGCEDIVRVISMDRDYHFECYHCEDCRMQLSDEEGCCCFPLDGHLLCHGCHMQRLNARQPPANYI

SEQ ID NO: 745815 - protein, 538 aa, Homo sapiens; identical to SEQ ID NO: 745814

SEQ ID NO: 745816 - protein, 538 aa, Homo sapiens; identical to SEQ ID NO: 745814

SEQ ID NO: 745817 - protein, 538 aa, Homo sapiens; identical to SEQ ID NO: 745814

SEQ ID NO: 745818 - protein, 458 aa, Homo sapiens
MERLGEKASRLLEKFGRRKGESSRSGSDGTPGPGKGRLSGLGGPRKSGPRGATGGPGDEPLEPAREQGSLDAERNQRGSFEAPRYEGSFPAGPPPTRALPLPQSLPPDFRLEPTAPALSPRSSFASSSASDASKPSSPRGSLLLDGAGAGGAGGSRPCSNRTSGISMGYDQRHGSPLPAGPCLFGPPLAGAPAGYSPGGVPSAYPELHAALDRLYAQRPAGFGCQESRHSYPPALGSPGALAGAGVGAAGPLERRGAQPGRHSVTGYGDCAVGARYQDELTALLRLTVGTGGREAGARGEPSGIEPSGLEEPPGPFVPEAARARMREPEAREDYFGTCIKCNKGIYGQSNACQALDSLYHTQCFVCCSCGRTLRCKAFYSVNGSVYCEEDYLFSGFQEAAEKCCVCGHLILEKILQAMGKSYHPGCFRCIVCNKCLDGIPFTVDFSNQVYCVTDYHKC

SEQ ID NO: 745819 - protein, 369 aa, Homo sapiens
MERLGEKASRLLEKFGRRKGESSRSGSDGTPGPGKGRLSGLGGPRKSGPRGATGGPGDEPLEPAREQGSLDAERNQRGSFEAPRYEGSFPAGPPPTRALPLPQSLPPDFRLEPTAPALSPRSSFASSSASDASKPSSPRGSLLLDGAGAGGAGGSRPCSNRTSGISMGYDQRHGSPLPAGPCLFGPPLAGAPAGYSPGGVPSAYPELHAALDRLYAQRPAGFGCQESRHSYPPALGSPGALAGAGVGAAGPLERRGAQPGRHSVTGYGDCAVGARYQDELTALLRLTVGTGGREAGARGEPSGIEPSGLEEPPGPFVPEAARARMREPEAREDYFGIMLTWSPLHGALCQARSFSPSLEVCSGEKSFYN

SEQ ID NO: 745820 - protein, 538 aa, Homo sapiens; identical to SEQ ID NO: 745814

SEQ ID NO: 745821 - protein, 538 aa, Homo sapiens; identical to SEQ ID NO: 745814

SEQ ID NO: 745822 - protein, 99 aa, Homo sapiens
GKQSSLVFAPNPSFSSMMSLTPESTCTPSALSSQQAPAMDVCLSSAQQPGRRREGLSSPGGWLEAEKKGAPQKDSTGGVLEGNLLLHHFNSFPQLFSWR

SEQ ID NO: 745823 - protein, 243 aa, Homo sapiens
MRPLLVLLLLGLAAGSPPLDDNKIPSLCPGHPGLPGTPGHHGSQGLPGRDGRDGRDGAPGAPGEKGEGGRPGLPGPRGDPGPRGEAGPAGPTGPAGECSVPPRSAFSAKRSESRVPPPSDAPLPFDRVLVNEQGHYDAVTGKFTCQVPGVYYFAVHATVYRASLQFDLVKNGESIASFFQFFGGWPKPASLSGGAMVRLEPEDQVWVQVGVGDYIGIYASIKTDSTFSGFLVYSDWHSSPVFA

SEQ ID NO: 745824 - protein, 151 aa, Homo sapiens
SQLPVSGTRVSRQGAPLPALCSPERGRGPGGGSPLGQPPRSALREGVEEVPVREEALAEAQAGAGRGTVTLESPPRCGLSRRYSHPAAPLTPQDCRDLEGTPGREERRDPRGPPGLPGSARCLRDPPSAPSAPRAGCLRRLTHPCPSTACW

SEQ ID NO: 745825 - protein, 151 aa, Homo sapiens; identical to SEQ ID NO: 745824

SEQ ID NO: 745826 - protein, 243 aa, Homo sapiens
MRPLLVLLLLGLAAGSPPLDDNKIPSLCPGHPGLPGTPGHHGSQGLPGRDGRDGRDGAPGAPGEKGEGGRPGLPGPRGDPGPRGEAGPAGPTGPAGECSVPPRSAFSAKRSESRVPPPSDAPLPFDRVLVNEQGHYDAVTGKFTCQVPGVYYFAVHATVYRASLQFDLVKNGESIASFFQFFGGWPKPASLSGGAMVRLEPEDQVWVQVGVGDYIGIYASIKTDSTFSGFSAQDQRSVLCWQV

SEQ ID NO: 745827 - protein, 299 aa, Homo sapiens
GLRALSLRCTAVGWGPTGPRRGGERGRSQDSGSRLQSCLVHRLREDPGVRAPGASAMRPLLVLLLLGLAAGSPPLDDNKIPSLCPGHPGLPGTPGHHGSQGLPGRDGRDGRDGAPGAPGEKGEGGRPGLPGPRGDPGPRGEAGPAGPTGPAGECSVPPRSAFSAKRSESRVPPPSDAPLPFDRVLVNEQGHYDAVTGKFTCQVPGVYYFAVHATVYRASLQFDLVKNGESIASFFQFFGGWPKPASLSGGAMVRLEPEDQVWVQVGVGDYIGIYASIKTDSTFSGFSAQDQRSVLCWQV

SEQ ID NO: 745828 - protein, 201 aa, Homo sapiens [sequence omitted]

SEQ ID NO: 745829 - protein, 625 aa, Homo sapiens
MNVTSIALRAETWLLAAWHVKVPPMWLEACINWIQEENNNVNLSQAQMNKQVFEQWLLTDLRDLEHPLLPDGILEIPKGELNGFYALQINSLVDVSQPAYSQIQKLRGKNTTNDLVTAEAQVTPKPWEAKPSRMLMLQLTDGIVQIQGMEYQPIPILHSDLPPGTKILIYGNISFRLGVLLLKPENVKVLGGEVDALLEEYAQEKVLARLIGEPDLVVSVIPNNSNENIPRVTDVLDPALGPSDEELLASLDENDELTANNDTSSERCFTTGSSSNTIPTRQSSFEPEFVISPRPKEEPSNLSIHVMDGELDDFSLEEALLLEETVQKEQMETKELQPLTFNRNADRSIERFSHNPNTTNNFSLTCKNGNNNWSEKNVSEQMTNEDKSFGCPSVRDQNRSIFSVHCNVPLAHDFTNKEKNLETDNKIKQTSSSDSHSLNNKILNREVVNYVQKRSSQISNENDCNLQSCSLRSSENSINLSIAMDLYSPPFVYLSVLMASKPKEVTTVKVKAFIVTLTGNLSSSGGIWSITAKVSDGTAYLDVDFVDEILTSLIGFSVPEMKQSKKDPLQYQKFLEGLQKCQRDLIDLCCLMTISFNPSLSKAMVLALQDVNMEHLENLKKRLNK

SEQ ID NO: 745830 - protein, 120 aa, Homo sapiens
PRPKALEEAAEETVQKEQMETKELQPLTFNRNADRSIERFSHNPNTTNNFSLTCKNGNNNWSEKNVSEQMTNEDKSFGCPSVRDQNRSIFSVHCNVPLAHDFTNKEKKLETVLLVPNSSA

SEQ ID NO: 745831 - protein, 625 aa, Homo sapiens; identical to SEQ ID NO: 745829

SEQ ID NO: 745832 - protein, 625 aa, Homo sapiens; identical to SEQ ID NO: 745829

SEQ ID NO: 745833 - protein, 149 aa, Homo sapiens
LPSFFQNQQSSAAPTSQERSSNPAPRRQQAFVAPLSQAPYTFQHGSPLHSTGHPHLAPAPAHLPSQAHLYTYAAPTSAAALGSTSSIAHLFSPQGSSRHAAAYTTHPSTLVHQVPVSVGPSLLTSASVAPAQYYQQLQRPPFKGTMHLT

SEQ ID NO: 745834 - protein, 550 aa, Homo sapiens
IAGLQATTKHSGFPVRMDNAVPIVPQAPAAQPLQIQSGVLTQGSCTPLMVATLHPQVATITPQYAVPFTLSCAAGRPALVEQTAAVLAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSSSGLKPRSNVISYVTVNDSPDSDSSLSSPYSTDTLSALRGNSGSVLEGPGRVVADGTGTRTIIVPPLKTQLGDCTVATQASGLLSNKTKPVASVSGQSSGCCITPTGYRAQRGGTSAAQPLNLSQNQQSSAAPTSQERSSNPAPRRQQAFVAPLSQAPYTFQHGSPLHSTGHPHLAPAPAHLPSQAHLYTYAAPTSAAALGSTSSIAHLFSPQGSSRHAAAYTTHPSTLVHQVPVSVGPSLLTSASVAPAQYQHQFATQSYIGSSRGSTIYTGYPLSPTKISQYSYL

SEQ ID NO: 745835 - protein, 169 aa, Homo sapiens
MLFVIKCVVITLELVLSVYVILQCYPGDGLMSPLYLNQNELILVGMYVNYLQLSSSMAARYTRQGTHTLPRPLLTCQARLICIRMLPRLLLLHWAQPAPLLIFSPHRVPQGMLQPIPLTLALWCTRSLSVLGPASSLLPAWPLLSTNTSLPPNPTLGLPEAQQFTLDTR

SEQ ID NO: 745836 - protein, 113 aa, Homo sapiens
MAARYTRQGTHTLPRPLLTCQARLICIRMLPRLLLLHWAQPAPLLIFSPHRVPQGMLQPIPLTLALWCTRSLSVLGPASSLLPAWPLLSTNTSLPPNPTLGLPEAQQFTLDTR

SEQ ID NO: 745837 - protein, 446 aa, Homo sapiens
IAGLQATTKHSGFPVRMDNAVPIVPQAPAAQPLQIQSGVLTQGSCTPLMVATLHPQVATITPQYAVPFTLSCAAGRPALVEQTAAVLAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSSSGLKPRSNVISYVTVNDSPDSDSSLSSPYSTDTLSALRGNSGSVLEGPGRVVADGTGTRTIIVPPLKTQLGDCTVATQASGLLSNKTKPVASVSGQSSGCCITPTGYRAQRGGTSAAQPLNLSQNQQSSAAPTSQERSSNPAPRRQQAFVAPLSQAPYTNTSLPPNPTLGLPEAQQFTLDTR

SEQ ID NO: 745838 - protein, 550 aa, Homo sapiens; identical to SEQ ID NO: 745834

SEQ ID NO: 745839 - protein, 550 aa, Homo sapiens; identical to SEQ ID NO: 745834

SEQ ID NO: 745840 - protein, 550 aa, Homo sapiens; identical to SEQ ID NO: 745834

SEQ ID NO: 745841 - protein, 415 aa, Homo sapiens
IAGLQATTKHSGFPVRMDNAVPIVPQAPAAQPLQIQSGVLTQGSCTPLMVATLHPQVATITPQYAVPFTLSCAAGRPALVEQTAAVLAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSSSGLKPRSNVISYVTVNDSPDSDSSLSSPYSTDTLSALRGNSGSVLEGPGRVVADGTGTRTIIVPPLKTQLGDCTVATQASGLLSNKTKPVASVSGQSSGCCITPTGYRAQRGGTSAAQPLNLSQVSAMGYCLLFGPCTVVTFWRTLLLAGC

SEQ ID NO: 745842 - protein, 514 aa, Homo sapiens
MGLAGAAGRWWGLALGLTAFFLPGVHSQVVQVNDSMYGFIGTDVVLHCSFANPLPSVKITQVTWQKSTNGSKQNVAIYNPSMGVSVLAPYRERVEFLRPSFTDGTIRLSRLELEDEGVYICEFATFPTGNRESQLNLTVMAKPTNWIEGTQAVLRAKKGQDDKVLVATCTSANGKPPSVVSWETRLKGEAEYQEIRNPNGTVTVISRYRLVPSREAHQQSLACIVNYHMDRFKESLTLNVQYEPEVTIEGFDGNWYLQRMDVKLTCKADANPPATEYHWTTLNGSLPKGVEAQNRTLFFKGPINYSLAGTYICEATNPIGTRSGQVEVNITEFPYTPSPPEHGRRAGPVPTAIIGGVAGSILLVLIVVGGIVVALRRRRHTFKGDYSTKKHVYGNGYSKAGIPQHHPPMAQNLQYPDDSDDEKKAGPLGGSSYEEEEEEEEGGGGGERKVGGPHPKYDEDAKRPYFTVDEAEARQDGYGDRTLGYQYDPEQLDLAENMVSQNDGSFISKKEWYV

SEQ ID NO: 745843 - protein, 80 aa, Homo sapiens
PPPSPLKYPFGPLNGSLPKGVEAQNRTLFFKGPINYSLAGTYICEATNPIGTRSGQVEVNITAFCQLIYPGKGRTRARMF

SEQ ID NO: 745844 - protein, 349 aa, Homo sapiens
MGLAGAAGRWWGLALGLTAFFLPGVHSQVVQVNDSMYGFIGTDVVLHCSFANPLPSVKITQVTWQKSTNGSKQNVAIYNPSMGVSVLAPYRERVEFLRPSFTDGTIRLSRLELEDEGVYICEFATFPTGNRESQLNLTVMAKPTNWIEGTQAVLRAKKGQDDKVLVATCTSANGKPPSVVSWETRLKGEAEYQEIRNPNGTVTVISRYRLVPSREAHQQSLACIVNYHMDRFKESLTLNVQYEPEVTIEGFDGNWYLQRMDVKLTCKADANPPATEYHWTTLNGSLPKGVEAQNRTLFFKGPINYSLAGTYICEATNPIGTRSGQVEVNITAFCQLIYPGKGRTRARMF

SEQ ID NO: 745845 - protein, 286 aa, Homo sapiens
MAVTVSVSFAQEDPRQAHDGVSVLAPYRERVEFLRPSFTDGTIRLSRLELEDEGVYICEFATFPTGNRESQLNLTVMAKPTNWIEGTQAVLRAKKGQDDKVLVATCTSANGKPPSVVSWETRLKGEAEYQEIRNPNGTVTVISRYRLVPSREAHQQSLACIVNYHMDRFKESLTLNVQYEPEVTIEGFDGNWYLQRMDVKLTCKADANPPATEYHWTTLNGSLPKGVEAQNRTLFFKGPINYSLAGTYICEATNPIGTRSGQVEVNITAFCQLIYPGKGRTRARMF

SEQ ID NO: 745846 - protein, 298 aa, Homo sapiens
MGLAGAAGRWWGLALGLTAFFLPGVHSQVVQVNDSMYGFIGTDVVLHCSFANPLPSVKITQVTWQKSTNGSKQNVAIYNPSMGVSVLAPYRERVEFLRPSFTDGTIRLSRLELEDEGVYICEFATFPTGNRESQLNLTVMAKPTNWIEGTQAVLRAKKGQDDKVLVATCTSANGKPPSVVSWETRLKGEAEYQEIRNPNGTVTVISRYRLVPSREAHQQSLACIVNYHMDRFKESLTLNVQYEPEVTIEGFDGNWYLQRMDVKLTCKADANPPATEYHWTTWTGPPPPSVKRGQYDVP

SEQ ID NO: 745847 - protein, 284 aa, Homo sapiens
MSVPDMLIHVQYEPEVTIEGFDGNWYLQRMDVKLTCKADANPPATEYHWTTLNGSLPKGVEAQNRTLFFKGPINYSLAGTYICEATNPIGTRSGQVEVNITEFPYTPSPPEHGRRAGPVPTAIIGGVAGSILLVLIVVGGIVVALRRRRHTFKGDYSTKKHVYGNGYSKAGIPQHHPPMAQNLQYPDDSDDEKKAGPLGGSSYEEEEEEEEGGGGGERKVGGPHPKYDEDAKRPYFTVDEAEARQDGYGDRTLGYQYDPEQLDLAENMVSQNDGSFISKKEWYV

SEQ ID NO: 745848 - protein, 91 aa, Homo sapiens
QDDKVLVATCTSANGKPPSVVSWETRLKGEAEYQEIRNPNGTVTVISRYRLVPSREAHQQSLACIVNYHMDRFKESLTLNVQCEQGWLPGA

SEQ ID NO: 745849 - protein, 455 aa, Homo sapiens
MGLAGAAGRWWGLALGLTAFFLPGVHSQVVQVNDSMYGFIGTDVVLHCSFANPLPSVKITQVTWQKSTNGSKQNVAIYNPSMGVSVLAPYRERVEFLRPSFTDGTIRLSRLELEDEGVYICEFATFPTGNRESQLNLTVMAKPTNWIEGTQAVLRAKKGQDDKVLVATCTSANGKPPSVVSWETRLKGEAEYQEIRNPNGTVTVISRYRLVPSREAHQQSLACIVNYHMDRFKESLTLNVQYEPEVTIEGFDGNWYLQRMDVKLTCKADANPPATEYHWTTLNGSLPKGVEAQNRTLFFKGPINYSLAGTYICEATNPIGTRSGQVEVNITEKPRPQRGLGSAARLLAGTVAVFLILVAVLTVFFLYNRQQKSPPETDGAGTDQPLSQKPEPSPSRQSSLVPEDIQVVHLDPGRQQQQEEEDLQKLSLQPPYYDLGVSPSYHPSVRTTEPRGECP

SEQ ID NO: 745850 - protein, 159 aa, Homo sapiens
PGHFFKLGFRGRRTNQGYRFPCGLGERGHHYEGAHQEAPEIDLVHQCVACGATFTTPYRPAPDSDDEKKAGPLGGSSYEEEEEEEEGGGGGERKVGGPHPKYDEDAKRPYFTVDEAEARQDGYGDRTLGYQYDPEQLDLAENMVSQNDGSFISKKEWYV

SEQ ID NO: 745851 - protein, 347 aa, Homo sapiens
MGLAGAAGRWWGLALGLTAFFLPGVHSQVVQVNDSMYGFIGTDVVLHCSFANPLPSVKITQVTWQKSTNGSKQNVAIYNPSMGVSVLAPYRERVEFLRPSFTDGTIRLSRLELEDEGVYICEFATFPTGNRESQLNLTVMAKPTNWIEGTQAVLRAKKGQDDKVLVATCTSANGKPPSVVSWETRLKGEAEYQEIRNPNGTVTVISRYRLVPSREAHQQSLACIVNYHMDRFKESLTLNVQYEPEVTIEGFDGNWYLQRMDVKLTCKADANPPATEYHWTTLNGSLPKGVEAQNRTLFFKGPINYSLAGTYICEATNPIGTRSGQVEVNITGGSTVCPSVNGVSSDP

SEQ ID NO: 745852 - protein, 81 aa, Homo sapiens
LDIPYRIWVHWTTLNGSLPKGVEAQNRTLFFKGPINYSLAGTYICEATNPIGTRSGQVEVNITAFCQLIYPGKGRTRARMF

SEQ ID NO: 745853 - protein, 118 aa, Homo sapiens
KQNVAIYNPSMGVSVLAPYRERVEFLRPSFTDGTIRLSRLELEDEGVYICEFATFPTGNRESQLNLTVMGKLPWAPSLFIQRPVTSGRGHPQDASMTPDIPLGWACCHHSRHEASSPF

SEQ ID NO: 745854 - protein, 60 aa, Homo sapiens
GVLCQEGVLPGGPFSPGRELTRLVSGLPSTLRTVRKFSASSVLEAGLGICEAWNCSLRGL

SEQ ID NO: 745855 - protein, 530 aa, Homo sapiens
MEEAGGPMARAKAQVVSATLTWRQWPPTQEEIKHGFHKVSLVSGAQMEAPQKEMFEFSRREEVEVNGFATQEEETVNCQGPRDTAGSKNFQSHGPIFSKKYIPPPKEKRPEGRLKEAVDQSDGSRQAPRTEPPCVGAMARTELLVPLPGPREPSPHPGVGLTSGSSRSLEEYRVTRTVRTTTVVGGHVDRRMSSSVTVRPVSSGEALPRGRQVSRMVPPVVVGSPPGSPSRSQAVKVLSNLVPAGHSPPASHLPRPTAGGPRSTGLGSTVGAALRQLPETGTAELKDSSALASTGIPASAHLPKNQDAPAACPDRDQGRAPDARACELWQVLGAPSSTELPLQTSQGQASVPSSPRLETHVPSPGLTHPAKQPVVPTHPGARLTPLVLPPKKKDGPVDPPAATVLPMVRSEHVTVPGQPPAPSTTRRKDVPSPGGLSAPSSPRNKFVQNSENVPVLPFTQREVVKGPGVWAESRLPRQTWSISESGHICSQMFEGQILDVKGGRGYDRDHVVLWEPDEDRASQIWTIHVL

SEQ ID NO: 745856 - protein, 155 aa, Homo sapiens
FTDGEIKAQRSGHGFALQSWRRVYFRLWNAALGGFLAVPDHVEDMKAGRVVVADPQAGGSCIWYYEDGLLKNQMAPTMSLQVIGPPSPGSKVVLWAESRLPRQTWSISESGHICSQMFEGQILDVKGGRGYDRDHVVLWEPDEDRASQIWTIHVL

SEQ ID NO: 745857 - protein, 419 aa, Homo sapiens
GGYDELLTSLRVIRTDFGEPAVVLFEAMDFEGHGVEVSKALPDVELVQHVPSTQAIHVLSGVWVAYQEVGFSGEQYVLEKGVYRNCEDWGAGNSTLASLQPVLQVGEHDLHFVSKIQLFSRPDFLGDHFSFEDDQAALPASFRPQSCRVHGGSWILFDETNFEGDQHILSEGEFPTLTAMGCLASTVLGSLQKVSLHFSEPSIFLYGLECFEGKEIELSREVRSLQAEGFNNHVLSVRIKGGIWVLCEHSDFRGRQWLVGSCEITNWLTYSGTQRVGSLYPIKQRRVYFRLWNAALGGFLAVPDHVEDMKAGRVVVADPQAGGSCIWYYEDGLLKNQMAPTMSLQVIGPPSPGSKVVLWAESRLPRQTWSISESGHICSQMFEGQILDVKGGRGYDRDHVVLWEPDEDRASQIWTIHVL

SEQ ID NO: 745858 - protein, 111 aa, Homo sapiens
MKAGRVVVADPQAGGSCIWYYEDGLLKNQMAPTMSLQVIGPPSPGSKVVLWAESRLPRQTWSISESGHICSQMFEGQILDVKGGRGYDRDHVVLWEPDEDRASQIWTIHVL

SEQ ID NO: 745859 - protein, 1347 aa, Homo sapiens
MDLLSGTYIFAVLLACVVFHSGAQEKNYTIREEMPENVLIGDLLKDLNLSLIPNKSLTTAMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAKINYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSTEAPVTPNTEIADVSSPTSDYVKILVAAVAGTITVVVVIFITAVVRCRQAPHLKAAQKNKQNSEWATPNPENRQMIMMKKKKKKKKHSPKNLLLNFVTIEETKADDVDSDGNRVTLDLPIDLEEQTMGKYNWVTTPTTFKPDSPDLARHYKSASPQPAFQIQPETPLNSKHHIIQELPLDNTFVACDSISKCSSSSSDPYSVSDCGYPVTTFEVPVSVHTRPPMKEVVRSCTPMKESTTMEIWIHPQPQRKSEGKVAGKSQRRVTFHLPEGSQESSSDGGLGDHDAGSLTSTSHGLPLGYPQEEYFDRATPSNRTEGDGNSDPESTFIPGLKKAAEITVQPTVEEASDNCTQECLIYGHSDACWMPASLDHSSSSQAQASALCHSPPLSQASTQHHSPRVTQTIALCHSPPVTQTIALCHSPPPIQVSALHHSPPLVQATALHHSPPSAQASALCYSPPLAQAAAISHSSPLPQVIALHRSQAQSSVSLQQGWVQGADGLCSVDQGVQGSATSQFYTMSERLHPSDDSIKVIPLTTFTPRQQARPSRGDSPIMEEHPL

SEQ ID NO: 745860 - protein, 1054 aa, Homo sapiens
MRTERQWVLIQIFQVLCGLIQQTVTSVPGMDLLSGTYIFAVLLACVVFHSGAQEKNYTIREEMPENVLIGDLLKDLNLSLIPNKSLTTAMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAKINYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSTEAPVTPNTEIADVSSPTSDYVKILVAAVAGTITVVVVIFITAVVRCRQAPHLKAAQKNKQNSEWATPNPENRQMIMMKKKKKKKKHSPKNLLLNFVTIEETKADDVDSDGNRVTLDLPIDLEEQTMGKYNWVTTPTTFKPDSPDLARHYKSASPQPAFQIQPETPLNSKHHIIQELPLDNTFVACDSISKCSSSSSDPYSVSDCGYPVTTFEVPVSVHTRPTDSRTSTIEICSEI

SEQ ID NO: 745861 - protein, 1339 aa, Homo sapiens
MRTERQWVLIQIFQVLCGLIQQTVTSVPGMDLLSGTYIFAVLLACVVFHSGAQEKNYTIREEMPENVLIGDLLKDLNLSLIPNKSLTTAMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAKINYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSTEAPVTPNTEIADVSSPTSDYVKILVAAVAGTITVVVVIFITAVVRCRQAPHLKAAQKNKQNSEWATPNPENRQMIMMKKKKKKKKHSPKNLLLNFVTIEETKADDVDSDGNRVTLDLPIDLEEQTMGKYNWVTTPTTFKPDSPDLARHYKSASPQPAFQIQPETPLNSKHHIIQELPLDNTFVACDSISKCSSSSSDPYSVSDCGYPVTTFEVPVSVHTRPSQRRVTFHLPEGSQESSSDGGLGDHDAGSLTSTSHGLPLGYPQEEYFDRATPSNRTEGDGNSDPESTFIPGLKKAAEITVQPTVEEASDNCTQECLIYGHSDACWMPASLDHSSSSQAQASALCHSPPLSQASTQHHSPRVTQTIALCHSPPVTQTIALCHSPPPIQVSALHHSPPLVQATALHHSPPSAQASALCYSPPLAQAAAISHSSPLPQVIALHRSQAQSSVSLQQGWVQGADGLCSVDQGVQGSATSQFYTMSERLHPSDDSIKVIPLTTFTPRQQARPSRGDSPIMEEHPL

SEQ ID NO: 745862 - protein, 1337 aa, Homo sapiens
MDLLSGTYIFAVLLACVVFHSGAQEKNYTIREEMPENVLIGDLLKDLNLSLIPNKSLTTAMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAKINYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSTEAPVTPNTEIADVSSPTSDYVKILVAAVAGTITVVVVIFITAVVRCRQAPHLKAAQKNKQNSEWATPNPENRQMIMMKKKKKKKKHSPKNLLLNFVTIEETKADDVDSDGNRVTLDLPIDLEEQTMGKYNWVTTPTTFKPDSPDLARHYKSASPQPAFQIQPETPLNSKHHIIQELPLDNTFVACDSISKCSSSSSDPYSVSDCGYPVTTFEVPVSVHTRPPMKEVVRSCTPMKESTTMEIWIHPQPQSQRRVTFHLPEGSQESSSDGGLGDHDAGSLTSTSHGLPLGYPQEEYFDRATPSNRTEGDGNSDPESTFIPGLKKAAEITVQPTVEEASDNCTQECLIYGHSDACWMPASLDHSSSSQAQASALCHSPPLSQASTQHHSPRVTQTIALCHSPPVTQTIALCHSPPPIQVSALHHSPPLVQATALHHSPPSAQASALCYSPPLAQAAAISHSSPLPQVIALHRSQAQSSVSLQQGWVQGADGLCSVDQGVQGSATSQFYTMSERLHPSDDSIKVIPLTTFTPRQQARPSRGDSPIMEEHPL

SEQ ID NO: 745863 - protein, 1021 aa, Homo sapiens
MDLLSGTYIFAVLLACVVFHSGAQEKNYTIREEMPENVLIGDLLKDLNLSLIPNKSLTTAMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAKINYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSTEAPVTPNTEIADVSSPTSDYVKILVAAVAGTITVVVVIFITAVVRCRQAPHLKAAQKNKQNSEWATPNPENRQMIMMKKKKKKKKHSPKNLLLNFVTIEETKADDVDSDGNRVTLDLPIDLEEQTMGKYNWVTTPTTFKPDSPDLARHYKSASPQPAFQIQPETPLNSKHHIIQELPLDNTFVACDSISKCSSSSSDPYSVSDCGYPVTTFEVPVSVHTRPVGIQVSNTTF

SEQ ID NO: 745864 - protein, 275 aa, Homo sapiens
MLAHMFKDKGVWGNKQDHRGAFLIDRSPEYFEPILNYLRHGQLIVNDGINLLGVLEEARFFGIDSLIEHLEVAIKNSQPPEDHSPISRKEFVRFLLATPTKSELRCQGLNFSGADLSRLDLRYINFKMANLSRCNLAHANLCCANLERADLSGSVLDCANLQGVKMLCSNAEGASLKLCNFEDPSGLKANLEGANLKGVDMEGSQMTGINLRVATLKNAKLKNCNLRGATLAGTDLENCDLSGCDLQEANLRGSNVKGAIFEEMLTPLHMSQSVR

SEQ ID NO: 745865 - protein, 275 aa, Homo sapiens; identical to SEQ ID NO: 745864

SEQ ID NO: 745866 - protein, 464 aa, Homo sapiens
PRQAEEPRGGVGRRTGRTLGVGQSACVWCVPKGRKVAKGGESEWVEGGEGREEKKVGGGPGGRVAAHSGPSGGSAMRRVTLFLNGSPKNGKVVAVYGTLSDLLSVASSKLGIKATSVYNGKGGLIDDIALIRDDDVLFVCEGEPFIDPQTDSKPPEGLLGFHTDWLTLNVGGRYFTTTRSTLVNKEPDSMLAHMFKDKGVWGNKQDHRGAFLIDRSPEYFEPILNYLRHGQLIVNDGINLLGVLEEARFFGIDSLIEHLEVAIKNSQPPEDHSPISRKEFVRFLLATPTKSELRCQGLNFSGADLSRLDLRYINFKMANLSRCNLAHANLCCANLERADLSGSVLDCANLQGVKMLCSNAEGASLKLCNFEDPSGLKANLEGANLKGVDMEGSQMTGINLRVATLKNAKLKNCNLRGATLAGTDLENCDLSGCDLQEANLRGSNVKGAIFEEMLTPLHMSQSVR

SEQ ID NO: 745867 - protein, 464 aa, Homo sapiens; identical to SEQ ID NO: 745866

SEQ ID NO: 745868 - protein, 464 aa, Homo sapiens; identical to SEQ ID NO: 745866

SEQ ID NO: 745869 - protein, 275 aa, Homo sapiens; identical to SEQ ID NO: 745864

SEQ ID NO: 745870 - protein, 275 aa, Homo sapiens; identical to SEQ ID NO: 745864

SEQ ID NO: 745871 - protein, 275 aa, Homo sapiens; identical to SEQ ID NO: 745864

SEQ ID NO: 745872 - protein, 275 aa, Homo sapiens; identical to SEQ ID NO: 745864

SEQ ID NO: 745873 - protein, 432 aa, Homo sapiens
PRQAEEPRGGVGRRTGRTLGVGQSACVWCVPKGRKVAKGGESEWVEGGEGREEKKVGGGPGGRVAAHSGPSGGSAMRRVTLFLNGSPKNGKVVAVYGTLSDLLSVASSKLGIKATSVYNGKGGLIDDIALIRDDDVLFVCEGEPFIDPQTDSKPPEGLLGFHTDWLTLNVGGRYFTTTRSTLVNKEPDSMLAHMFKDKGVWGNKQDHRGAFLIDRSPEYFEPILNYLRHGQLIVNDGINLLGVLEEARFFGIDSLIEHLEVAIKNSQPPEDHSPISRKEFVRFLLATPTKSELRCQGLNFSGADLSRLDLRYINFKMANLSRCNLAHANLCCANLERADLSGSVLDCANLQGVKMLCSNAEGASLKLCNFEDPSGLKANLEGANLKGVDMEGSQMTGINLRVATLKNAKLKNCNLRGATLAGTDLEVSSPTL

SEQ ID NO: 745874 - protein, 464 aa, Homo sapiens; identical to SEQ ID NO: 745866

SEQ ID NO: 745875 - protein, 361 aa, Homo sapiens
MTGKKSSREKRRKRSSQEAAAALAAPDIVPALASGSSGSTSGCGSAGGCGSVSCCGNANFSGSVTGGGSGGSCWGGSSVERSERRKRRSTDSSSVSGSLQQETKYILPTLEKELFLAEHSDLEEGGLDLTVSLKPVSFYISDKKEMLQQCFCIIGEKKLQKMLPDVLKNCSIEEIKKLCQEQLELLSEKKILKILEGDNGMDSDMEEEADDGSKMGSDLVSQQDICIDSASSVRENKQPEGLELKQGKGEDSDVLSINADAYDSDIEGPCNEEAAAPEAPENTVQSEAGQIDDLEKDIEKSVNEILGLAESSPNEPKAATLAVPPPEDVQPSAQQLELLELEMRARAIKALMKAGDIKKPA

SEQ ID NO: 745876 - protein, 361 aa, Homo sapiens; identical to SEQ ID NO: 745875

SEQ ID NO: 745877 - protein, 133 aa, Homo sapiens
MTGKKSSREKRRKRSSQEAAAALAAPDIVPALASGSSGSTSGCGSAGGCGSVSCCGNANFSGSVTGGGSGGSCWGGSSVERSERRKRRSTDSSSVSGSLQQVRARPSGRFLELLLFRKKSGFQRDGAQAGAHC

SEQ ID NO: 745878 - protein, 190 aa, Homo sapiens
MTGKKSSREKRRKRSSQEAAAALAAPDIVPALASGSSGSTSGCGSAGGCGSVSCCGNANFSGSVTGGGSGGSCWGGSSVERSERRKRRSTDSSSVSGSLQQETKYILPTLEKELFLAEHSDLEEGGLDLTVSLKPVSFYISDKKEMLQQCFCIIGEKKLQKMLPDVLKVTMEWTLIWKRKQMMVLRWDLI

SEQ ID NO: 745879 - protein, 133 aa, Homo sapiens; identical to SEQ ID NO: 745877

SEQ ID NO: 745880 - protein, 216 aa, Homo sapiens
MLQQCFCIIGEKKLQKMLPDVLKNCSIEEIKKLCQEQLELLSEKKILKILEGDNGMDSDMEEEADDGSKMGSDLVSQQDICIDSASSVRENKQPEGLELKQGKGEDSDVLSINADAYDSDIEGPCNEEAAAPEAPENTVQSEAGQIDDLEKDIEKSVNEILGLAESSPNEPKAATLAVPPPEDVQPSAQQLELLELEMRARAIKALMKAGDIKKPA

SEQ ID NO: 745881 - protein, 133 aa, Homo sapiens; identical to SEQ ID NO: 745877

SEQ ID NO: 745882 - protein, 120 aa, Homo sapiens
LKFLRDQQREPKPGMLLQPASDQRGRKTSRPSSLLAAPSALPGGDVLEPAIPSLQAQLQTQAPCPVCNGKGEELCIGEETGVLAGLVQVSITKCVRRNMDSDKKSFRDRKERFDERILKQ

SEQ ID NO: 745883 - protein, 1637 aa, Homo sapiens
DGISHCNRTCLEDCGHGVCSGPPDFTCVCDLGWTSDLPPPTPAPGPPAPRCSRDCGCSFHSHCRKRGPGFCDECQDWTWGEHCERCRPGSFGNATGSRGCRPCQCNGHGDPRRGHCDNLSGLCFCQDHTEGAHCQLCSPGYYGDPRAGGSCFRECGGRALLTNVSSVALGSRRVGGLLPPGGGAARAGPGLSYCVWVVSATEELQPCAPGTLCPPLTLTFSPDSSTPCTLSYVLAFDGFPRFLDTGVVQSDRSLIAAFCGQRRDRPLTVQALSGLLVLHWEANGSSSWGFNASVGSARCGSGGPGSCPVPQECVPQDGAAGAGLCRCPQGWAGPHCRMALCPENCNAHTGAGTCNQSLGVCICAEGFGGPDCATKLDGGQLVWETLMDSRLSADTASRFLHRLGHTMVDGPDATLWMFGGLGLPQGLLGNLYRYSVSERRWTQMLAGAEDGGPGPSPRSFHAAAYVPAGRGAMYLLGGLTAGGVTRDFWVLNLTTLQWRQEKAPQTVELPAVAGHTLTARRGLSLLLVGGYSPENGFNQQLLEYQLATGTWVSGAQSGTPPTGLYGHSAVYHEATDSLYVFGGFRFHVELAAPSPELYSLHCPDRTWSLLAPSQGAKPRPRLFHASALLGDTMVVLGGRSDPDEFSSDVLLYQVNCNAWLLPDLTRSASVGPPMEESVAHAVAAVGSRLYISGGFGGVALGRLLALTLPPDPCRLLSSPEACNQSGACTWCHGACLSGDQAHRLGCGGSPCSPMPRSPEECRRLRTCSECLARHPRTLQPGDGEASTPRCKWCTNCPEGACIGRNGSCTSENDCRINQREVFWAGNCSEAACGAADCEQCTREGKCMWTRQFKRTGETRRILSVQPTYDWTCFSHSLLNVSPMPVESSPPLPCPTPCHLLPNCTSCLDSKGADGGWQHCVWSSSLQQCLSPSYLPLRCMAGGCGRLLRGPESCSLGCAQATQCALCLRRPHCGWCAWGGQDGGGRCMEGGLSGPRDGLTCGRPGASWAFLSCPPEDECANGHHDCNETQNCHDQPHGYECSCKTGYTMDNMTGLCRPVCAQGCVNGSCVEPDHCRCHFGFVGRNCSTECRCNRHSECAGVGARDHCLLCRNHTKGSHCEQCLPLFVGSAVGGGTCRPCHAFCRGNSHICISRKELQMSKGEPKKYSLDPEEIENWVTEGPSEDEAVCVNCQNNSYGEKCESCLQGYFLLDGKCTNAAKCRESFHGSPLGGQQCYRLISVEQECCLDPTSQTNCFHEPKRRALGPGRTVLFGVQPKFTNVDIRLTLDVTFGAVDLYVSTSYDTFVVRVAPDTGVHTVHIQPPPAPPPPPPPADGGPRGAGDPGGAGASSGPGAPAEPRVREVWPRGLITYVTVTEPSAVLVVRGVRDRLVITYPHEHHALKSSRFYLLLLGVGDPSGPGANGSADSQGLLFFRQDQAHIDLFVFFSVFFSCFFLFLSLCVLLWKAKQALDQRQEQRRHLQEMTKMASRPFAKVTVCFPPDPTAPASAWKPAGLPPPAFRRSEPFLAPLLLTGAGGPWGPMGGGCCPPAIPATTAGLRAGPITLEPTEDGMAGVATLLLQLPGGPHAPNGACLGSALVTLRHRLHEYCGGGGGAGGSGHGTGAGRKGLLSQDNLTSMSL

SEQ ID NO: 745884 - protein, 1389 aa, Homo sapiens
DGISHCNRTCLEDCGHGVCSGPPDFTCVCDLGWTSDLPPPTPAPGPPAPRCSRDCGCSFHSHCRKRGPGFCDECQDWTWGEHCERCRPGSFGNATGSRGCRPCQCNGHGDPRRGHCDNLSGLCFCQDHTEGAHCQLCSPGYYGDPRAGGSCFRECGGRALLTNVSSVALGSRRVGGLLPPGGGAARAGPGLSYCVWVVSATEELQPCAPGTLCPPLTLTFSPDSSTPCTLSYVLAFDGFPRFLDTGVVQSDRSLIAAFCGQRRDRPLTVQALSGLLVLHWEANGSSSWGFNASVGSARCGSGGPGSCPVPQECVPQDGAAGAGLCRCPQGWAGPHCRMALCPENCNAHTGAGTCNQSLGVCICAEGFGGPDCATKLDGGQLVWETLMDSRLSADTASRFLHRLGHTMVDGPDATLWMFGGLGLPQGLLGNLYRYSVSERRWTQMLAGAEDGGPGPSPRSFHAAAYVPAGRGAMYLLGGLTAGGVTRDFWVLNLTTLQWRQEKAPQTVELPAVAGHTLTARRGLSLLLVGGYSPENGFNQQLLEYQLATGTWVSGAQSGTPPTGLYGHSAVYHEATDSLYVFGGFRFHVELAAPSPELYSLHCPDRTWSLLAPSQGAKPRPRLFHASALLGDTMVVLGGRSDPDEFSSDVLLYQVNCNAWLLPDLTRSASVGPPMEESVAHAVAAVGSRLYISGGFGGVALGRLLALTLPPDPCRLLSSPEACNQSGACTWCHGACLSGDQAHRLGCGGSPCSPMPRSPEECRRLRTCSECLARHPRTLQPGDGEASTPRCKWCTNCPEGACIGRNGSCTSENDCRINQREVFWAGNCSEAACGAADCEQCTREGKCMWTRQFKRTGETRRILSVQPTYDWTCFSHSLLNVSPMPVESSPPLPCPTPCHLLPNCTSCLDSKGADGGWQHCVWSSSLQQCLSPSYLPLRCMAGGCGRLLRGPESCSLGCAQATQCALCLRRPHCGWCAWGGQDGGGRCMEGGLSGPRDGLTCGRPGASWAFLSCPPEDECANGHHDCNETQNCHDQPHGYECSCKTGYTMDNMTGLCRPVCAQGCVNGSCVEPDHCRCHFGFVGRNCSTECRCNRHSECAGVGARDHCLLCRNHTKGSHCEQCLPLFVGSAVGGGTCRPCHAFCRGNSHICISRKELQMSKGEPKKYSLDPEEIENWVTEGPSEDEAVCVNCQNNSYGEKCESCLQGYFLLDGKLHQAKQALDQRQEQRRHLQEMTKMASRPFAKVTVCFPPDPTAPASAWKPAGLPPPAFRRSEPFLAPLLLTGAGGPWGPMGGGCCPPAIPATTAGLRAGPITLEPTEDGMAGVATLLLQLPGGPHAPNGACLGSALVTLRHRLHEYCGGGGGAGGSGHGTGAGRKGLLSQDNLTSMSL

SEQ ID NO: 745885 - protein, 1030 aa, Homo sapiens
DGISHCNRTCLEDCGHGVCSGPPDFTCVCDLGWTSDLPPPTPAPGPPAPRCSRDCGCSFHSHCRKRGPGFCDECQDWTWGEHCERCRPGSFGNATGSRGCRPCQCNGHGDPRRGHCDNLSGLCFCQDHTEGAHCQLCSPGYYGDPRAGGSCFRECGGRALLTNVSSVALGSRRVGGLLPPGGGAARAGPGLSYCVWVVSATEELQPCAPGTLCPPLTLTFSPDSSTPCTLSYVLAFDGFPRFLDTGVVQSDRSLIAAFCGQRRDRPLTVQALSGLLVLHWEANGSSSWGFNASVGSARCGSGGPGSCPVPQECVPQDGAAGAGLCRCPQGWAGPHCRMALCPENCNAHTGAGTCNQSLGVCICAEGFGGPDCATKLDGGQLVWETLMDSRLSADTASRFLHRLGHTMVDGPDATLWMFGGLGLPQGLLGNLYRYSVSERRWTQMLAGAEDGGPGPSPRSFHAAAYVPAGRGAMYLLGGLTAGGVTRDFWVLNLTTLQWRQEKAPQTVELPAVAGHTLTARRGLSLLLVGGYSPENGFNQQLLEYQLATGTWVSGAQSGTPPTGLYGHSAVYHEATDSLYVFGGFRFHVELAAPSPELYSLHCPDRTWSLLAPSQGAKPRPRLFHASALLGDTMVVLGGRSDPDEFSSDVLLYQVNCNAWLLPDLTRSASVGPPMEESVAHAVAAVGSRLYISGGFGGVALGRLLALTLPPDPCRLLSSPEACNQSGACTWCHGACLSGDQAHRLGCGGSPCSPMPRSPEECRRLRTCSECLARHPRTLQPGDGEASTPRCKWCTNCPEGACIGRNGSCTSENDCRINQREVFWAGNCSEAACGAADCEQCTREGKCMWTRQFKRTGETRRILSVQPTYDWTCFSHSLLNVSPMPVESSPPLPCPTPCHLLPNCTSCLDSKGADGGWQHCVWSSSLQQVLHLARTVPGKGPGRSPSSLRWQGPFFHHLLHPPPSISLALAAVVLPSRATISFLPRCLMRVPVVSSSHASVCATFPTPGLCLSNSCPWYHGLLILSMTLKKF

SEQ ID NO: 745886 - protein, 795 aa, Homo sapiens
DGISHCNRTCLEDCGHGVCSGPPDFTCVCDLGWTSDLPPPTPAPGPPAPRCSRDCGCSFHSHCRKRGPGFCDECQDWTWGEHCERCRPGSFGNATGSRGCRPCQCNGHGDPRRGHCDNLSGLCFCQDHTEGAHCQLCSPGYYGDPRAGGSCFRECGGRALLTNVSSVALGSRRVGGLLPPGGGAARAGPGLSYCVWVVSATEELQPCAPGTLCPPLTLTFSPDSSTPCTLSYVLAFDGFPRFLDTGVVQSDRSLIAAFCGQRRDRPLTVQALSGLLVLHWEANGSSSWGFNASVGSARCGSGGPGSCPVPQECVPQDGAAGAGLCRCPQGWAGPHCRMALCPENCNAHTGAGTCNQSLGVCICAEGFGGPDCATKLDGGQLVWETLMDSRLSADTASRFLHRLGHTMVDGPDATLWMFGGLGLPQGLLGNLYRYSVSERRWTQMLAGAEDGGPGPSPRSFHAAAYVPAGRGAMYLLGGLTAGGVTRDFWVLNLTTLQWRQEKAPQTVELPAVAGHTLTARRGLSLLLVGGYSPENGFNQQLLEYQLATGTWVSGAQSGTPPTGLYGHSAVYHEATDSLYVFGGFRFHVELAAPSPELYSLHCPDRTWSLLAPSQGAKPRPRLFHASALLGDTMVVLGGRSDPDEFSSDVLLYQVNCNAWLLPDLTRSASVGPPMEESVAHAVAAVGSRLYISGGFGGVALGRLLALTLPPDPCRLLSSPEACNQSGACTWCHGACLSGDQAHRLGCGGSPCSPMPRSPEECRRLRTCSECLARHPRTLQPGDGGGGGDHIRRRGG

SEQ ID NO: 745887 - protein, 113 aa, Homo sapiens
MGATEVGDENAGTVSAQPCSRQCCLEDFWALLRRHPAPEPPPWTPVLYPLRTSLPSTLAVFLNLGLSFPKTSITSSWRDWTLHLPFAWSLSVRGPSQCVHVRGGGDHIRRRGG

SEQ ID NO: 745888 - protein, 1737 aa, Homo sapiens
DGISHCNRTCLEDCGHGVCSGPPDFTCVCDLGWTSDLPPPTPAPGPPAPRCSRDCGCSFHSHCRKRGPGFCDECQDWTWGEHCERCRPGSFGNATGSRGCRPCQCNGHGDPRRGHCDNLSGLCFCQDHTEGAHCQLCSPGYYGDPRAGGSCFRECGGRALLTNVSSVALGSRRVGGLLPPGGGAARAGPGLSYCVWVVSATEELQPCAPGTLCPPLTLTFSPDSSTPCTLSYVLAFDGFPRFLDTGVVQSDRSLIAAFCGQRRDRPLTVQALSGLLVLHWEANGSSSWGFNASVGSARCGSGGPGSCPVPQECVPQDGAAGAGLCRCPQGWAGPHCRMALCPENCNAHTGAGTCNQSLGVCICAEGFGGPDCATKLDGGQLVWETLMDSRLSADTASRFLHRLGHTMVDGPDATLWMFGGLGLPQGLLGNLYRYSVSERRWTQMLAGAEDGGPGPSPRSFHAAAYVPAGRGAMYLLGGLTAGGVTRDFWVLNLTTLQWRQEKAPQTVELPAVAGHTLTARRGLSLLLVGGYSPENGFNQQLLEYQLATGTWVSGAQSGTPPTGLYGHSAVYHEATDSLYVFGGFRFHVELAAPSPELYSLHCPDRTWSLLAPSQGAKRDRMRNVRGSSRGLGQVPGEQPGSWGFREVRKKMALWAALAGTGGFLEEISPHLKEPRPRLFHASALLGDTMVVLGGRSDPDEFSSDVLLYQVNCNAWLLPDLTRSASVGPPMEESVAHAVAAVGSRLYISGGFGGVALGRLLALTLPPDPCRLLSSPEACNQSGACTWCHGACLSGDQAHRLGCGGSPCSPMPRSPEECRRLRTCSECLARHPRTLQPGDGEASTPRCKWCTNCPEGACIGRNGSCTSENDCRINQREVFWAGNCSEAACGAADCEQCTREGKCMWTRQFKRTGETRRILSVQPTYDWTCFSHSLLNVSPMPVESSPPLPCPTPCHLLPNCTSCLDSKGADGGWQHCVWSSSLQQCLSPSYLPLRCMAGGCGRLLRGPESCSLGCAQATQCALCLRRPHCGWCAWGGQDGGGRCMEGGLSGPRDGLTCGRPGASWAFLSCPPEDECANGHHDCNETQNCHDQPHGYECSCKTGYTMDNMTGLCRPVCAQGCVNGSCVEPDHCRCHFGFVGRNCSTECRCNRHSECAGVGARDHCLLCRNHTKGSHCEQCLPLFVGSAVGGGTCRPCHAFCRGNSHICISRKELQMSKGEPKKYSLDPEEIENWVTEGPSEDEAVCVNCQNNSYGEKCESCLQGYFLLDGKCTKCQCNGHADTCNEQDGTGCPCQNNTETGTCQGSSPSDRRDCYKYQCAKCRESFHGSPLGGQQCYRLISVEQECCLDPTSQTNCFHEPKRRALGPGRTVLFGVQPKFTNVDIRLTLDVTFGAVDLYVSTSYDTFVVRVAPDTGVHTVHIQPPPAPPPPPPPADGGPRGAGDPGGAGASSGPGAPAEPRVREVWPRGLITYVTVTEPSAVLVVRGVRDRLVITYPHEHHALKSSRFYLLLLGVGDPSGPGANGSADSQGLLFFRQDQAHIDLFVFFSVFFSCFFLFLSLCVLLWKAKQALDQRQEQRRHLQEMTKMASRPFAKVTVCFPPDPTAPASAWKPAGLPPPAFRRSEPFLAPLLLTGAGGPWGPMGGGCCPPAIPATTAGLRAGPITLEPTEDGMAGVATLLLQLPGGPHAPNGACLGSALVTLRHRLHEYCGGGGGAGGSGHGTGAGRKGLLSQDNLTSMSL

SEQ ID NO: 745889 - protein, 1637 aa, Homo sapiens; identical to SEQ ID NO: 745883

SEQ ID NO: 745890 - protein, 579 aa, Homo sapiens
DGISHCNRTCLEDCGHGVCSGPPDFTCVCDLGWTSDLPPPTPAPGPPAPRCSRDCGCSFHSHCRKRGPGFCDECQDWTWGEHCERCRPGSFGNATGSRGCRPCQCNGHGDPRRGHCDNLSGLCFCQDHTEGAHCQLCSPGYYGDPRAGGSCFRECGGRALLTNVSSVALGSRRVGGLLPPGGGAARAGPGLSYCVWVVSATEELQPCAPGTLCPPLTLTFSPDSSTPCTLSYVLAFDGFPRFLDTGVVQSDRSLIAAFCGQRRDRPLTVQALSGLLVLHWEANGSSSWGFNASVGSARCGSGGPGSCPVPQECVPQDGAAGAGLCRCPQGWAGPHCRMALCPENCNAHTGAGTCNQSLGVCICAEGFGGPDCATKLDGGQLVWETLMDSRLSADTASRFLHRLGHTMVDGPDATLWMFGGLGLPQGLLGNLYRYSVSERRWTQMLAGAEDGGPGPSPRSFHAAAYVPAGRGAMYLLGGLTAGGVTRDFWVLNLTTLQWRQEKAPQTVELPAVAGHTLTARRGLSLLLVGGYSPENGFNQQLLEYQLATGTWVSGAQSGTPPTVSMVTLLSTTPPLLVRA

SEQ ID NO: 745891 - protein, 117 aa, Homo sapiens
MVWNQKTFLYILLCHLTNFGAGLDVLPQEVAAGEMLETKVLGDPLAHGALARAGRPEDDRAQEFGSHCLREEGGGQTRSPDRGPGGSPRNFVSRPPTSGTLRSHWDSPAAPTGGRRS

SEQ ID NO: 745892 - protein, 117 aa, Homo sapiens
MVQRLTYQCRLSYNTASNKTRLPRTPGNRIVYLYTKKVGKAPRSASGMCPGRLRGVRAVRPKVLMKLSKRKKHVSRAYGGSMCAKCVRGRIKRAFLIGEQKIVVKVLKAQVQSHKAK

SEQ ID NO: 745893 - protein, 92 aa, Homo sapiens
MAYLGPYPTSRQSPQMRPTASQQPPQAQLHRYNGLFRPSSCLPAFSPGPELPQVDLTRPSSCFLAASPGPAPASWQPLQAQPLPPVSLYSPN

SEQ ID NO: 745894 - protein, 119 aa, Homo sapiens
VTFSHHAQVGPSSCRKTSLTRPLILHYGELYNYFIIYYSVIMEIKCLINVMCLNLLAQLLPPGSLSRPRTFSSQPRQTKLMTHNGLFRPIPYLTAVSADEAYCLTTASTGTAPSLQWPL

SEQ ID NO: 745895 - protein, 128 aa, Homo sapiens
MDAVAVYHGKISRETGEKLLLATGLDGSYLLRDSESVPGVYCLCVLYHGYIYTYRVSQTETGSWSAETAPGVHKRYFRKIKNLISAFQKPDQGIVIPLQYPVEKKSSARSTQGTTGIREDPDVCLKAP

SEQ ID NO: 745896 - protein, 128 aa, Homo sapiens; identical to SEQ ID NO: 745895

SEQ ID NO: 745897 - protein, 76 aa, Homo sapiens
MDAVAVYHGKISRETGEKLLLATGLDGSYLLRDSESVPGVYCLCVLYHGYIYTYRVSQTETGSWSAEHFRSQIKAL

SEQ ID NO: 745898 - protein, 76 aa, Homo sapiens
MDAVAVYHGKISRETGEKLLLATGLDGSYLLRDSESVPGITVTFIHTECPRQKQVLGVLSISEARSRHCNTSAVSS

SEQ ID NO: 745899 - protein, 62 aa, Homo sapiens
MDAVAVYHGKISRETGEKLLLATGLDGSYLLRDSESVPGVYCLCVLISEARSRHCNTSAVSS

SEQ ID NO: 745900 - protein, 136 aa, Homo sapiens
LTPVSESSKVVVVESVMGQLSSHHQLTSGLWGKRLQYSILGVWAANLACSGFPPCALGWAHPREGTPDTAPTSRLKADALPAPPVFCVAALTHVCLSRPVPRRLSDPKKGFPDTRTEAGGLGLREGGGPAGTFLLC

SEQ ID NO: 745901 - protein, 120 aa, Homo sapiens
MIHGRRNVLMRNHIQNIVSAVVILTKSTQSQAELTEDGFQAYMYFTHPPPSSPKQIPNILLRTQPAQPRGTERQEAPRCPHTVPLWTCRAGFQDMGDGRVEPRRPLHSVAHLSRMGAVKA

SEQ ID NO: 745902 - protein, 116 aa, Homo sapiens
PHCKPGCDYEGQLYEEGVTFLSSSNPCLQCTCLRSRVRCMALKCPPSPCPEPVLRPGHCCPTCQGCTEGGSHWEHGQEWTTPGDPCRICRCLGTEVLNQKASAWRGPFITLSSNKS

SEQ ID NO: 745903 - protein, 216 aa, Homo sapiens
MSFLFSSRSSKTFKPKKNIPEGSHQYELLKHAEATLGSGNLRQAVMLPEGEDLNEWIAVNTVDFFNQINMLYGTITEFCTEASCPVMSAGPRYEYHWADGTNIKKPIKCSAPKYIDYLMTWVQDQLDDETLFPSKIGVPFPKNFMSVAKTILKRLFRVYAHIYHQHFDSVMQLQEEAHLNTSFKHFIFFVQEFNLIDRRELAPLQELIEKLGSKDR

SEQ ID NO: 745904 - protein, 216 aa, Homo sapiens; identical to SEQ ID NO: 745903

SEQ ID NO: 745905 - protein, 216 aa, Homo sapiens; identical to SEQ ID NO: 745903

SEQ ID NO: 745906 - protein, 216 aa, Homo sapiens; identical to SEQ ID NO: 745903

SEQ ID NO: 745907 - protein, 216 aa, Homo sapiens; identical to SEQ ID NO: 745903

SEQ ID NO: 745908 - protein, 147 aa, Homo sapiens [sequence omitted]

SEQ ID NO: 745909 - protein, 198 aa, Homo sapiens
MSFLFSSRSSKTFKPKKNIPEGSHQYELLPEGEDLNEWIAVNTVDFFNQINMLYGTITEFCTEASCPVMSAGPRYEYHWADGTNIKKPIKCSAPKYIDYLMTWVQDQLDDETLFPSKIGVPFPKNFMSVAKTILKRLFRVYAHIYHQHFDSVMQLQEEAHLNTSFKHFIFFVQEFNLIDRRELAPLQELIEKLGSKDR

SEQ ID NO: 745910 - protein, 216 aa, Homo sapiens; identical to SEQ ID NO: 745903

SEQ ID NO: 745911 - protein, 863 aa, Homo sapiens
EKLSVLTVQDVGQVMPGANVCVVKLEGTPYLCKTDEVGEICVSSSATGTAYYGLLGITKNVFEAVPVTTGGAPIFDRPFTRTGLLGFIGPDNLVFIVGKLDGLMVTGVRRHNADDVVATALAVEPMKFVYRGRIAVFSVTVLHDDRIVLVAEQRPDASEEDSFQWMSRVLQAIDSIHQVGVYCLALVPANTLPKAPLGGIHISETKQRFLEGTLHPCNVLMCPHTCVTNLPKPRQKQPEVGPASMIVGNLVAGKRIAQASGRELAHLEDSDQARKFLFLADVLQWRAHTTPDHPLFLLLNAKGTVTSTATCVQLHKRAERVAAALMEKGRLSVGDHVALVYPPGVDLIAAFYGCLYCGCVPVTVRPPHPQNLGTTLPTVKMIVEVSKSACVLTTQAVTRLLRSKEAAAAVDIRTWPTILDTDDIPKKKIASVFRPPSPDVLAYLDFSVSTTGILAGVKMSHAATSALCRSIKLQCELYPSRQIAICLDPYCGLGFALWCLCSVYSGHQSVLVPPLELESNVSLWLSAVSQYKARVTFCSYSVMEMCTKGLGAQTGVLRMKGVNLSCVRTCMVVAEERPRIALTQSFSKLFKDLGLPARAVSTTFGCRVNVAICLQGTAGPDPTTVYVDMRALRHDRVRLVERGSPHSLPLMESGKILPGVKVIIAHTETKGPLGDSHLGEIWVSSPHNATGYYTVYGEEALHADHFSARLSFGDTQTIWARTGYLGFLRRTELTDASGGRHDALYVVGSLDETLELRGMRYHPIDIETSVIRAHRSIAECAVFTWTNLLVVVVELDGLEQDALDLVALVTNVVLEEHYLVVGVVVIVDPGVIPINSRGEKQRMHLRDGFLADQLDPIYVAYNM

SEQ ID NO: 745912 - protein, 148 aa, Homo sapiens
MSFLFSSRSSKTFKPKKNIPEGSHQYELLKHAEATLGSGNLRQAVMLPEGEDLNEWIAVNTVDFFNQINMLYGTITEFCTEASCPVMSAGPRYEYHWADGTNIKKPIKCSAPKYIDYLMTWVQDQLDDETLFPSKIGELTLSKYSFFF

SEQ ID NO: 745913 - protein, 216 aa, Homo sapiens; identical to SEQ ID NO: 745903

SEQ ID NO: 745914 - protein, 216 aa, Homo sapiens; identical to SEQ ID NO: 745903

SEQ ID NO: 745915 - protein, 216 aa, Homo sapiens; identical to SEQ ID NO: 745903

SEQ ID NO: 745916 - protein, 258 aa, Homo sapiens
MPPQENVRCRSLRSLKLRCWPWSRIVLSSSDSAHLLALILTNFSCPRSSRSSKTFKPKKNIPEGSHQYELLKHAEATLGSGNLRQAVMLPEGEDLNEWIAVNTVDFFNQINMLYGTITEFCTEASCPVMSAGPRYEYHWADGTNIKKPIKCSAPKYIDYLMTWVQDQLDDETLFPSKIGVPFPKNFMSVAKTILKRLFRVYAHIYHQHFDSVMQLQEEAHLNTSFKHFIFFVQEFNLIDRRELAPLQELIEKLGSKDR

SEQ ID NO: 745917 - protein, 171 aa, Homo sapiens
MLPEGEDLNEWIAVNTVDFFNQINMLYGTITEFCTEASCPVMSAGPRYEYHWADGTNIKKPIKCSAPKYIDYLMTWVQDQLDDETLFPSKIGVPFPKNFMSVAKTILKRLFRVYAHIYHQHFDSVMQLQEEAHLNTSFKHFIFFVQEFNLIDRRELAPLQELIEKLGSKDR

SEQ ID NO: 745918 - protein, 216 aa, Homo sapiens; identical to SEQ ID NO: 745903

SEQ ID NO: 745919 - protein, 216 aa, Homo sapiens; identical to SEQ ID NO: 745903

SEQ ID NO: 745920 - protein, 216 aa, Homo sapiens; identical to SEQ ID NO: 745903

SEQ ID NO: 745921 - protein, 60 aa, Homo sapiens
VIMPPWTFDKCLETLQLASGGCIEVRGAAKCLRMHGLDPTAKNSLAQNVNSAAVEKPCII

SEQ ID NO: 745922 - protein, 123 aa, Homo sapiens
MSTLSNFTQTLEDVFRRIFITYMDNWRQNTTAEQEALQAKVDAENFYYVILYLMVMIGMFSFIIVAILVSTVKSKRREHSNDPYHQYIVEDWQEKYKSQILNLEESKATIHENIGAAGFKMSP

SEQ ID NO: 745923 - protein, 123 aa, Homo sapiens; identical to SEQ ID NO: 745922

SEQ ID NO: 745924 - protein, 69 aa, Homo sapiens
GTLFNFAVVFTDVKRPGYRVKEVGSTKSGRKGTDDSMTLPSQKFQVDYLDIAITPPHRAPPPSGHMRPH

SEQ ID NO: 745925 - protein, 147 aa, Homo sapiens
GLRPRVPALPYPIAWSHHRRGTPLSWAPGASEAEPAGSAGGRTFLWTSCVLQTQRTLINRGGGHFRIHRWRVSAWRAPPGHTYCSLALARRQPDPVCARRAALCSCLQGVPAKTSTLGKSLRLNLNSQLPESDLCFFTSTEDVRAFP

SEQ ID NO: 745926 - protein, 107 aa, Homo sapiens
CEVWVSIEPRLRSESLISPPHREHILFSGAQLSSGVYVSFDCYCILNFLLCLRLAVLPPIPAIILFLSYHHAPPINKLIKMCHERALPATAGAVWVLGHAQASLDPG

SEQ ID NO: 745927 - protein, 119 aa, Homo sapiens
LPVPALVFVFGRVRRCCRGWRSPVFTNPHVSPLSTAPAHWAPGRPAAGSLGLRVSPEPPPERGSLPPGERSPAASKPPSSPSVSQKQRRGGGGSARAAAPRFALYSELATSAARGWSCG

SEQ ID NO: 745928 - protein, 408 aa, Homo sapiens
MKKNNSAKRGPQDGNQQPAPPEKVGWVRKFCGKGIFREIWKNRYVVLKGDQLYISEKEVKDEKNIQEVFDLSDYEKCEELRKSKSRSKKNHSKFTLAHSKQPGNTAPNLIFLAVSPEEKESWINALNSAITRAKNRILDEVTVEEDSYLAHPTRDRAKIQHSRRPPTRGHLMAVASTSTSDGMLTLDLIQEEDPSPEEPTSCAESFRVDLDKSVAQLAGSRRRADSDRIQPSADRASSLSRPWEKTDKGATYTPQAPKKLTPTEKGRCASLEEILSQRDAASARTLQLRAEEPPTPALPNPGQLSRIQDLVARKLEETQELLAEVQGLGDGKRKAKDPPRSPPDSESEQLLLETERLLGEASSNWSQAKRVLQEVRELRDLYRQMDLQTPDSHLRQTTPHSQYRKSLM

SEQ ID NO: 745929 - protein, 408 aa, Homo sapiens; identical to SEQ ID NO: 745928

SEQ ID NO: 745930 - protein, 351 aa, Homo sapiens
MVKDEKNIQEVFDLSDYEKCEELRKSKSRSKKNHSKFTLAHSKQPGNTAPNLIFLAVSPEEKESWINALNSAITRAKNRILDEVTVEEDSYLAHPTRDRAKIQHSRRPPTRGHLMAVASTSTSDGMLTLDLIQEEDPSPEEPTSCAESFRVDLDKSVAQLAGSRRRADSDRIQPSADRASSLSRPWEKTDKGATYTPQAPKKLTPTEKGRCASLEEILSQRDAASARTLQLRAEEPPTPALPNPGQLSRIQDLVARKLEETQELLAEVQGLGDGKRKAKDPPRSPPDSESEQLLLETERLLGEASSNWSQAKRVLQEVRELRDLYRQMDLQTPDSHLRQTTPHSQYRKSLM

SEQ ID NO: 745931 - protein, 532 aa, Homo sapiens
MKKNNSAKRGPQDGNQQPAPPEKVGWVRKFCGKGIFREIWKNRYVVLKGDQLYISEKEVKDEKNIQEVFDLSDYEKCEELRKSKSRSKKNHSKFTLAHSKQPGNTAPNLIFLAVSPEEKESWINALNSAITRAKNRILDESQGAHCGEREERWGRGNSCDPLKGEDCAGPVYSLLHQLYFFTALLKALISFYLLSKSHLTPPLPRFMMGEPALGQLKEPPSCPVNPLAHSEAVNGVGTCSGLGMLGWDSESCKEHSWIHSTSLQVTVEEDSYLAHPTRDRAKIQHSRRPPTRGHLMAVASTSTSDGMLTLDLIQEEDPSPEEPTSCAESFRVDLDKSVAQLAGSRRRADSDRIQPSADRASSLSRPWEKTDKGATYTPQAPKKLTPTEKGRCASLEEILSQRDAASARTLQLRAEEPPTPALPNPGQLSRIQDLVARKLEETQELLAEVQGLGDGKRKAKDPPRSPPDSESEQLLLETERLLGEASSNWSQAKRVLQEVRELRDLYRQMDLQTPDSHLRQTTPHSQYRKSLM

SEQ ID NO: 745932 - protein, 361 aa, Homo sapiens
MKKNNSAKRGPQDGNQQPAPPEKVGWVRKFCGKGIFREIWKNRYVVLKGDQLYISEKEAPNLIFLAVSPEEKESWINALNSAITRAKNRILDEVTVEEDSYLAHPTRDRAKIQHSRRPPTRGHLMAVASTSTSDGMLTLDLIQEEDPSPEEPTSCAESFRVDLDKSVAQLAGSRRRADSDRIQPSADRASSLSRPWEKTDKGATYTPQAPKKLTPTEKGRCASLEEILSQRDAASARTLQLRAEEPPTPALPNPGQLSRIQDLVARKLEETQELLAEVQGLGDGKRKAKDPPRSPPDSESEQLLLETERLLGEASSNWSQAKRVLQEVRELRDLYRQMDLQTPDSHLRQTTPHSQYRKSLM

SEQ ID NO: 745933 - protein, 417 aa, Homo sapiens
MKKNNSAKRGPQDGNQQPAPPEKVGWVRKFCGKGIFREIWKNRYVVLKGDQLYISEKEVKDEKNIQEVFDLSDYEKCEELRKSKSRSKKNHSKFTLAHSKQPGNTAPNLIFLAVSPEEKESWINALNSAITRAKNRILDEVTVEEDSYLAHPTRDRAKIQHSRRPPTRGHLMAVASTSTSDGMLTLDLIQEEDPSPEEPTSCAESFRVDLDKSVAQLAGSRRRADSDRIQPSADRASSLSRPWEKTDKGATYTPQAPKKLTPTEKGRCASLEEILSQRDAASARTLQLRAEEPPTPALPNPGQLSRIQDLVARKLEETQELLAEVQGLGDGKRKAKDPPRSPPDSESEQLLLETERLLGEASSNWSQAKRVLQEVRELRDLYRQMDLQTPDSHLRQTTPHNIKAMTANSPFLLRFLI

SEQ ID NO: 745934 - protein, 298 aa, Homo sapiens
MEWAHVQASGCWVGTASRERALMIHSTSLQVTVEEDSYLAHPTRDRAKIQHSRRPPTRGHLMAVASTSTSDGMLTLDLIQEEDPSPEEPTSCAESFRVDLDKSVAQLAGSRRRADSDRIQPSADRASSLSRPWEKTDKGATYTPQAPKKLTPTEKGRCASLEEILSQRDAASARTLQLRAEEPPTPALPNPGQLSRIQDLVARKLEETQELLAEVQGLGDGKRKAKDPPRSPPDSESEQLLLETERLLGEASSNWSQAKRVLQEVRELRDLYRQMDLQTPDSHLRQTTPHSQYRKSLM

SEQ ID NO: 745935 - protein, 447 aa, Homo sapiens
LPVPALVFVFGRVRRCCRGWRSPVFTNPHVSPLSTAPAHWAPGRPAAGSLGLRVSPEPPPERGSLPPGERSPAASKPPSSPSGPQDGNQQPAPPEKVGWVRKFCGKGIFREIWKNRYVVLKGDQLYISEKEVKDEKNIQEVFDLSDYEKCEELRKSKSRSKKNHSKFTLAHSKQPGNTAPNLIFLAVSPEEKESWINALNSAITRAKNRILDEASTSTSDGMLTLDLIQEEDPSPEEPTSCAESFRVDLDKSVAQLAGSRRRADSDRIQPSADRASSLSRPWEKTDKGATYTPQAPKKLTPTEKGRCASLEEILSQRDAASARTLQLRAEEPPTPALPNPGQLSRIQDLVARKLEETQELLAEVQGLGDGKRKAKDPPRSPPDSESEQLLLETERLLGEASSNWSQAKRVLQEVRELRDLYRQMDLQTPDSHLRQTTPHSQYRKSLM

SEQ ID NO: 745936 - protein, 408 aa, Homo sapiens; identical to SEQ ID NO: 745928

SEQ ID NO: 745937 - protein, 141 aa, Homo sapiens
VPARRGRGGGGAGPGGNLGASPRPAGAPATCSPGCLFGSGGGERGEFLGVKTFPKWERTWGGPPPPGRSLRRRLGRRGGRERRTERKRRLESPNRPLLILSWGRDLRMETSSLHRPRRSAGSGNSAGKGFSGRFGKTAMWC

SEQ ID NO: 745938 - protein, 408 aa, Homo sapiens; identical to SEQ ID NO: 745928

SEQ ID NO: 745939 - protein, 503 aa, Homo sapiens
VPARRGRGGGGAGPGGNLGASPRPAGAPATCSPGCLFGSGGGERGEFLGVKTFPKWERTWGGPPPPGRSLRRRLGRRGGRERRTERKRRLESPNRPLLIFVLGQGPQDGNQQPAPPEKVGWVRKFCGKGIFREIWKNRYVVLKGDQLYISEKEVKDEKNIQEVFDLSDYEKCEELRKSKSRSKKNHSKFTLAHSKQPGNTAPNLIFLAVSPEEKESWINALNSAITRAKNRILDEVTVEEDSYLAHPTRDRAKIQHSRRPPTRGHLMAVASTSTSDGMLTLDLIQEEDPSPEEPTSCAESFRVDLDKSVAQLAGSRRRADSDRIQPSADRASSLSRPWEKTDKGATYTPQAPKKLTPTEKGRCASLEEILSQRDAASARTLQLRAEEPPTPALPNPGQLSRIQDLVARKLEETQELLAEVQGLGDGKRKAKDPPRSPPDSESEQLLLETERLLGEASSNWSQAKRVLQEVRELRDLYRQMDLQTPDSHLRQTTPHSQYRKSLM

SEQ ID NO: 745940 - protein, 226 aa, Homo sapiens
MLTLDLIQEEDPSPEEPTSCAESFRVDLDKSVAQLAGSRRRADSDRIQPSADRASSLSRPWEKTDKGATYTPQAPKKLTPTEKGRCASLEEILSQRDAASARTLQLRAEEPPTPALPNPGQLSRIQDLVARKLEETQELLAEVQGLGDGKRKAKDPPRSPPDSESEQLLLETERLLGEASSNWSQAKRVLQEVRELRDLYRQMDLQTPDSHLRQTTPHSQYRKSLM

SEQ ID NO: 745941 - protein, 147 aa, Homo sapiens
SLLLLQQVLSQGEGDLGMPQPQATGLISCLSPDHCLSQQQQQREQQGKTCLSLLLLTQELLAEVQGLGDGKRKAKDPPRSPPDSESEQLLLETERLLGEASSNWSQAKRVLQEVRELRDLYRQMDLQTPDSHLRQTTPHSQYRKSLM

SEQ ID NO: 745942 - protein, 148 aa, Homo sapiens
ASQSVGITGMSHCTQPFLFSFPVHQASCGLKEPCLPCPPHTLQDAFPECPLLACALSFKILPTPSRSPLPTASHLTGPLCFGRTPRGQHSPVGSASWVGPPHSTYPGSATRVGAPMNGTPSWVPGGAPVAGRLEVQMWSEAAMSPPTG

SEQ ID NO: 745943 - protein, 84 aa, Homo sapiens
QLAHCAGVPRKTSLNNEEDLGVRWDRNQQGLQFPAGRAPTPSEGPVAGHARSCSVGRLYNLGCLEDLELLFLEDLFDRFKKSRN

SEQ ID NO: 745944 - protein, 462 aa, Homo sapiens
MPSKTKYNLVDDGHDLRIPLHNEDAFQHGICFEAKYVGSLDVPRPNSRVEIVAAMRRIRYEFKAKNIKKKKVSIMVSVDGVKVILKKKKKLLLLQKKEWTWDESKMLVMQDPIYRIFYVSHDSQDLKIFSYIARDGASNIFRCNVFKSKKKSQAMRIVRTVGQAFEVCHKLSLQHTQQNADGQEDGESERNSNSSGDPGRQLTGAERASTATAEETDIDAVEVPLPGNDVLEFSRGVTDLDAVGKEGGSHTGSKVSHPQEPMLTASPRMLLPSSSSKPPGLGTETPLSTHHQMQLLQQLLQQQQQQTQVAVAQVHLLKDQLAAEAAARLEAQARVHQLLLQNKDMLQHISLLVKQVQELELKLSGQNAMGSQDSLLEITFRSGALPVLCDPTTPKPEDLHSPPLGAGLADFAHPAGSPLVDHGMFENLNTALTPKLQASRSFPHLSKPVAPGSAPLGSGEPG

SEQ ID NO: 745945 - protein, 506 aa, Homo sapiens
MPSKTKYNLVDDGHDLRIPLHNEDAFQHGICFEAKYVGSLDVPRPNSRVEIVAAMRRIRYEFKAKNIKKKKVSIMVSVDGVKVILKKKKKLLLLQKKEWTWDESKMLVMQDPIYRIFYVSHDSQDLKIFSYIARDGASNIFRCNVFKSKKKSQAMRIVRTVGQAFEVCHKLSLQHTQQNADGQEDGESERNSNSSGDPGRQLTGAERASTATAEETDIDAVEVPLPGNDVLEFSRGVTDLDAVGKEGGSHTGSKVSHPQEPMLTASPRMLLPSSSSKPPGLGTETPLSTHHQMQLLQQLLQQQQQQTQVAVAQVHLLKDQLAAEAAARLEAQARVHQLLLQNKDMLQHISLLVKQVQELELKLSGQNAMGSQDSLLEITFRSGALPVLCDPTTPKPEDLHSPPLGAGLADFAHPAGSPLGRRDCLVKLECFRFLPPEDTPPPAQGEALLGGLELIKFRESGIASEYESNTDESEERDSWSQEELPRLLNVLQRQELGDGLDDEIAV

SEQ ID NO: 745946 - protein, 253 aa, Homo sapiens
MRARRRTDLIMGCIKSKENKSPAIKYRPENTPEPVSTSVSHYGAEPTTVSPCPSSSAKGTAVNFSSLSMTPFGGSSGVTPFGGASSSFSVVPSSYPAGLTGGVTIFVALYDYEARTTEDLSFKKGERFQIINNTEGDWWEARSIATGKNGYIPSNYVAPADSIQAEEWYFGKMGRKDAERLLLNPGNQRGIFLVRESETTKGAYSLSIRDWDEIRGDNVKHYKIRKLDNGGYYITTRAQFDTLQKLVKHYTGM

SEQ ID NO: 745947 - protein, 248 aa, Homo sapiens
MLDLIMGCIKSKENKSPAIKYRPENTPEPVSTSVSHYGAEPTTVSPCPSSSAKGTAVNFSSLSMTPFGGSSGVTPFGGASSSFSVVPSSYPAGLTGGVTIFVALYDYEARTTEDLSFKKGERFQIINNTEGDWWEARSIATGKNGYIPSNYVAPADSIQAEEWYFGKMGRKDAERLLLNPGNQRGIFLVRESETTKGAYSLSIRDWDEIRGDNVKHYKIRKLDNGGYYITTRAQFDTLQKLVKHYTGM

SEQ ID NO: 745948 - protein, 314 aa, Homo sapiens
MRARRRTDLIMGCIKSKENKSPAIKYRPENTPEPVSTSVSHYGAEPTTVSPCPSSSAKGTAVNFSSLSMTPFGGSSGVTPFGGASSSFSVVPSSYPAGLTGGVTIFVALYDYEARTTEDLSFKKGERFQIINNTEGDWWEARSIATGKNGYIPSNYVAPADSIQAEEWYFGKMGRKDAERLLLNPGNQRGIFLVRESETTKGAYSLSIRDWDEIRGDNVKHYKIRKLDNGGYYITTRAQFDTLQKLVKHYTEHADGLCHKLTTVCPTVKPQTQGLAKDAWEIPRESLRLEVKLGQGCFGEVWMGTWNGTTKVAI

SEQ ID NO: 745949 - protein, 88 aa, Homo sapiens
MATTVAQTARCPTQENNRPGSERPTDLTRNSPTHNQQNSAPRATPPHTRSRNTTSPQAPHTTDSLRGDPTQTDERPKRRRPVQTLGPR

SEQ ID NO: 745950 - protein, 145 aa, Homo sapiens
GKGALTELTPFPLLPEPARQDHRARPWKTREIRAVSRAGHVGRLRVRRFWSQNSRIAFARPAPRLLQKLPGTPGSATQPEPPGAPREAERPVGSWDGSSRSLRRLHPLKSLCPPCPVALGAAEELPLPSSDPVFRTGAPPGQGWW

SEQ ID NO: 745951 - protein, 167 aa, Homo sapiens
GKGALTELTPFPLLPEPARQDHRARPWKTREIRAVSRAGHVGRLRVRRFWSQNSRIAFARPAPRLLQKLPGTPGSATQPEPPGAPREAERPVGSWDGSSRSLRRLHPLKSLCPPCPVALGAAEELPLPSSDPVFRTGAPPGQGWCRMGKWRENLKEPQTRGPIAPQE

SEQ ID NO: 745952 - protein, 1050 aa, Homo sapiens
VLGASLPRVRRAGKLAEGVRQRLLPSATRPLSNSSYELKLPRDGDRSGAAEAAAAAAAAAAAAAAAAAALAGTEQTRRGATTPARLPPCRRSCRRLAKRRYSRETRHTKAAFSAPPAQGGCGQQGTPPESSSGCCVRFVSELCALHGTDPVPMALIMEPVSKWSPSQVVDWMKGLDDCLQQYIKNFEREKISGDQLLRITHQELEDLGVSRIGHQELILEAVDLLCALNYGLETENLKTLSHKLNASAKNLQNFITGRRRSGHYDGRTSRKLPNDFLTSVVDLIGAAKSLLAWLDRSPFAAVTDYSVTRNNVIQLCLELTTIVQQDCTVYETENKILHVCKTLSGVCDHIISLSSDPLVSQSAHLEVIQLANIKPSEGLGMYIKSTYDGLHVITGTTENSPADRCKKIHAGDEVIQVNHQTVVGWQLKNLVNALREDPSGVILTLKKRPQSMLTSAPALLKNMRWKPLALQPLIPRSPTSSVATPSSTISTPTKRDSSALQDLYIPPPPAEPYIPRDEKGNLPCEDLRGHMVGKPVHKGSESPNSFLDQEYRKRFNIVEEDTVLYCYEYEKGRSSSQGRRESTPTYGKLRPISMPVEYNWVGDYEDPNKMKRDSRRENSLLRYMSNEKIAQEEYMFQRNSKKDTGKKSKKKGDKSNSPTHYSLLPSLQMDALRQDIMGTPVPETTLYHTFQQSSLQHKSKKKNKGPIAGKSKRRISCKDLGRGDCEGWLWKKKDAKSYFSQKWKKYWFVLKDASLYWYINEEDEKAEGFISLPEFKIDRASECRKKYAFKACHPKIKSFYFAAEHLDDMNRWLNRINMLTAGYAERERIKQEQDYWSESDKEEADTPSTPKQDSPPPPYDTYPRPPSMSCASPYVEAKHSRLSSTETSQSQSSHEEFRQEVTGSSAVSPIRKTASQRRSWQDLIETPLTSSGLHYLQTLPLEDSVFSDSAAISPEHRRQSTLPTQKCHLQDHYGPYPLAESERMQVLNGNGGKPRSFTLPRDSGFNHCCLNAPVSACDPQDDVQPPEVEEEEEEEEEEGEAAGENIGEKS

SEQ ID NO: 745953 - protein, 174 aa, Homo sapiens
MAAFAVEPQGPALGSEPMMLGSPTSPKPGVNAQFLPGFLMGDLPAPVTPQPRSISGPSVGVMEMRSPLLAGGSPPQPVVPAHKDKSGAPPVRSIYDDISSPGLGSTPLTSRRQPNISVMQSPLVGVTSTPGTGQSMFSPASIGQPRKTTLSPAQLDPFYTQGDSLTFKKESPFE

SEQ ID NO: 745954 - protein, 136 aa, Homo sapiens [sequence omitted]

SEQ ID NO: 745955 - protein, 326 aa, Homo sapiens
MAAFAVEPQGPALGSEPMMLGSPTSPKPGVNAQFLPGFLMGDLPAPVTPQPRSISGPSVGVMEMRSPLLAGGSPPQPVVPAHKDKSGAPPVRSIYDDISSPGLGSTPLTSRRQPNISVMQSPLVGVTSTPGTGQSMFSPASIGQPRKTTLSPAQLDPFYTQGDSLTSEDHLDDSWVTVFGFPQASASYILLQFAQYGNILKHVMSNTGNWMHIRYQSKLQARKALSKDGRIFGESIMIGVKPCIDKSVMESSDRCALSSPSLAFTPPIKTLGTPTQPGSTPRISTMRPLATAYKASTSDYQVISDRQTPKKDESLVSKAMEYMFGW

SEQ ID NO: 745956 - protein, 326 aa, Homo sapiens; identical to SEQ ID NO: 745955

SEQ ID NO: 745957 - protein, 209 aa, Homo sapiens
MAAFAVEPQGPALGSEPMMLGSPTSPKPGVNAQFLPGFLMGDLPAPVTPQPRSISGPSVGVMEMRSPLLAGGSPPQPVVPAHKDKSGAPPVRSIYDDISSPGLGSTPLTSRRQPNISVMQSPLVGVTSTPGTGQSMFSPASIGQPRKTTLSPAQLDPFYTQGDSLTSEDHLDDSWVTVFGFPQASASYILLQFAQYGNILKHVCRLGKP

SEQ ID NO: 745958 - protein, 152 aa, Homo sapiens
MAAFAVEPQGPALGSEPMMLGSPTSPKPGVNAQFLPGFLMGDLPAPVTPQPRSISGPSVGVMEMRSPLLAGGSPPQPVVPAHKDKSGAPPVRSIYDDISSPGLGSTPLTSRRQPNISVMQSPLVGVTSTPGTGFLKHLLPTYYYNLHSMGIS

SEQ ID NO: 745959 - protein, 320 aa, Homo sapiens
MAAFAVEPQGPALGSEPMMLGSPTSPKPGVNAQFLPGFLMGDLPAPVTPQPRSISGPSVGVMEMRSPLLAGGSPPQPVVPAHKDKSGAPPVRSIYDDISSPGLGSTPLTSRRQGPQQGPAQLPRLECSGTVITLQPVNSWVQPILLPQLSYWDIAKHFSNAESSCWSYIYSWNRFPQASASYILLQFAQYGNILKHVMSNTGNWMHIRYQSKLQARKALSKDGRIFGESIMIGVKPCIDKSVMESSDRCALSSPSLAFTPPIKTLGTPTQPGSTPRISTMRPLATAYKASTSDYQVISDRQTPKKDESLVSKAMEYMFGW

SEQ ID NO: 745960 - protein, 236 aa, Homo sapiens
MAAFAVEPQGPALGSEPMMLGSPTSPKPGVNAQFLPGFLMGDLPAPVTPQPRSISGPSVGVMEMRSPLLAGGSPPQPVVPAHKDKSGAPPVRSIYDDISSPGLGSTPLTSRRQMSNTGNWMHIRYQSKLQARKALSKDGRIFGESIMIGVKPCIDKSVMESSDRCALSSPSLAFTPPIKTLGTPTQPGSTPRISTMRPLATAYKASTSDYQVISDRQTPKKDESLVSKAMEYMFGW

SEQ ID NO: 745961 - protein, 201 aa, Homo sapiens
MGNHLTEMAPTASSFLPHFQALHVVVIGLDSAGKTSLLYRLKFKEFVQSVPTKGFNTEKIRVPLGGSRGITFQVWDVGGQEKLRPLWRSYTRRTDGLVFVVDAAEAERLEEAKVELHRISRASDNQGVPVLVLANKQDQPGALSAAEVEKRLAVRELAAATLTHVQGCSAVDGLGLQQGLERLYEMILKRKKAARGGKKRR

SEQ ID NO: 745962 - protein, 201 aa, Homo sapiens; identical to SEQ ID NO: 745961

SEQ ID NO: 745963 - protein, 201 aa, Homo sapiens; identical to SEQ ID NO: 745961

SEQ ID NO: 745964 - protein, 201 aa, Homo sapiens; identical to SEQ ID NO: 745961

SEQ ID NO: 745965 - protein, 201 aa, Homo sapiens; identical to SEQ ID NO: 745961

SEQ ID NO: 745966 - protein, 1144 aa, Homo sapiens
MKLSRQFTVFGSAIFCVVIFSLYLMLDRGHLDYPRNPRREGSFPQGQLSMLQEKIDHLERLLAENNEIISNIRDSVINLSESVEDGPKSSQSNFSQGAGSHLLPSQLSLSVDTADCLFASQSGSHNSDVQMLDVYSLISFDNPDGGVWKQGFDITYESNEWDTEPLQVFVVPHSHNDPGWLKTFNDYFRDKTQYIFNNMVLKLKEDSRRKFIWSEISYLSKWWDIIDIQKKDAVKSLIENGQLEIVTGGWVMPDEATPHYFALIDQLIEGHQWLENNIGVKPRSGWAIDPFGHSPTMAYLLNRAGLSHMLIQRVHYAVKKHFALHKTLEFFWRQNWDLGSVTDILCHMMPFYSYDIPHTCGPDPKICCQFDFKRLPGGRFGCPWGVPPETIHPGNVQSRARMLLDQYRKKSKLFRTKVLLAPLGDDFRYCEYTEWDLQFKNYQQLFDYMNSQSKFKVKIQFGTLSDFFDALDKADETQRDKGQSMFPVLSGDFFTYADRDDHYWSGYFTSRPFYKRMDRIMESHLRAAEILYYFALRQAHKYKINKFLSSSLYTALTEARRNLGLFQHHDAITGTAKDWVVVDYGTRLFHSLMVLEKIIGNSAFLLILKDKLTYDSYSPDTFLEMDLKQKSQDSLPQKNIIRLSAEPRYLVVYNPLEQDRISLVSVYVSSPTVQVFSASGKPVEVQVSAVWDTANTISETAYEISFRAHIPPLGLKVYKILESASSNSHLADYVLYKNKVEDSGIFTIKNMINTEEGITLENSFVLLRFDQTGLMKQMMTKEDGKHHEVNVQFSWYGTTIKRDKSGAYLFLPDGNAKPYVYTTPPFVRVTHGRIYSEVTCFFDHVTHRVRLYHIQGIEGQSVEVSNIVDIRKVYNREIAMKISSDIKSQNRFYTDLNGYQIQPRMTLSKLPLQANVYPMTTMAYIQDAKHRLTLLSAQSLGVSSLNSGQIEVIMDRRLMQDDNRGLEQGIQDNKITANLFRILLEKRSAVNTEEEKKSVSYPSLLSHITSSLMNHPVIPMANKFSSPTLELQGEFSPLQSSLPCDIHLVNLRTIQSKVGNGHSNEAALILHRKGFDCRFSSKGTGLFCSTTQGKILVQKLLNKFIVESLTPSSLSLMHSPPGTQNISEINLSPMEISTFRIQLR

SEQ ID NO: 745967 - protein, 1144 aa, Homo sapiens; identical to SEQ ID NO: 745966

SEQ ID NO: 745968 - protein, 1144 aa, Homo sapiens; identical to SEQ ID NO: 745966

SEQ ID NO: 745969 - protein, 1144 aa, Homo sapiens; identical to SEQ ID NO: 745966

SEQ ID NO: 745970 - protein, 109 aa, Homo sapiens
LTKSHKSSRDKTKKKAPSGFQKVGNGHSNEAALILHRKGFDCRFSSKGTGLFCSTTQGKILVQKLLNKFIVESLTPSSLSLMHSPPGTQNISEINLSPMEISTFRIQLR

SEQ ID NO: 745971 - protein, 103 aa, Homo sapiens
AWLRPHPAIPWPWLTRHPRHCSACRPRGPALCLRSRRSPSVSPGPVSWIGSPCPRESLIPPQLRNTPRSRRPIFSIPTPYSGSLASKLRSLAFAPGAGTRGRI

SEQ ID NO: 745972 - protein, 114 aa, Homo sapiens
AAGIRHESCSRNRGAMQPRVLLVVALLALLASARASEAEDASLLSFMQGYMKHATKTAKDALSSVQESQVAQQARGWVTDGFSSLKDYWSTVKDKFSEFWDLDPEVRPTSAVAA

SEQ ID NO: 745973 - protein, 119 aa, Homo sapiens
PSCLSAQFIPRGSCSRNRGAMQPRVLLVVALLALLASARASEAEDASLLSFMQGYMKHATKTAKDALSSVQESQVAQQARGWVTDGFSSLKDYWSTVKDKFSEFWDLDPEVRPTSAVAA

SEQ ID NO: 745974 - protein, 102 aa, Homo sapiens
SPGKFRLNSEGKLEQTVSMATRASEAEDASLLSFMQGYMKHATKTAKDALSSVQESQVAQQARGWVTDGFSSLKDYWSTVKDKFSEFWDLDPEVRPTSAVAA

SEQ ID NO: 745975 - protein, 139 aa, Homo sapiens
LQDSARELLQGPRHLPREGSRGMGTWGAPHRTLPCRNRGAMQPRVLLVVALLALLASARASEAEDASLLSFMQGYMKHATKTAKDALSSVQESQVAQQARGWVTDGFSSLKDYWSTVKDKFSEFWDLDPEVRPTSAVAA

SEQ ID NO: 745976 - protein, 114 aa, Homo sapiens; identical to SEQ ID NO: 745972

SEQ ID NO: 745977 - protein, 102 aa, Homo sapiens; identical to SEQ ID NO: 745974

SEQ ID NO: 745978 - protein, 114 aa, Homo sapiens; identical to SEQ ID NO: 745972

SEQ ID NO: 745979 - protein, 133 aa, Homo sapiens
AAGLAGQQRGLSLLGISQLSRPLAASGHPASGPHLHWSAGDLCPAPWVLSACCPGDDISRNRGAMQPRVLLVVALLALLASARASEAEDASLLSFMQGYMKHATKTAKDALSSVQESQVAQQARAFVRLLRER

SEQ ID NO: 745980 - protein, 108 aa, Homo sapiens
MICSRNRGAMQPRVLLVVALLALLASARASEAEDASLLSFMQGYMKHATKTAKDALSSVQESQVAQQARGWVTDGFSSLKDYWSTVKDKFSEFWDLDPEVRPTSAVAA

SEQ ID NO: 745981 - protein, 182 aa, Homo sapiens
MKPDCACALTAPPGPAPRSGLAEGSEAPPQRVSPVNGRGLGGAAVGSGGLSPSHTYTCLPNVHGLGFAYLFKRRRPHPFVRRSADSSEFRDFSRLRRLRLSTLGGKPRGAELPSVVSRGWNLPLRSPKNPDGPAFPRTGDLGLLRLPSDSNKSRNWKDHPFDVFAVIDVLLSSTAHSLSLLS

SEQ ID NO: 745982 - protein, 165 aa, Homo sapiens
MGPLPVCLPIMLLLLLPSLLLLLLLPGPGSGEASRILRVHRRGILELAGTVGCVGPRTPIAYMKYGCFCGLGGHGQPRDAIDWCCHGHDCCYTRAEEAGCSPKTERYSWQCVNQSVLCGPAENKCQELLCKCDQEIANCLAQTEYNLKYLFYPQFLCEPDSPKCD

SEQ ID NO: 745983 - protein, 320 aa, Homo sapiens
AKVTGFSEGVVDSVKGGFSSFSQATHSAAGAVVSKPREIASLIRNKFGSADNIPNLKDSLEEGQVDDAGKALGVISNFQSSPKYGSEEDCSSATSGSVGANSTTGGIAVGASSSKTNTLDMQSSGFDALLHEIQEIRETQARLEESFETLKEHYQRDYSLIMQTLQEERYRCERLEEQLNDLTELHQNEILNLKQELASMEEKIAYQSYERARDIQEALEACQTRISKMELQQQQQQVVQLEGLENATARNLLGKLINILLAVMAVLLVFVSTVANCVVPLMKTRNRTFSTLFLVVFIAFLWKHWDALFSYVERFFSSPR

SEQ ID NO: 745984 - protein, 121 aa, Homo sapiens
MEEKIAYQSYERARDIQEALEACQTRISKMELQQQQQQVVQLEGLENATARNLLGKLINILLAVMAVLLVFVSTVANCVVPLMKTRNRTFSTLFLVVFIAFLWKHWDALFSYVERFFSSPR

SEQ ID NO: 745985 - protein, 320 aa, Homo sapiens; identical to SEQ ID NO: 745983

SEQ ID NO: 745986 - protein, 320 aa, Homo sapiens; identical to SEQ ID NO: 745983

SEQ ID NO: 745987 - protein, 75 aa, Homo sapiens
TSESIGAYYYAARRRQIGTRPRSCTHLMLFVTMHLFSFFAVPFAAHPVTFEFLSLWLFLGSFVLSELFYNLALMA

SEQ ID NO: 745988 - protein, 320 aa, Homo sapiens; identical to SEQ ID NO: 745983

SEQ ID NO: 745989 - protein, 513 aa, Homo sapiens
MARGSAVAWAALGPLLWGCALGLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVWVNGVDTLEHEGGYLPFEADISNLVQVGPLPSRLRITIAINNTLTPTTLPPGTIQYLTDTSKYPKGYFVQNTYFDFFNYAGLQRSVLLYTTPTTYIDDITVTTSVEQDSGLVNYQISVKGSNLFKLEVRLLDAENKVVANGTGTQGQLKVPGVSLWWPYLMHERPAYLYSLEIRGKGFDWPLLVKDFNLLRWLGANAFRTSHYPYAEEVMQMCDRYGIVVIDECPGVGLALPQFFNNVSLHHHMQVMEEVVRRDKNHPAVVMWSVANEPASHLESAGYYLKMVIAHTKSLDPSRPVTFVSNSNYAADKGAPYVDVICLNSYYSWYHDYGHLELIQAAAGHQFENWNKKYQEAHYSERVWKRKRLQGFTRDPTLMYTEGVPE

SEQ ID NO: 745990 - protein, 579 aa, Homo sapiens
LAPQTVAERGTGPGSMARGSAVAWAALGPLLWGCALGLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVWVNGVDTLEHEGGYLPFEADISNLVQVGPLPSRLRITIAINNTLTPTTLPPGTIQYLTDTSKYPKGYFVQNTYFDFFNYAGLQRSVLLYTTPTTYIDDITVTTSVEQDSGLVNYQISVKGSNLFKLEVRLLDAENKVVANGTGTQGQLKVPGVSLWWPYLMHERPAYLYSLEVQLTAQTSLGPVSDFYTLPVGIRTVAVTKSQFLINGKPFYFHGVNKHEDADIRGKGFDWPLLVKDFNLLRWLGANAFRTSHYPYAEEVMQMCDRYGIVVIDECPGVGLALPQFFNNVSLHHHMQVMEEVVRRDKNHPAVVMWSVANEPASHLESAGYYLKMVIAHTKSLDPSRPVTFVSNSNYAADKGAPYVDVICLNSYYSWYHDYGHLELIQAAAGHQFENWNKKYQEAHYSERVWKRKRLQGFTRDPTLMYTEGVPE

SEQ ID NO: 745991 - protein, 358 aa, Homo sapiens
EARVLISCDEGEGGPGSMARGSAVAWAALGPLLWGCALGLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVIRGKGFDWPLLVKDFNLLRWLGANAFRTSHYPYAEEVMQMCDRYGIVVIDECPGVGLALPQFFNNVSLHHHMQVMEEVVRRDKNHPAVVMWSVANEPASHLESAGYYLKMVIAHTKSLDPSRPVTFVSNSNYAADKGAPYVDVICLNSYYSWYHDYGHLELIQAAAGHQFENWNKKYQEAHYSERVWKRKRLQGFTRDPTLMYTEGVPE

SEQ ID NO: 745992 - protein, 564 aa, Homo sapiens
MARGSAVAWAALGPLLWGCALGLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVWVNGVDTLEHEGGYLPFEADISNLVQVGPLPSRLRITIAINNTLTPTTLPPGTIQYLTDTSKYPKGYFVQNTYFDFFNYAGLQRSVLLYTTPTTYIDDITVTTSVEQDSGLVNYQISVKGSNLFKLEVRLLDAENKVVANGTGTQGQLKVPGVSLWWPYLMHERPAYLYSLEVQLTAQTSLGPVSDFYTLPVGIRTVAVTKSQFLINGKPFYFHGVNKHEDADIRGKGFDWPLLVKDFNLLRWLGANAFRTSHYPYAEEVMQMCDRYGIVVIDECPGVGLALPQFFNNVSLHHHMQVMEEVVRRDKNHPAVVMWSVANEPASHLESAGYYLKMVIAHTKSLDPSRPVTFVSNSNYAADKGAPYVDVICLNSYYSWYHDYGHLELIQAAAGHQFENWNKKYQEAHYSERVWKRKRLQGFTRDPTLMYTEGVPE

SEQ ID NO: 745993 - protein, 581 aa, Homo sapiens
EARVLISCDEGEGGPGSMARGSAVAWAALGPLLWGCALGLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVWVNGVDTLEHEGGYLPFEADISNLVQVGPLPSRLRITIAINNTLTPTTLPPGTIQYLTDTSKYPKGYFVQNTYFDFFNYAGLQRSVLLYTTPTTYIDDITVTTSVEQDSGLVNYQISVKGSNLFKLEVRLLDAENKVVANGTGTQGQLKVPGVSLWWPYLMHERPAYLYSLEVQLTAQTSLGPVSDFYTLPVGIRTVAVTKSQFLINGKPFYFHGVNKHEDADIRGKGFDWPLLVKDFNLLRWLGANAFRTSHYPYAEEVMQMCDRYGIVVIDECPGVGLALPQFFNNVSLHHHMQVMEEVVRRDKNHPAVVMWSVANEPASHLESAGYYLKMVIAHTKSLDPSRPVTFVSNSNYAADKGAPYVDVICLNSYYSWYHDYGHLELIQAAAGHQFENCNKKYQEAHYSERVWKRKRLQGFTRDPTLMYTEGVPE

SEQ ID NO: 745994 - protein, 136 aa, Homo sapiens
MRMRTCVGAPGSLWGLLLVTLHFRLPCVLQLRAAQGNEANGSKWRGGSWGGSPGSWLSEEVQLRQGQGSLGSAISYIRGKGFDWPLLVKDFNLLRWLGANAFRTSHYPYAEEVMQMCDRYGIVVIDECPGVGLALP

SEQ ID NO: 745995 - protein, 138 aa, Homo sapiens
RQGLALLPRLEYSGTSTAHCSLDPQAQGILPPQPAQVAGTTGICHYTWVTFLFLAEIGSCYVAQAGLKFLGSRDPPTLASQCAGITGIHHCAQPINFLTAIQSFNSLVHWALHRSCSFFSYMDLSGMEVTYSSQHMAT

SEQ ID NO: 745996 - protein, 220 aa, Homo sapiens
MSGNGNAAATAEENSPKMRVIRVGTRKSQLARIQTDSVVATLKASYPGLQFEIIAMSTTGDKILDTALSKIGEKSLFTKELEHALEKNEVDLVVHSLKDLPTVLPPGFTIGAICKRENPHDAVVFHPKFVGKTLETLPEKSVVGTSSLRRAAQLQRKFPHLEFRSIRGNLNTRLRKLDEQQEFSAIILATAGLQRMGWHNRVGQVRACPISPKSFDLFLA

SEQ ID NO: 745997 - protein, 304 aa, Homo sapiens
MRVIRVGTRKSQLARIQTDSVVATLKASYPGLQFEIIAMSTTGDKILDTALSKIGEKSLFTKELEHALEKNEVDLVVHSLKDLPTVLPPGFTIGAICKRENPHDAVVFHPKFVGKTLETLPEKSVVGTSSLRRAAQLQRKFPHLEFRSIRGNLNTRLRKLDEQQEFSAIILATAGLQRMGWHNRVGQILHPEECMYAVGQEGGCSVPVAVHTAMKDGQLYLTGGVWSLDGSDSIQETMQATIHVPAQHEDGPEDDPQLVGITARNIPRGPQLAAQNLGISLANLLLSKGAKNILDVARQLNDAH

SEQ ID NO: 745998 - protein, 321 aa, Homo sapiens
MSGNGNAAATAEENSPKMRVIRVGTRKSQLARIQTDSVVATLKASYPGLQFEIIAMSTTGDKILDTALSKIGEKSLFTKELEHALEKNEVDLVVHSLKDLPTVLPPGFTIGAICKRENPHDAVVFHPKFVGKTLETLPEKSVVGTSSLRRAAQLQRKFPHLEFRSIRGNLNTRLRKLDEQQEFSAIILATAGLQRMGWHNRVGQILHPEECMYAVGQEGGCSVPVAVHTAMKDGQLYLTGGVWSLDGSDSIQETMQATIHVPAQHEDGPEDDPQLVGITARNIPRGPQLAAQNLGISLANLLLSKGAKNILDVARQLNDAH

SEQ ID NO: 745999 - protein, 267 aa, Homo sapiens
MSTTGDKILDTALSKIGEKSLFTKELEHALEKNEVDLVSSLLEGPGPHVLPPGFTIGAICKRENPHDAVVFHPKFVGKTLETLPEKSVVGTSSLRRAAQLQRKFPHLEFRSIRGNLNTRLRKLDEQQEFSAIILATAGLQRMGWHNRVGQILHPEECMYAVGQEGGCSVPVAVHTAMKDGQLYLTGGVWSLDGSDSIQETMQATIHVPAQHEDGPEDDPQLVGITARNIPRGPQLAAQNLGISLANLLLSKGAKNILDVARQLNDAH

SEQ ID NO: 746000 - protein, 218 aa, Homo sapiens
MSGNGNAAATALARIQTDSVVATLKASYPGLQFEIIAMSTTGDKILDTALSKIGEKSLFTKELEHALEKNEVDLVVHSLKDLPTVLPPGFTIGAICKRENPHDAVVFHPKFVGKTLETLPEKSVVGTSSLRRAAQLQRKFPHLEFRSIRGNLNTRLRKLDEQQEFSAIILATAGLQRMGWHNRVGQGGLGRGSASQGPGHLGSGGCAARSRDSASLHR

SEQ ID NO: 746001 - protein, 266 aa, Homo sapiens
MSTTGDKILDTALSKIGEKSLFTKELEHALEKNEVDLVVHSLKDLPTVLPPGFTIGAICKRENPHDAVVFHPKFVGKTLETLPEKSVVGTSSLRRAAQLQRKFPHLEFRSIRGNLNTRLRKLDEQQEFSAIILATAGLQRMGWHNRVGQILHPEECMYAVGQEGGCSVPVAVHTAMKDGQLYLTGGVWSLDGSDSIQETMQATIHVPAQHEDGPEDDPQLVGITARNIPRGPQLAAQNLGISLANLLLSKGAKNILDVARQLNDAH

SEQ ID NO: 746002 - protein, 304 aa, Homo sapiens; identical to SEQ ID NO: 745997

SEQ ID NO: 746003 - protein, 361 aa, Homo sapiens [sequence omitted]

SEQ ID NO: 746004 - protein, 226 aa, Homo sapiens
MRVIRVGTRKSQLARIQTDSVVATLKASYPGLQFEIIAMSTTGDKILDTALSKIGEKSLFTKELEHALEKNEVDLVVHSLKDLPTVLPPGFTIGAICKRENPHDAVVFHPKFVGKTLETLPEKSVVGTSSLRRAAQLQRKFPHLEFRSIRGNLNTRLRKLDEQQEFSAIILATAGLQRMGWHNRVGQILHPEECMYAVGQVHLDQGSHMVDICFPFVLNQKLVSQL

SEQ ID NO: 746005 - protein, 266 aa, Homo sapiens; identical to SEQ ID NO: 746001

SEQ ID NO: 746006 - protein, 126 aa, Homo sapiens
MGWHNRVGQILHPEECMYAVGQEGGCSVPVAVHTAMKDGQLYLTGGVWSLDGSDSIQETMQATIHVPAQHEDGPEDDPQLVGITARNIPRGPQLAAQNLGISLANLLLSKGAKNILDVARQLNDAH

SEQ ID NO: 746007 - protein, 343 aa, Homo sapiens
MSGNGNAAATALARIQTDSVVATLKASYPGLQFEIIAMSTTGDKILDTALSKIGEKSLFTKELEHALEKNEVDLVVHSLKDLPTVLPPGFTIGAICKRENPHDAVVFHPKFVGKTLETLPEKSVVGTSSLRRAAQLQRKFPHLEFRSIRGNLNTRLRKLDEQQEFSAIILATAGLQRMGWHNRVGQILHPEECMYAVGQGALGVEVRAKDQDILDLVGVLHDPETLLRCIAERAFLRHLEGGCSVPVAVHTAMKDGQLYLTGGVWSLDGSDSIQETMQATIHVPAQHEDGPEDDPQLVGITARNIPRGPQLAAQNLGISLANLLLSKGAKNILDVARQLNDAH

SEQ ID NO: 746008 - protein, 344 aa, Homo sapiens; identical to SEQ ID NO: 744022

SEQ ID NO: 746009 - protein, 298 aa, Homo sapiens
KAKSEQASEVSYAGVIGADVRGHGLICEGQPVTSRLAVICGTSSCHMGISKDPIFVPGVWGPYFSAMVPGFWLNEGGQSVTGKLIDHMVQGHAAFPELQVKATARCQSIYAYLNSHLDLIKKAQPVGFLTVDLHVWPDFHGNRSPLADLTLKGMVTGLKLSQDLDDLAILYLATVQAIALGTRFIIEAMEAAGHSISTLFLCGGLSKNPLFVQMHADITGMPVVLSQEVESVLVGAAVLGACASGDFASVQEAMAKMSKVGKVVFPRLQDKKYYDKKYQVFLKLVEHQKEYLAIMNDD

SEQ ID NO: 746010 - protein, 252 aa, Homo sapiens
MGISKDPIFVPGVWGPYFSAMVPGFWLNEGGQSVTGKLIDHMVQGHAAFPELQVKATARCQSIYAYLNSHLDLIKKAQPVGFLTVDLHVWPDFHGNRSPLADLTLKGMVTGLKLSQDLDDLAILYLATVQAIALGTRFIIEAMEAAGHSISTLFLCGGLSKNPLFVQMHADITGMPVVLSQEVESVLVGAAVLGACASGDFASVQEAMAKMSKVGKVVFPRLQDKKYYDKKYQVFLKLVEHQKEYLAIMNDD

SEQ ID NO: 746011 - protein, 252 aa, Homo sapiens; identical to SEQ ID NO: 746010

SEQ ID NO: 746012 - protein, 439 aa, Homo sapiens
MWLDHRAVSQVNRINETKHSVLQYVGGVMSVEMQAPKLLWLKENLREICWDKAGHFFDLPDFLSWKATGVTARSLCSLVCKWTYSAEKGWDDSFWKMIGLEDFVADNYSKIGNQVLPPGASLGNGLTPEAARDLGLLPGIAVAASLIDAHAGGLGVIGADVRGHGLICEGQPVTSRLAVICGTSSCHMGISKDPIFVPGVWGPYFSAMVPGFWLNEGGQSVTGKLIDHMVQGHAAFPELQVKATARCQSIYAYLNSHLDLIKKAQPVGFLTVDLHVWPDFHGNRSPLADLTLKGMVTGLKLSQDLDDLAILYLATVQAIALGTRFIIEAMEAAGHSISTLFLCGGLSKNPLFVQMHADITGMPVVLSQEVESVLVGAAVLGACASGDFASVQEAMAKMSKVGKVVFPRLQDKKYYDKKYQVFLKLVEHQKEYLAIMNDD

SEQ ID NO: 746013 - protein, 252 aa, Homo sapiens; identical to SEQ ID NO: 746010

SEQ ID NO: 746014 - protein, 252 aa, Homo sapiens; identical to SEQ ID NO: 746010

SEQ ID NO: 746015 - protein, 233 aa, Homo sapiens
MGISKDPIFVPGVWGPYFSAMVPGFWLNEGGQSVTGATARCQSIYAYLNSHLDLIKKAQPVGFLTVDLHVWPDFHGNRSPLADLTLKGMVTGLKLSQDLDDLAILYLATVQAIALGTRFIIEAMEAAGHSISTLFLCGGLSKNPLFVQMHADITGMPVVLSQEVESVLVGAAVLGACASGDFASVQEAMAKMSKVGKVVFPRLQDKKYYDKKYQVFLKLVEHQKEYLAIMNDD

SEQ ID NO: 746016 - protein, 322 aa, Homo sapiens
MSGGEQKPERYYVGVDVGTGSVRAALVDQSGVLLAFADQPIKNWEPQFNHHEQSSEDIWAACCVVTKKVVQGIDLNQIRGLGFDATCSLVVLDKQFHPLPVNQEGDSHRNVIMWLDHRAVSQVNRINETKHSVLQYVGGVMSVEMQAPKLLWLKENLREICWDKAGHFFDLPDFLSWKATGVTARELSAPWCCNVDIIQQSIGWDPQKLAELIRLGQTSLHINFRGKVGKPNVASLPGGQYHLAQWGSVRVTVGMQDLWPSSPVELRVRTFHLIWMPPFRAVLGAASGGPHLPTAPALLVSRVPSRFPSRLGLPLSPRPLCP

SEQ ID NO: 746017 - protein, 79 aa, Homo sapiens
GIHNCSLELEGRECVSICISLSFLLGDSHRNVIMWLDHRAVSQVNRINETKHSVLQYVGGVMSVEMQAPKLLWLKEVSA

SEQ ID NO: 746018 - protein, 551 aa, Homo sapiens
MSGGEQKPERYYVGVDVGTGSVRAALVDQSGVLLAFADQPIKNWEPQFNHHEQSSEDIWAACCVVTKKVVQGIDLNQIRGLGFDATCSLVVLDKQFHPLPVNQEGDSHRNVIMWLDHRAVSQVNRINETKHSVLQYVGGVMSVEMQAPKLLWLKENLREICWDKAGHFFDLPDFLSWKATGVTARSLCSLVCKWTYSAEKGWDDSFWKMIGLEDFVADNYSKIGNQVLPPGASLGNGLTPEAARDLGLLPGIAVAASLIDAHAGGLGVIGADVRGHGLICEGQPVTSRLAVICGTSSCHMGISKDPIFVPGVWGPYFSAMVPGFWLNEGGQSVTGKLIDHMVQGHAAFPELQVKATARCQSIYAYLNSHLDLIKKAQPVGFLTVDLHVWPDFHGNRSPLADLTLKGMVTGLKLSQDLDDLAILYLATVQAIALGTRFIIEAMEAAGHSISTLFLCGGLSKNPLFVQMHADITGMPVVLSQEVESVLVGAAVLGACASGDFASVQEAMAKMSKVGKVVFPRLQDKKYYDKKYQVFLKLVEHQKEYLAIMNDD

SEQ ID NO: 746019 - protein, 246 aa, Homo sapiens
MWLDHRAVSQVNRINETKHSVLQYVGGVMSVEMQAPKLLWLKENLREICWDKAGHFFDLPDFLSWKATGVTARSLCSLVCKWTYSAEKGWDDSFWKMIGLEDFVADNYSKIGNQVLPPGASLGNGLTPEAARDLGLLPGIAVAASLIDAHAGGLGVIGADVRGHGLICEGQPVTSRLAVICGTSSCHMGISKDPIFVPGVWGPYFSAMVPGFWLNEGGQSVTGKLIDHMVQGHAAFPELQVKATAR

SEQ ID NO: 746020 - protein, 551 aa, Homo sapiens; identical to SEQ ID NO: 746018

SEQ ID NO: 746021 - protein, 439 aa, Homo sapiens; identical to SEQ ID NO: 746012

SEQ ID NO: 746022 - protein, 439 aa, Homo sapiens; identical to SEQ ID NO: 746012

SEQ ID NO: 746023 - protein, 377 aa, Homo sapiens
ILLCCLHGKVRSLCSLVCKWTYSAEKGWDDSFWKMIGLEDFVADNYSKIGNQVLPPGASLGNGLTPEAARDLGLLPGIAVAASLIDAHAGGLGVIGADVRGHGLICEGQPVTSRLAVICGTSSCHMGISKDPIFVPGVWGPYFSAMVPGFWLNEGGQSVTGKLIDHMVQGHAAFPELQVKATARCQSIYAYLNSHLDLIKKAQPVGFLTVDLHVWPDFHGNRSPLADLTLKGMVTGLKLSQDLDDLAILYLATVQAIALGTRFIIEAMEAAGHSISTLFLCGGLSKNPLFVQMHADITGMPVVLSQEVESVLVGAAVLGACASGDFASVQEAMAKMSKVGKVVFPRLQDKKYYDKKYQVFLKLVEHQKEYLAIMNDD

SEQ ID NO: 746024 - protein, 491 aa, Homo sapiens
MSGGEQKPERYYVGVDVGTGSVRAALVDQSGVLLAFADQPIKNWEPQFNHHEQSSEDIWAACCVVTKKVVQGIDLNQIRGLGFDATCSLVVLDKQFHPLPVNQEGDSHRNVIMWLDHRAVSQVNRINETKHSVLQYVGGVMSVEMQAPKLLWLKENLREICWDKAGHFFDLPDFLSWKATGVTARSLCSLVCKWTYSAEKGWDDSFWKMIGLEDFVADNYSKIGNQVLPPGASLGNGLTPEAARDLGLLPGIAVAASLIDAHAGGLGVIGADVRGHGLICEGQPVTSRLAVICGTSSCHMGISKDPIFVPGVWGPYFSAMVPGFWLNEGGQSVTGKLIDHMVQGHAAFPELQVKATARCQSIYAYLNSHLDLIKKAQPVGFLTVDLHVWPDFHGNRSPLADLTLKGMVTGLKLSQDLDDLAILYLATVQAIALGTRFIIEAMEAAGHSISTLFLCGGLSKNPLFVQMHADITGSNGKNEQSWESCVPETTG

SEQ ID NO: 746025 - protein, 105 aa, Homo sapiens
MLRHSPLTQMGPAKDKLVIGRIFHIVENDLYIDFGGKFHCVCRRPEVDGEKYQKGTRVRLRLLDLELTSRFLGATTDTTVLEANAVLLGIQESKDSRSKEEHHEK

SEQ ID NO: 746026 - protein, 201 aa, Homo sapiens
ALAEGRSKVRGKEVMAALCRTRAVAAESHFLRVFLFFRPFRGVGTESGSESGSSNAKEPKTRAGGFASALERHSELLQKVEPLQKGSPKNVESFASMLRHSPLTQMGPAKDKLVIGRIFHIVENDLYIDFGGKFHCVCRRPEVDGEKYQKGTRVRLRLLDLELTSRFLGATTDTTVLEANAVLLGIQESKDSRSKEEHHEK

SEQ ID NO: 746027 - protein, 181 aa, Homo sapiens
ALAEGRSKVRGKEVMAALCRTRAVAAESHFLRVFLFFRPFRGVGTESGSESGSSNAKEPKTRAGGFASALERHSELLQKVEPLQKMGPAKDKLVIGRIFHIVENDLYIDFGGKFHCVCRRPEVDGEKYQKGTRVRLRLLDLELTSRFLGATTDTTVLEANAVLLGIQESKDSRSKEEHHEK

SEQ ID NO: 746028 - protein, 125 aa, Homo sapiens
MLPRLVLNSWVQVILLRWPPKVLGLQMTDMGPAKDKLVIGRIFHIVENDLYIDFGGKFHCVCRRPEVDGEKYQKGTRVRLRLLDLELTSRFLGATTDTTVLEANAVLLGIQESKDSRSKEEHHEK

SEQ ID NO: 746029 - protein, 178 aa, Homo sapiens
ALAEGRSKVRGKEVMAALCRTRAVAAESHFLRVFLFFRPFRGVGTESGSESGSSNAKEPKTRAGGFASALERHSELLQKVEPLQKGSPKNVESFASMLRHSPLTQMGPAKDKLVIGRIFHIVENDLYIDFGGKFHCVCRRPEVDGESPISWYAVWRRFSQVMITCFSSNSDFGKHRKR

SEQ ID NO: 746030 - protein, 212 aa, Homo sapiens
ALAEGRSKVRGKEVMAALCRTRAVAAESHFLRVFLFFRPFRGVGTESGSESGSSNAKEPKTRAGGFASALERHSELLQKVEPLQKRWGFAMLPRLVLNSWVQVILLRWPPKVLGLQMTDGSPKNVESFASMLRHSPLTQMGPAKDKLVIGRIFHIVENDLYIDFGGKFHCVCRRPEVDGESPISWYAVWRRFSQVMITCFSSNSDFGKHRKR

SEQ ID NO: 746031 - protein, 68 aa, Homo sapiens
WFPYATLAGPRTLRVHKDLRVRLRLLDLELTSRFLGATTDTTVLEANAVLLGIQESKDSRSKEEHHEK

SEQ ID NO: 746032 - protein, 178 aa, Homo sapiens; identical to SEQ ID NO: 746029

SEQ ID NO: 746033 - protein, 201 aa, Homo sapiens; identical to SEQ ID NO: 746026

SEQ ID NO: 746034 - protein, 201 aa, Homo sapiens; identical to SEQ ID NO: 746026

SEQ ID NO: 746035 - protein, 125 aa, Homo sapiens; identical to SEQ ID NO: 746028

SEQ ID NO: 746036 - protein, 100 aa, Homo sapiens
ALAEGRSKVRGKEVMAALCRTRAVAAESHFLRVFLFFRPFRGVGTESGSESGSSNAKEPKTRAGGFASALERHSELLQKVEPLQKEIPERNQGPVAAIRS

SEQ ID NO: 746037 - protein, 201 aa, Homo sapiens; identical to SEQ ID NO: 746026

SEQ ID NO: 746038 - protein, 119 aa, Homo sapiens
EADLRSFWARRGRRKGKTGPGKAVVRNEPHGPEEATGRRELGLPKRRRGRSFGLGRPQARASWAWRVRCEAEAGPVQAFGRQEARPAEADWRSSSGPAEAAESQKRGLGRPPGGMSWAG

SEQ ID NO: 746039 - protein, 144 aa, Homo sapiens
GSRETAFTYAVSAAGVVNAMSRACREGELSTCGCSRAARPKDLPRDWLWGGCGDNIDYGYRFAKEFVDARERERIHAKGSYESARILMNLHNNEAGRRTVYNLADVACKCHGVSGSCSLKTCWLQLADFRKVGDALKEKYDKLV

SEQ ID NO: 746040 - protein, 159 aa, Homo sapiens
GSRETAFTYAVSAAGVVNAMSRACREGELSTCGCSRAARPKDLPRDWLWGGCGDNIDYGYRFAKEFVDARERERIHAKGSYESARILMNLHNNEAGRRTVYNLADVACKCHGVSGSCSLKTCWLQLADFRKVGDALKEKYDSWFKKQTSKGLCQMEDRI

SEQ ID NO: 746041 - protein, 86 aa, Homo sapiens
PAGRLPARQGLEKARAPKATEMPRDESRLEMPWLNSLCTSRAHRAVLELVLHMKMSRSPLLKERVPDLSWAHQIQYLPGIGKRWGE

SEQ ID NO: 746042 - protein, 86 aa, Homo sapiens; identical to SEQ ID NO: 746041

SEQ ID NO: 746043 - protein, 424 aa, Homo sapiens
MHRKHLQEIPDLSSNVATSFTWGWDSSKTSELLSGMGVSALEKEEPDSENIPQELLSNLGHPESPPRKRLKSKGSDKDFVIVRRPKLNRENFPGVSWDSLPDELLLGIFSCLCLPELLKVSGVCKRWYRLASDESLWQTLDLTGKNLHPDVTGRLLSQGVIAFRCPRSFMDQPLAEHFSPFRVQHMDLSNSVIEVSTLHGILSQCSKLQNLSLEGLRLSDPIVNTLAKNSNLVRLNLSGCSGFSEFALQTLLSSCSRLDELNLSWCFDFTEKHVQVAVAHVSETITQLNLSGYRKNLQKSDLSTLVRRCPNLVHLDLSDSVMLKNDCFQEFFQLNYLQHLSLSRCYDIIPETLLELGEIPTLKTLQVFGIVPDGTLQLLKEALPHLQINCSHFTTIARPTIGNKKNQEIWGIKCRLTLQKPSCL

SEQ ID NO: 746044 - protein, 156 aa, Homo sapiens
MHRKHLQEIPDLSSNVATSFTWGWDSSKTSELLSGMGVSALGGKTGKGARAPPRGTPRDWGKGKTKFSPPGETWLLSNLGHPESPPRKRLKSKGSDKDFVIVRRPKLNRENFPGVSWDSLPDELLLGIFSCLCLPELLKVSGVCKRWYRLASLYFS

SEQ ID NO: 746045 - protein, 390 aa, Homo sapiens
MHRKHLQEIPDLSSNVATSFTWGWDSSKTSELLSGMGVSALEKEEPDSENIPQELLSNLGHPESPPRKRLKSKGSDKDFVIVRRPKLNRENFPGVSWDSLPDELLLGIFSCLCLPELLKVSGVCKRWYRLASDESLWQTLDLTGKNLHPDVTGRLLSQGVIAFRCPRSFMDQPLAEHFSPFRVQHMDLSNSVIEVSTLHGILSQCSKLQNLSLEGLRLSDPIVNTLAKNSNLVRLNLSGCSGFSEFALQTLLSSCSRLDELNLSWCFDFTEKHVQVAVAHVSETITQLNLSGYRKNLQKSDLSTLVRRCPNLVHLDLSDSVMLKNDCFQEFFQLNYLQHLSLSRCYDIIPETLLQELGLGSGWTLTSDALKHTELPNSSPAISYFANMSE

SEQ ID NO: 746046 - protein, 444 aa, Homo sapiens
MHRKHLQEIPDLSSNVATSFTWGWDSSKTSELLSGMGVSALGGKTGKGARAPPRGTPRDWGKGKTKFSPPGETWLLSNLGHPESPPRKRLKSKGSDKDFVIVRRPKLNRENFPGVSWDSLPDELLLGIFSCLCLPELLKVSGVCKRWYRLASDESLWQTLDLTGKNLHPDVTGRLLSQGVIAFRCPRSFMDQPLAEHFSPFRVQHMDLSNSVIEVSTLHGILSQCSKLQNLSLEGLRLSDPIVNTLAKNSNLVRLNLSGCSGFSEFALQTLLSSCSRLDELNLSWCFDFTEKHVQVAVAHVSETITQLNLSGYRKNLQKSDLSTLVRRCPNLVHLDLSDSVMLKNDCFQEFFQLNYLQHLSLSRCYDIIPETLLELGEIPTLKTLQVFGIVPDGTLQLLKEALPHLQINCSHFTTIARPTIGNKKNQEIWGIKCRLTLQKPSCL

SEQ ID NO: 746047 - protein, 155 aa, Homo sapiens
MRKVVLITGASSGIGLALCKRLLAEDDELHLCLACRNMSKAEAVCAALLASHPTAEVTIVQVDVSNLQSVFRASKELKQRFQRLDCIYLNAGIMPNPQLNIKALFFGLFSRKVIHMFSTAEGLLTQGDKITADGLQEVFETNVFGHFILVKKLWA

SEQ ID NO: 746048 - protein, 355 aa, Homo sapiens
MRKVVLITGASSGIGLALCKRLLAEDDELHLCLACRNMSKAEAVCAALLASHPTAEVTIVQVDVSNLQSVFRASKELKQRMIKKWLYVICVKTMFQRLDCIYLNAGIMPNPQLNIKALFFGLFSRKVIHMFSTAEGLLTQGDKITADGLQEVFETNVFGHFILIRELEPLLCHSDNPSQLIWTSSRSARKSNFSLEDFQHSKGKEPYSSSKYATDLLSVALNRNFNQQGLYSNVACPGTALTNLTYGILPPFIWTLLMPAILLLRFFANAFTLTPYNGTEALVWLFHQKPESLNPLIKYLSATTGFGRNYIMTQKMDLDEDTAEKFYQKLLELEKHIRVTIQKTDNQARLSGSCL

SEQ ID NO: 746049 - protein, 341 aa, Homo sapiens
MRKVVLITGASSGIGLALCKRLLAEDDELHLCLACRNMSKAEAVCAALLASHPTAEVTIVQVDVSNLQSVFRASKELKQRFQRLDCIYLNAGIMPNPQLNIKALFFGLFSRKVIHMFSTAEGLLTQGDKITADGLQEVFETNVFGHFILIRELEPLLCHSDNPSQLIWTSSRSARKSNFSLEDFQHSKGKEPYSSSKYATDLLSVALNRNFNQQGLYSNVACPGTALTNLTYGILPPFIWTLLMPAILLLRFFANAFTLTPYNGTEALVWLFHQKPESLNPLIKYLSATTGFGRNYIMTQKMDLDEDTAEKFYQKLLELEKHIRVTIQKTDNQARLSGSCL

SEQ ID NO: 746050 - protein, 111 aa, Homo sapiens
MRKVVLITGASSGIGLALCKRLLAEDDELHLCLACRNMSKAEAVCAALLASHPTAEVTIVQVDVSNLQSVFRASKELKQRFQRLDCIYLNAGIMPNPQLNIKALFFGLFSS

SEQ ID NO: 746051 - protein, 341 aa, Homo sapiens; identical to SEQ ID NO: 746049

SEQ ID NO: 746052 - protein, 667 aa, Homo sapiens
METLESELTCPICLELFEDPLLLPCAHSLCFNCAHRILVSHCATNESVESITAFQCPTCRHVITLSQRGLDGLKRNVTLQNIIDRFQKASVSGPNSPSETRRERAFDANTMTSAEKVLCQFCDQDPAQDAVKTCVTCEVSYCDECLKATHPNKKPFTGHRLIEPIPDSHIRGLMCLEHEDEKVNMYCVTDDQLICALCKLVGRHRDHQVAALSERYDKLKQNLESNLTNLIKRNTELETLLAKLIQTCQHVEVNASRQEAKLTEECDLLIEIIQQRRQIIGTKIKEGKVMRLRKLAQQIANCKQCIERSASLISQAEHSLKENDHARFLQTAKNITERVSMATASSQVLIPEINLNDTFDTFALDFSREKKLLECLDYLTAPNPPTIREELCTASYDTITVHWTSDDEFSVVSYELQYTIFTGQANVVSLCNSADSWMIVPNIKQNHYTVHGLQSGTKYIFMVKAINQAGSRSSEPGKLKTNSQPFKLDPKSAHRKLKVSHDNLTVERDESSSKKSHTPERFTSQGSYGVAGNVFIDSGRHYWEVVISGSTWYAIGLAYKSAPKHEWIGKNSASWALCRCNNNWVVRHNSKEIPIEPAPHLRRVGILLDYDNGSIAFYDALNSIHLYTFDVAFAQPVCPTFTVWNKCLTIITGLPIPDHLDCTEQLP

SEQ ID NO: 746053 - protein, 667 aa, Homo sapiens; identical to SEQ ID NO: 746052

SEQ ID NO: 746054 - protein, 667 aa, Homo sapiens; identical to SEQ ID NO: 746052

SEQ ID NO: 746055 - protein, 667 aa, Homo sapiens; identical to SEQ ID NO: 746052

SEQ ID NO: 746056 - protein, 667 aa, Homo sapiens; identical to SEQ ID NO: 746052

SEQ ID NO: 746057 - protein, 667 aa, Homo sapiens; identical to SEQ ID NO: 746052

SEQ ID NO: 746058 - protein, 667 aa, Homo sapiens; identical to SEQ ID NO: 746052

SEQ ID NO: 746059 - protein, 629 aa, Homo sapiens
METLESELTCPICLELFEDPLLLPCAHSLCFNCAHRILVSHCATNESVESITAFQCPTCRHVITLSQRGLDGLKRNVTLQNIIDRFQKASVSGPNSPSETRRERAFDANTMTSAEKVLCQFCDQDPAQDAVKTCVTCEVSYCDECLKATHPNKKPFTGHRLIEPIPDSHIRGLMCLEHEDEKQNLESNLTNLIKRNTELETLLAKLIQTCQHVEVNASRQEAKLTEECDLLIEIIQQRRQIIGTKIKEGKVMRLRKLAQQIANCKQCIERSASLISQAEHSLKENDHARFLQTAKNITERVSMATASSQVLIPEINLNDTFDTFALDFSREKKLLECLDYLTAPNPPTIREELCTASYDTITVHWTSDDEFSVVSYELQYTIFTGQANVVSLCNSADSWMIVPNIKQNHYTVHGLQSGTKYIFMVKAINQAGSRSSEPGKLKTNSQPFKLDPKSAHRKLKVSHDNLTVERDESSSKKSHTPERFTSQGSYGVAGNVFIDSGRHYWEVVISGSTWYAIGLAYKSAPKHEWIGKNSASWALCRCNNNWVVRHNSKEIPIEPAPHLRRVGILLDYDNGSIAFYDALNSIHLYTFDVAFAQPVCPTFTVWNKCLTIITGLPIPDHLDCTEQLP

SEQ ID NO: 746060 - protein, 667 aa, Homo sapiens; identical to SEQ ID NO: 746052

SEQ ID NO: 746061 - protein, 667 aa, Homo sapiens; identical to SEQ ID NO: 746052

SEQ ID NO: 746062 - protein, 667 aa, Homo sapiens; identical to SEQ ID NO: 746052

SEQ ID NO: 746063 - protein, 552 aa, Homo sapiens
METLESELTCPICLELFEDPLLLPCAHSLCFNCAHRILVSHCATNESVESITAFQCPTCRHVITLSQRGLDGLKRNVTLQNIIDRFQKASVSGPNSPSETRRERAFDANTMTSAEKVLCQFCDQDPAQDAVKTCVTCEVSYCDECLKATHPNKKPFTGHRLIEPIPDSHIRGLMCLEHEDEKVNMYCVTDDQLICALCKLVGRHRDHQVAALSERYDKLKQNLESNLTNLIKRNTELETLLAKLIQTCQHVEVNASRQEAKLTEECDLLIEIIQQRRQIIGTKIKEGKVMRLRKLAQQIANCKQCIERSASLISQAEHSLKENDHARFLQTAKNITERVSMATASSQVLIPEINLNDTFDTFALDFSREKKLLECLDYLTAPNPPTIREELCTASYDTITVHWTSDDEFSVVSYELQYTIFTGQANVVSLCNSADSWMIVPNIKQNHYTVHGLQSGTKYIFMVKAINQAGSRSSEPGKLKTNSQPFKLDPKSAHRKLKVSHDNLTVERDESSSKKSHTPERFTSQGSYGVAGNVFIDSGRHYWEVVISGSTW

SEQ ID NO: 746064 - protein, 667 aa, Homo sapiens; identical to SEQ ID NO: 746052

SEQ ID NO: 746065 - protein, 79 aa, Homo sapiens
SAQGKLKTNSQPFKLDPKSAHRKLKVSHDNLTVERDESSSKKSHTPERFTSQGSYGVAGNVFIDSGRHYWEVVISGSTW

SEQ ID NO: 746066 - protein, 27 aa, Homo sapiens
MTFHFTGGVFSVQFPNPKAEPAPFEGQ

SEQ ID NO: 746067 - protein, 206 aa, Homo sapiens
MFPEPPTPGPPSPDTPPDSSRISHGPVPPWALATIVLVSGLLIFSCCFCLYRKSCRRRTGKKSQAQAQVHLQEVKGLGQSYIDKVQPEVEELEPAPSGPGQQVADKHELGRLQYSLDYDFQSGQLLVGILQAMGLAALDLGGSSDPYVRVYLLPDKRRRYETKVHRQTLNPHFGETFAFKVPYGGAWGAGLPALAACPTSRRSLPP

SEQ ID NO: 746068 - protein, 386 aa, Homo sapiens
MFPEPPTPGPPSPDTPPDSSRISHGPVPPWALATIVLVSGLLIFSCCFCLYRKSCRRRTGKKSQAQAQVHLQEVKGLGQSYIDKVQPEVEELEPAPSGPGQQVADKHELGRLQYSLDYDFQSGQLLVGILQAMGLAALDLGGSSDPYVRVYLLPDKRRRYETKVHRQTLNPHFGETFAFKVPYVELGGRVLVMAVYDFDRFSRNDAIGEVRVPMSSVDLGRPVQAWRELQAAPREEQEKLGDICFSLRYVPTAGKLTVIVLEAKNLKKMDVGGLSDPYVKVHLLQGGKKVRKKKTTIKKNTLNPYYNEAFSFEVPCDQVQKVQVELTVLDYDKLGKNEAIGRVAVGAAAGGAGLRHWADMLANPRRPIAQWHSLRPPDRVRLLPAP

SEQ ID NO: 746069 - protein, 350 aa, Homo sapiens
MFPEPPTPGPPSPDTPPDSSRISHGPVPPWALATIVLVSGLLIFSCCFCLYRKSCRRRTGKKSQAQAQVHLQEVKGLGQSYIDKVQPEVEELEPAPSGPGQQVADKHELGRLQYSLDYDFQSGQLLVGILQAMGLAALDLGGSSDPYVRVYLLPDKRRRYDFDRFSRNDAIGEVRVPMSSVDLGRPVQAWRELQAAPREEQEKLGDICFSLRYVPTAGKLTVIVLEAKNLKKMDVGGLSDPYVKVHLLQGGKKVRKKKTTIKKNTLNPYYNEAFSFEVPCDQVQKVQVELTVLDYDKLGKNEAIGRVAVGAAAGGAGLRHWADMLANPRRPIAQWHSLRPPDRVRLLPAP

SEQ ID NO: 746070 - protein, 144 aa, Homo sapiens
EEFISLETWLRRKKGARASSSPQAPSLSSPTPSPVPSSGAPSPRVAARGTLSRENGHRPFRGLLPSRSSLLFLPRPPQKVQVELTVLDYDKLGKNEAIGRVAVGAAAGGAGLRHWADMLANPRRPIAQWHSLRPPDRVRLLPAP

SEQ ID NO: 746071 - protein, 386 aa, Homo sapiens; identical to SEQ ID NO: 746068

SEQ ID NO: 746072 - protein, 383 aa, Homo sapiens
MTRGGCPVSARLFAQRPHGSWSSLLCVGLKGRLGWEWGTRVLECLCRKDSRTPPPCSRSPQPRGLHRPTRLPTPVASATAQVQPEVEELEPAPSGPGQQVADKHELGRLQYSLDYDFQSGQLLVGILQAMGLAALDLGGSSDPYVRVYLLPDKRRRYETKVHRQTLNPHFGETFAFKVPYVELGGRVLVMAVYDFDRFSRNDAIGEVRVPMSSVDLGRPVQAWRELQAAPREEQEKLGDICFSLRYVPTAGKLTVIVLEAKNLKKMDVGGLSDPYVKVHLLQGGKKVRKKKTTIKKNTLNPYYNEAFSFEVPCDQVQKVQVELTVLDYDKLGKNEAIGRVAVGAAAGGAGLRHWADMLANPRRPIAQWHSLRPPDRVRLLPAP

SEQ ID NO: 746073 - protein, 160 aa, Homo sapiens
GSGDGPLSFQQEKLGDICFSLRYVPTAGKLTVIVLEAKNLKKMDVGGLSDPYVKVHLLQGGKKVRKKKTTIKKNTLNPYYNEAFSFEVPCDQVQKVQVELTVLDYDKLGKNEAIGRVAVGAAAGGAGLRHWADMLANPRRPIAQWHSLRPPDRVRLLPAP

SEQ ID NO: 746074 - protein, 506 aa, Homo sapiens
MRDPLTDCPYNKVYKNLKEFSQNGENFCKQVTSVLQQRANLEISYAKGLQKLASKLSKALQNTRKSCVSSAWAWASEGMKSTADLHQKLGKAIELEAIKPTYQVLNVQEKKRKSLDNEVEKTANLVISNWNQQIKAKKKLMVSTKKHEALFQLVESSKQSMTEKEKRKLLNKLTKSTEKLEKEDENYYQKNMAGYSTRLKWENTLENCYQSILELEKERIQLLCNNLNQYSQHISLFGQTLTTCHTQIHCAISKIDIEKDIQAVMEETAILSTENKSEFLLTDYFEEDPNSAMDKERRKSLLKPKLLRLQRDIEKASKDKEGLERMLKTYSSTSSFSDAKSQKDTAALMDENNLKLDLLEANSYKLSSMLAELEQRPQPSHPCSNSIFRWREKEHTHSYVKISRPFLMKRLENIVSKASSGGQSNPGSSTPAPGAAQLSSRLCKALYSFQARQDDELNLEKGDIVIIHEKKEEGWWFGSLNGKKGHFPAAYVEELPSNAGNTATKA

SEQ ID NO: 746075 - protein, 506 aa, Homo sapiens; identical to SEQ ID NO: 746074

SEQ ID NO: 746076 - protein, 428 aa, Homo sapiens
MKSTADLHQKLGKAIELEAIKPTYQVLNVQEKKRKSLDNEVEKTANLVISNWNQQIKAKKKLMVSTKKHEALFQLVESSKQSMTEKEKRKLLNKLTKSTEKLEKEDENYYQKNMAGYSTRLKWENTLENCYQSILELEKERIQLLCNNLNQYSQHISLFGQTLTTCHTQIHCAISKIDIEKDIQAVMEETAILSTENKSEFLLTDYFEEDPNSAMDKERRKSLLKPKLLRLQRDIEKASKDKEGLERMLKTYSSTSSFSDAKSQKDTAALMDENNLKLDLLEANSYKLSSMLAELEQRPQPSHPCSNSIFRWREKEHTHSYVKISRPFLMKRLENIVSKASSGGQSNPGSSTPAPGAAQLSSRLCKALYSFQARQDDELNLEKGDIVIIHEKKEEGWWFGSLNGKKGHFPAAYVEELPSNAGNTATKA

SEQ ID NO: 746077 - protein, 120 aa, Homo sapiens
VKTRRRQLSPIQTEMPGTALLSQPSEGTNPADTLALYFWPPEPQESTFLLLRPLSLWHFVTASHPVQALLIDCWAFAVVFASNIFISQFISGGCHPRGRTSIVSLMGNLAGIMWSTAQGC

SEQ ID NO: 746078 - protein, 135 aa, Homo sapiens
PGPGPGGRTGRDHEQLHRNPSPGLQGPGGTPTSGRRPQCPSRSGVRWVERFGGESWGLRRRGCGWDPIPLWLQQAVKLHQGLHPADHSPGAPSGGRRHQQVLLVTWPHLPCPPEPPRLGMSCEGSDGRRRTHDTE

SEQ ID NO: 746079 - protein, 137 aa, Homo sapiens
KRAARGRWCDSMEKLKALLPRLEQELKDTAKFKDFYQFTFTFAKNPGQKGLDLEMAVAYWKLVLSGRFKFLDLWNTFLMEHHKRSIPRDTWNLLLDFGNMIADDMSNYDEEGAWPVLIDDFVEYARPVVTGGKRSLF

SEQ ID NO: 746080 - protein, 193 aa, Homo sapiens
EAGGAGEMHKLKSSQKDKVRQFMACTQAGERTAIYCLTQNEWRLDEATDSFFQNPDSLHRESMRNAVDKKKLERLYGRYKDPQDENKIGVDGIQQFCDDLSLDPASISVLVIAWKFRAATQCEFSRKEFLDGMTELGCDSMEKLKALLPRLEQELKDTAKFKDFYQFTFTFAKNPGQKGLGSPPFLNVKALHH

SEQ ID NO: 746081 - protein, 246 aa, Homo sapiens
EAGGAGEMHKLKSSQKDKVRQFMACTQAGERTAIYCLTQNEWRLDEATDSFFQNPDSLHRESMRNAVDKKKLERLYGRYKDPQDENKIGVDGIQQFCDDLSLDPASISVLVIAWKFRAATQCEFSRKEFLDGMTELGCDSMEKLKALLPRLEQELKDTAKFKDFYQFTFTFAKNPGQKGLDLEMAVAYWKLVLSGRFKFLDLWNTFLMMIADDMSNYDEEGAWPVLIDDFVEYARPVVTGGKRSLF

SEQ ID NO: 746082 - protein, 193 aa, Homo sapiens; identical to SEQ ID NO: 746080

SEQ ID NO: 746083 - protein, 110 aa, Homo sapiens [sequence omitted]

SEQ ID NO: 746084 - protein, 103 aa, Homo sapiens [sequence omitted]

SEQ ID NO: 746085 - protein, 646 aa, Homo sapiens
RNRFTEIPSDVWLFAPLETLNLYHNCIKTIPEAIKNLQMLTYLNISRNLLSTLPKYLFDLPLKVLVVSNNKLVSIPEEIGKLKDLMELDISCNEIQVLPQQMGKLHSLRELNIRRNNLHVLPDELGDLPLVKLDFSCNKVTEIPVCYRKLHHLQVIILDNNPLQVPPAQICLKGKVHIFKYLNIQACCRMDKKPDSLDLPSLSKRMPSQPLTDSMEDFYPNKNHGPDSGIGSDNGEKRLSTTEPSDDDTVSLHSQVSESNREQTSRNDSHIIGSKTDSQKDQEVYDFVDPNTEDVAVPEQGNAHIGSFVSFFKGKEKCSEKSRKNEELGDEKRLEKEQLLAEEEDDDLKEVTDLRKIAAQLLQQEQKNRILNHSTSVMRNKPKQTVECEKSVSADEVNSPLSPLTWQPLENQKDQIDEQPWPESHPIIWQSEERRRSKQIRKEYFKYKSMRKSSSGNENDEQDSDNANMSTQSPVSSEEYDRTDGFSHSPFGLKPRSAFSRSSRQEYGAADPGFTMRRKMEHLREEREQIRQLRNNLESRLKVILPDDIGAALMDGVVLCHLANHIRPRSVASIHVPSPAVPKLSMAKCRRNVENFLDACKKLGVSQERLCLPHHILEERGLVKVGVTVQALLELPTTKASQLSVA

SEQ ID NO: 746086 - protein, 121 aa, Homo sapiens
SAQPRIMPLNSQELTPSCFAAYSPVLSCSFLIVNIPQYQLSETWDLAFHYHIQIKGVYLFILFIFFLRRILALSPRLECNGAISAHCNLRLQGSSDSLASASQVAGIIDTRHHAWLISVFL

SEQ ID NO: 746087 - protein, 131 aa, Homo sapiens
MTLGAAAQLRLRMEDPGRLLTLPTAARLWLCTKDPPRQAFLPCGQRHSWGCAPQDPAGHSYPADCGTSVARSFYGVDSSTAAAAHYGPRRAFLPCRLWQGGGGAPTMQASVLPCDWQHRLRSQDSGGSPYS

SEQ ID NO: 746088 - protein, 129 aa, Homo sapiens
DQLSGSHSLLQLFLHFQQIISDVLLIPFIPQTAVITMSLIILFCYNNLCYHLFSPDHTILTTFSWSPFCLSLIHTDARMIFRKHKYDPETPSLLKIQKISRAQWHTSVISGAQEAETGESLEPGSRRLQ

SEQ ID NO: 746089 - protein, 486 aa, Homo sapiens
MSSSSPPAGAASAAISASEKVDGFTRKSVRKAQRQKRSQGSSQFRSQGSQAELHPLPQLKDATSNEQQELFCQKLQQCCILFDFMDSVSDLKSKEIKRATLNELVEYVSTNRGVIVESAYSDIVKMISANIFRTLPPSDNPDFDPEEDEPTLEASWPHIQLVYEFFLRFLESPDFQPSIAKRYIDQKFVQQLLELFDSEDPRERDFLKTVLHRIYGKFLGLRAFIRKQINNIFLRFIYETEHFNGVAELLEILGSIINGFALPLKAEHKQFLMKVLIPMHTAKGLALFHAQLAYCVVQFLEKDTTLTEPVIRGLLKFWPKTCSQKEVMFLGEIEEILDVIEPTQFKKIEEPLFKQISKCVSSSHFQVAERALYFWNNEYILSLIEENIDKILPIMFASLYKISKEHWNPTIVALVYNVLKTLMEMNGKLFDDLTSSYKAERQREKKKELEREELWKKLEELKLKKALEKQNSAYNMHSILSNTSAE

SEQ ID NO: 746090 - protein, 260 aa, Homo sapiens
ADRSRSYLRFIYETEHFNGVAELLEILGSIINGFALPLKAEHKQFLMKVLIPMHTAKGLALFHAQLAYCVVQFLEKDTTLTEPVIRGLLKFWPKTCSQKEVMFLGEIEEILDVIEPTQFKKIEEPLFKQISKCVSSSHFQVAERALYFWNNEYILSLIEENIDKILPIMFASLYKISKEHWNPTIVALVYNVLKTLMEMNGKLFDDLTSSYKAERQREKKKELEREELWKKLEELKLKKALEKQNSAYNMHSILSNTSAE

SEQ ID NO: 746091 - protein, 486 aa, Homo sapiens; identical to SEQ ID NO: 746089

SEQ ID NO: 746092 - protein, 486 aa, Homo sapiens; identical to SEQ ID NO: 746089

SEQ ID NO: 746093 - protein, 402 aa, Homo sapiens
MDSVSDLKSKEIKRATLNELVEYVSTNRGVIVESAYSDIVKMISANIFRTLPPSDNPDFDPEEDEPTLEASWPHIQLVYEFFLRFLESPDFQPSIAKRYIDQKFVQQLLELFDSEDPRERDFLKTVLHRIYGKFLGLRAFIRKQINNIFLRFIYETEHFNGVAELLEILGSIINGFALPLKAEHKQFLMKVLIPMHTAKGLALFHAQLAYCVVQFLEKDTTLTEPVIRGLLKFWPKTCSQKEVMFLGEIEEILDVIEPTQFKKIEEPLFKQISKCVSSSHFQVAERALYFWNNEYILSLIEENIDKILPIMFASLYKISKEHWNPTIVALVYNVLKTLMEMNGKLFDDLTSSYKAERQREKKKELEREELWKKLEELKLKKALEKQNSAYNMHSILSNTSAE

SEQ ID NO: 746094 - protein, 169 aa, Homo sapiens
FLQLTLNTCDGCWQEALRPLSLEMPYYSQWHWEGLEELFRGPSGPAPVFRGPSRPAPVFSGPSGSFPVFSRHSGSAPGFSGPSGSGPVLTLKGSECAFQKLVSENILAKALSDRHYCSAPQMVHQELFVQVAERQGCITFTPAFVFVSWIALRSLQRPCVMEGRKSARF

SEQ ID NO: 746095 - protein, 322 aa, Homo sapiens
MGQNQTSISDFLLLGLPIQPEQQNLCYALFLAMYLTTLLGNLLIIVLIRLDSHLHTPVYLFLSNLSFSDLCFSSVTMPKLLQNMQNQDPSIPYADCLTQMYFFLYFSDLESFLLVAMAYDRYVAICFPMHYTAICFLLHYTAIMSPMLCLSVVALSWVLTTFHAMLHTLLMARLCFCADNVIPHFFCDMSALLKLACSDTRVNEWVIFIMGGLILVIPFLLILGSYARIVSSILKVPSSKGICKAFSTCGSHLSVVSLFYGTVIGLYLCPSANSSTLKDTVMAMMYTVVTPMLTPFIYSLRNRDMKGALERVICKRKNPFLL

SEQ ID NO: 746096 - protein, 377 aa, Homo sapiens
MAADLGPWNDTINGTWDGDELGYRCRFNEDFKYVLLPVSYGVVCVLGLCLNAVALYIFLCRLKTWNASTTYMFHLAVSDALYAASLPLLVYYYARGDHWPFSTVLCKLVRFLFYTNLYCSILFLTCISVHRCLGVLRPLRSLRWGRARYARRVAGAVWVLVLACQAPVLYFVTTSARGGRVTCHDTSAPELFSRFVAYSSVMLGLLFAVPFAVILVCYVLMARRLLKPAYGTSGGLPRAKRKSVRTIAVVLAVFALCFLPFHVTRTLYYSFRSLDLSCHTLNAINMAYKVTRPLASANSCLDPVLYFLAGQRLVRFARDAKPPTGPSPATPARRRLGLRRSDRTDMQRIEDVLGSSEDSRRTESTPAGSENTKDIRL

SEQ ID NO: 746097 - protein, 377 aa, Homo sapiens; identical to SEQ ID NO: 746096

SEQ ID NO: 746098 - protein, 377 aa, Homo sapiens; identical to SEQ ID NO: 746096

SEQ ID NO: 746099 - protein, 377 aa, Homo sapiens; identical to SEQ ID NO: 746096

SEQ ID NO: 746100 - protein, 74 aa, Homo sapiens
GEDATCKGHRGRGEPNLGLQTGRQEVSVDKLLSDVLLWPHSNRGGERLLTGTGRLLRMMNVFRSEMSGDGCTTS

SEQ ID NO: 746101 - protein, 124 aa, Homo sapiens
MPTPTFLAKLSEAFVTWRHCSCQLRSWKTWPLLSCPGPGPSCQLDVGISAPSRTPQPGKMPGRLEKRRDGGTPCVATEQHTQLFSATMWERNDASVELPMAGAAPYSILTFTPNYSVAMAKGIF

SEQ ID NO: 746102 - protein, 124 aa, Homo sapiens; identical to SEQ ID NO: 746101

SEQ ID NO: 746103 - protein, 74 aa, Homo sapiens; identical to SEQ ID NO: 746100

SEQ ID NO: 746104 - protein, 124 aa, Homo sapiens; identical to SEQ ID NO: 746101

SEQ ID NO: 746105 - protein, 162 aa, Homo sapiens
MTTQAPTFTQPLQSVVVLEGSTATFEAHISGFPVPEVSWFRDGQVISTSTLPGVQISFSDGRAKLTIPAVTKANSGRYSLKATNGSGQATSTAELLVKAETAPPNFVQRLQSMTVRQGSQVRLQVRVTGIPTPVVEVLPGMEPKSRAPLISKFHKKATSTAY

SEQ ID NO: 746106 - protein, 1211 aa, Homo sapiens
MDPPAGAARRLLCPALLLLLLLLPPPLLPPPPPPANARLAAAADPPGGPLGHGAERILAVPVRTDAQGRLVSHVVSAATSRAGVRARRAAPVRTPSFPGGNEEEPGSHLFYNVTVFGRDLHLRLRPNARLVAPGATMEWQGEKGTTRVEPLLGSCLYVGDVAGLAEASSVALSNCDGLAGLIRMEEEEFFIEPLEKGLAAQEAEQGRVHVVYRRPPTSPPLGGPQALDTGASLDSLDSLSRALGVLEEHANSSRRRARRHAADDDYNIEVLLGVDDSVVQFHGKEHVQKYLLTLMNIVNEIYHDESLGAHINVVLVRIILLSYGKSMSLIEIGNPSQSLENVCRWAYLQQKPDTGHDEYHDHAIFLTRQDFGPSGMQGYAPVTGMCHPVRSCTLNHEDGFSSAFVVAHETGHVLGMEHDGQGNRCGDEVRLGSIMAPLVQAAFHRFHWSRCSQQELSRYLHSYDCLLDDPFAHDWPALPQLPGLHYSMNEQCRFDFGLGYMMCTAFRTFDPCKQLWCSHPDNPYFCKTKKGPPLDGTMCAPGKHCFKGHCIWLTPDILKRDGSWGAWSPFGSCSRTCGTGVKFRTRQCDNPHPANGGRTCSGLAYDFQLCSRQDCPDSLADFREEQCRQWDLYFEHGDAQHHWLPHEHRDAKERCHLYCESRETGEVVSMKRMVHDGTRCSYKDAFSLCVRGDCRKVGCDGVIGSSKQEDKCGVCGGDNSHCKVVKGTFTRSPKKHGYIKMFEIPAGARHLLIQEVDATSHHLAVKNLETGKFILNEENDVDASSKTFIAMGVEWEYRDEDGRETLQTMGPLHGTITVLVIPVGDTRVSLTYKYMIHEDSLNVDDNNVLEEDSVVYEWALKKWSPCSKPCGGGSQFTKYGCRRRLDHKMVHRGFCAALSKPKAIRRACNPQECSQPVWVTGEWEPCSQTCGRTGMQVRSVRCIQPLHDNTTRSVHAKHCNDARPESRRACSRELCPGRWRAGPWSQCSVTCGNGTQERPVPCRTADDSFGICQEERPETARTCRLGPCPRNISDPSKKSYVVQWLSRPDPDSPIRKISSKGHCQGDKSIFCRMEVLSRYCSIPGYNKLSCKSCNLYNNLTNVEGRIEPPPGKHNDIDVFMPTLPVPTVAMEVRPSPSTPLEVPLNASSTNATEDHPETNAVDEPYKIHGLEDEVQPPNLIPRRPSPYEKTRNQRIQELIDEMRKKEMLGKF

SEQ ID NO: 746107 - protein, 566 aa, Homo sapiens
MDPPAGAARRLLCPALLLLLLLLPPPLLPPPPPPANARLAAAADPPGGPLGHGAERILAVPVRTDAQGRLVSHVVSAATSRAGVRARRAAPVRTPSFPGGNEEEPGSHLFYNVTVFGRDLHLRLRPNARLVAPGATMEWQGEKGTTRVEPLLGSCLYVGDVAGLAEASSVALSNCDGLAGLIRMEEEEFFIEPLEKGLAAQEAEQGRVHVVYRRPPTSPPLGGPQALDTGASLDSLDSLSRALGVLEEHANSSRRRARRHAADDDYNIEVLLGVDDSVVQFHGKEHVQKYLLTLMNIVNEIYHDESLGAHINVVLVRIILLSYGKSMSLIEIGNPSQSLENVCRWAYLQQKPDTGHDEYHDHAIFLTRQDFGPSGMQGYAPVTGMCHPVRSCTLNHEDGFSSAFVVAHETGHVLGMEHDGQGNRCGDEVRLGSIMAPLVQAAFHRFHWSRCSQQELSRYLHSYDCLLDDPFAHDWPALPQLPGLHYSMNEQCRFDFGLGYMMCTAFRTFDPCKQLWCSHPDNPYFCKTKKGPPLDGTMCAPGKFRPGAVAHACYPSTLGGQGRWIA

SEQ ID NO: 746108 - protein, 113 aa, Homo sapiens
SEKMTICVSVSEASTTHHCVETGSQEASAIYFTSGTSGLPKMAEHSYSSLGLKAKMDAGWTGLQASDIMWTISDTGWILNILGSLMEPWALGACTFVHLLPKFDPLVILKVFR

SEQ ID NO: 746109 - protein, 389 aa, Homo sapiens
SEKMTICVSVSEASTTHHCVETGSQEASAIYFTSGTSGLPKMAEHSYSSLGLKAKMDAGWTGLQASDIMWTISDTGWILNILGSLMEPWALGACTFVHLLPKFDPLVILKTLSSYPIKSMMGAPIVYRMLLQQDLSSYKFPHLQNCVTVGESLLPETLENWRAQTGLDIRESYGQTETGLTCMVSKTMKIKPGYMGTAASCYDVQVIDDKGNVLPPGTEGDIGIRVKPIRPIGIFSGYVENPDKTAANIRGDFWLLGDRGIKDEDGYFQFMGRADDIINSSGYRIGPSEVENALMKHPAVVETAVISSPDPVRGEVVKAFVVLASQFLSHDPEQLTKELQQHVKSVTAPYKYPRKIEFVLNLPKTVTGKIQRTKLRDKEWKMSGKARAQ

SEQ ID NO: 746110 - protein, 389 aa, Homo sapiens; identical to SEQ ID NO: 746109

SEQ ID NO: 746111 - protein, 389 aa, Homo sapiens; identical to SEQ ID NO: 746109

SEQ ID NO: 746112 - protein, 243 aa, Homo sapiens
SEKMTICVSVSEASTTHHCVETGSQEASAIYFTSGTSGLPKMAEHSYSSLGLKAKMDAGWTGLQASDIMWTISDTGWILNILGSLMEPWALGACTFVHLLPKFDPLVILKTLSSYPIKSMMGAPIVYRMLLQQDLSSYKFPHLQNCVTVGESLLPETLENWRAQTGLDIRESYGQTETGLTCMVSKTMKIKPGYMGTAASCYDVQVIDDKGNVLPPGTEGDIGIRVKPIRPIGIFSGYVVSSP

SEQ ID NO: 746113 - protein, 203 aa, Homo sapiens
SEKMTICVSVSEASTTHHCVETGSQEASAIYFTSGTSGLPKMAEHSYSSLGLKAKMDAGWTGLQASDIMWTISDTGWILNILGSLMEPWALGACTFVHLLPKFDPLVILKTLSSYPIKSMMGAPIVYRMLLQQDLSSYKFPHLQNCVTVGESLLPETLENWRAQTGLDIRESYGQTETVPVPRGTMGWVHFLGFKILFDNKNC

SEQ ID NO: 746114 - protein, 389 aa, Homo sapiens; identical to SEQ ID NO: 746109

SEQ ID NO: 746115 - protein, 389 aa, Homo sapiens; identical to SEQ ID NO: 746109

SEQ ID NO: 746116 - protein, 265 aa, Homo sapiens
SEKMTICVSVSEASTTHHCVETGSQEASAIYFTSGTSGLPKMAEHSYSSLGLKAKMDAGWTGLQASDIMWTISDTGWILNILGSLMEPWALGACTFVHLLPKFDPLVILKTLSSYPIKSMMGAPIVYRMLLQQDLSSYKFPHLQNCVTVGESLLPETLENWRAQTGLDIRESYGQTETGLTCMVSKTMKIKPGYMGTAASCYDVQVIDDKGNVLPPGTEGDIGIRVKPIRPIGIFSGYVVRNCAPPPLFPSEDGSTKRDEGGQMF

SEQ ID NO: 746117 - protein, 234 aa, Homo sapiens
MARGSAVAWAALGPLLWGCALGLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVLQYVDVICLNSYYSWYHDYGHLELIQLQLATQFENWYKKYQKPIIQSEYGAETIAGFHQDPPLMFTEGVPEKSARAGTIWVWIKNRRKICGWGAHLEFADFM

SEQ ID NO: 746118 - protein, 175 aa, Homo sapiens
MRGATSPSRPTSATWSRYPKGYFVQNTYFDFFNYAGLQRSVLLYTTPTTYIDDITVTTSVEQDSGLVNYQISVKGSNLFKLEVRLLDAENKVVANGTGTQGQLKVPGVSLWWPYLMHERPAYLYSSEVQLTAKTSLGPVSDFYTPPCEIRTCAVTKKQFLINWETFYFSRVPKHE

SEQ ID NO: 746119 - protein, 80 aa, Homo sapiens
AISGQGREAPESPAVGVGEPGPPADFFPWASPSWGPQEVKGQRAWGRRLGGRGNRSTLEGRGGLGRRRKGSCRALSRGKG

SEQ ID NO: 746120 - protein, 188 aa, Homo sapiens
MARGSAVAWAALGPLLWGCALGLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVWVNGVDTLEHEGGYLPFEADISNLVQVGPLPPGSESLSPSTTHSPPPPCHQGPSNT

SEQ ID NO: 746121 - protein, 162 aa, Homo sapiens
MPSWYPKGYFVQNTYFDFFNYAGLQRSVLLYTTPTTYIDDITVTTSVEQDSGLVNYQISVKGSNLFKLEVRLLDAENKVVANGTGTQGQLKVPGVSLWWPYLMHERPAYLYSSEVQLTAKTSLGPVSDFYTLPGEIRTCAVTKKQFLINWETFYFSRVPKHE

SEQ ID NO: 746122 - protein, 316 aa, Homo sapiens
MARGSAVAWAALGPLLWGCALGLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVWVNGVDTLEHEGGYLPFEATSATWSRYPKGYFVQNTYFDFFNYAGLQRSVLLYTTPTTYIDDITVTTSVEQDSGLVNYQISVKGSNLFKLEVRLLDAENKVVANGTGTQGQLKVPGVSLWWPYLMHERPAYLYSSEVQLTAKTSLGPVSDFYTPPCEIRTCAVTKKQFLINWETFYFSRVPKHE

SEQ ID NO: 746123 - protein, 90 aa, Homo sapiens
YPKGYFVQNTYFDFFNYAGLQRSVLLYTTPTTYIDDITVTTSVEQDSGEGFWEDPLSGAQGGSVCSLFGKLSQEKGAPSISTPSQIPFHL

SEQ ID NO: 746124 - protein, 109 aa, Homo sapiens
MSITDVLSADDIAAALQECQDPDTFEPQKFFQTSGLSKMSASQVKDVFRFIDNDQSGYLDEEELKFFLQKFESGARELTESETKSLMAAADNDGDGKIGAEEFQEMVHS

SEQ ID NO: 746125 - protein, 109 aa, Homo sapiens
SVPNSDVFIRNTRGPSEVIPAPGKLTWHGAPFCPGLFHPICPGPRACPVWSSLSCLVCHHVMLGWLVFAASLPKLTDVSARDHQLPSRMTVLSFKVQRLPFQSGPSPTS

SEQ ID NO: 746126 - protein, 309 aa, Homo sapiens
MRENNQSSTLEFILLGVTGQQEQEDFFYILFLFIYPITLIGNLLIVLAICSDVRLHNPMYFLLANLSLVDIFFSSVTIPKMLANHLLGSKSISFGGCLTQMYFMIALGNTDSYILAAMAYDRAVAISRPLHYTTIMSPRSCIWLIAGSWVIGNANALPHTLLTASLSFCGNQEVANFYCDITPLLKLSCSDIHFHVKMMYLGVGIFSVPLLCIIVSYIRVFSTVFQVPSTKGVLKAFSTCGSHLTVVSLYYGTVMGTYFRPLTNYSLKDAVITVMYTAVTPMLNPFIYSLRNRDMKAALRKLFNKRISS

SEQ ID NO: 746127 - protein, 176 aa, Homo sapiens
RSGARPSSASAAQPVIALRPSPAPSAPHGGWSRRGKEKVRLGVITNPSPEGEETGIQQRRAAAGRSHLEMESRPPPPPPTSSSSSSSSSHPGSLPKPLGLQPLPRPEVSFLTEYLRKLKACEGGGVEIAAASFPRIYLMGMCSRQDRIQKDIDVADPERSRAEDCLSAGVKAILKA

SEQ ID NO: 746128 - protein, 98 aa, Homo sapiens
MSVRGKAGKGLGKGGAKCHRKVLSDNIQGITKCTIRRLARHGGVKRILGLIYEETRRVFKVFLENVIWYAVTNTEHAKRKTVTAMAVVYVLKRQGRTL

SEQ ID NO: 746129 - protein, 99 aa, Homo sapiens [sequence omitted]

SEQ ID NO: 746130 - protein, 91 aa, Homo sapiens
LQREQDLRLINEGDVPHLPVNRAYSVNGALRSPNMDISSSPNIRLRRHSSQIEGVRQMHNNAPRSQMATERDLMAWSRRVVVNELNNGVSR

SEQ ID NO: 746131 - protein, 659 aa, Homo sapiens
QWKSHLRPTAEVPGVPSTRVHTAAGMAHYNFKKITVVPSAKDFIDLTLSKTQRKTPTVIHKHYQIHRIRHFYMRKVKFTQQNYHDRLSQILTDFPKLDDIHPFYADLMNILYDKDHYKLALGQINIAKNLVDNVAKDYVRLMKYGDSLYRCKQLKRAALGRMCTVIKRQKQSLEYLEQVRQHLSRLPTIDPNTRTLLLCGYPNVGKSSFINKVTRADVDVQPYAFTTKSLFVGHMDYKYLRWQVVDTPGILDHPLEDRNTIEMQAITALAHLRAAVLYVMDLSEQCGHGLREQLELFQNIRPLFINKPLIVVANKCDVKRIAELSEDDQKIFTDLQSEGFPVIETSTLTEEGVIKVKTEACDRLLAHRVETKMKGNKVNEVLNRLHLAIPTRRDDKERPPFIPEGVVARRKRMETEESRKKRERDLELEMGDDYILDLQKYWDLMNLSEKHDKIPEIWEGHNIADYIDPAIMKKLEELEKEEELRTAAGEYDSVSESEDEEMLEIRQLAKQIREKKKLKILESKEKNTQGPRMPRTAKKVQRTVLEKEMRSLGVDMDDKDDAHYAVQARRSRSITRKRKREDSAPPSSVARSGSCSRTPRDVSGLRDVKMVKKAKTMMKNAQKKMNRLGKKGEADRHVFDMKPKHLLSGKRKAGKKDRR

SEQ ID NO: 746132 - protein, 659 aa, Homo sapiens; identical to SEQ ID NO: 746131

SEQ ID NO: 746133 - protein, 659 aa, Homo sapiens; identical to SEQ ID NO: 746131

SEQ ID NO: 746134 - protein, 645 aa, Homo sapiens
QWKSHLRPTAEVPGVPSTRVHTAAGMAHYNFKKITVVPSAKDFIDLTLSKTQRKTPTVIHKHYQIHRIRHFYMRKVKFTQQNYHDRLSQILTDFPKLDDIHPFYADLMNILYDKDHYKLALGQINIAKNLVDNVAKDYVRLMKYGDSLYRCKQLKRAALGRMCTVIKRQKQSLEYLEQVRQHLSRLPTIDPNTRTLLLCGYPNVGKSSFINKVTRADVDVQPYAFTTKSLFVGHMDYKYLRWQVVDTPGILDHPLEDRNTIEMQAITALAHLRAAVLYVMDLSEQCGHGLREQLELFQNIRPLFINKPLIVVANKCDVKRIAELSEDDQKIFTDLQSEGFPVIETSTLTEEGVIKVKTEACDRLLAHRVETKMKGNKVNEVLNRLHLAIPTRRDDKERPPFIPEGVVARRKRMETEESRKKRERDLELEMGDDYILDLQKYWDLMNLSEKHDKIPEIWEGHNIADYIDPAIMKKLEELEKEEELRTAAGEYDSVSESEDEEMLEIRQLAKQIREKKKLKILESKEKNTQGPRMPRTAKKVQRTVLEKEMRSLGVDMDDKDDAHYAVQARRSPSSVARSGSCSRTPRDVSGLRDVKMVKKAKTMMKNAQKKMNRLGKKGEADRHVFDMKPKHLLSGKRKAGKKDRR

SEQ ID NO: 746135 - protein, 587 aa, Homo sapiens
MRKVKFTQQNYHDRLSQILTDFPKLDDIHPFYADLMNILYDKDHYKLALGQINIAKNLVDNVAKDYVRLMKYGDSLYRCKQLKRAALGRMCTVIKRQKQSLEYLEQVRQHLSRLPTIDPNTRTLLLCGYPNVGKSSFINKVTRADVDVQPYAFTTKSLFVGHMDYKYLRWQVVDTPGILDHPLEDRNTIEMQAITALAHLRAAVLYVMDLSEQCGHGLREQLELFQNIRPLFINKPLIVVANKCDVKRIAELSEDDQKIFTDLQSEGFPVIETSTLTEEGVIKVKTEACDRLLAHRVETKMKGNKVNEVLNRLHLAIPTRRDDKERPPFIPEGVVARRKRMETEESRKKRERDLELEMGDDYILDLQKYWDLMNLSEKHDKIPEIWEGHNIADYIDPAIMKKLEELEKEEELRTAAGEYDSVSESEDEEMLEIRQLAKQIREKKKLKILESKEKNTQGPRMPRTAKKVQRTVLEKEMRSLGVDMDDKDDAHYAVQARRSRSITRKRKREDSAPPSSVARSGSCSRTPRDVSGLRDVKMVKKAKTMMKNAQKKMNRLGKKGEADRHVFDMKPKHLLSGKRKAGKKDRR

SEQ ID NO: 746136 - protein, 659 aa, Homo sapiens; identical to SEQ ID NO: 746131

SEQ ID NO: 746137 - protein, 390 aa, Homo sapiens
RPAYYYKNFRPRRPEQCGHGLREQLELFQNIRPLFINKPLIVVANKCDVKRIAELSEDDQKIFTDLQSEGFPVIETSTLTEEGVIKVKTEACDRLLAHRVETKMKGNKVNEVLNRLHLAIPTRRDDKERPPFIPEGVVARRKRMETEESRKKRERDLELEMGDDYILDLQKYWDLMNLSEKHDKIPEIWEGHNIADYIDPAIMKKLEELEKEEELRTAAGEYDSVSESEDEEMLEIRQLAKQIREKKKLKILESKEKNTQGPRMPRTAKKVQRTVLEKEMRSLGVDMDDKDDAHYAVQARRSRSITRKRKREDSAPPSSVARSGSCSRTPRDVSGLRDVKMVKKAKTMMKNAQKKMNRLGKKGEADRHVFDMKPKHLLSGKRKAGKKDRR

SEQ ID NO: 746138 - protein, 323 aa, Homo sapiens
GCWSLLQESFRLTEEGVIKVKTEACDRLLAHRVETKMKGNKVNEVLNRLHLAIPTRRDDKERPPFIPEGVVARRKRMETEESRKKRERDLELEMGDDYILDLQKYWDLMNLSEKHDKIPEIWEGHNIADYIDPAIMKKLEELEKEEELRTAAGEYDSVSESEDEEMLEIRQLAKQIREKKKLKILESKEKNTQGPRMPRTAKKVQRTVLEKEMRSLGVDMDDKDDAHYAVQARRSRSITRKRKREDSAPPSSVARSGSCSRTPRDVSGLRDVKMVKKAKTMMKNAQKKMNRLGKKGEADRHVFDMKPKHLLSGKRKAGKKDRR

SEQ ID NO: 746139 - protein, 555 aa, Homo sapiens
QWKSHLRPTAEVPGVPSTRVHTAAGMAHYNFKKITVVPSAKDFIDLTLSKTQRKTPTVIHKHYQIHRIRHFYMRKVKFTQQNYHDRLSQILTDFPKLDDIHPFYADLMNILYDKDHYKLALGQINIAKNLVDNVAKDYVRLMKYGDSLYRCKQLKRAALGRMCTVIKRQKQSLEYLEQVRQHLSRLPTIDPNTRTLLLCGYPNVGKSSFINKVTRADVDVQPYAFTTKSLFVGHMDYKYLRWQVVDTPGILDHPLEDRNTIEMQAITALAHLRAAVLYVMDLSEQCGHGLREQLELFQNIRPLFINKPLIVVANKCDVKRIAELSEDDQKIFTDLQSEGFPVIETSTLTEEGVIKVKTEACDRLLAHRVETKMKGNKVNEVLNRLHLAIPTRRDDKERPPFIPEGVVARRKRMETEESRKKRERDLELEMGDDYILDLQKYWDLMNLSEKHDKIPEIWEGHNIADYIDPAIMKKLEELEKEEELRTAAGEYDSVSESEDEEMLEIRQLAKQIREKKKLKILESKEKNTQGPRMPRTAKKKGTGFEPGDTMTTTGK

SEQ ID NO: 746140 - protein, 158 aa, Homo sapiens [sequence omitted]

SEQ ID NO: 746141 - protein, 452 aa, Homo sapiens
QWKSHLRPTAEVPGVPSTRVHTAAGMAHYNFKKITVVPSAKDFIDLTLSKTQRKTPTVIHKHYQIHRIRHFYMRKVKFTQQNYHDRLSQILTDFPKLDDIHPFYADLMNILYDKDHYKLALGQINIAKNLVDNVAKDYVRLMKYGDSLYRCKQLKRAALGRMCTVIKRQKQSLEYLEQVRQHLSRLPTIDPNTRTLLLCGYPNVGKSSFINKVTRADVDVQPYAFTTKSLFVGHMDYKYLRWQVVDTPGILDHPLEDRNTIEMQAITALAHLRAAVLYVMDLSEQCGHGLREQLELFQNIRPLFINKPLIVVANKCDVKRIAELSEDDQKIFTDLQSEGFPVIETSTLTEEGVIKVKTEACDRLLAHRVETKMKGNKVNEVLNRLHLAIPTRRDDKERPPFIPEGVVARRKRMETEESRKKRERDLELEMGDDYILDLQKYWDYRRELLRPA

SEQ ID NO: 746142 - protein, 460 aa, Homo sapiens
QWKSHLRPTAEVPGVPSTRVHTAAGMAHYNFKKITVVPSAKDFIDLTLSKTQRKTPTVIHKHYQIHRIRHFYMRKVKFTQQNYHDRLSQILTDFPKLDDIHPFYADLMNILYDKDHYKLALGQINIAKNLVDNVAKDYVRLMKYGDSLYRCKQLKRAALGRMCTVIKRQKQSLEYLEQVRQHLSRLPTIDPNTRTLLLCGYPNVGKSSFINKVTRADVDVQPYAFTTKSLFVGHMDYKYLRWQVVDTPGILDHPLEDRNTIEMQAITALAHLRAAVLYVMDLSEQCGHGLREQLELFQNIRPLFINKPLIVVANKCDVKRIAELSEDDQKIFTDLQSEGFPVIETSTLTEEGVIKVKTEACDRLLAHRVETKMKGNKVNEVLNRLHLAIPTRRDDKVRRPLGQPWAHSTVSRCCLRAFSRSLPSSFTHSQVDIVGGPQFHLLAYIKDREGEESAERHMAP

SEQ ID NO: 746143 - protein, 278 aa, Homo sapiens
MLLEIYGFPTRRDDKERPPFIPEGVVARRKRMETEESRKKRERDLELEMGDDYILDLQKYWDLMNLSEKHDKIPEIWEGHNIADYIDPAIMKKLEELEKEEELRTAAGEYDSVSESEDEEMLEIRQLAKQIREKKKLKILESKEKNTQGPRMPRTAKKVQRTVLEKEMRSLGVDMDDKDDAHYAVQARRSRSITRKRKREDSAPPSSVARSGSCSRTPRDVSGLRDVKMVKKAKTMMKNAQKKMNRLGKKGEADRHVFDMKPKHLLSGKRKAGKKDRR

SEQ ID NO: 746144 - protein, 548 aa, Homo sapiens
QWKSHLRPTAEVPGVPSTRVHTAAGMAHYNFKKITVVPSAKDFIDLTLSKTQRKTPTVIHKHYQIHRIRHFYMRKVKFTQQNYHDRLSQILTDFPKLDDIHPFYADLMNILYDKDHYKLALGQINIAKNLVDNVAKDYVRLMKYGDSLYRCKQLKRAALGRMCTVIKRQKQSLEYLEQVRQHLSRLPTIDPNTRTLLLCGYPNVGKSSFINKVTRADVDVQPYAFTTKSLFVGHMDYKYLRWQVVDTPGILDHPLEDRNTIEMQAITALAHLRAAVLYVMDLSEQCGHGLREQLELFQNIRPLFINKPLIVVANKCDVKRIAELSEDDQKIFTDLQSEGFPVIETSTLTEEGVIKVKTEACDRLLAHRVETKMKGNKVNEVLNRLHLAIPTRRDDKERPPFIPEGVVARRKRMETEESRKKRERDLELEMGDDYILDLQKYWDLMNLSEKHDKIPEIWEGHNIADYIDPAIMKKLEELEKEEELRTAAGEYDSVSESEDEEMLEIRQLAKQIREKKKLKILESKEKNTQGPRMPRTAKKSLKRHGGAG

SEQ ID NO: 746145 - protein, 478 aa, Homo sapiens
QWKSHLRPTAEVPGVPSTRVHTAAGMAHYNFKKITVVPSAKDFIDLTLSKTQRKTPTVIHKHYQIHRIRHFYMRKVKFTQQNYHDRLSQILTDFPKLDDIHPFYADLMNILYDKDHYKLALGQINIAKNLVDNVAKDYVRLMKYGDSLYRCKQLKRAALGRMCTVIKRQKQSLEYLEQVRQHLSRLPTIDPNTRTLLLCGYPNVGKSSFINKVTRADVDVQPYAFTTKSLFVGHMDYKYLRWQVVDTPGILDHPLEDRNTIEMQAITALAHLRAAVLYVMDLSEQCGHGLREQLELFQNIRPLFINKPLIVVANKCDVKRIAELSEDDQKIFTDLQSEGFPVIETSTLTEEGVIKVKTEACDRLLAHRVETKMKGNKVNEVLNRLHLAIPTRRDDKERPPFIPEGVVARRKRMETEESRKKRERDLELEMGDDYILDLQKYWDLMNLSEKHDKIPEIWEGHNIADYIDPAIMKVCVTF

SEQ ID NO: 746146 - protein, 74 aa, Homo sapiens
LAGALLQICVVFMMAGVPPWSRVCYRRGGRVAVTHVVAQTAWPAGFKVHWFPNVILLMRIVWTLPDMLLAPPVT

SEQ ID NO: 746147 - protein, 312 aa, Homo sapiens
MALRPEDPSSGFRHGNVVAFIIEKMARHTKGPEFYFENISLSWEEVEDKLRAILEDSEVPSEVKEACTWGSLALGVRFAHRQGQLQNRRVQWLQGFAKLHRSAALVLASNLTELKEQQEMECNEATFQLQLTETSLAEVQRERDMLRWKLFHAELAPPQGQGQATVFPGLATAGGDWTEGAGEQEKEAVAAAGAAGGKGEERYAEAGPAPAEVLQGLGGGFRQPLGAIVAGKLHLCGAEGERSQVSTNSHVCLLWAWVHSLTGASSCPAPYLIHILIPMPFVRLLSHTQYTPFTSKGHRTGSNSDAFQLGGL

SEQ ID NO: 746148 - protein, 229 aa, Homo sapiens
MPCAQRSWLANLSVVAQLLNFGALCYGRQPQPGPVRFPDRRQEHFIKGLPEYHVVGPVRVDASGHFLSYGLHYPITSSRRKRDLDGSEDWVYYRISHEEKDLFFNLTVNQGFLSNSYIMEKRYGNLSHVKMMASSAPLCHLSGTVLQQGTRVGTAALSACHGLTGFFQLPHGDFFIEPVKKHPLVEGGYHPHIVYRRQKVPETKEPTCGLKGIVTHMSSWVEESVLFFW

SEQ ID NO: 746149 - protein, 229 aa, Homo sapiens; identical to SEQ ID NO: 746148

SEQ ID NO: 746150 - protein, 170 aa, Homo sapiens
PQQVFGDLDQVRMTSEGSDCRCKCIMRPLSKDACSRVRSGRARVEDFYTVETVSSGTDCRCSCTAPPSSLNPCENEWKMEKLKKQAPELLKLQSMVDLLEGTLYSMDLMKVHAYVHKVASQMNTLEESIKANLSRENEVVKDSVRHLSEQLRHYENHSAIMLGIKKELSR

SEQ ID NO: 746151 - protein, 106 aa, Homo sapiens
PQQVFGDLDQVRMTSEGSDCRCKCIMRPLSKDACSRVRSGRARVEDFYTVETVSSGTDCRCSCTAPPSSLNPCENEWKMEKLKKQAPELLKLHSSLGNRVRLRLKK

SEQ ID NO: 746152 - protein, 97 aa, Homo sapiens
PQQVFGDLDQVRMTSEGSDCRCKCIMRPLSKDACSRVRSGRARVEDFYTVETVSSGTDCRCSCTAPPSSLNPCENEWKMEKLKKQAPELLKGCSLYS

SEQ ID NO: 746153 - protein, 85 aa, Homo sapiens
QGPRTRAPKRPALGELTVCVPPATDLTVGKIYAAMMIMEYYRQSKAKKLQAMREEQVRCSPLWGHLGWGQWLACHHGNQLEYEGG

SEQ ID NO: 746154 - protein, 87 aa, Homo sapiens
MDLPVADDNTVHFNSTLMALIRTALDIKIAKGGADKQQMDAELRKEMMAIWPNLSQKTLDLLVTPHKCEELSPALGSNPPGQMEGEG

SEQ ID NO: 746155 - protein, 110 aa, Homo sapiens
MVTPLPPSPQNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFR

SEQ ID NO: 746156 - protein, 432 aa, Homo sapiens
MARFGDEMPARYGGGGSGAAAGVVVGSGGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAGEALSSWGPGMEIPGHGVQRESCSLEKAKLGGL

SEQ ID NO: 746157 - protein, 77 aa, Homo sapiens
RASIKSAKLENSTFFHKKERRMRFYIRRMVKTQAFYWTVLSLVALNTLCVAIVHYNQPEWLSDFLCEYHPAPPLPTP

SEQ ID NO: 746158 - protein, 217 aa, Homo sapiens
EAEGCRYQFRVALLGDAAVGKTSLLRSYVAGAPGAPEPEPEPEPTVGAECYRRALQLRAGPRVKLQLWDTAGHERFRCITRSFYRNVVGVLLVFDVTNRKSFEHIQDWHQEVMATQGPDKVIFLLVGHKSDLQSTRCVSAQEAEELAASLGMAFVETSVKNNCNVDLAFDTLADAIQQALQQGDIKLEEGWGGVRLIHKTQIPRSPSRKQHSGPCQC

SEQ ID NO: 746159 - protein, 105 aa, Homo sapiens
MATQGPDKVIFLLVGHKSDLQSTRCVSAQEAEELAASLGMAFVETSVKNNCNVDLAFDTLADAIQQALQQGDIKLEEGWGGVRLIHKTQIPRSPSRKQHSGPCQC

SEQ ID NO: 746160 - protein, 217 aa, Homo sapiens; identical to SEQ ID NO: 746158

SEQ ID NO: 746161 - protein, 784 aa, Homo sapiens
MASLDDPGEVREGFLCPLCLKDLQSFYQLHSHYEEEHSGEDRDVKGQIKSLVQKAKKAKDRLLKREGDDRAESGTQGYESFSYGGVDPYMWEPQELGAVRSHLSDFKKHRAARIDHYVVEVNKLIIRLEKLTAFDRTNTESAKIRAIEKSVVPWVNDQDVPFCPDCGNKFSIRNRRHHCRLCGSIMCKKCMELISLPLANKLTSASKESLSTHTSPSQSPNSVHGSRRGSISSMSSVSSVLDEKDDDRIRCCTHCKDTLLKREQQIDEKEHTPDIVKLYEKLRLCMEKVDQKAPEYIRMAASLNAGETTYSLEHASDLRVEVQKVYELIDALSKKILTLGLNQDPPPHPSNLRLQRMIRYSATLFVQEKLLGLMSLPTKEQFEELKKKRKEEMERKRAVERQAALESQRRLEERQSGLASRAANGEVASLRRGPAPLRKAEGWLPLSGGQGQSEDSDPLLQQIHNITSFIRQAKAAGRMDEVRTLQENLRQLQDEYDQQQTEKAIELSRRQAEEEDLQREQLQMLRERELEREREQFRVASLHTRTRSLDFREIGPFQLEPSREPRTHLAYALDLGSSPVPSSTAPKTPSLSSTQPTRVWSGPPAVGQERLPQSSMPQQHEGPSLNPFDEEDLSSPMEEATTGPPAAGVSLDPSARILKEYNPFEEEDEEEEAVAGNPFIQPDSPAPNPFSEEDEHPQQRLSSPLVPGNPFEEPTCINPFEMDSDSGPEAEEPIEEELLLQQIDNIKAYIFDAKQCGRLDEVEVLTENLRELKHTLAKQKGGTD

SEQ ID NO: 746162 - protein, 733 aa, Homo sapiens
FFGERRGLAMLTNLLLKFTGIRGKVETRLPQRNYKSFVSLPSFPLGAVRSHLSDFKKHRAARIDHYVVEVNKLIIRLEKLTAFDRTNTESAKIRAIEKSVVPWVNDQDVPFCPDCGNKFSIRNRRHHCRLCGSIMCKKCMELISLPLANKLTSASKESLSTHTSPSQSPNSVHGSRRGSISSMSSVSSVLDEKDDDRIRCCTHCKDTLLKREQQIDEKEHTPDIVKLYEKLRLCMEKVDQKAPEYIRMAASLNAGETTYSLEHASDLRVEVQKVYELIDALSKKILTLGLNQDPPPHPSNLRLQRMIRYSATLFVQEKLLGLMSLPTKEQFEELKKKRKEEMERKRAVERQAALESQRRLEERQSGLASRAANGEVASLRRGPAPLRKAEGWLPLSGGQGQSEDSDPLLQQIHNITSFIRQAKAAGRMDEVRTLQENLRQLQDEYDQQQTEKAIELSRRQAEEEDLQREQLQMLRERELEREREQFRVASLHTRTRSLDFREIGPFQLEPSREPRTHLAYALDLGSSPVPSSTAPKTPSLSSTQPTRVWSGPPAVGQERLPQSSMPQQHEGPSLNPFDEEDLSSPMEEATTGPPAAGVSLDPSARILKEYNPFEEEDEEEEAVAGNPFIQPDSPAPNPFSEEDEHPQQRLSSPLVPGNPFEEPTCINPFEMDSDSGPEAEEPIEEELLLQQIDNIKAYIFDAKQCGRLDEVEVLTENLRELKHTLAKQKGGTD

SEQ ID NO: 746163 - protein, 784 aa, Homo sapiens; identical to SEQ ID NO: 746161

SEQ ID NO: 746164 - protein, 599 aa, Homo sapiens
MCKKCMELISLPLANKLTSASKESLSTHTSPSQSPNSVHGSRRGSISSMSSVSSVLDEKDDDRIRCCTHCKDTLLKREQQIDEKEHTPDIVKLYEKLRLCMEKVDQKAPEYIRMAASLNAGETTYSLEHASDLRVEVQKVYELIDALSKKILTLGLNQDPPPHPSNLRLQRMIRYSATLFVQEKLLGLMSLPTKEQFEELKKKRKEEMERKRAVERQAALESQRRLEERQSGLASRAANGEVASLRRGPAPLRKAEGWLPLSGGQGQSEDSDPLLQQIHNITSFIRQAKAAGRMDEVRTLQENLRQLQDEYDQQQTEKAIELSRRQAEEEDLQREQLQMLRERELEREREQFRVASLHTRTRSLDFREIGPFQLEPSREPRTHLAYALDLGSSPVPSSTAPKTPSLSSTQPTRVWSGPPAVGQERLPQSSMPQQHEGPSLNPFDEEDLSSPMEEATTGPPAAGVSLDPSARILKEYNPFEEEDEEEEAVAGNPFIQPDSPAPNPFSEEDEHPQQRLSSPLVPGNPFEEPTCINPFEMDSDSGPEAEEPIEEELLLQQIDNIKAYIFDAKQCGRLDEVEVLTENLRELKHTLAKQKGGTD

SEQ ID NO: 746165 - protein, 180 aa, Homo sapiens
MQAEGRGTGGSTGDADGPGGPGIPDGPGGNAGGPGEAGATGGRGPRGAGAARASGPGGGAPRGPHGGAASGLNGCCRCGARGPESRLLEFYLAMPFATPMEAELARRSLAQDAPPLPVPGVLLKEFTVSGNILTIRLTAADHRQLQLSISSCLQQLSLLMWITQCFLPVFLAQPPSGQRR

SEQ ID NO: 746166 - protein, 168 aa, Homo sapiens
MQAEGRGTGGSTGDADGPGGPGIPDGPGGNAGGPGEAGATGGRGPRGAGAARASGPGGGAPRGPHGGAASGLNGCCRCGARGPESRLLEFYLAMPFATPMEAELARRSLAQDAPPLPVPGVLLKEFTVSGNILTMSVQDQDRDGAWVGGGHSVAGWGLGSAYTPRSGC

SEQ ID NO: 746167 - protein, 108 aa, Homo sapiens
SPVSTVLESKGGPSSGAEGKGGACRVSREPLLVREGARSGLRTPAGTASPSSGGSRLIWAHEQEERRHPGLTSRPCSRLGAFWQTHLDLGDSLISCSHDLQGWQLSQA

SEQ ID NO: 746168 - protein, 128 aa, Homo sapiens
DNWNADPPLMMTNGGFIFSHRFLLEPQLLAALDSYCHNLRRKRNDSLFKSSFLQPFINRKIPGRERSESNMCQSLLSCTNSQDWARSCKPLYQLLSQGGPGYDDSSQQNSGNRKGKVLPKEQKIHFLK

SEQ ID NO: 746169 - protein, 651 aa, Homo sapiens
MARGSAVAWAALGPLLWGCALGLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVWVNGVDTLEHEGGYLPFEADISNLVQVGPLPSRLRITIAINNTLTPTTLPPGTIQYLTDTSKYPKGYFVQNTYFDFFNYAGLQRSVLLYTTPTTYIDDITVTTSVEQDSGLVNYQISVKGSNLFKLEVRLLDAENKVVANGTGTQGQLKVPGVSLWWPYLMHERPAYLYSLEVQLTAQTSLGPVSDFYTLPVGIRTVAVTKSQFLINGKPFYFHGVNKHEDADIRGKGFDWPLLVKDFNLLRWLGANAFRTSHYPYAEEVMQMCDRYGIVVIDECPGVGLALPQFFNNVSLHHHMQVMEEVVRRDKNHPAVVMWSVANEPASHLESAGYYLKMVIAHTKSLDPSRPVTFVSNSNYAADKGAPYVDVICLNSYYSWYHDYGHLELIQLQLATQFENWYKKYQKPIIQSEYGAETIAGFHQDPPLMFTEEYQKSLLEQYHLGLDQKRRKYVVGELIWNFADFMTEQSPTRVLGNKKGIFTRQRQPKSAAFLLRERYWKIANETRYPHSVAKSQCLENSPFT

SEQ ID NO: 746170 - protein, 437 aa, Homo sapiens
GFPRKREAIVRNRARSGKHSKLREETQWLVNYQISVKGSNLFKLEVRLLDAENKVVANGTGTQGQLKVPGVSLWWPYLMHERPAYLYSLEVQLTAQTSLGPVSDFYTLPVGIRTVAVTKSQFLINGKPFYFHGVNKHEDADIRGKGFDWPLLVKDFNLLRWLGANAFRTSHYPYAEEVMQMCDRYGIVVIDECPGVGLALPQFFNNVSLHHHMQVMEEVVRRDKNHPAVVMWSVANEPASHLESAGYYLKMVIAHTKSLDPSRPVTFVSNSNYAADKGAPYVDVICLNSYYSWYHDYGHLELIQLQLATQFENWYKKYQKPIIQSEYGAETIAGFHQDPPLMFTEEYQKSLLEQYHLGLDQKRRKYVVGELIWNFADFMTEQSPTRVLGNKKGIFTRQRQPKSAAFLLRERYWKIANETRYPHSVAKSQCLENSPFT

SEQ ID NO: 746171 - protein, 723 aa, Homo sapiens
MARGSAVAWAALGPLLWGCALGLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVWVNGVDTLEHEGGYLPFEADISNLVQVGPLPSRLRITIAINNTLTPTTLPPGTIQYLTDTSKYPKGYFVQNTYFDFFNYAGLQRSVLLYTTPTTYIDDITVTTSVEQDSGLVNYQISVKGSNLFKLEVRLLDAENKVVANGTGTQGQLKVPGVSLWWPYLMHERPAYLYSLEVQLTAQTSLGPVSDFYTLPVGIRTVAVTKSQFLINGKPFYFHGVNKHEDADVCWGSWVLVGAASGHPPLSPSLCPAVEGSSGQMRQMAPNGEGAHGVALQGPGSQRKCSFDRDRGHLALLSPEIRGKGFDWPLLVKDFNLLRWLGANAFRTSHYPYAEEVMQMCDRYGIVVIDECPGVGLALPQFFNNVSLHHHMQVMEEVVRRDKNHPAVVMWSVANEPASHLESAGYYLKMVIAHTKSLDPSRPVTFVSNSNYAADKGAPYVDVICLNSYYSWYHDYGHLELIQLQLATQFENWYKKYQKPIIQSEYGAETIAGFHQDPPLMFTEEYQKSLLEQYHLGLDQKRRKYVVGELIWNFADFMTEQSPTRVLGNKKGIFTRQRQPKSAAFLLRERYWKIANETRYPHSVAKSQCLENSPFT

SEQ ID NO: 746172 - protein, 301 aa, Homo sapiens
TKHKQKTTNKQKPKQKTHAYDLLRWLGANAFRTSHYPYAEEVMQMCDRYGIVVIDECPGVGLALPQFFNNVSLHHHMQVMEEVVRRDKNHPAVVMWSVANEPASHLESAGYYLKMVIAHTKSLDPSRPVTFVSNSNYAADKGAPYVDVICLNSYYSWYHDYGHLELIQLQLATQFENWYKKYQKPIIQSEYGAETIAGFHQDPPLMFTEEYQKSLLEQYHLGLDQKRRKYVVGELIWNFADFMTEQSPTRVLGNKKGIFTRQRQPKSAAFLLRERYWKIANETRYPHSVAKSQCLENSPFT

SEQ ID NO: 746173 - protein, 750 aa, Homo sapiens
MARGSAVAWAALGPLLWGCALGLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVWVNGVDTLEHEGGYLPFEADISNLVQVGPLPSRLRITIAINNTLTPTTLPPGTIQYLTDTSKYPKGYFVQNTYFDFFNYAGLQRSVLLYTTPTTYIDDITVTTSVEQDSGLVNYQISVKGSNLFKLEVRLLDAENKVVANGTGTQGQLKVPGVSLWWPYLMHERPAYLYSLEVQLTAQTSLGPVSDFYTLPVGIRTVAVTKSQFLINGKPFYFHGVNKHEDADVCWGSWVLWGLLLVTLHFRLPCVLQLRAAQGNEANGSKWRGGSWGGSPGSWLSEEVQLRQGQGSLGSAISKIRGKGFDWPLLVKDFNLLRWLGANAFRTSHYPYAEEVMQMCDRYGIVVIDECPGVGLALPVSLCCAPAPPAQPGGVTVTLCPFPPGPQQFFNNVSLHHHMQVMEEVVRRDKNHPAVVMWSVANEPASHLESAGYYLKMVIAHTKSLDPSRPVTFVSNSNYAADKGAPYVDVICLNSYYSWYHDYGHLELIQLQLATQFENWYKKYQKPIIQSEYGAETIAGFHQDPPLMFTEEYQKSLLEQYHLGLDQKRRKYVVGELIWNFADFMTEQSPTRVLGNKKGIFTRQRQPKSAAFLLRERYWKIANETRYPHSVAKSQCLENSPFT

SEQ ID NO: 746174 - protein, 201 aa, Homo sapiens
VTKQIVLGSHLTSIVLSGYPKSLDPSRPVTFVSNSNYAADKGAPYVDVICLNSYYSWYHDYGHLELIQLQLATQFENWYKKYQKPIIQSEYGAETIAGFHQDPPLMFTEEYQKSLLEQYHLGLDQKRRKYVVGELIWNFADFMTEQSPTRVLGNKKGIFTRQRQPKSAAFLLRERYWKIANETRYPHSVAKSQCLENSPFT

SEQ ID NO: 746175 - protein, 415 aa, Homo sapiens
MARGSAVAWAALGPLLWGCALGLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVWVNGVDTLEHEGGYLPFEADISNLVQVGPLPSRLRITIAINNTLTPTTLPPGTIQYLTDTSKYPKGYFVQNTYFDFFNYAGLQRSVLLYTTPTTYIDDITVTTSVEQDSGLVNYQISVKGSNLFKLEVRLLDAENKVVANGTGTQGQLKVPGVSLWWPYLMHERPAYLYSLEVQLTAQTSLGPVSDFYTLPVGIRTVAVTKSQFLINGKPFYFHGVNKHEDADIRGKGFDWPLLVKDFNLLRWLGANAFRTSHYPYAEEVMQMCDRYGIVVIDECPGVGLALP

SEQ ID NO: 746176 - protein, 651 aa, Homo sapiens; identical to SEQ ID NO: 746169

SEQ ID NO: 746177 - protein, 651 aa, Homo sapiens; identical to SEQ ID NO: 746169

SEQ ID NO: 746178 - protein, 651 aa, Homo sapiens; identical to SEQ ID NO: 746169

SEQ ID NO: 746179 - protein, 609 aa, Homo sapiens
MARGSAVAWAALGPLLWGCALGLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVWVNGVDTLEHEGGYLPFEADISNLVQVGPLPSRLRITIAINNTLTPTTLPPGTIQYLTDTSKYPKGYFVQNTYFDFFNYAGLQRSVLLYTTPTTYIDDITVTTSVEQDSGLVNYQISVKGSNLFKLEVRLLDAENKVVANGTGTQGQLKVPGVSLWWPYLMHERPAYLYSLEVQLTAQTSLGPVSDFYTLPVGIRTVAVTKSQFLINGKPFYFHGVNKHEDADIRGKGFDWPLLVKDFNLLRWLGANAFRTSHYPYAEEVMQMCDRYGIVVIDECPGVGLALPQFFNNVSLHHHMQVMEEVVRRDKNHPAVVMWSVANEPASHLESAGYYLKMVIAHTKSLDPSRPVTFVSNSNYAADKGAPYVDVICLNSYYSWYHDYGHLELIQLQLATQFENWYKKYQKPIIQSEYGAETIAGFHQDPPLMFTEEYQKSLLEQYHLGLDQKRLQGFTRIHLLMFTEEYQKSLLEQYHLQFMIQT

SEQ ID NO: 746180 - protein, 415 aa, Homo sapiens; identical to SEQ ID NO: 746175

SEQ ID NO: 746181 - protein, 317 aa, Homo sapiens
MARGSAVAWAALGPLLWGCALGLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVWVNGVDTLEHEGGYLPFEADISNLVQVGPLPSRLRITIAINNTLTPTTLPPGTIQYLTDTSKYPKGYFVQNTYFDFFNYAGLQRSVLLYTTPTTYIDDITVTTSVEQDSGLVNYQISVKGSNLFKLEVRLLDAENKVVANGTGTQGQLKVPGVSLWWPYLMHERPAYLYSLEIRGKGFDCRAEST

SEQ ID NO: 746182 - protein, 381 aa, Homo sapiens
MRSHTITMTTTSVSSWPYSSHRMRFITNHSDQPPQNFSATPNVTTCPMDEKLLSTVLTTSYSVIFIVGLVGNIIALYVFLGIHRKRNSIQIYLLNVAIADLLLIFCLPFRIMYHINQNKWTLGVILCKVVGTLFYMNMYISIILLGFISLDRYIKINRSIQQRKAITTKQSIYVCCIVWMLALGGFLTMIILTLKKGGHNSTMCFHYRDKHNAKGEAIFNFILVVMFWLIFLLIILSYIKIGKNLLRISKRRSKFPNSGKYATTARNSFIVLIIFTICFVPYHAFRFIYISSQLNVSSCYWKEIVHKTNEIMLVLSSFNSCLDPVMYFLMSSNIRKIMCQLLFRRFQGEPSRSESTSEFKPGYSLHDTSVAVKIQSSSKST

SEQ ID NO: 746183 - protein, 381 aa, Homo sapiens; identical to SEQ ID NO: 746182

SEQ ID NO: 746184 - protein, 374 aa, Homo sapiens [sequence omitted]

SEQ ID NO: 746185 - protein, 343 aa, Homo sapiens
MRDPLTDCPYNKVYKNLKEFSQNGENFCKQVTSVLQQRANLEISYAKGLQKLASKLSKALQNTRKSCVSSAWAWASEGMKSTADLHQKLGKAIELEAIKPTYQVLNVQEKKRKSLDNEVEKTANLVISNWNQQIKAKKKLMVSTKKHEALFQLVESSKQSMTEKEKRKLLNKLTKSTEKLEKEDENYYQKNMAGYSTRLKWENTLENCYQSILELEKERIQLLCNNLNQYSQHISLFGQTLTTCHTQIHCAISKIDIEKDIQAVMEETAILSTENKSEFLLTDYFEEDPNSAMDKERRKSLLKPKLLRLQRDIEKASKDKEGLERMLKTYSSTSSFSDAKSQK

SEQ ID NO: 746186 - protein, 226 aa, Homo sapiens
MLMCLLCFISRKLGKAIELEAIKPTYQVLNVQEKKRKSLDNEVEKTANLVISNWNQQIKAKKKLMVSTKKHEALFQLVESSKQSMTEKEKRKLLNKLTKSTEKLEKEDENYYQKNMAGYSTRLKWENTLENCYQSILELEKERIQLLCNNLNQYSQHISLFGQTLTTCHTQIHCAISKIDIEKDIQAVMEETAILSTENKSEFLLTDYFVSMKWKKKVTLMENLRY

SEQ ID NO: 746187 - protein, 107 aa, Homo sapiens
MRDPLTDCPYNKVYKNLKEFSQNGENFCKQVTSVLQQRANLEISYAKGLQKLASKLSKALQNTRKSCVSSAWAWASEGMKSTADLHQKLGKAIEMVANPGLATISIR

SEQ ID NO: 746188 - protein, 323 aa, Homo sapiens [sequence omitted]

SEQ ID NO: 746189 - protein, 302 aa, Homo sapiens
MRDPLTDCPYNKVYKNLKEFSQNGENFCKQVTSVLQQRANLEISYAKGLQKLASKLSKALQNTRKSCVSSAWAWASEGMKSTADLHQKLGKAIELEAIKPTYQVLNVQEKKRKSLDNEVEKTANLVISNWNQQIKAKKKLMVSTKKHEALFQLVESSKQSMTEKEKRKLLNKLTKSTEKLEKEDENYYQKNMAGYSTRLKWENTLENCYQSILELEKERIQLLCNNLNQYSQHISLFGQTLTTCHTQIHCAISKIDIEKDIQAVMEETAILSTENKSEFLLTDYFVSMKWKKKVTLMENLRY

SEQ ID NO: 746190 - protein, 215 aa, Homo sapiens
MRDPLTDCPYNKVYKNLKEFSQNGENFCKQVTSVLQQRANLEISYAKGLQKLASKLSKALQNTRKSCVSSAWAWASEGMKSTADLHQKLGKAIELEAIKPTYQVLNVQEKKRKSLDNEVEKTANLVISNWNQQIKAKKKLMVSTKKHEALFQLVESSKQSMTEKEKRKLLNKLTKSTEKLEKEDENYYQKNMAGYSTRLKWENTLENCYQYQPKG

SEQ ID NO: 746191 - protein, 302 aa, Homo sapiens
MRDPLTDCPYNKVYKNLKEFSQNGENFCKQVTSVLQQRANLEISYAKGLQKLASKLSKALQNTRKSCVSSAWAWASEGMKSTADLHQKLGKAIELEAIKPTYQVLNVQEKKRKSAKKKLMVSTKKHEALFQLVESSKQSMTEKEKRKLLNKLTKSTEKLEKEDENYYQKNMAGYSTRLKWENTLENCYQSILELEKERIQLLCNNLNQYSQHISLFGQTLTTCHTQIHCAISKIDIEKDIQAVMEETAILSTENKSEFLLTDYFEEDPNSAMDKERRKSLLKPKLLRLQRDIEKASKDKEGV

SEQ ID NO: 746192 - protein, 327 aa, Homo sapiens
RVSGMRDPLTDCPYNKVYKNLKEFSQNGENFCKQVTSVLQQRANLEISYAKGLQKLASKLSKALQNTRKSCVSSAWAWASEGMKSTADLHQKLGKAIELEAIKPTYQVLNVQEKKRKSLDNEVEKTANLVISNWNQQIKAKKKLMVSTKKHEALFQLVESSKQSMTEKEKRKLLNKLTKSTEKLEKEDENYYQKNMAGYSTRLKWENTLENCYQSILELEKERIQLLCNNLNQYSQHISLFGQTLTTCHTQIHCAISKIDIEKDIQAVMEETAILSTENKSEFLLTDYFEEDPNSAMDKERRKSLLKPKLLRLQRDIEKASKDKEGV

SEQ ID NO: 746193 - protein, 245 aa, Homo sapiens
MKSTADLHQKLGKAIELEAIKPTYQVLNVQEKKRKSLDNEVEKTANLVISNWNQQIKAKKKLMVSTKKHEALFQLVESSKQSMTEKEKRKLLNKLTKSTEKLEKEDENYYQKNMAGYSTRLKWENTLENCYQSILELEKERIQLLCNNLNQYSQHISLFGQTLTTCHTQIHCAISKIDIEKDIQAVMEETAILSTENKSEFLLTDYFEEDPNSAMDKERRKSLLKPKLLRLQRDIEKASKDKEGV

SEQ ID NO: 746194 - protein, 245 aa, Homo sapiens; identical to SEQ ID NO: 746193

SEQ ID NO: 746195 - protein, 488 aa, Homo sapiens
MKRSLQALYCQLLSFLLILALTEALAFAIQEPSPRESLQVLPSGTPPGTMVTAPHSSTRHTSVVMLTPNPDGPPSQAAAPMATPTPRAEGHPPTHTISTIAATVTAPHSESSLSTGPAPAAMATTSSKPEGRPRGQAAPTILLTKPPGATSRPTTAPPRTTTRRPPRPPGSSRKGAGNSSRPVPPAPGGHSRSKEGQRGRNPSSTPLGQKRPLGKIFQIYKGNFTGSVEPEPSTLTPRTPLWGYSSSPQPQTVAATTVPSNTSWAPTTTSLGPAKDKPGLRRAAQGGGSTFTSQGGTPDATAASGAPVSPQAAPVPSQRPHHGDPQDGPSHSDSWLTVTPGTSRPLSTSSGVFTAATGPTPAAFDTSVSAPSQGIPQGASTTPQAPTHPSRVSESTISGAKEETVATLTMTDRVPSPLSTVVSTATGNFLNRLVPAGTWKPGTAGNISHVAEGDKPQHRATICLSKMDIAWVILAISVPISSCSDPIT

SEQ ID NO: 746196 - protein, 575 aa, Homo sapiens
MKRSLQALYCQLLSFLLILALTEALAFAIQEPSPRESLQVLPSGTPPGTMVTAPHSSTRHTSVVMLTPNPDGPPSQAAAPMATPTPRAEGHPPTHTISTIAATVTAPHSESSLSTGPAPAAMATTSSKPEGRPRGQAAPTILLTKPPGATSRPTTAPPRTTTRRPPRPPGSSRKGAGNSSRPVPPAPGGHSRSKEGQRGRNPSSTPLGQKRPLGKIFQIYKGNFTGSVEPEPSTLTPRTPLWGYSSSPQPQTVAATTVPSNTSWAPTTTSLGPAKDKPGLRRAAQGGGSTFTSQGGTPDATAASGAPVSPQAAPVPSQRPHHGDPQDGPSHSDSWLTVTPGTSRPLSTSSGVFTAATGPTPAAFDTSVSAPSQGIPQGASTTPQAPTHPSRVSESTISGAKEETVATLTMTDRVPSPLSTVVSTATGNFLNRLVPAGTWKPGTAGNISHVAEGDKPQHRATICLSKMDIAWVILAISVPISSCSVLLTVCCMKRKKKTANPENNLSYWNNTITMDYFNRHAVELPREIQSLETSEDQLSEPRSPANGDYRDTGMVLVNPFCQETLFVGNDQVSEI

SEQ ID NO: 746197 - protein, 575 aa, Homo sapiens; identical to SEQ ID NO: 746196

SEQ ID NO: 746198 - protein, 569 aa, Homo sapiens
MNKEVLTGFLLILALTEALAFAIQEPSPRESLQVLPSGTPPGTMVTAPHSSTRHTSVVMLTPNPDGPPSQAAAPMATPTPRAEGHPPTHTISTIAATVTAPHSESSLSTGPAPAAMATTSSKPEGRPRGQAAPTILLTKPPGATSRPTTAPPRTTTRRPPRPPGSSRKGAGNSSRPVPPAPGGHSRSKEGQRGRNPSSTPLGQKRPLGKIFQIYKGNFTGSVEPEPSTLTPRTPLWGYSSSPQPQTVAATTVPSNTSWAPTTTSLGPAKDKPGLRRAAQGGGSTFTSQGGTPDATAASGAPVSPQAAPVPSQRPHHGDPQDGPSHSDSWLTVTPGTSRPLSTSSGVFTAATGPTPAAFDTSVSAPSQGIPQGASTTPQAPTHPSRVSESTISGAKEETVATLTMTDRVPSPLSTVVSTATGNFLNRLVPAGTWKPGTAGNISHVAEGDKPQHRATICLSKMDIAWVILAISVPISSCSVLLTVCCMKRKKKTANPENNLSYWNNTITMDYFNRHAVELPREIQSLETSEDQLSEPRSPANGDYRDTGMVLVNPFCQETLFVGNDQVSEI

SEQ ID NO: 746199 - protein, 575 aa, Homo sapiens; identical to SEQ ID NO: 746196

SEQ ID NO: 746200 - protein, 575 aa, Homo sapiens; identical to SEQ ID NO: 746196

SEQ ID NO: 746201 - protein, 575 aa, Homo sapiens; identical to SEQ ID NO: 746196

SEQ ID NO: 746202 - protein, 575 aa, Homo sapiens; identical to SEQ ID NO: 746196

SEQ ID NO: 746203 - protein, 575 aa, Homo sapiens; identical to SEQ ID NO: 746196

SEQ ID NO: 746204 - protein, 137 aa, Homo sapiens
MSTHHQNPANGPPLPPSPDAEMVMGSWRVGSEMKGTPQWAAGPIFPKPCHYLCEGGQVAEGSGCRLLYPLCLKHPPHRALVFTRFVLDSLNGNQIPWLRAKTTTYQCPCPFQLTLSSLRSSLSLWKGHPSQGRNAWS

SEQ ID NO: 746205 - protein, 137 aa, Homo sapiens; identical to SEQ ID NO: 746204

SEQ ID NO: 746206 - protein, 111 aa, Homo sapiens
FLRQSFAHVAQAGVQLRNRDSLQPPPPGFKRFSCLSLPSSWGYRYAPLRLANFLVFLIETGFRHVGQAGLERLTSGDPPASASQNARITGVSHHSWPHYLYFYLAFRLLYI

SEQ ID NO: 746207 - protein, 213 aa, Homo sapiens
SESPHFANLLGAQNALRERRLLIPTLLRYRAACWPPGPPCHAPGRLSTDTACAELYETEWVFLVCVCNTTICQLLFTMRSAGGGNLAAVTHSRLEGTTRKEGRGEEGKAATLGPLASRFQHQFSTEPAAAAQGWGLPELRASRGFGQSRGGCPVVGATLHLSGERRPTTQPTRSAAVGPAGPPRGHKNRRQFASSLFPNLNRQAEGSSKVAVP

SEQ ID NO: 746208 - protein, 122 aa, Homo sapiens
ASVSNASLNISAQIFVQISFNSMGSMSRSGIAGSNGNLLFNFLRNSTPIFTVAITFPIPISNALELQFFHLLENTCCFVLLSLLLFIKAILKCVRWCNIVVLICTSLSIHDAEELCMGLLDI

SEQ ID NO: 746209 - protein, 83 aa, Homo sapiens
MEGELGCGGAAGLWGRGQSPQIPGALTHEAVCGATPGVWGRGQAVGVSDAVEEEPTSVGAAGVCYRRQAVEETDSVGMPGPWG

SEQ ID NO: 746210 - protein, 281 aa, Homo sapiens
HGWIQLICSLVLIFNAAKTCPTMPALFSDHTFRHYAYLRDSLSHLVPALRLPGRKLVSSAVSPSIIPQEDPSQQFLQQSLERVYSLQHLDPQGAQELLEFTIRDLQRLGELQSELAGVADFSATYLRCQLLLIKALQEKLWNVAAPLYLKQSDLASAAAKQIMEETYKMEFMYSGVENKQVVIIHHMRLQAKALQLIVTARTTRGLDPLFGMCDNILQEVDFFQRYFIADLAHLQEALWTNFLTYAPSHEIQTCRSGPNFLNMCGEGVGIPRREITRSPTL

SEQ ID NO: 746211 - protein, 202 aa, Homo sapiens
GLSFHIYGGLSRLAVTSGWHIPLPGFTGVVLVPLPGDPTNQHILSSSHCSGHSGSGKTEAAKKIMQFLSSLEQDQTGNRECQPGEGWSPGLWRLLGSAAGTALSDGTDASLDLPLAGMPAGGGYCCPGMLEHPSLYQVEDMLPILSSFGHAKTILNANASRFGQVFCLYLQQGVIVGASVSHYLLETSRVVFQLLAGLDSIE

SEQ ID NO: 746212 - protein, 167 aa, Homo sapiens
MRACFPPQTFGGPVLLVLNPHRSLPLFSPEVQASYHPRKALSTTPHIFAIVASAYDLAQNTGQDPCILLCGHSGSGKTEAAKKIMQFLSSLEQDQTGNRECQVEDMLPILSSFGHAKTILNANASRFGQVFCLYLQQGVIVGASVSHYLLETSRVVFQLLAGLDSIE

SEQ ID NO: 746213 - protein, 143 aa, Homo sapiens
PLAGMPAGGGYCCPGMLEHPSLYRWRICCLYSAALAMPRPSSMPMPAASARSSASTYSSEWQGCRGHLQSLTLPGSLGCFPGVQTLVGLLLHGAPGCSASWALTPIFCAHRGVIVGASVSHYLLETSRVVFQVKAALLSTPAQ

SEQ ID NO: 746214 - protein, 122 aa, Homo sapiens
FQGRLSLIKGDQAGGVWEKPEKGLICSIMMGLSLASAVLLASLLSLHLGTATRGSDISKTCCFQYSHKPLPWTWVRSYEFTSNSCSQRAVIFTTKRGKKVCTHPRKKWVQKYISLLKTPKQL

SEQ ID NO: 746215 - protein, 105 aa, Homo sapiens
FQGRLSLIKGDQAGGVWEKPEKGLICSIMMGLSLASAVLLASLLSFQYSHKPLPWTWVRSYEFTSNSCSQRAVIFTTKRGKKVCTHPRKKWVQKYISLLKTPKQL

SEQ ID NO: 746216 - protein, 140 aa, Homo sapiens
SPKAVYRRGSSTWLTAFVLKVLSLAQEQVGGSPEKLQETSNWLLSQQQADGSFQDLSPVIHRSMQGGLVGNDETVALTAFVTIALHHGLAVFQDEGAEPLKQRVEASISKANSFLGEKASAGLLGAHAVAITAYALTLTK

SEQ ID NO: 746217 - protein, 310 aa, Homo sapiens
MKTLFEEIKASIKNNYNQDRSFCRPVLPWGGVFTIKAGRKAVSCTPLYVEIRLKNTCTIDGFLMLLYVILNENENFPRELSLHFGREFVDCFLYLMDTYSFTTVKLLWIWDKMEKQQYKSEVHKASLIIDLFGNEHDNFTKNLENLMSTIQESYCSNWRCPTRVQEDQQRTININPPQEIPHGNLIRLAVNELFCSKIELCEEHGCGGLREFSQRIFCHGAPPFVVLNMQHWKSEDLAYVPYYLDLSDHKYLLEGATLFNKEEHHYSAAFQIGGHWMHYDGLRNVNLILLNKPPEFLLLSSLVYIRATEK

SEQ ID NO: 746218 - protein, 105 aa, Homo sapiens
MSSLSEYAFRMSRLSARLFGEVTRPTNSKSMKVVKLFSELPLAKKKETYDWYPNHHTYAELMQTLRFLGLYRDEAFRDFWDEAKRLKEAFVGKGRKPKKREKGKR

SEQ ID NO: 746219 - protein, 74 aa, Homo sapiens
SGSDRVVIGLAELSPEEIGRSPSPTGSWECWPLSASSPALFLLQLLKDSAPRPVFPDVCVAMCTAPDRHIVGAQ

SEQ ID NO: 746220 - protein, 136 aa, Homo sapiens; identical to SEQ ID NO: 741065

SEQ ID NO: 746221 - protein, 316 aa, Homo sapiens
MENVTTMNEFLLLGLTGVQELQPFFFGIFLIIYLINLIGNGSILVMVVLEPQLHSPMYFFLGNLSCLDISYSSVTLPKLLVNLVCSRRAISFLGCITQLHFFHFLGSTEAILLAIMAFDRFVAICNPLRYTVIMNPQVCILLAAAAWLISFFYALMHSVMTAHLSFCGSQKLNHFFYDVKPLLELACSDTLLNQWLLSIVTGSISMGAFFLTLLSCFYVIGFLLFKNRSCRILHKALSTCASHFMVVCLFYGPVGFTYIRPASATSMIQDRIMAIMYSAVTPVLNPLIYTLRNKEVMMALKKIFGRKLFKDWQQHH

SEQ ID NO: 746222 - protein, 299 aa, Homo sapiens
AGRQVPEQRSPPPPGLGSARPGSPAVSCGAAAMAPRRARGCRTLGLPALLLLLLLRPPATRGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 746223 - protein, 429 aa, Homo sapiens
SCSRNSAKWRSWGPSGRRGPREPAGGGGCAPPGPERTRQVPAPPHRGDTSAGTHPGRPLTTERRAAEGDQESRRRSSWRRPAPGEVKWIRAAERAGESLLSDDFAHSLRSGDTGPSAHWRSQSTTSAEDREAPGLAWMQETGWLSWREGAEYLKASTMRSRHTRPACDSGQWKTAPSATTIGQAGSKQAGREGQKISVEQNMEKKPLTLQHQIAPEASKPGGSAGITCPPPMSVEHADIWVKSYSLYSRERYICNSGFKRKAGTSSLTECVLNKATNVAHWTTPSLKCIKPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 746224 - protein, 359 aa, Homo sapiens
AAAGIRRSGGAGAPAGAGGRGSQQVAGAALRPGQSAPGRCPRLRTAATPPRALTQAGRSQPSAGPRRETRKAEGGAAGGDQRRARSSGSEPQRGLERVCSPMTLPTLFAVGTPDRVHTGGPRARRARRTGRLPACVGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRASVCSCHPRSAGHTCSVGSVC

SEQ ID NO: 746225 - protein, 363 aa, Homo sapiens
AAAGIRRSGGAGAPAGAGGRGSQQVAGAALRPGQSAPGRCPRLRTAATPPRALTQAGRSQPSAGPRRETRKAEGGAAGGDQRRARSSGSEPQRGLERVCSPMTLPTLFAVGTPDRVHTGGPRARRARRTGRLPACVGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPVAISTSTVLLCGLSAVSLLACYLKSRQTPPLASVEMEAMEALPVTWGTSSRDEDLENCSHHL

SEQ ID NO: 746226 - protein, 374 aa, Homo sapiens
AAAGIRRSGGAGAPAGAGGRGSQQVAGAALRPGQSAPGRCPRLRTAATPPRALTQAGRSQPSAGPRRETRKAEGGAAGGDQRRARSSGSEPQRGLERVCSPMTLPTLFAVGTPDRVHTGGPRARRARRTGRLPACVGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 746227 - protein, 171 aa, Homo sapiens
GAGYVAGVASVFSEVGVSNLTRPEMTSPLREKPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 746228 - protein, 308 aa, Homo sapiens
AAAGIRRSGGAGAPAGAGGRGSQQVAGAALRPGQSAPGRCPRLRTAATPPRALTQAGRSQPSAGPRRETRKAEGGAAGGDQRRARSSGSEPQRGLERVCSPMTLPTLFAVGTPDRVHTGGPRARRARRTGRLPACVGITCPPPMSVEHADIWVKSYSLYSRERYICNSGFKRKAGTSSLTECVLNKATNVAHWTTPSLKCIRTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 746229 - protein, 94 aa, Homo sapiens
ADKALTNRGLRRVPGVQGSRAASEPLSSHCSQSCVPLLDSASMREAARSWDFTGERTCQRQSLVLSPRLECSGAISVHYNLRLPGSSDSPVSAS

SEQ ID NO: 746230 - protein, 33 aa, Homo sapiens
MRKGGKAESTEGFYFVQRNLLVGMLAGLGFLHQ

SEQ ID NO: 746231 - protein, 158 aa, Homo sapiens
ETPYLRAWVELRRGRLGRPSGRKGQTATAASGGTVCPGSEVKKRAGGERATCLSAMALNAGLAEPHLCCLQNGENCACPASSLGTPGAQRTKSCKCPGGLGSLWMVQIWGGGHGQDREGCQREGLWVCGVWGSVADSLDEPGACMLQPTCQILPPPAF

SEQ ID NO: 746232 - protein, 667 aa, Homo sapiens
MHRGLIHPQSRAVGGDAMTPILTVLICLGLSLGPRTHVQAGHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVTLQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRRKATEPPPSQEGPSPAVPSIYATLAIH

SEQ ID NO: 746233 - protein, 527 aa, Homo sapiens
MHRGLIHPQSRAVGGDAMTPILTVLICLGLSLGPRTHVQAGHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVTLQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSSPAQLPMPRKKTSMLP

SEQ ID NO: 746234 - protein, 434 aa, Homo sapiens
MHRGLIHPQSRAVGGDAMTPILTVLICLGLSLGPRTHVQAGHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVTLQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGRALSSCAQHLRHSGHPLAQGGTQTPHSMESGMHGSCPPSGHHWTPPSLDLPQETLGTFRGHSILQYK

SEQ ID NO: 746235 - protein, 472 aa, Homo sapiens
MHRGLIHPQSRAVGGDAMTPILTVLICLGLSLGPRTHVQAGHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVTLQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSGPEDQPLTPTGSDPQSGE

SEQ ID NO: 746236 - protein, 667 aa, Homo sapiens; identical to SEQ ID NO: 746232

SEQ ID NO: 746237 - protein, 650 aa, Homo sapiens
MHRGLIHPQSRAVGGDAMTPILTVLICLGLSLGPRTHVQAGHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVTLQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRRKATEPPPSQEGPSPAVPSIYATLAIH

SEQ ID NO: 746238 - protein, 103 aa, Homo sapiens
ETQEYRLYREKKTALWITRIPQELVKKGQFPIPSITWEHAGRYRCYYGSDTAGRSESSDPLELVVTGELTLRGPSPRLCPQEGGRLSGASPSHSPALGMTRVV

SEQ ID NO: 746239 - protein, 348 aa, Homo sapiens
MGPRARPALLLLMLLQTAVLQGRLLRSHSLHYLFMGASEQDLGLSLFEALGYVDDQLFVFYDHESRRVEPRTPWVSSRISSQMWLQLSQSLKGWDHMFTVDFWTIMENHNHSKESHTLQVILGCEMQEDNSTEGYWKYGYDGQDHLEFCPDTLDWRAAEPRAWPTKLEWERHKIRARQNRAYLERDCPAQLQQLLELGRGVLDQQVPPLVKVTHHVTSSVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSRGAMGHYVLAERE

SEQ ID NO: 746240 - protein, 73 aa, Homo sapiens
MGPRARPALLLLMLLQTAVLQGRLLRSHSLHYLFMGASEQDLGLSLFEALGYVDDQLLVIRLPRPPKVLRLQV

SEQ ID NO: 746241 - protein, 256 aa, Homo sapiens
MGPRARPALLLLMLLQTAVLQGRLLRSHSLHYLFMGASEQDLGLSLFEALGYVDDQLFVFYDHESRRVEPRTPWVSSRISSQMWLQLSQSLKGWDHMFTVDFWTIMENHNHSKVPPLVKVTHHVTSSVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSRGAMGHYVLAERE

SEQ ID NO: 746242 - protein, 260 aa, Homo sapiens
MGPRARPALLLLMLLQTAVLQGRLLQSHTLQVILGCEMQEDNSTEGYWKYGYDGQDHLEFCPDTLDWRAAEPRAWPTKLEWERHKIRARQNRAYLERDCPAQLQQLLELGRGVLDQQVPPLVKVTHHVTSSVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSRGAMGHYVLAERE

SEQ ID NO: 746243 - protein, 325 aa, Homo sapiens
MGPRARPALLLLMLLQTAVLQGRLLPLGYVDDQLFVFYDHESRRVEPRTPWVSSRISSQMWLQLSQSLKGWDHMFTVDFWTIMENHNHSKESHTLQVILGCEMQEDNSTEGYWKYGYDGQDHLEFCPDTLDWRAAEPRAWPTKLEWERHKIRARQNRAYLERDCPAQLQQLLELGRGVLDQQVPPLVKVTHHVTSSVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSRGAMGHYVLAERE

SEQ ID NO: 746244 - protein, 175 aa, Homo sapiens
MGPRARPALLLLMLLQTAVLQGRLLRSHSLHYLFMGASEQDLGLSLFEALGYVDDQLFVFYDHESRRVEPRTPWVSSRISSQMWLQLSQSLKGWDHMFTVDFWTIMENHNHSKEGSESSSLPGKGKQIPSPHPSSFLSSASFGEGDTSCDLFSDHSTVSGLELLPPEHHHEVAEG

SEQ ID NO: 746245 - protein, 246 aa, Homo sapiens
MGPRARPALLLLMLLQTAVLQGRLLQSHTLQVILGCEMQEDNSTEGYWKYGYDGQDHLEFCPDTLDWRAAEPRAWPTKLEWERHKIRARQNRAYLERDCPAQLQQLLELGRGVLDQQVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSRGAMGHYVLAERE

SEQ ID NO: 746246 - protein, 211 aa, Homo sapiens
MGPRARPALLLLMLLQTAVLQGRLLQSHTLQVILGCEMQEDNSTEGYWKYGYDGQDHLEFCPDTLDWRAAEPRAWPTKLEWERHKIRARQNRAYLERDCPAQLQQLLELGRGVLDQQVPPLVKVTHHVTSSVTTLRCRALNYYPQNITMKWLKDKQPMDAKEFEPKDVLPNGDGTYQGWITLAVPPGEEQRYTCQVEHPGLDQPLIVIWGM

SEQ ID NO: 746247 - protein, 211 aa, Homo sapiens
MGPRARPALLLLMLLQTAVLQGRLLRSHSLHYLFMGASEQDLGLSLFEALGYVDDQLFVFYDHESRRVEPRTPWVSSRISSQMWLQLSQSLKGWDHMFTVDFWTIMENHNHSKESHTLQVILGCEMQEDNSTEGYWKYGYDGQDHLEFCPDTLDWRAAEPRAWPTKLEWERHKIRARQNRAYLERDCPAQLQQLLELGRGVLDQQVLRLQV

SEQ ID NO: 746248 - protein, 159 aa, Homo sapiens
MGPRARPALLLLMLLQTAVLQGRLLRSHSLHYLFMGASEQDLGLSLFEALGYVDDQLFVFYDHESRRVEPRTPWVSSRISSQMWLQLSQSLKGWDHMFTVDFWTIMENHNHSKESHTLQVILGCEMQEDNSTEGYWKYGYDGAGASGYHIQLRSFFFRH

SEQ ID NO: 746249 - protein, 256 aa, Homo sapiens; identical to SEQ ID NO: 746241

SEQ ID NO: 746250 - protein, 334 aa, Homo sapiens
MGPRARPALLLLMLLQTAVLQGRLLRSHSLHYLFMGASEQDLGLSLFEALGYVDDQLFVFYDHESRRVEPRTPWVSSRISSQMWLQLSQSLKGWDHMFTVDFWTIMENHNHSKESHTLQVILGCEMQEDNSTEGYWKYGYDGQDHLEFCPDTLDWRAAEPRAWPTKLEWERHKIRARQNRAYLERDCPAQLQQLLELGRGVLDQQVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSRGAMGHYVLAERF

SEQ ID NO: 746251 - protein, 242 aa, Homo sapiens
MGPRARPALLLLMLLQTAVLQGRLLRSHSLHYLFMGASEQDLGLSLFEALGYVDDQLFVFYDHESRRVEPRTPWVSSRISSQMWLQLSQSLKGWDHMFTVDFWTIMENHNHSKVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSRGAMGHYVLAERE

SEQ ID NO: 746252 - protein, 159 aa, Homo sapiens
MGPRARPALLLLMLLQTAVLQGRLLRSHSLHYLFMGASEQDLGLSLFEALGYVDDQLFVFYDHESRRVEPRTPWVSSRISSQMWLQLSQSLKGWDHMFTVDFWTIMENHNHSKESHTLQVILGCEMQEDNSTEGFLHFLRHLRDIHLCHFISYFWKRTP

SEQ ID NO: 746253 - protein, 279 aa, Homo sapiens
MGPRARPALLLLMLLQTAVLQGRLLRSHSLHYLFMGASEQDLGLSLFEALGYVDDQLFVFYDHESRRVEPRTPWVSSRISSQMWLQLSQSLKGWDHMFTVDFWTIMENHNHSKESHTLQVILGCEMQEDNSTEGYWKYGYDGQDHLEFCPDTLDWRAAEPRAWPTKLEWERHKIRARQNRAYLERDCPAQLQQLLELGRGVLDQQVPPLVKVTHHVTSSVTTLRCRALNYYPQNITMKWLKDKQPMDAKEFEPKDVLPNGDGTYQGWITLAVPLLRLQV

SEQ ID NO: 746254 - protein, 76 aa, Homo sapiens
MGPRARPALLLLMLLQTAVLQGRLLQPSPSGTLVIGVISGIAVFVVILFIGILFIILRKRQGSRGAMGHYVLAERE

SEQ ID NO: 746255 - protein, 428 aa, Homo sapiens
MDSLWGPGAGSHPFGVHNTRLSPDLCPGKIVLRALKESGAGMPEQDKDPRVQENPGDQRRVPEVTGDAPSAFRPLRDNGGLSPFVPGPGPLQTDLHAQRSEIRYNQTSQTSWTSSCTNRNAISSSYSSTGGLPGLKRRRGPASSHCQLTLSSSKTVSEDRPQAVSSGHTQCEKAADIAPGQTLTLRNDSSTSEASRPSTHKFPLLPCRRGEPLMLPPPLELGYRVTVEDLDREKEAAFQRINSALQVEDKAISDCRPSRPSHTLSSLATGASGLPAVSKAPSMDAQQETHKSQDCLGLLAPLASAAEVPSTAPMSGKKHRPPGPLFSSSDPLPATSSHSQDSAQVTSLIPAPFPAASMDAGMRRTRRGTSAPAAAAAAPPPSALNPTLGSLLEWMEALHISGPQPQLQQVPRGQNQRSQTSRTSSCPK

SEQ ID NO: 746256 - protein, 124 aa, Homo sapiens
MLNNILYRFSDGWDIITLGQVTPTLYMLSEDRQLWKKLCQYHFAEKQFCRHLILSEKGHIEWKLMYFALQKHYPAKEQYGDTLHFCRHCSILFWKDSGHPCTAADPDSCFTPVSPQHFIDLFKF

SEQ ID NO: 746257 - protein, 358 aa, Homo sapiens
MPFLGQDWRSPGWSWIKTEDGWKRCESCSQKLERENNRCNISHSIILNSEDGEIFNNEEHEYASKKRKKDHFRNDTNTQSFYREKWIYVHKESTKERHGYCTLGEAFNRLDFSSAIQDIRRFNYVVKLLQLIAKSQLTSLSGVAQKNYFNILDKIVQKVLDDHHNPRLIKDLLQDLSSTLCILIRGVGKSVLVGNINIWICRLETILAWQQQLQDLQMTKQVNNGLTLSDLPLHMLNNILYRFSDGWDIITLGQVTPTLYMLSEDRQLWKKLCQYHFAEKQFCRHLILSEKGHIEWKLMYFALQKHYPAKEQYGDTLHFCRHCSILFWKDSGHPCTAADPDSCFTPVSPQHFIDLFKF

SEQ ID NO: 746258 - protein, 358 aa, Homo sapiens; identical to SEQ ID NO: 746257

SEQ ID NO: 746259 - protein, 141 aa, Homo sapiens
MTKQVNNGLTLSDLPLHMLNNILYRFSDGWDIITLGQVTPTLYMLSEDRQLWKKLCQYHFAEKQFCRHLILSEKGHIEWKLMYFALQKHYPAKEQYGDTLHFCRHCSILFWKDSGHPCTAADPDSCFTPVSPQHFIDLFKF

SEQ ID NO: 746260 - protein, 367 aa, Homo sapiens
MPFLGQDWRSPGWSWIKTEDGWKRCESCSQKLERENNRCNISHSIILNSEDGEIFNNEEHEYASKKRKKDHFRNDTNTQSFYREKWIYVHKESTKERHGYCTLGEAFNRLDFSSAIQDIRRFNYVVKLLQLIAKSQLTSLSGVAQKNYFNILDKIVQKVLDDHHNPRLIKDLLQDLSSTLCILIRGVGKSVLVGNINIWICRLETILAWQQQLQDLQMTKQVNNGLTLSDLPLHMLNNILYRFSDGWDIITLGQVTPTLYMLSEDRQLWKKLCQYHFAEKQFCRHLILSEKGHIEWKLMYFALQKHYPAKEQYGDTLHFCRHCSILFWKDYHLALLFKDSGHPCTAADPDSCFTPVSPQHFIDLFKF

SEQ ID NO: 746261 - protein, 321 aa, Homo sapiens
MPFLGQDWRSPGWSWIKTEDGWKRCESCSQKLERENNRCNISHSIILNSEDGEIFNNEEHEYASKKRKKDHFRNDTNTQSFYREKWIYVHKESTKERHGYCTLGEAFNRLDFSSAIQDIRRFNYVVKLLQLIAKSQLTSLSGVAQKNYFNILDKIVQKVLDDHHNPRLIKDLLQDLSSTLCILIRGVGKSVLVGNINIWICRLETILAWQQQLQDLQMTKQVNNGLTLSDLPLHMLNNILYRFSDGWDIITLGQVTPTLYMLSEDRQLWKKLCQYHFAEKQFCRHLILSEKGHIEWKLMYFATSSTSSSFKGCPCHPYWRL

SEQ ID NO: 746262 - protein, 124 aa, Homo sapiens
MIQQEEIRNLEEEKKQLDWINHSSSLARTRSLSSLREKGMYDVQSTTEPTNLMATIFWIAASLLESDYEYEYVLALRLLNKLLIHLPLHKSESREKIENVQSKSKWTSLPGVQQLFLKGISGYR

SEQ ID NO: 746263 - protein, 291 aa, Homo sapiens
MEKYSIMKSMNMHRKKGKRTILEMTQILKRHGYCTLGEAFNRLDFSSAIQDIRRFNYVVKLLQLIAKSQLTSLSGVAQKNYFNILDKIVQKVLDDHHNPRLIKDLLQDLSSTLCILIRGVGKSVLVGNINIWICRLETILAWQQQLQDLQMTKQVNNGLTLSDLPLHMLNNILYRFSDGWDIITLGQVTPTLYMLSEDRQLWKKLCQYHFAEKQFCRHLILSEKGHIEWKLMYFALQKHYPAKEQYGDTLHFCRHCSILFWKDSGHPCTAADPDSCFTPVSPQHFIDLFKF

SEQ ID NO: 746264 - protein, 141 aa, Homo sapiens; identical to SEQ ID NO: 746259

SEQ ID NO: 746265 - protein, 291 aa, Homo sapiens; identical to SEQ ID NO: 746263

SEQ ID NO: 746266 - protein, 367 aa, Homo sapiens; identical to SEQ ID NO: 746260

SEQ ID NO: 746267 - protein, 340 aa, Homo sapiens
MPFLGQDWRSPGWSWIKTEDGWKRCESCSQKLERENNRCNISHSIILNSEDGEIFNNEEHEYASKKRKKDHFRNDTNTQSFYREKWIYVHKESTKERHGYCTLGEAFNRLDFSSAIQDIRRFNYVVKLLQLIAKSQLTSLSGVAQKNYFNILDKIVQKVLDDHHNPRLIKDLLQDLSSTLCILIRGVGKSVLVGNINIWICRLETILAWQQQLQDLQMTKQVNNGLTLSDLPLHMLNNILYRFSDGWDIITLGQVTPTLYMLSEDRQLWKKLCQYHFAEKQFCRHLILSETKEQYGDTLHFCRHCSILFWKDSGHPCTAADPDSCFTPVSPQHFIDLFKF

SEQ ID NO: 746268 - protein, 376 aa, Homo sapiens
MPFLGQDWRSPGWSWIKTEDGWKRCESCSQKLERENNRCNISHSIILNSEDGEIFNNEEHEYASKKRKKDHFRNDTNTQSFYREKWIYVHKESTKERHGYCTLGEAFNRLDFSSAIQDIRRFNYVVKLLQLIAKSQLTSLSGVAQKNYFNILDKIVQKVLDDHHNPRLIKDLLQDLSSTLCILIRGVGKSVLVGNINIWICRLETILAWQQQLQDLQMTKQVNNGLTLSDLPLHMLNNILYRFSDGWDIITLGQVTPTLYMLSEDRQLWKKLCQYHFAEKQFCRHLILSEKGHIEWKLMYFALQKHYPAKEQYGDTLHFCRHCSILFWKDYHLALLFKVLPCLATHPVFGMKTLHRAASHARHLGHCPARFQLSLT

SEQ ID NO: 746269 - protein, 163 aa, Homo sapiens
MAEDRPQQPQLDMPLVLDQGLTRQMRLRVESLKQRGEKRQDGEKLLQPAESVYRLNFTQQQRLQFERWNVVLDKPGKVTITGTSQNWTPDLTNLMTRQLLDPTAIFWRKEDSDAIDWNEADALEFGERLSDLAKIRKVMYFLVTFGEGVEPANLKASVVFNQL

SEQ ID NO: 746270 - protein, 138 aa, Homo sapiens
WDPEPHFSRVGGVRAPGRAATGLRAPGHPVSLQVTGMKQAGWWACEDSPRLAGGTGPWCLGEGLGLQGSCWAEPHVCLPTFLLSPSCLLYLVNLFPSVSFLLFSVSAIPCLAVPPLSPLLLWCICDLCSAIVSPACLS

SEQ ID NO: 746271 - protein, 127 aa, Homo sapiens
MLTSQNSIKRKTPTFHAQVTKGLDAIPFASLSYLLCVADGKLKVFLIGCFVQPFLLLAPGGCERVLGLGASWQRSTPGCSPKSHCPPHSLVLTAVCRECWHLTPLKACLCSSTVLSYAVSTPLPEGQ

SEQ ID NO: 746272 - protein, 224 aa, Homo sapiens
MRLWKARVLKLVLKTAKDSRLGLNSKWLSLKLGDAGNPRSLAIRFILTNYNKLSIQSWFSLRRVEIISNNSIQAVFNPTGVYAPSGYSYRCQRVGSLQQDQALLLPSDTDDGSSLWEVTFIDFQIQGFAIKGGRFTKAQDCASSFSPAFLIGLAMSLILLLVLAYALHMLIYLRYLDQQYDLIASPAHFSQLKARDTAEEKELLRSQGAECYKLRSQQISKIYV

SEQ ID NO: 746273 - protein, 224 aa, Homo sapiens; identical to SEQ ID NO: 746272

SEQ ID NO: 746274 - protein, 224 aa, Homo sapiens; identical to SEQ ID NO: 746272

SEQ ID NO: 746275 - protein, 208 aa, Homo sapiens
MRLWKARVLKLVLKTAKDSRLGLNSKWLSLKLGDAGNPRSLAIRFILTNYNKLSIQSWFSLRRVEIISNNSIQAVFNPTGVYAPSGYSYRCQRVGSLQQDQALLLPSDTDDGSSLWEVTFIDFQALGLVPCMKVHFKANRTIFLEWEEKASSLNRHYAEHRIECVGTAISWQVCLQPALWIYKHTKEEAHTGVMGQMTILCLPTLSST

SEQ ID NO: 746276 - protein, 126 aa, Homo sapiens
QNCQPNWEEILGEKGCITSAPSFLLQIQGFAIKGGRFTKAQDCASSFSPAFLIGLAMSLILLLVLAYALHMLIYLRYLDQQYDLIASPAHFSQLKARDTAEEKELLRSQGAECYKLRSQQISKIYV

SEQ ID NO: 746277 - protein, 172 aa, Homo sapiens
MRLWKARVLKLVLKTAKDSRLGLNSKWLSLKLGDAGNPRSLAIRFILTNYNKLSIQSWFSLRRVEIISNNSIQAVFNPTGVYAPSGYSYRCQRVGSLQQDQALLLPSDTDDGSSLWEVTFIDFQALGLVPCMKVHFKANRTIFLEWEEKASSLNRAGVSQSCQCWSPTPGFR

SEQ ID NO: 746278 - protein, 52 aa, Homo sapiens
AGGVGAGRRQVGTLAWRGHQQTPGRPHQWEPLQRKEMSGRLWVWGLEPGPDL

SEQ ID NO: 746279 - protein, 472 aa, Homo sapiens
SGHTGGLGCGARVGARGGRPGRYGPRAAGRAPKPRYLRDLMTFEDVAVYFSQEEWGLLDTAQRALYRHVMLENFTLVTSLGLSTSRPRVVIQLERGEEPWVPSGKDMTLARNTYGRLNSGSWSLTEDRDVSGEWPRAFPDTPPGMTTSVFPVADACHSVKSLQRQPGASPSQERKPTGVSVIYWERLLLGSRSDQASISLRLTSPLRPPKSSRPREKTFTEYRVPGRQPRTPERQKPCAQEVPGRAFGNASDLKAASGGRDRRMGAAWQEPHRLLGGQEPSTWDELGEALHAGEKSFECRACSKVFVKSSDLLKHLRTHTGERPYECTQCGKAFSQTSHLTQHQRIHSGETPYACPVCGKAFRHSSSLVRHQRIHTAEKSFRCSECGKAFSHGSNLSQHRKIHAGGRPYACAQCGRRFCRNSHLIQHERTHTGEKPFVCALCGAAFSQGSSLFLHQRVHTGEKPFACAQCGR

SEQ ID NO: 746280 - protein, 306 aa, Homo sapiens
MYSFMAGSIFITIFGNLAMIISISYFKQLHTPTNFLILSMAITDFLLGFTIMPYSMIRSVENCWYFGLTFCKIYYSFDLMLSITSIFHLCSVAIDRFYAICYPLLYSTKITIPVIKRLLLLCWSVPGAFAFGVVFSEAYADGIEGYDILVACSSSCPVMFNKLWGTTLFMAGFFTPGSMMVGIYGKIFAVSRKHAHAINNLRENQNNQVKKDKKAAKTLGIVIGVFLLCWFPCFFTILLDPFLNFSTPVVLFDALTWFGYFNSTCNPLIYGFFYPWFRRALKYILLGKIFSSCFHNTILCMQKESE

SEQ ID NO: 746281 - protein, 82 aa, Homo sapiens
MHYGRKQVSWIIFLKIGAGCQVHVGHDCSTLRRQQGAPWSFASSFRPAASPLAPPSPGVSGWTHGSSLWPFLIKDRTNGLSG

SEQ ID NO: 746282 - protein, 111 aa, Homo sapiens
MPRQNHSTLGLRTQAVFQCGSDVCYFSSAPPGRVWSADRGYAGSWGMWSMTFESGMVVAGRSGSCLSSQHFGGPRRVDHLRSAVRDQPDQHGETPSLLKIQKIAGHCGRHL

SEQ ID NO: 746283 - protein, 104 aa, Homo sapiens
FFLRQGLVLSPRRECSGMITAHCSLDLPRLKQSSQLSLPISWDYRHAPPRLANCCIFHRDGVLPHCPGWSQTPGLKRATYLRLPKCWDDRHEPPNPALRFYLRE

SEQ ID NO: 746284 - protein, 155 aa, Homo sapiens
MVLSGALCFRMKDSALKVLYLHNNQLLAGGLHAGKVIKGEEISVVPNRWLDASLSPVILGVQGGSQCLSCGVGQEPTLTLEPVNIMELYLGAKESKSFTFYRRDMGLTSSFESAAYPGWFLCTVPEADQPVRLTQLPENGGWNAPITDFYFQQCD

SEQ ID NO: 746285 - protein, 199 aa, Homo sapiens
ESPTSNISCRPGNGRQERQRKEGGRREGVKEGVKKGSLHPVELKMVLSGALCFRMKDSALKVLYLHNNQLLAGGLHAGKVIKGEEISVVPNRWLDASLSPVILGVQGGSQCLSCGVGQEPTLTLEPVNIMELYLGAKESKSFTFYRRDMGLTSSFESAAYPGWFLCTVPEADQPVRLTQLPENGGWNAPITDFYFQQCD

SEQ ID NO: 746286 - protein, 199 aa, Homo sapiens; identical to SEQ ID NO: 746285

SEQ ID NO: 746287 - protein, 312 aa, Homo sapiens
MDGDNQSENSQFLLLGISESPEQQRILFWMFLSMYLVTVLGNVLIILAISSDSHLHTPMYFFLANLSFTDLFFVTNTIPKMLVNFQSQNKAISYAGCLTQLYFLVSLVTLDNLILAVMAYDRYVATCCPLHYVTAMSPGLCVLLLSLCWGLSVLYGLLLTFLLTRVTFCGPREIHYLFCDMYILLWLACSNTHIIHTALIATGCFIFLTPLGFMTTSYVRIVRTILQMPSASKKYKTFSTCASHLGVVSLFYGTLAMVYLQPLHTYSMKDSVATVMYAVLTPMMNPFIYRLRNKDMHGAPGRVLWRPFQRPK

SEQ ID NO: 746288 - protein, 1095 aa, Homo sapiens
HLLQMGANVHARDDGGLIPLHNACSFGHAEVVSLLLCQGADPNARDNWNYTPLHEAAIKGKIDVCIVLLQHGADPNIRNTDGKSALDLADPSAKAVLTGEYKKDELLEAARSGNEEKLMALLTPLNVNCHASDGRKSTPLHLAAGYNRVRIVQLLLQHGADVHAKDKGGLVPLHNACSYGHYEVTELLLKHGACVNAMDLWQFTPLHEAASKNRVEVCSLLLSHGADPTLVNCHGKSAVDMAPTPELRERLTYEFKGHSLLQAAREADLAKVKKTLALEIINFKQPQSHETALHCAVASLHPKRKQVTELLLRKGANVNEKNKDFMTPLHVAAERAHNDVMEVLHKHGAKMNALDTLGQTALHRAALAGHLQTCRLLLSYGSDPSIISLQGFTAAQMGNEAVQQILSESTPIRTSDVDYRLLEASKAGDLETVKQLCSSQNVNCRDLEGRHSTPLHFAAGYNRVSVVEYLLHHGADVHAKDKGGLVPLHNACSYGHYEVAELLVRHGASVNVADLWKFTPLHEAAAKGKYEICKLLLKHGADPTKKNRDGNTPLDLVKEGDTDIQDLLKGDAALLDAAKKGCLARVQKLCTPENINCRDTQGRNSTPLHLAAGYNNLEVAEYLLEHGADVNAQDKGGLIPLHNAASYGHVDIAALLIKYNTCVNATDKWAFTPLHEAAQKGRTQLCALLLAHGADPTMKNQEGQTPLDLATADDIRALLIDAMPPEALPTCFKPQATVVSASLISPASTPSCLSAASSIDNLTGPLAELAVGGASNAGDGAAGTERKEGEVAGLDMNISQFLKSLGLEHLRDIFETEQITLDVLADMGHEELKEIGINAYGHRHKLIKGVERLLGGQQGTNPYLTFHCVNQGTDFAGSAPEDKEYQSVEEGDAKYYFENTEMVVMLAGIFNRYNVIRIQKVVNKKLRERFCHRQKEVSEENHNHHNERMLFHGSPFINAIIHKGFDERHAYIGGMFGAGIYFAENSSKSNQYVYGIGGGTGCPTHKDRSCYICHRQMLFCRVTLGKSFLQFSTMKMAHAPPGHHSVIGRPSVNGLAYAEYVIYRGEQAYPEYLITYQIMKPEAPSQTATAAEQKT

SEQ ID NO: 746289 - protein, 1095 aa, Homo sapiens; identical to SEQ ID NO: 746288

SEQ ID NO: 746290 - protein, 1095 aa, Homo sapiens; identical to SEQ ID NO: 746288

SEQ ID NO: 746291 - protein, 1095 aa, Homo sapiens; identical to SEQ ID NO: 746288

SEQ ID NO: 746292 - protein, 1450 aa, Homo sapiens
RTASSSSPPDEAEVRHVEAPRRSFGARALGGGSKLTSWIFSCFSLVFDFFWTLVSTISEMPSSLLGAAMPASTSAAALQEALENAGRLIDRQLQEDRMYPDLSELLMVSAPNNPTVSGMSDMDYPLQGPGLLSVPNLPEISSIRRVPLPPELVEQFGHMQCNCMMGVFPPISRAWLTIDSDIFMWNYEDGGDLAYFDGLSETILAVGLVKPKAGIFQPHVRHLLVLATPVDIVILGLSYANLQTGSGVLNDSLSGGMQLLPDPLYSLPTDNTYLLTITSTDNGRIFLAGKDGCLYEVAYQAEAGWFSQRCRKINHSKSSLSFLVPSLLQFTFSEDDPILQIAIDNSRNILYTRSEKGVIQVYDLGQDGQGMSRVASVSQNAIVSAAGNIARTIDRSVFKPIVQIAVIENSESLDCQLLAVTHAGVRLYFSTCPFRQPLARPNTLTLVHVRLPPGFSASSTVEKPSKVHRALYSKGILLMAASENEDNDILWCVNHDTFPFQKPMMETQMTAGVDGHSWALSAIDELKVDKIITPLNKDHIPITDSPVVVQQHMLPPKKFVLLSAQGSLMFHKLRPVDQLRHLLVSNVGGDGEEIERFFKLHQEDQACATCLILACSTAACDREVSAWATRAFFRYGGEAQMRFPTTLPPPSNVGPILGSPVYSSSPVPSGSPYPNPSFLGTPSHGIQPPAMSTPVCALGNPATQATNMSCVTGPEIVYSGKHNGICIYFSRIMGNIWDASLVVERIFKSGNREITAIESSVPCQLLESVLQELKGLQEFLDRNSQFAGGPLGNPNTTAKVQQRLIGFMRPENGNPQQMQQELQRKFHEAQLSEKISLQAIQQLVRKSYQALALWKLLCEHQFTIIVAELQKELQEQLKITTFKDLVIRDKELTGALIASLINCYIRDNAAVDGISLHLQDICPLLYSTDDAICSKANELLQRSRQVQNKTEKERMLRESLKEYQKISNQVDLSNVCAQYRQVRFYEGVVELSLTAAEKKDPQGLGLHFYKHGEPEEDIVGLQAFQERLNSYKCITDTLQELVNQSKAAPQSPSVPKKPGPPVLSSDPNMLSNEEAGHHFEQMLKLSQRSKDELFSIALYNWLIQVDLADKLLQVASPFLEPHLVRMAKVDQNRVRYMDLLWRYYEKNRSFSNAARVLSRLADMHSTEISLQQRLEYIARAILSAKSSTAISSIAADGEFLHELEEKMEVARIQLQIQETLQRQYSHHSSVQDAVSQLDSELMDITKLYGEFADPFKLAECKLAIIHCAGYSDPILVQTLWQDIIEKELSDSVTLSSSDRMHALSLKIVLLGKIYAGTPRFFPLDFIVQFLEQQVCTLNWDVGFVIQTMNEIGVPLPRLLEVYDQLFKSRDPFWNRMKKPLHLLDCIHVLLIRYVENPSQVLNCERRRFTNLCLDAVCGYLVELQSMSSSVAVQAITGNFKSLQAKLERLH

SEQ ID NO: 746293 - protein, 1450 aa, Homo sapiens; identical to SEQ ID NO: 746292

SEQ ID NO: 746294 - protein, 1450 aa, Homo sapiens; identical to SEQ ID NO: 746292

SEQ ID NO: 746295 - protein, 1021 aa, Homo sapiens
RTASSSSPPDEAEVRHVEAPRRSFGARALGGGSKLTSWIFSCFSLVFDFFWTLVSTISEMPSSLLGAAMPASTSAAALQEALENAGRLIDRQLQEDRMYPDLSELLMVSAPNNPTVSGMSDMDYPLQGPGLLSVPNLPEISSIRRVPLPPELVEQFGHMQCNCMMGVFPPISRAWLTIDSDIFMWNYEDGGDLAYFDGLSETILAVGLVKPKAGIFQPHVRHLLVLATPVDIVILGLSYANLQTGSGVLNDSLSGGMQLLPDPLYSLPTDNTYLLTITSTDNGRIFLAGKDGCLYEVAYQAEAGWFSQRCRKINHSKSSLSFLVPSLLQFTFSEDDPILQIAIDNSRNILYTRSEKGVIQVYDLGQDGQGMSRVASVSQNAIVSAAGNIARTIDRSVFKPIVQIAVIENSESLDCQLLAVTHAGVRLYFSTCPFRQPLARPNTLTLVHVRLPPGFSASSTVEKPSKVHRALYSKGILLMAASENEDNDILWCVNHDTFPFQKPMMETQMTAGVDGHSWALSAIDELKVDKIITPLNKDHIPITDSPVVVQQHMLPPKKFVLLSAQGSLMFHKLRPVDQLRHLLVSNVGGDGEEIERFFKLHQEDQACATCLILACSTAACDREVSAWATRAFFRYGGEAQMRFPTTLPPPSNVGPILGSPVYSSSPVPSGSPYPNPSFLGTPSHGIQPPAMSTPVCALGNPATQATNMSCVTGPEIVYSGKHNGICIYFSRIMGNIWDASLVVERIFKSGNREITAIESSVPCQLLESVLQELKGLQEFLDRNSQFAGGPLGNPNTTAKVQQRLIGFMRPENGNPQQMQQELQRKFHEAQLSEKISLQAIQQLVRKSYQALALWKLLCEHQFTIIVAELQKELQEQLKITTFKDLVIRDKELTGALIASLINCYIRDNAAVDGISLHLQDICPLLYSTDDAICSKANELLQRSRQVQNKTEKERMLRESLKEYQKISNQVDLPWSGPETSEIIRVGDLPNGGKKNPGRAQLKRDQHGDTLNRHNRSTPHGA

SEQ ID NO: 746296 - protein, 1332 aa, Homo sapiens
MSDMDYPLQGPGLLSVPNLPEISSIRRVPLPPELVEQFGHMQCNCMMGVFPPISRAWLTIDSDIFMWNYEDGGDLAYFDGLSETILAVGLVKPKAGIFQPHVRHLLVLATPVDIVILGLSYANLQTGSGVLNDSLSGGMQLLPDPLYSLPTDNTYLLTITSTDNGRIFLAGKDGCLYEVAYQAEAGWFSQRCRKINHSKSSLSFLVPSLLQFTFSEDDPILQIAIDNSRNILYTRSEKGVIQVYDLGQDGQGMSRVASVSQNAIVSAAGNIARTIDRSVFKPIVQIAVIENSESLDCQLLAVTHAGVRLYFSTCPFRQPLARPNTLTLVHVRLPPGFSASSTVEKPSKVHRALYSKGILLMAASENEDNDILWCVNHDTFPFQKPMMETQMTAGVDGHSWALSAIDELKVDKIITPLNKDHIPITDSPVVVQQHMLPPKKFVLLSAQGSLMFHKLRPVDQLRHLLVSNVGGDGEEIERFFKLHQEDQACATCLILACSTAACDREVSAWATRAFFRYGGEAQMRFPTTLPPPSNVGPILGSPVYSSSPVPSGSPYPNPSFLGTPSHGIQPPAMSTPVCALGNPATQATNMSCVTGPEIVYSGKHNGICIYFSRIMGNIWDASLVVERIFKSGNREITAIESSVPCQLLESVLQELKGLQEFLDRNSQFAGGPLGNPNTTAKVQQRLIGFMRPENGNPQQMQQELQRKFHEAQLSEKISLQAIQQLVRKSYQALALWKLLCEHQFTIIVAELQKELQEQLKITTFKDLVIRDKELTGALIASLINCYIRDNAAVDGISLHLQDICPLLYSTDDAICSKANELLQRSRQVQNKTEKERMLRESLKEYQKISNQVDLSNVCAQYRQVRFYEGVVELSLTAAEKKDPQGLGLHFYKHGEPEEDIVGLQAFQERLNSYKCITDTLQELVNQSKAAPQSPSVPKKPGPPVLSSDPNMLSNEEAGHHFEQMLKLSQRSKDELFSIALYNWLIQVDLADKLLQVASPFLEPHLVRMAKVDQNRVRYMDLLWRYYEKNRSFSNAARVLSRLADMHSTEISLQQRLEYIARAILSAKSSTAISSIAADGEFLHELEEKMEVARIQLQIQETLQRQYSHHSSVQDAVSQLDSELMDITKLYGEFADPFKLAECKLAIIHCAGYSDPILVQTLWQDIIEKELSDSVTLSSSDRMHALSLKIVLLGKIYAGTPRFFPLDFIVQFLEQQVCTLNWDVGFVIQTMNEIGVPLPRLLEVYDQLFKSRDPFWNRMKKPLHLLDCIHVLLIRYVENPSQVLNCERRRFTNLCLDAVCGYLVELQSMSSSVAVQAITGNFKSLQAKLERLH

SEQ ID NO: 746297 - protein, 1450 aa, Homo sapiens; identical to SEQ ID NO: 746292

SEQ ID NO: 746298 - protein, 1255 aa, Homo sapiens
RTASSSSPPDEAEVRHVEAPRRSFGARALGGGSKLTSWIFSCFSLVFDFFWTLVSTISEMPSSLLGAAMPASTSAAALQEALENAGRLIDRQLQEDRMYPDLSELLMVSAPNNPTVSGMSDMDYPLQGPGLLSVPNLPEISSIRRVPLPPELVEQFGHMQCNCMMGVFPPISRAWLTIDSDIFMWNYEDGGDLAYFDGLSETILAVGLVKPKAGIFQPHVRHLLVLATPVDIVILGLSYANLQTGSGVLNDSLSGGMQLLPDPLYSLPTDNTYLLTITSTDNGRIFLAGKDGCLYEVAYQAEAGWFSQRCRKINHSKSSLSFLVPSLLQFTFSEDDPILQIAIDNSRNILYTRSEKGVIQVYDLGQDGQGMSRVASVSQNAIVSAAGNIARTIDRSVFKPIVQIAVIENSESLDCQLLAVTHAGVRLYFSTCPFRQPLARPNTLTLVHVRLPPGFSASSTVEKPSKVHRALYSKGILLMAASENEDNDILWCVNHDTFPFQKPMMETQMTAGVDGHSWALSAIDELKVDKIITPLNKDHIPITDSPVVVQQHMLPPKKFVLLSAQGSLMFHKLRPVDQLRHLLVSNVGGDGEEIERFFKLHQEDQACATCLILACSTAACDREVSAWATRAFFRYGGEAQMRFPTTLPPPSNVGPILGSPVYSSSPVPSGSPYPNPSFLGTPSHGIQPPAMSTPVCALGNPATQATNMSCVTGPEIVYSGKHNGICIYFSRIMGNIWDASLVVERIFKSGNREITAIESSVPCQLLESVLQELKGLQEFLDRNSQFAGGPLGNPNTTAKVQQRLIGFMRPENGNPQQMQQELQRKFHEAQLSEKISLQAIQQLVRKSYQALALWKLLCEHQFTIIVAELQKELQEQLKITTFKDLVIRDKELTGALIASLINCYIRDNAAVDGISLHLQDICPLLYSTDDAICSKANELLQRSRQVQNKTEKERMLRESLKEYQKISNQVDLSNVCAQYRQVRFYEGVVELSLTAAEKKDPQGLGLHFYKHGEPEEDIVGLQAFQERLNSYKCITDTLQELVNQSKAAPQSPSVPKKPGPPVLSSDPNMLSNEEAGHHFEQMLKLSQRSKDELFSIALYNWLIQVDLADKLLQVASPFLEPHLVRMAKVDQNRVRYMDLLWRYYEKNRSFSNAARVLSRLADMHSTEISLQQRLEYIARAILSAKSSTAISSIAADGEFLHELEEKMEVARIQLQIQETLQRQYSHHSSVQDAVSQLDSELMDITKVIKKQVKFL

SEQ ID NO: 746299 - protein, 134 aa, Homo sapiens
MGMYNRNQSSPPPGDLHFRSLRLPVTPERQTADWPSCLKTQPDSDACQPASPTRAAALPTRMGGTTPPRCPRAERSRGSTGIARASALAAGGAGVLRGRDQSAIRAATPDLGRQLSSHCDGHWGAPSILVKFSL

SEQ ID NO: 746300 - protein, 140 aa, Homo sapiens [sequence omitted]

SEQ ID NO: 746301 - protein, 140 aa, Homo sapiens [sequence omitted]

SEQ ID NO: 746302 - protein, 140 aa, Homo sapiens [sequence omitted]

SEQ ID NO: 746303 - protein, 158 aa, Homo sapiens
FTIKIFSPQVSNIEESLTRRHRSFMGMYNRNQSSPPPGDLHFRSLRLPVTPERQTADWPSCLKTQPDSDACQPASPTRAAALPTRMGGTTPPRCPRAERSRGSTGIARASALAAGGAGVLRGRDQSAIRAATPDLGRQLSSHCDGHWGAPSILVKFSL

SEQ ID NO: 746304 - protein, 134 aa, Homo sapiens; identical to SEQ ID NO: 746299

SEQ ID NO: 746305 - protein, 140 aa, Homo sapiens [sequence omitted]

SEQ ID NO: 746306 - protein, 140 aa, Homo sapiens [sequence omitted]

SEQ ID NO: 746307 - protein, 101 aa, Homo sapiens
CPSFPAVRPGFQQTMDQRWSMAWELGTPALKNTQIQGKLKVTENKTPPFHSAFTCFFLISSLLQSCVMCIMIIPILENLNPKQFFNNEQEKQVINIYSAFY

SEQ ID NO: 746308 - protein, 548 aa, Homo sapiens
MALHVPKAPGFAQMLKEGAKHFSGLEEAVYRNIQACKELAQTTRTAYGPKGMNKMVINHLEKLFVTNDAATILRELEVQHPAAKMIVMASHMQEQEVGDGTNFVLVFAGALLELAEELLRIGLSVSEVIEGYEIACRKAHEILPNLVCCSAKNLRDIDEVSSLLRTSIMSKQYGNEVFLAKLIAQACVSIFPDSGHFNVDNIRVCKILGSGISSSSVLHGMVFKKETEGDVTSVKDAKIAVYSCPFDGMITETKGTVLIKTAEELMNFSKGEENLMDAQVKAIADTGANVVVTGGKVADMALHYANKYNIMLVRLNSKWDLRRLCKTVGATALPRLTPPVLEEMGHCDSVYLSEVGDTQVVVFKHEKEDGAISTIVLRGSTDNLMDDIERVVDDGVNTFKVLTRDKRLVPGGGATEIELAKQITSYGETCPGLEQYAIKKFAEAFEAIPRALAENSGVKANEVISKLYAVHQEGNKNVGLDIEAEVPAVKDMLEAGILDTYLGKYWAIKLATNAAVTVLRVDQIIMAKPAGGPKPPSGKKDWDDDQND

SEQ ID NO: 746309 - protein, 250 aa, Homo sapiens
MFVELNNLLNTTPDRAEQGKLTLLCDAKTDGSFLVHHFLSFYLKANCKVCFVALIQSFSHYSIVGQKLGVSLTMARERGQLVFLEGLKSAVDVVFQAQKEPHPLQFLREANAGNLKPLFEFVREALKPVDSGEARWTYPVLLVDDLSVLLSLGMGAVAVLDFIHYCRATVCWELKGNMVVLVHDSGDAEDEENDILLNGLSHQSHLILRAEGLATGFCRDVHGQVCRGLLGNGLLARVPVILDYIGESQA

SEQ ID NO: 746310 - protein, 266 aa, Homo sapiens
MFVELNNLLNTTPDRAEQGKLTLLCDAKTDGSFLVHHFLSFYLKANCKVCFVALIQSFSHYSIVGQKLGVSLTMARERGQLVFLEGLKSAVDVVFQAQKEPHPLQFLREANAGNLKPLFEFVREALKPVDSGEARWTYPVLLVDDLSVLLSLGMGAVAVLDFIHYCRATVCWELKGNMVVLVHDSGDAEDEENDILLNGLSHQSHLILRAEGLATGFCRDVHGQLRILWRRPSQPAVHRDQSFTYQYKIQDKSVSFFAKGMSPAVL

SEQ ID NO: 746311 - protein, 193 aa, Homo sapiens
MARERGQLVFLEGLKSAVDVVFQAQKEPHPLQFLREANAGNLKPLFEFVREALKPVDSGEARWTYPVLLVDDLSVLLSLGMGAVAVLDFIHYCRATVCWELKGNMVVLVHDSGDAEDEENDILLNGLSHQSHLILRAEGLATGFCRDVHGQLRILWRRPSQPAVHRDQSFTYQYKIQDKSVSFFAKGMSPAVL

SEQ ID NO: 746312 - protein, 274 aa, Homo sapiens
IDPGIGLEAWARRKWASGPSRIFSTAGKLTLLCDAKTDGSFLVHHFLSFYLKANCKVCFVALIQSFSHYSIVGQKLGVSLTMARERGQLVFLEGLKSAVDVVFQAQKEPHPLQFLREANAGNLKPLFEFVREALKPVDSGEARWTYPVLLVDDLSVLLSLGMGAVAVLDFIHYCRATVCWELKGNMVVLVHDSGDAEDEENDILLNGLSHQSHLILRAEGLATGFCRDVHGQLRILWRRPSQPAVHRDQSFTYQYKIQDKSVSFFAKGMSPAVL

SEQ ID NO: 746313 - protein, 193 aa, Homo sapiens; identical to SEQ ID NO: 746311

SEQ ID NO: 746314 - protein, 266 aa, Homo sapiens; identical to SEQ ID NO: 746310

SEQ ID NO: 746315 - protein, 217 aa, Homo sapiens
MPRQMGVSLYTTFSPSISKGVSLTMARERGQLVFLEGLKSAVDVVFQAQKEPHPLQFLREANAGNLKPLFEFVREALKPVDSGEARWTYPVLLVDDLSVLLSLGMGAVAVLDFIHYCRATVCWELKGNMVVLVHDSGDAEDEENDILLNGLSHQSHLILRAEGLATGFCRDVHGQLRILWRRPSQPAVHRDQSFTYQYKIQDKSVSFFAKGMSPAVL

SEQ ID NO: 746316 - protein, 217 aa, Homo sapiens; identical to SEQ ID NO: 746315

SEQ ID NO: 746317 - protein, 274 aa, Homo sapiens
MFVELNNLLNTTPDRAEQGKLTLLCDAKTDGSFLVHHFLSFYLKANCKVCFVALIQSFSHYSIVGQKLGVSLTMARERGQLVFLEGLKSAVDVVFQAQKEPHPLQFLREANAGNLKPLFEFVREALKPVDSGEARWTYPVLLVDDLSVLLSLGMGAVAVLDFIHYCRATVCWELKASILYLMQGNMVVLVHDSGDAEDEENDILLNGLSHQSHLILRAEGLATGFCRDVHGQLRILWRRPSQPAVHRDQSFTYQYKIQDKSVSFFAKGMSPAVL

SEQ ID NO: 746318 - protein, 129 aa, Homo sapiens
MFVELNNLLNTTPDRAEQGKLTLLCDAKTDGSFLVHHFLSFYLKANCKVCFVALIQSFSHYSIVGQKLGVSLTMARERGQLVFLEGLKSAVDVVFQAQKEPHPLQFLRETWWSLCTTVEMRRMRRMTSC

SEQ ID NO: 746319 - protein, 108 aa, Homo sapiens
MFVELNNLLNTTPDRAEQGKLTLLCDAKTDGSFLVHHFLSFYLKANCKVCFVALIQSFSHYSIVGQKLGVSLTMARERGQLVFLEGLKSAVDVVFQAQKEPHPLQFLS

SEQ ID NO: 746320 - protein, 293 aa, Homo sapiens
PVASRGCRAVFGVSSSLRRSRSQHSRVLRSRRASSPGSLGNVSGEAQVTRVLTYQHTGTERRSRGREREPANVHAGCAKRTRSGEVSRATRLICTFSFFLDLKTCIKWCTYRPAVRGMSICMPCQPFTDNVAHSKLDVTPDHGGWSVGCVCSLRESSTCPMERTIYAQAHRRGSHQPRACRFLREANAGNLKPLFEFVREALKPVDSGEARWTYPVLLVDDLSVLLSLGMGAVAVLDFIHYCRATVCWELKLRILWRRPSQPAVHRDQSFTYQYKIQDKSVSFFAKGMSPAVL

SEQ ID NO: 746321 - protein, 181 aa, Homo sapiens
MFVELNNLLNTTPDRAEQGKLTLLCDAKTDGSFLVHHFLSFYLKANCKVCFVALIQSFSHYSIVGQKLGVSLTMARERGQLVFLEGLKSAVDVVFQAEPGHGGGGCARLHSLLQSHRVLGTKGTHGTAFSAPTCDLQELRQVQTSLACCDLFICLGFWLYSGRPRKLLQPPCFPLPAIAEK

SEQ ID NO: 746322 - protein, 114 aa, Homo sapiens
MISTHCSLHPQGSSDPPISASQVAWTTDTCYHTQLIFIFLVETGFHHVGQAGLDLLSSSNLPTSASQSAGITGVSHCTRPTLCPPLELGLGTVARPDSLNVQFKDGRQWGISSI

SEQ ID NO: 746323 - protein, 136 aa, Homo sapiens; identical to SEQ ID NO: 741065

SEQ ID NO: 746324 - protein, 349 aa, Homo sapiens [sequence omitted]

SEQ ID NO: 746325 - protein, 334 aa, Homo sapiens
MNILYSSDTTLGILPVFQSGIGLMGNLLLFITYMYIFLFWPHQKNPLDVILMHLTLANVITVIIRGVPYIMSSFRLRSTFVDTGCKTGLYIYKMTWGICVCTSSLLSTFQAVIICPCHSKWAWLKLKSPHKFSLIDLFLNNRLINMWVIISTVATSKSTNVGLVYSLIYCKTRLFIYYHAMIFQSAMFTQGFLFLFLMIWTSFYMVTIFLRHQKTVFHIHSISLSPQSFPETEASHVFFLLVSRFVFFYGTNVCLSTYISSMYENSLILENITSFVSSSYPIICTLILINYDNKVSRLTCAILNMIISPCLPHSFLLHQRNPDKNYFNHKRMCF

SEQ ID NO: 746326 - protein, 280 aa, Homo sapiens
MDLQGRGVPSIDRLRVLLMLFHTMAQIMAEQEVENLSGLSTNPEKDIFVVRENGTTCLMAEFAAKFIVPYDVWASNYVDLITEQADIALTRGAEVKGRCGHSQSELQVFWVDRAYALKMLFVKESHNMSKGPEATWRLSKVQFVYDSSEKTHFKDAVSAGKHTANSHHLSALVTPAGKSYECQAQQTISLASSDPQKTVTMILSAVHIQPFDIISDFVFSEEHKCPVDEREQLEETLPLILGLILGLVIMVTLAIYHVHHKMTANQVQIPRDRSQYKHMG

SEQ ID NO: 746327 - protein, 414 aa, Homo sapiens
RTVTVRTRIAVLSLRPQCGGILFRHVVVLTLGNGLGQNLDLASVQAHAAVQGRRVLIPGVNIRQENLGRGRFHDHVQDAAVGGVGQALRCHQHKAVGLTQHLEPFPDLRAECRVAEHQPGFVQDDERPPVWWNSNPEKDIFVVRENGTTCLMAEFAAKFIVPYDVWASNYVDLITEQADIALTRGAEVKGRCGHSQSELQVFWVDRAYALKMLFVKVTPSPAGRGAAGSAWVWEVAAPRFKNPELRGRLKRTSPAQQESHNMSKGPEATWRLSKVQFVYDSSEKTHFKDAVSAGKHTANSHHLSALVTPAGKSYECQAQQTISLASSDPQKTVTMILSAVHIQPFDIISDFVFSEEHKCPVDEREQLEETLPLILGLILGLVIMVTLAIYHVHHKMTANQVQIPRDRSQYKHMG

SEQ ID NO: 746328 - protein, 153 aa, Homo sapiens [sequence omitted]

SEQ ID NO: 746329 - protein, 302 aa, Homo sapiens
RTVTVRTRIAVLSLRPPVWWNSNPEKDIFVVRENGTTCLMAEFAAKFIVPYDVWASNYVDLITEQADIALTRGAEVKGRCGHSQSELQVFWVDRAYALKMLFVKVTPSPAGRGAAGSAWVWEVAAPRFKNPELRGRLKRTSPAQQESHNMSKGPEATWRLSKVQFVYDSSEKTHFKDAVSAGKHTANSHHLSALVTPAGKSYECQAQQTISLASSDPQKTVTMILSAVHIQPFDIISDFVFSEEHKCPVDEREQLEETLPLILGLILGLVIMVTLAIYHVHHKMTANQVQIPRDRSQYKHMG

SEQ ID NO: 746330 - protein, 186 aa, Homo sapiens
MGRRCGHSQSELQVFWVDRAYALKMLFVKESHNMSKGPEATWRLSKVQFVYDSSEKTHFKDAVSAGKHTANSHHLSALVTPAGKSYECQAQQTISLASSDPQKTVTMILSAVHIQPFDIISDFVFSEEHKCPVDEREQLEETLPLILGLILGLVIMVTLAIYHVHHKMTANQVQIPRDRSQYKHMG

SEQ ID NO: 746331 - protein, 162 aa, Homo sapiens
MLFVKESHNMSKGPEATWRLSKVQFVYDSSEKTHFKDAVSAGKHTANSHHLSALVTPAGKSYECQAQQTISLASSDPQKTVTMILSAVHIQPFDIISDFVFSEEHKCPVDEREQLEETLPLILGLILGLVIMVTLAIYHVHHKMTANQVQIPRDRSQYKHMG

SEQ ID NO: 746332 - protein, 280 aa, Homo sapiens; identical to SEQ ID NO: 746326

SEQ ID NO: 746333 - protein, 321 aa, Homo sapiens
MDLQGRGVPSIDRLRVLLMLFHTMAQIMAEQEVENLSGLSTNPEKDIFVVRENGTTCLMAEFAAKFIVPYDVWASNYVDLITEQADIALTRGAEVKGRCGHSQSELQVFWVDRAYALKMLFVKVTPSPAGRGAAGSAWVWEVAAPRFKNPELRGRLKRTSPAQQESHNMSKGPEATWRLSKVQFVYDSSEKTHFKDAVSAGKHTANSHHLSALVTPAGKSYECQAQQTISLASSDPQKTVTMILSAVHIQPFDIISDFVFSEEHKCPVDEREQLEETLPLILGLILGLVIMVTLAIYHVHHKMTANQVQIPRDRSQYKHMG

SEQ ID NO: 746334 - protein, 135 aa, Homo sapiens
VPDLPQSLDLGPLALWVAGSLDDAGEKACVHCLSSNFSFSKGSSQNAQLSPLQKALPERAQVEDVCIYLETVHGETQRGVLTRQQVHSSRHHECSPYARVHLLKSLTKQPNCGWDYSLFIGEKTEAESHWVVCQS

SEQ ID NO: 746335 - protein, 447 aa, Homo sapiens
GHQDNGRRRRRVTSGCGLARGSSAMVFSNNDEGLINKKLPKELLLRIFSFLDIVTLCRCAQISKAWNILALDGSNWQRIDLFNFQTDVEGRVVENISKRCGGFLRKLSLRGCIGVGDSSLKTFAQNCRNIEHLNLNGCTKITDSTCYSLSRFCSKLKHLDLTSCVSITNSSLKGISEGCRNLEYLNLSWCDQITKDGIEALVRGCRGLKALLLRGCTQLEDEALKHIQNYCHELVSLNLQSCSRITDEGVVQICRGCHRLQALCLSGCSNLTDASLTALGLNCPRLQILEAARCSHLTDAGFTLLARNCHELEKMDLEECILITDSTLIQLSIHCPKLQALSLSHCELITDDGILHLSNSTCGHERLRVLELDNCLLITDVALEHLENCRGLERLELYDCQQVTRAGIKRMRAQLPHVKVHAYFAPVTPPTAVAGSGQRLCRCCVIL

SEQ ID NO: 746336 - protein, 447 aa, Homo sapiens; identical to SEQ ID NO: 746335

SEQ ID NO: 746337 - protein, 447 aa, Homo sapiens; identical to SEQ ID NO: 746335

SEQ ID NO: 746338 - protein, 447 aa, Homo sapiens; identical to SEQ ID NO: 746335

SEQ ID NO: 746339 - protein, 447 aa, Homo sapiens; identical to SEQ ID NO: 746335

SEQ ID NO: 746340 - protein, 478 aa, Homo sapiens
GHQDNGRRRRRVTSGCGLARGSSAMVFSNNDEGLINKKLPKELLLRMLFSLMLNFTWSNPECTKYVHSIGLDSFCNGIFSFLDIVTLCRCAQISKAWNILALDGSNWQRIDLFNFQTDVEGRVVENISKRCGGFLRKLSLRGCIGVGDSSLKTFAQNCRNIEHLNLNGCTKITDSTCYSLSRFCSKLKHLDLTSCVSITNSSLKGISEGCRNLEYLNLSWCDQITKDGIEALVRGCRGLKALLLRGCTQLEDEALKHIQNYCHELVSLNLQSCSRITDEGVVQICRGCHRLQALCLSGCSNLTDASLTALGLNCPRLQILEAARCSHLTDAGFTLLARNCHELEKMDLEECILITDSTLIQLSIHCPKLQALSLSHCELITDDGILHLSNSTCGHERLRVLELDNCLLITDVALEHLENCRGLERLELYDCQQVTRAGIKRMRAQLPHVKVHAYFAPVTPPTAVAGSGQRLCRCCVIL

SEQ ID NO: 746341 - protein, 432 aa, Homo sapiens
MLFSLMLNFTWSNPECTKYVHSIGLDSFCNGIFSFLDIVTLCRCAQISKAWNILALDGSNWQRIDLFNFQTDVEGRVVENISKRCGGFLRKLSLRGCIGVGDSSLKTFAQNCRNIEHLNLNGCTKITDSTCYSLSRFCSKLKHLDLTSCVSITNSSLKGISEGCRNLEYLNLSWCDQITKDGIEALVRGCRGLKALLLRGCTQLEDEALKHIQNYCHELVSLNLQSCSRITDEGVVQICRGCHRLQALCLSGCSNLTDASLTALGLNCPRLQILEAARCSHLTDAGFTLLARNCHELEKMDLEECILITDSTLIQLSIHCPKLQALSLSHCELITDDGILHLSNSTCGHERLRVLELDNCLLITDVALEHLENCRGLERLELYDCQQVTRAGIKRMRAQLPHVKVHAYFAPVTPPTAVAGSGQRLCRCCVIL

SEQ ID NO: 746342 - protein, 453 aa, Homo sapiens
GHQDNGRRRRRVTSGCGLARGSSAMVFSNNDEGLINKKLPKELLLRIFSFLDIVTLCRCAQISKAWNILALDGSNWQRIDLFNFQTDVEGRVVENISKRCGGFLRKLSLRGCIGVGDSSLKTFAQNCRNIEHLNLNGCTKITDSALLFFSTCYSLSRFCSKLKHLDLTSCVSITNSSLKGISEGCRNLEYLNLSWCDQITKDGIEALVRGCRGLKALLLRGCTQLEDEALKHIQNYCHELVSLNLQSCSRITDEGVVQICRGCHRLQALCLSGCSNLTDASLTALGLNCPRLQILEAARCSHLTDAGFTLLARNCHELEKMDLEECILITDSTLIQLSIHCPKLQALSLSHCELITDDGILHLSNSTCGHERLRVLELDNCLLITDVALEHLENCRGLERLELYDCQQVTRAGIKRMRAQLPHVKVHAYFAPVTPPTAVAGSGQRLCRCCVIL

SEQ ID NO: 746343 - protein, 112 aa, Homo sapiens
MVFLFQSLSHCELITDDGILHLSNSTCGHERLRVLELDNCLLITDVALEHLENCRGLERLELYDCQQVTRAGIKRMRAQLPHVKVHAYFAPVTPPTAVAGSGQRLCRCCVIL

SEQ ID NO: 746344 - protein, 134 aa, Homo sapiens
SFSDIIHLLKMKEPSHHNKKLFGFSFCKSLSHCELITDDGILHLSNSTCGHERLRVLELDNCLLITDVALEHLENCRGLERLELYDCQQVTRAGIKRMRAQLPHVKVHAYFAPVTPPTAVAGSGQRLCRCCVIL

SEQ ID NO: 746345 - protein, 244 aa, Homo sapiens
GHQDNGRRRRRVTSGCGLARGSSAMVFSNNDEGLINKKLPKELLLRIFSFLDIVTLCRCAQISKAWNILALDGSNWQRIDLFNFQTDVEGRVVENISKRCGGFLRKLSLRGCIGVGDSSLKTFAQNCRNIEHLNLNGCTKITDSTCYSLSRFCSKLKHLDLTSCVSITNSSLKGISEGCRNLEYLNLSWCDQITKDGIEALVRGCRGLKALLLRGCTQEVRSRCFGLEQNLLRLSHVLSVIFGR

SEQ ID NO: 746346 - protein, 1844 aa, Homo sapiens
SALPCVHRVETWDVKDVVNCVGGMGALLPLLERVAAQPKEAEAGPAETHDLVGPELTSGHNTQGLVLPLGKSSEERMERNAVAAFLLMLRNFLQGHMVNQESLVQCQGPAIIGALLRKVPSWAMDMNVLMSAQLLMEQVAAEGSGPLLYLLYQHLLFNFHLWTLSDFAVRLGHIQYMSSIVREHRQKLRKKYGVQFILDALRTHYSPQRERPLAADDLRTVQTSLLGLAREFLVRSLSADDVQVTQTMLSFLAATGDDGQAVGALDLLLALLHGSLVQESLAVFLLEPGNLEVLLALLVRPGSLPLLPDRVCKILRRLQQNERLPERSRQRLRLRECGLQGLVACLPEGTVSPQLCQGLYKLFLGADCLNLSDLLAVVQLSLQADLSVRLDICRQLFHLIYGQPDVVRLLARQAGWQDVLTRLYVLEAATAGSPPPSSPESPTSPKPAPPKPPTESPAEPSDVFLPSEAPCPDPDGFYHALSPFCTPFDLGLERSSVGSGNTAGGGGSSGTLTPASQPGTPSPLDGPRPFPAAPGRHSSSLSNVLEDGSLPEPTISGDDTSNTSNPQQTSEEELCNLLTNVLFSVTWRGVEGSDEAAWRERGQVFSVLTQLGASATLVRPPDCIKRSLLEMMLESALTDIKEAPVGVLASLTQQALWLLRLLQDFLCAEGHGNQELWSEKLFEGVCSLLDRLGAWPHLANGTADLREMAQIGLRLVLGYILLEDPQLHAQAYVRLHMLLQTAVPARREEACYVLSKLEAALGRVLNTSSLESATDEAGSPLAAAAAAAAAERCSWLVPLVRTLLDRAYEPLGLQWGLPSLPPTNGSPTFFEDFQAFCATPEWRHFIDKQVQPTMSQFEMDTYAKSHDLMSGFWNACYDMLMSSGQRRQWERAQSRRAFQELVLEPAQRRARLEGLRYTAVLKQQATQHSMALLHWGALWRQLASPCGAWALRDTPIPRWKLSSAETYSRMRLKLVPNHHFDPHLEASALRDNLGEVPLTPTEEASLPLAVTKEAKVSTPPELLQEDQLGEDELAELETPMEAAELDEQREKLVLSAECQLVTVVAVVPGLLEVTTQNVYFYDGSTERVETEEGIGYDFRRPLAQLREVHLRRFNLRRSALELFFIDQANYFLNFPCKVGTTPVSSPSQTPRPQPGPIPPHTQVRNQVYSWLLRLRPPSQGYLSSRSPQEMLRASGLTQKWVQREISNFEYLMQLNTIAGRTYNDLSQYPVYESFEDPAGTIDKFHYGTHYSNAAGVMHYLIRVEPFTSLHVQLQSGRFDCSDRQFHSVAAAWQARLESPADVKELIPEFFYFPDFLENQNGFDLGCLQLTNEKVGDVVLPPWASSPEDFIQQHRQALESEYVSAHLHEWIDLIFGYKQRGPAAEEALNVFYYCTYEGAVDLDHVTDERERKALEGIISNFGQTPCQLLKEPHPTRLSAEEAAHRLARLDTNSPSIFQHLDELKAFFAEVVSDGVPLVLALVPHRQPHSFITQGSPDLLVTVSASGLLGTHSWLPYDRNISNYFSFSKDPTMGSHKTQRLLSGPWVPGSGVSGQALAVAPDGKLLFSGGHWDGSLRVTALPRGKLLSQLSCHLDVVTCLALDTCGIYLISGSRDTTCMVWRLLHQGGLSVGLAPKPVQVLYGHGAAVSCVAISTELDMAVSGSEDGTVIIHTVRRGQFVAALRPLGATFPGPIFHLALGSEGQIVVQSSAWERPGAQVTYSLHLYSVNGKLRASLPLAEQPTALTVTEDFVLLGTAQCALHILQLNTLLPAAPPLPMKVAIRSVAVTKERSHVLVGLEDGKLIVVVAGQPSEVRSSQFARKLWRSSRRISQVSSGETEYNPTEAR

SEQ ID NO: 746347 - protein, 1961 aa, Homo sapiens
LEDPQTRHRSLPSLSEPFSSCCIGSAGYRIDSTLAGTQDTRWGSPTSLEGELGAVAIFHEALQATALRTLCTLGPNETAPFKPEGELHELSTRLLLHYSPQACKNNICLDLSPSHGLDGRLTGHRVETWDVKDVVNCVGGMGALLPLLERVAAQPKEAEAGPAETHDLVGPELTSGHNTQGLVLPLGKSSEERMERNAVAAFLLMLRNFLQGHMVNQESLVQCQGPAIIGALLRKVPSWAMDMNVLMSAQLLMEQVAAEGSGPLLYLLYQHLLFNFHLWTLSDFAVRLGHIQYMSSIVREHRQKLRKKYGVQFILDALRTHYSPQRERPLAADDLRTVQTSLLGLAREFLVRSLSADDVQVTQTMLSFLAATGDDGQAVGALDLLLALLHGSLVQESLAVFLLEPGNLEVLLALLVRPGSLPLLPDRVCKILRRLQQNERLPERSRQRLRLRECGLQGLVACLPEGTVSPQLCQGLYKLFLGADCLNLSDLLAVVQLSLQADLSVRLDICRQLFHLIYGQPDVVRLLARQAGWQDVLTRLYVLEAATAGSPPPSSPESPTSPKPAPPKPPTESPAEPSDVFLPSEAPCPDPDGFYHALSPFCTPFDLGLERSSVGSGNTAGGGGSSGTLTPASQPGTPSPLDGPRPFPAAPGRHSSSLSNVLEDGSLPEPTISGDDTSNTSNPQQTSEEELCNLLTNVLFSVTWRGVEGSDEAAWRERGQVFSVLTQLGASATLVRPPDCIKRSLLEMMLESALTDIKEAPVGVLASLTQQALWLLRLLQDFLCAEGHGNQELWSEKLFEGVCSLLDRLGAWPHLANGTADLREMAQIGLRLVLGYILLEDPQLHAQAYVRLHMLLQTAVPARREEACYVLSKLEAALGRVLNTSSLESATDEAGSPLAAAAAAAAAERCSWLVPLVRTLLDRAYEPLGLQWGLPSLPPTNGSPTFFEDFQAFCATPEWRHFIDKQVQPTMSQFEMDTYAKSHDLMSGFWNACYDMLMSSGQRRQWERAQSRRAFQELVLEPAQRRARLEGLRYTAVLKQQATQHSMALLHWGALWRQLASPCGAWALRDTPIPRWKLSSAETYSRMRLKLVPNHHFDPHLEASALRDNLGEVPLTPTEEASLPLAVTKEAKVSTPPELLQEDQLGEDELAELETPMEAAELDEQREKLVLSAECQLVTVVAVVPGLLEVTTQNVYFYDGSTERVETEEGIGYDFRRPLAQLREVHLRRFNLRRSALELFFIDQANYFLNFPCKVGTTPVSSPSQTPRPQPGPIPPHTQVRNQVYSWLLRLRPPSQGYLSSRSPQEMLRASGLTQKWVQREISNFEYLMQLNTIAGRTYNDLSQYPVYESFEDPAGTIDKFHYGTHYSNAAGVMHYLIRVEPFTSLHVQLQSGRFDCSDRQFHSVAAAWQARLESPADVKELIPEFFYFPDFLENQNGFDLGCLQLTNEKVGDVVLPPWASSPEDFIQQHRQALESEYVSAHLHEWIDLIFGYKQRGPAAEEALNVFYYCTYEGAVDLDHVTDERERKALEGIISNFGQTPCQLLKEPHPTRLSAEEAAHRLARLDTNSPSIFQHLDELKAFFAEVVSDGVPLVLALVPHRQPHSFITQGSPDLLVTVSASGLLGTHSWLPYDRNISNYFSFSKDPTMGSHKTQRLLSGPWVPGSGVSGQALAVAPDGKLLFSGGHWDGSLRVTALPRGKLLSQLSCHLDVVTCLALDTCGIYLISGSRDTTCMVWRLLHQGGLSVGLAPKPVQVLYGHGAAVSCVAISTELDMAVSGSEDGTVIIHTVRRGQFVAALRPLGATFPGPIFHLALGSEGQIVVQSSAWERPGAQVTYSLHLYSVNGKLRASLPLAEQPTALTVTEDFVLLGTAQCALHILQLNTLLPAAPPLPMKVAIRSVAVTKERSHVLVGLEDGKLIVVVAGQPSEVRSSQFARKLWRSSRRISQVSSGETEYNPTEAR

SEQ ID NO: 746348 - protein, 1886 aa, Homo sapiens
SALPCVHRVETWDVKDVVNCVGGMGALLPLLERVAAQPKEAEAGPAETHDLVGPELTSGHNTQGLVLPLGKSSEERMERNAVAAFLLMLRNFLQGHMVNQESLVQCQGPAIIGALLRKVPSWAMDMNVLMSAQLLMEQVAAEGSGPLLYLLYQHLLFNFHLWTLSDFAVRLGHIQYMSSIVREHRQKLRKKYGVQFILDALRTHYSPQRERPLAADDLRTVQTSLLGLAREFLVRSLSADDVQVTQTMLSFLAATGDDGQAVGALDLLLALLHGSLVQESLAVFLLEPGNLEVLLALLVRPGSLPLLPDRVCKILRRLQQNERLPERSRQRLRLRECGLQGLVACLPEGTVSPQLCQGLYKLFLGADCLNLSDLLAVVQLSLQADLSVRLDICRQLFHLIYGQPDVVRLLARQAGWQDVLTRLYVLEAATAGSPPPSSPESPTSPKPAPPKPPTESPAEPSDVFLPSEAPCPDPDGFYHALSPFCTPFDLGLERSSVGSGNTAGGGGSSGTLTPASQPGTPSPLDGPRPFPAAPGRHSSSLSNVLEDGSLPEPTISGDDTSNTSNPQQTSEEELCNLLTNVLFSVTWRGVEGSDEAAWRERGQVFSVLTQLGASATLVRPPDCIKRSLLEMMLESALTDIKEAPVGVLASLTQQALWLLRLLQDFLCAEGHGNQELWSEKLFEGVCSLLDRLGAWPHLANGTADLREMAQIGLRLVLGYILLEDPQLHAQAYVRLHMLLQTAVPARREEACYVLSKLEAALGRVLNTSSLESATDEAGSPLAAAAAAAAAERCSWLVPLVRTLLDRAYEPLGLQWGLPSLPPTNGSPTFFEDFQAFCATPEWRHFIDKQVQPTMSQFEMDTYAKSHDLMSGFWNACYDMLMSSGQRRQWERAQSRRAFQELVLEPAQRRARLEGLRYTAVLKQQATQHSMALLHWGALWRQLASPCGAWALRDTPIPRWKLSSAETYSRMRLKLVPNHHFDPHLEASALRDNLGEVPLTPTEEASLPLAVTKEAKVSTPPELLQEDQLGEDELAELETPMEAAELDEQREKLVLSAECQLVTVVAVVPGLLEVTTQNVYFYDGSTERVETEEGIGYDFRRPLAQLREVHLRRFNLRRSALELFFIDQANYFLNFPCKVGTTPVSSPSQTPRPQPGPIPPHTQVRNQVYSWLLRLRPPSQGYLSSRSPQEMLRASGLTQKWVQREISNFEYLMQLNTIAGRTYNDLSQYPVFPWVLQDYVSPTLDLSNPAVFRDLSKPIGVVNPKHAQLVREKYESFEDPAGTIDKFHYGTHYSNAAGVMHYLIRVEPFTSLHVQLQSGRFDCSDRQFHSVAAAWQARLESPADVKELIPEFFYFPDFLENQNGFDLGCLQLTNEKVGDVVLPPWASSPEDFIQQHRQALESEYVSAHLHEWIDLIFGYKQRGPAAEEALNVFYYCTYEGAVDLDHVTDERERKALEGIISNFGQTPCQLLKEPHPTRLSAEEAAHRLARLDTNSPSIFQHLDELKAFFAEVVSDGVPLVLALVPHRQPHSFITQGSPDLLVTVSASGLLGTHSWLPYDRNISNYFSFSKDPTMGSHKTQRLLSGPWVPGSGVSGQALAVAPDGKLLFSGGHWDGSLRVTALPRGKLLSQLSCHLDVVTCLALDTCGIYLISGSRDTTCMVWRLLHQGGLSVGLAPKPVQVLYGHGAAVSCVAISTELDMAVSGSEDGTVIIHTVRRGQFVAALRPLGATFPGPIFHLALGSEGQIVVQSSAWERPGAQVTYSLHLYSVNGKLRASLPLAEQPTALTVTEDFVLLGTAQCALHILQLNTLLPAAPPLPMKVAIRSVAVTKERSHVLVGLEDGKLIVVVAGQPSEVRSSQFARKLWRSSRRISQVSSGETEYNPTEAR

SEQ ID NO: 746349 - protein, 1856 aa, Homo sapiens
SALPCVHRVETWDVKDVVNCVGGMGALLPLLERVAAQPKEAEAGPAETHDLVGPELTSGHNTQGLVLPLGKSSEERMERNAVAAFLLMLRNFLQGHMVNQESLVQCQGPAIIGALLRKVPSWAMDMNVLMSAQLLMEQVAAEGSGPLLYLLYQHLLFNFHLWTLSDFAVRLGHIQYMSSIVREHRQKLRKKYGVQFILDALRTHYSPQRERPLAADDLRTVQTSLLGLAREFLVRSLSADDVQVTQTMLSFLAATGDDGQAVGALDLLLALLHGSLVQESLAVFLLEPGNLEVLLALLVRPGSLPLLPDRVCKILRRLQQNERLPERSRQRLRLRECGLQGLVACLPEGTVSPQLCQGLYKLFLGADCLNLSDLLAVVQLSLQADLSVRLDICRQLFHLIYGQPDVVRLLARQAGWQDVLTRLYVLEAATAGSPPPSSPESPTSPKPAPPKPPTESPAEPSDVFLPSEAPCPDPDGFYHALSPFCTPFDLGLERSSVGSGNTAGGGGSSGTLTPASQPGTPSPLDGPRPFPAAPGRHSSSLSNVLEDGSLPEPTISGDDTSNTSNPQQTSEEELCNLLTNVLFSVTWRGVEGSDEAAWRERGQVFSVLTQLGASATLVRPPDCIKRSLLEMMLESALTDIKEAPVGVLASLTQQALWLLRLLQDFLCAEGHGNQELWSEKLFEGVCSLLDRLGAWPHLANGTADLREMAQIGLRLVLGYILLEDPQLHAQAYVRLHMLLQTAVPARREEACYVLSKLEAALGRVLNTSSLESATDEAGSPLAAAAAAAAAERCSWLVPLVRTLLDRAYEPLGLQWGLPSLPPTNGSPTFFEDFQAFCATPEWRHFIDKQVQPTMSQFEMDTYAKSHDLMSGFWNACYDMLMSSGQRRQWERAQSRRAFQELVLEPAQRRARLEGLRYTAVLKQQATQHSMALLHWGALWRQLASPCGAWALRDTPIPRWKLSSAETYSRMRLKLVPNHHFDPHLEASALRDNLGEVPLTPTEEASLPLAVTKEAKVSTPPELLQEDQLGEDELAELETPMEAAELDEQREKLVLSAECQLVTVVAVVPGLLEVTTQNVYFYDGSTERVETEEGIGYDFRRPLAQLREVHLRRFNLRRSALELFFIDQANYFLNFPCKVGTTPVSSPSQTPRPQPGPIPPHTQVRNQVYSWLLRLRPPSQGYLSSRSPQEMLRASGLTQKWVQREISNFEYLMQLNTIAGRTYNDLSQYPVFPWVLQDYVSPTLDLSNPAVFRDLSKPIGVVNPKHAQLVREKYESFEDPAGTIDKFHYGTHYSNAAGVMHYLIRVEPFTSLHVQLQSGRFDCSDRQFHSVAAAWQARLESPADVKELIPEFFYFPDFLENQNGFDLGCLQLTNEKVGDVVLPPWASSPEDFIQQHRQALESEYVSAHLHEWIDLIFGYKQRGPAAEEALNVFYYCTYEGAVDLDHVTDERERKALEGIISNFGQTPCQLLKEPHPTRLSAEEAAHRLARLDTNSPSIFQHLDELKAFFAEVTVSASGLLGTHSWLPYDRNISNYFSFSKDPTMGSHKTQRLLSGPWVPGSGVSGQALAVAPDGKLLFSGGHWDGSLRVTALPRGKLLSQLSCHLDVVTCLALDTCGIYLISGSRDTTCMVWRLLHQGGLSVGLAPKPVQVLYGHGAAVSCVAISTELDMAVSGSEDGTVIIHTVRRGQFVAALRPLGATFPGPIFHLALGSEGQIVVQSSAWERPGAQVTYSLHLYSVNGKLRASLPLAEQPTALTVTEDFVLLGTAQCALHILQLNTLLPAAPPLPMKVAIRSVAVTKERSHVLVGLEDGKLIVVVAGQPSEVRSSQFARKLWRSSRRISQVSSGETEYNPTEAR

SEQ ID NO: 746350 - protein, 1914 aa, Homo sapiens
SALPCVHRVETWDVKDVVNCVGGMGALLPLLERVAAQPKEAEAGPAETHDLVGPELTSGHNTQGLVLPLGKSSEERMERNAVAAFLLMLRNFLQGHMVNQESLVQCQGPAIIGALLRKVPSWAMDMNVLMSAQLLMEQVAAEGSGPLLYLLYQHLLFNFHLWTLSDFAVRLGHIQYMSSIVREHRQKLRKKYGVQFILDALRTHYSPQRERPLAADDLRTVQTSLLGLAREFLVRSLSADDVQVTQTMLSFLAATGDDGQAVGALDLLLALLHGSLVQESLAVFLLEPGNLEVLLALLVRPGSLPLLPDRVCKILRRLQQNERLPERSRQRLRLRECGLQGLVACLPEGTVSPQLCQGLYKLFLGADCLNLSDLLAVVQLSLQADLSVRLDICRQLFHLIYGQPDVVRLLARQAGWQDVLTRLYVLEAATAGSPPPSSPESPTSPKPAPPKPPTESPAEPSDVFLPSEAPCPDPDGFYHALSPFCTPFDLGLERSSVGSGNTAGGGGSSGTLTPASQPGTPSPLDGPRPFPAAPGRHSSSLSNVLEDGSLPEPTISGDDTSNTSNPQQTSEEELCNLLTNVLFSVTWRGVEGSDEAAWRERGQVFSVLTQLGASATLVRPPDCIKRSLLEMMLESALTDIKEAPVGVLASLTQQALWLLRLLQDFLCAEGHGNQELWSEKLFEGVCSLLDRLGAWPHLANGTADLREMAQIGLRLVLGYILLEDPQLHAQAYVRLHMLLQTAVPARREEACYVLSKLEAALGRVLNTSSLESATDEAGSPLAAAAAAAAAERCSWLVPLVRTLLDRAYEPLGLQWGLPSLPPTNGSPTFFEDFQAFCATPEWRHFIDKQVQPTMSQFEMDTYAKSHDLMSGFWNACYDMLMSSGQRRQWERAQSRRAFQELVLEPAQRRARLEGLRYTAVLKQQATQHSMALLHWGALWRQLASPCGAWALRDTPIPRWKLSSAETYSRMRLKLVPNHHFDPHLEASALRDNLGEVPLTPTEEASLPLAVTKEAKVSTPPELLQEDQLGEDELAELETPMEAAELDEQREKLVLSAECQLVTVVAVVPGLLEVTTQNVYFYDGSTERVETEEGIGYDFRRPLAQLREVHLRRFNLRRSALELFFIDQANYFLNFPCKVGTTPVSSPSQTPRPQPGPIPPHTQVRNQVYSWLLRLRPPSQGYLSSRSPQEMLRASGLTQKWVQREISNFEYLMQLNTIAGRTYNDLSQYPVFPWVLQDYVSPTLDLSNPAVFRDLSKPIGVVNPKHAQLVREKYESFEDPAGTIDKFHYGTHYSNAAGVMHYLIRVEPFTSLHVQLQSGRFDCSDRQFHSVAAAWQARLESPADVKELIPEFFYFPDFLENQNGFDLGCLQLTNEKVGDVVLPPWASSPEDFIQQHRQALESEYVSAHLHEWIDLIFGYKQRGPAAEEALNVFYYCTYEGAVDLDHVTDERERKALEGIISNFGQTPCQLLKEPHPTRLSAEEAAHRLARLDTNSPSIFQHLDELKAFFAEVVSDGVPLVLALVPHRQPHSFITQGSPDLLVSALCRAPAQLHSPLLCQKPTSAPSCLQVTVSASGLLGTHSWLPYDRNISNYFSFSKDPTMGSHKTQRLLSGPWVPGSGVSGQALAVAPDGKLLFSGGHWDGSLRVTALPRGKLLSQLSCHLDVVTCLALDTCGIYLISGSRDTTCMVWRLLHQGGLSVGLAPKPVQVLYGHGAAVSCVAISTELDMAVSGSEDGTVIIHTVRRGQFVAALRPLGATFPGPIFHLALGSEGQIVVQSSAWERPGAQVTYSLHLYSVNGKLRASLPLAEQPTALTVTEDFVLLGTAQCALHILQLNTLLPAAPPLPMKVAIRSVAVTKERSHVLVGLEDGKLIVVVAGQPSEVRSSQFARKLWRSSRRISQVSSGETEYNPTEAR

SEQ ID NO: 746351 - protein, 1972 aa, Homo sapiens
SALPCVHRVETWDVKDVVNCVGGMGALLPLLERVAAQPKEAEAGPAETHDLVGPELTSGHNTQGLVLPLGKSSEERMERNAVAAFLLMLRNFLQGHMVNQESLVQCQGPAIIGALLRKVPSWAMDMNVLMSAQLLMEQVAAEGSGPLLYLLYQHLLFNFHLWTLSDFAVRLGHIQYMSSIVREHRQKLRKKYGVQFILDALRTHYSPQRERPLAADDLRTVQTSLLGLAREFLVRSLSADDVQVTQTMLSFLAATGDDGQAVGALDLLLALLHGSLVQESLAVFLLEPGNLEVLLALLVRPGSLPLLPDRVCKILRRLQQNERLPERSRQRLRLRECGLQGLVACLPEGTVSPQLCQGLYKLFLGADCLNLSDLLAVVQLSLQADLSVRLDICRQLFHLIYGQPDVVRLLARQAGWQDVLTRLYVLEAATAGSPPPSSPESPTSPKPAPPKPPTESPAEPSDVFLPSEAPCPDPDGFYHALSPFCTPFDLGLERSSVGSGNTAGGGGSSGTLTPASQPGTPSPLDGPRPFPAAPGRHSSSLSNVLEDGSLPEPTISGDDTSNTSNPQQTSEEELCNLLTNVLFSVTWRGVEGSDEAAWRERGQVFSVLTQLGASATLVRPPDCIKRSLLEMMLESALTDIKEAPVGVLASLTQQALWLLRLLQDFLCAEGHGNQELWSEKLFEGVCSLLDRLGAWPHLANGTADLREMAQIGLRLVLGYILLEDPQLHAQAYVRLHMLLQTAVPARREEACYVLSKLEAALGRVLNTSSLESATDEAGSPLAAAAAAAAAERCSWLVPLVRTLLDRAYEPLGLQWGLPSLPPTNGSPTFFEDFQAFCATPEWRHFIDKQVQPTMSQFEMDTYAKSHDLMSGFWNACYDMLMSSGQRRQWERAQSRRAFQELVLEPAQRRARLEGLRYTAVLKQQATQHSMALLHWGALWRQLASPCGAWALRDTPIPRWKLSSAETYSRMRLKLVPNHHFDPHLEASALRDNLGEVPLTPTEEASLPLAVTKEAKVSTPPELLQEDQLGEDELAELETPMEAAELDEQREKLVLSAECQLVTVVAVVPGLLEVTTQNVYFYDGSTERVETEEGIGYDFRRPLAQLREVHLRRFNLRRSALELFFIDQANYFLNFPCKVGTTPVSSPSQTPRPQPGPIPPHTQVRNQVYSWLLRLRPPSQGYLSSRSPQEMLRASGLTQKWVQREISNFEYLMQLNTIAGRTYNDLSQYPVFPWVLQDYVSPTLDLSNPAVFRDLSKPIGVVNPKHAQLVREKYESFEDPAGTIDKFHYGTHYSNAAGVMHYLIRVEPFTSLHVQLQSGRFDCSDRQFHSVAAAWQARLESPADVKELIPEFFYFPDFLENQNGFDLGCLQLTNEKVGDVVLPPWASSPEDFIQQHRQALESEYVSAHLHEWIDLIFGYKQRGPAAEEALNVFYYCTYEGAVDLDHVTDERERKALEGIISNFGQTPCQLLKEPHPTRLSAEEAAHRLARLDTNSPSIFQHLDELKAFFAEVVSDGVPLVLALVPHRQPHSFITQGSPDLLVSALCRAPAQLHSPLLCQKPTSAPSCLQVTVSASGLLGTHSWLPYDRNISNYFSFSKDPTMGSHKYGQRAVGGVGYKCPAPGIIPLPNQNVGQLQGKGLARLPEGLGLFHVAWLTCYPPHWVRTQRLLSGPWVPGSGVSGQALAVAPDGKLLFSGGHWDGSLRVTALPRGKLLSQLSCHLDVVTCLALDTCGIYLISGSRDTTCMVWRLLHQGGLSVGLAPKPVQVLYGHGAAVSCVAISTELDMAVSGSEDGTVIIHTVRRGQFVAALRPLGATFPGPIFHLALGSEGQIVVQSSAWERPGAQVTYSLHLYSVNGKLRASLPLAEQPTALTVTEDFVLLGTAQCALHILQLNTLLPAAPPLPMKVAIRSVAVTKERSHVLVGLEDGKLIVVVAGQPSEVRSSQFARKLWRSSRRISQVSSGETEYNPTEAR

SEQ ID NO: 746352 - protein, 1939 aa, Homo sapiens
SALPCVHRVETWDVKDVVNCVGGMGALLPLLERVAAQPKEAEAGPAETHDLVGPELTSGHNTQGLVLPLGKSSEERMERNAVAAFLLMLRNFLQGHMVNQESLVQCQGPAIIGALLRKVPSWAMDMNVLMSAQLLMEQVAAEGSGPLLYLLYQHLLFNFHLWTLSDFAVRLGHIQYMSSIVREHRQKLRKKYGVQFILDALRTHYSPQRERPLAADDLRTVQTSLLGLAREFLVRSLSADDVQVTQTMLSFLAATGDDGQAVGALDLLLALLHGSLVQESLAVFLLEPGNLEVLLALLVRPGSLPLLPDRVCKILRRLQQNERLPERSRQRLRLRECGLQGLVACLPEGTVSPQLCQGLYKLFLGADCLNLSDLLAVVQLSLQADLSVRLDICRQLFHLIYGQPDVVRLLARQAGWQDVLTRLYVLEAATAGSPPPSSPESPTSPKPAPPKPPTESPAEPSDVFLPSEAPCPDPDGFYHALSPFCTPFDLGLERSSVGSGNTAGGGGSSGTLTPASQPGTPSPLDGPRPFPAAPGRHSSSLSNVLEDGSLPEPTISGDDTSNTSNPQQTSEEELCNLLTNVLFSVTWRGVEGSDEAAWRERGQVFSVLTQLGASATLVRPPDCIKRSLLEMMLESALTDIKEAPVGVLASLTQQALWLLRLLQDFLCAEGHGNQELWSEKLFEGVCSLLDRLGAWPHLANGTADLREMAQIGLRLVLGYILLEDPQLHAQAYVRLHMLLQTAVPARREEACYVLSKLEAALGRVLNTSSLESATDEAGSPLAAAAAAAAAERCSWLVPLVRTLLDRAYEPLGLQWGLPSLPPTNGSPTFFEDFQAFCATPEWRHFIDKQVQPTMSQFEMDTYAKSHDLMSGFWNACYDMLMSSGQRRQWERAQSRRAFQELVLEPAQRRARLEGLRYTAVLKQQATQHSMALLHWGALWRQLASPCGAWALRDTPIPRWKLSSAETYSRMRLKLVPNHHFDPHLEASALRDNLGEVPLTPTEEASLPLAVTKEAKVSTPPELLQEDQLGEDELAELETPMEAAELDEQREKLVLSAECQLVTVVAVVPGLLEVTTQNVYFYDGSTERVETEEGIGYDFRRPLAQLREVHLRRFNLRRSALELFFIDQANYFLNFPCKVGTTPVSSPSQTPRPQPGPIPPHTQVRNQVYSWLLRLRPPSQGYLSSRSPQEMLRASGLTQKWVQREISNFEYLMQLNTIAGRTYNDLSQYPVFPWVLQDYVSPTLDLSNPAVFRDLSKPIGVVNPKHAQLVREKYESFEDPAGTIDKFHYGTHYSNAAGVMHYLIRVEPFTSLHVQLQSGRFDCSDRQFHSVAAAWQARLESPADVKELIPEFFYFPDFLENQNGFDLGCLQLTNEKVGDVVLPPWASSPEDFIQQHRQALESEYVSAHLHEWIDLIFGYKQRGPAAEEALNVFYYCTYEGAVDLDHVTDERERKALEGIISNFGQTPCQLLKEPHPTRLSAEEAAHRLARLDTNSPSIFQHLDELKAFFAEVVSDGVPLVLALVPHRQPHSFITQGSPDLLVTVSASGLLGTHSWLPYDRNISNYFSFSKDPTMGSHKTQRLLSGPWVPGSGVSGQALAVAPDGKLLFSGGHWDGSLRVTALPRGKLLSQLSCHLDVVTCLALDTCGIYLISGSRDTTCMVWRLLHQVCLVGSSVGPPEPRPAAHPSLSGLPVLSSSSLGQGLHFLSLRGQSSANPGPPQGGLSVGLAPKPVQVLYGHGAAVSCVAISTELDMAVSGSEDGTVIIHTVRRGQFVAALRPLGATFPGPIFHLALGSEGQIVVQSSAWERPGAQVTYSLHLYSVNGKLRASLPLAEQPTALTVTEDFVLLGTAQCALHILQLNTLLPAAPPLPMKVAIRSVAVTKERSHVLVGLEDGKLIVVVAGQPSEVRSSQFARKLWRSSRRISQVSSGETEYNPTEAR

SEQ ID NO: 746353 - protein, 1918 aa, Homo sapiens
SALPCVHRVETWDVKDVVNCVGGMGALLPLLERVAAQPKEAEAGPAETHDLVGPELTSGHNTQGLVLPLGKSSEERMERNAVAAFLLMLRNFLQGHMVNQESLVQCQGPAIIGALLRKVPSWAMDMNVLMSAQLLMEQVAAEGSGPLLYLLYQHLLFNFHLWTLSDFAVRLGHIQYMSSIVREHRQKLRKKYGVQFILDALRTHYSPQRERPLAADDLRTVQTSLLGLAREFLVRSLSADDVQVTQTMLSFLAATGDDGQAVGALDLLLALLHGSLVQESLAVFLLEPGNLEVLLALLVRPGSLPLLPDRVCKILRRLQQNERLPERSRQRLRLRECGLQGLVACLPEGTVSPQLCQGLYKLFLGADCLNLSDLLAVVQLSLQADLSVRLDICRQLFHLIYGQPDVVRLLARQAGWQDVLTRLYVLEAATAGSPPPSSPESPTSPKPAPPKPPTESPAEPSDVFLPSEAPCPDPDGFYHALSPFCTPFDLGLERSSVGSGNTAGGGGSSGTLTPASQPGTPSPLDGPRPFPAAPGRHSSSLSNVLEDGSLPEPTISGDDTSNTSNPQQTSEEELCNLLTNVLFSVTWRGVEGSDEAAWRERGQVFSVLTQLGASATLVRPPDCIKRSLLEMMLESALTDIKEAPVGVLASLTQQALWLLRLLQDFLCAEGHGNQELWSEKLFEGVCSLLDRLGAWPHLANGTADLREMAQIGLRLVLGYILLEDPQLHAQAYVRLHMLLQTAVPARREEACYVLSKLEAALGRVLNTSSLESATDEAGSPLAAAAAAAAAERCSWLVPLVRTLLDRAYEPLGLQWGLPSLPPTNGSPTFFEDFQAFCATPEWRHFIDKQVQPTMSQFEMDTYAKSHDLMSGFWNACYDMLMSSGQRRQWERAQSRRAFQELVLEPAQRRARLEGLRYTAVLKQQATQHSMALLHWGALWRQLASPCGAWALRDTPIPRWKLSSAETYSRMRLKLVPNHHFDPHLEASALRDNLGEVPLTPTEEASLPLAVTKEAKVSTPPELLQEDQLGEDELAELETPMEAAELDEQREKLVLSAECQLVTVVAVVPGLLEVTTQNVYFYDGSTERVETEEGIGYDFRRPLAQLREVHLRRFNLRRSALELFFIDQANYFLNFPCKVGTTPVSSPSQTPRPQPGPIPPHTQVRNQVYSWLLRLRPPSQGYLSSRSPQEMLRASGLTQKWVQREISNFEYLMQLNTIAGRTYNDLSQYPVFPWVLQDYVSPTLDLSNPAVFRDLSKPIGVVNPKHAQLVREKYESFEDPAGTIDKFHYGTHYSNAAGVMHYLIRVEPFTSLHVQLQSGRFDCSDRQFHSVAAAWQARLESPADVKELIPEFFYFPDFLENQNGFDLGCLQLTNEKVGDVVLPPWASSPEDFIQQHRQALESEYVSAHLHEWIDLIFGYKQRGPAAEEALNVFYYCTYEGAVDLDHVTDERERKALEGIISNFGQTPCQLLKEPHPTRLSAEEAAHRLARLDTNSPSIFQHLDELKAFFAEVVSDGVPLVLALVPHRQPHSFITQGSPDLLVTVSASGLLGTHSWLPYDRNISNYFSFSKDPTMGSHKTQRLLSGPWVPGSGVSGQALAVAPDGKLLFSGGHWDGSLRVTALPRGKLLSQLSCHLDVVTCLALDTCGIYLISGSRDTTCMVWRLLHQGGLSVGLAPKPVQVLYGHGAAVSCVAISTELDMAVSGSEVCVCMCPGEGEFPGQSPWSPDSCPGPKVAFLQDGTVIIHTVRRGQFVAALRPLGATFPGPIFHLALGSEGQIVVQSSAWERPGAQVTYSLHLYSVNGKLRASLPLAEQPTALTVTEDFVLLGTAQCALHILQLNTLLPAAPPLPMKVAIRSVAVTKERSHVLVGLEDGKLIVVVAGQPSEVRSSQFARKLWRSSRRISQVSSGETEYNPTEAR

SEQ ID NO: 746354 - protein, 1847 aa, Homo sapiens
SALPCVHRVETWDVKDVVNCVGGMGALLPLLERVAAQPKEAEAGPAETHDLVGPELTSGHNTQGLVLPLGKSSEERMERNAVAAFLLMLRNFLQGHMVNQESLVQCQGPAIIGALLRKVPSWAMDMNVLMSAQLLMEQVAAEGSGPLLYLLYQHLLFNFHLWTLSDFAVRLGHIQYMSSIVREHRQKLRKKYGVQFILDALRTHYSPQRERPLAADDLRTVQTSLLGLAREFLVRSLSADDVQVTQTMLSFLAATGDDGQAVGALDLLLALLHGSLVQESLAVFLLEPGNLEVLLALLVRPGSLPLLPDRVCKILRRLQQNERLPERSRQRLRLRECGLQGLVACLPEGTVSPQLCQGLYKLFLGADCLNLSDLLAVVQLSLQADLSVRLDICRQLFHLIYGQPDVVRLLARQAGWQDVLTRLYVLEAATAGSPPPSSPESPTSPKPAPPKPPTESPAEPSDVFLPSEAPCPDPDGFYHALSPFCTPFDLGLERSSVGSGNTAGGGGSSGTLTPASQPGTPSPLDGPRPFPAAPGRHSSSLSNVLEDGSLPEPTISGDDTSNTSNPQQTSEEELCNLLTNVLFSVTWRGVEGSDEAAWRERGQVFSVLTQLGASATLVRPPDCIKRSLLEMMLESALTDIKEAPVGVLASLTQQALWLLRLLQDFLCAEGHGNQELWSEKLFEGVCSLLDRLGAWPHLANGTADLREMAQIGLRLVLGYILLEDPQLHAQAYVRLHMLLQTAVPARREEACYVLSKLEAALGRVLNTSSLESATDEAGSPLAAAAAAAAAERCSWLVPLVRTLLDRAYEPLGLQWGLPSLPPTNGSPTFFEDFQAFCATPEWRHFIDKQVQPTMSQFEMDTYAKSHDLMSGFWNACYDMLMSSGQRRQWERAQSRRAFQELVLEPAQRRARLEGLRYTAVLKQQATQHSMALLHWGALWRQLASPCGAWALRDTPIPRWKLSSAETYSRMRLKLVPNHHFDPHLEASALRDNLGEVPLTPTEEASLPLAVTKEAKVSTPPELLQEDQLGEDELAELETPMEAAELDEQREKLVLSAECQLVTVVAVVPGLLEVTTQNVYFYDGSTERVETEEGIGYDFRRPLAQLREVHLRRFNLRRSALELFFIDQANYFLNFPCKVGTTPVSSPSQTPRPQPGPIPPHTQVRNQVYSWLLRLRPPSQGYLSSRSPQEMLRASGLTQKWVQREISNFEYLMQLNTIAGRTYNDLSQYPVFPWVLQDYVSPTLDLSNPAVFRDLSKPIGVVNPKHAQLVREKYESFEDPAGTIDKFHYGTHYSNAAGVMHYLIRVEPFTSLHVQLQSGRFDCSDRQFHSVAAAWQARLESPADVKELIPEFFYFPDFLENQNGFDLGCLQLTNEKVGDVVLPPWASSPEDFIQQHRQALESEYVSAHLHEWIDLIFGYKQRGPAAEEALNVFYYCTYEGAVDLDHVTDERERKALEGIISNFGQTPCQLLKEPHPTRLSAEEAAHRLARLDTNSPSIFQHLDELKAFFAEVVSDGVPLVLALVPHRQPHSFITQGSPDLLVTVSASGLLGTHSWLPYDRNISNYFSFSKDPTMGSHKTQRLLSGPWVPGSGVSGQALAVAPDGKLLFSGGHWDGSLRVTALPRGKLLSQLSCHLDVVTCLALDTCGIYLISGSRDTTCMVWRLLHQDGTVIIHTVRRGQFVAALRPLGATFPGPIFHLALGSEGQIVVQSSAWERPGAQVTYSLHLYSVNGKLRASLPLAEQPTALTVTEDFVLLGTAQCALHILQLNTLLPAAPPLPMKVAIRSVAVTKERSHVLVGLEDGKLIVVVAGQPSEVRSSQFARKLWRSSRRISQVSSGETEYNPTEAR

SEQ ID NO: 746355 - protein, 1944 aa, Homo sapiens
SALPCVHRVETWDVKDVVNCVGGMGALLPLLERVAAQPKEAEAGPAETHDLVGPELTSGHNTQGLVLPLGKSSEERMERNAVAAFLLMLRNFLQGHMVNQESLVQCQGPAIIGALLRKVPSWAMDMNVLMSAQLLMEQVAAEGSGPLLYLLYQHLLFNFHLWTLSDFAVRLGHIQYMSSIVREHRQKLRKKYGVQFILDALRTHYSPQRERPLAADDLRTVQTSLLGLAREFLVRSLSADDVQVTQTMLSFLAATGDDGQAVGALDLLLALLHGSLVQESLAVFLLEPGNLEVLLALLVRPGSLPLLPDRVCKILRRLQQNERLPERSRQRLRLRECGLQGLVACLPEGTVSPQLCQGLYKLFLGADCLNLSDLLAVVQLSLQADLSVRLDICRQLFHLIYGQPDVVRLLARQAGWQDVLTRLYVLEAATAGSPPPSSPESPTSPKPAPPKPPTESPAEPSDVFLPSEAPCPDPDGFYHALSPFCTPFDLGLERSSVGSGNTAGGGGSSGTLTPASQPGTPSPLDGPRPFPAAPGRHSSSLSNVLEDGSLPEPTISGDDTSNTSNPQQTSEEELCNLLTNVLFSVTWRGVEGSDEAAWRERGQVFSVLTQLGASATLVRPPDCIKRSLLEMMLESALTDIKEAPVGVLASLTQQALWLLRLLQDFLCAEGHGNQELWSEKLFEGVCSLLDRLGAWPHLANGTADLREMAQIGLRLVLGYILLEDPQLHAQAYVRLHMLLQTAVPARREEACYVLSKLEAALGRVLNTSSLESATDEAGSPLAAAAAAAAAERCSWLVPLVRTLLDRAYEPLGLQWGLPSLPPTNGSPTFFEDFQAFCATPEWRHFIDKQVQPTMSQFEMDTYAKSHDLMSGFWNACYDMLMSSGQRRQWERAQSRRAFQELVLEPAQRRARLEGLRYTAVLKQQATQHSMALLHWGALWRQLASPCGAWALRDTPIPRWKLSSAETYSRMRLKLVPNHHFDPHLEASALRDNLGEVPLTPTEEASLPLAVTKEAKVSTPPELLQEDQLGEDELAELETPMEAAELDEQREKLVLSAECQLVTVVAVVPGLLEVTTQNVYFYDGSTERVETEEGIGYDFRRPLAQLREVHLRRFNLRRSALELFFIDQANYFLNFPCKVGTTPVSSPSQTPRPQPGPIPPHTQVRNQVYSWLLRLRPPSQGYLSSRSPQEMLRASGLTQKWVQREISNFEYLMQLNTIAGRTYNDLSQYPVFPWVLQDYVSPTLDLSNPAVFRDLSKPIGVVNPKHAQLVREKYESFEDPAGTIDKFHYGTHYSNAAGVMHYLIRVEPFTSLHVQLQSGRFDCSDRQFHSVAAAWQARLESPADVKELIPEFFYFPDFLENQNGFDLGCLQLTNEKVGDVVLPPWASSPEDFIQQHRQALESEYVSAHLHEWIDLIFGYKQRGPAAEEALNVFYYCTYEGAVDLDHVTDERERKALEGIISNFGQTPCQLLKEPHPTRLSAEEAAHRLARLDTNSPSIFQHLDELKAFFAEVVSDGVPLVLALVPHRQPHSFITQGSPDLLVTVSASGLLGTHSWLPYDRNISNYFSFSKDPTMGSHKTQRLLSGPWVPGSGVSGQALAVAPDGKLLFSGGHWDGSLRVTALPRGKLLSQLSCHLDVVTCLALDTCGIYLISGSRDTTCMVWRLLHQGGLSVGLAPKPVQVLYGHGAAVSCVAISTELDMAVSGSEVCVCMCPGEGEFPGQSPWSPDSCPGPKVAFLQDGTVIIHTVRRGQFVAALRPLGATFPGPIFHLALGSEGQIVVQSSAWERPGAQVWGRGAQQRWRGSWDPVLADTPCFLQVTYSLHLYSVNGKLRASLPLAEQPTALTVTEDFVLLGTAQCALHILQLNTLLPAAPPLPMKVAIRSVAVTKERSHVLVGLEDGKLIVVVAGQPSEVRSSQFARKLWRSSRRISQVSSGETEYNPTEAR

SEQ ID NO: 746356 - protein, 759 aa, Homo sapiens
LGSPKCRYLPVGQALSLVKGRCANEDLASVPSLTPFPSLPSLYSSKGILFQDTLSFSPVTPLSGAPPDLWAGSVPAFLRVWAGQGGLVGHQGPHAAPARVGGQFPWVLQDYVSPTLDLSNPAVFRDLSKPIGVVNPKHAQLVREKYESFEDPAGTIDKFHYGTHYSNAAGVMHYLIRVEPFTSLHVQLQSGRFDCSDRQFHSVAAAWQARLESPADVKELIPEFFYFPDFLENQNGFDLGCLQLTNEKVGDVVLPPWASSPEDFIQQHRQALESEYVSAHLHEWIDLIFGYKQRGPAAEEALNVFYYCTYEGAVDLDHVTDERERKALEGIISNFGQTPCQLLKEPHPTRLSAEEAAHRLARLDTNSPSIFQHLDELKAFFAEVVSDGVPLVLALVPHRQPHSFITQGSPDLLVTVSASGLLGTHSWLPYDRNISNYFSFSKDPTMGSHKTQRLLSGPWVPGSGVSGQALAVAPDGKLLFSGGHWDGSLRVTALPRGKLLSQLSCHLDVVTCLALDTCGIYLISGSRDTTCMVWRLLHQGGLSVGLAPKPVQVLYGHGAAVSCVAISTELDMAVSGSEDGTVIIHTVRRGQFVAALRPLGATFPGPIFHLALGSEGQIVVQSSAWERPGAQVTYSLHLYSVNGKLRASLPLAEQPTALTVTEDFVLLGTAQCALHILQLNTLLPAAPPLPMKVAIRSVAVTKERSHVLVGLEDGKLIVVVAGQPSEVRSSQFARKLWRSSRRISQVSSGETEYNPTEAR

SEQ ID NO: 746357 - protein, 424 aa, Homo sapiens
GADQATYPQEPHPTRLSAEEAAHRLARLDTNSPSIFQHLDELKAFFAEVVSDGVPLVLALVPHRQPHSFITQGSPDLLVTVSASGLLGTHSWLPYDRNISNYFSFSKDPTMGSHKTQRLLSGPWVPGSGVSGQALAVAPDGKLLFSGGHWDGSLRVTALPRGKLLSQLSCHLDVVTCLALDTCGIYLISGSRDTTCMVWRLLHQGGLSVGLAPKPVQVLYGHGAAVSCVAISTELDMAVSGSEDGTVIIHTVRRGQFVAALRPLGATFPGPIFHLALGSEGQIVVQSSAWERPGAQVTYSLHLYSVNGKLRASLPLAEQPTALTVTEDFVLLGTAQCALHILQLNTLLPAAPPLPMKVAIRSVAVTKERSHVLVGLEDGKLIVVVAGQPSEVRSSQFARKLWRSSRRISQVSSGETEYNPTEAR

SEQ ID NO: 746358 - protein, 262 aa, Homo sapiens
DYNTNNKTTARYEAGFTLDTCGIYLISGSRDTTCMVWRLLHQGGLSVGLAPKPVQVLYGHGAAVSCVAISTELDMAVSGSEDGTVIIHTVRRGQFVAALRPLGATFPGPIFHLALGSEGQIVVQSSAWERPGAQVTYSLHLYSVNGKLRASLPLAEQPTALTVTEDFVLLGTAQCALHILQLNTLLPAAPPLPMKVAIRSVAVTKERSHVLVGLEDGKLIVVVAGQPSEVRSSQFARKLWRSSRRISQVSSGETEYNPTEAR

SEQ ID NO: 746359 - protein, 258 aa, Homo sapiens
MCNPVDDYDSTSYPSRLLLHVLVVVDSKPAYYYRRPCLGGLSVGLAPKPVQVLYGHGAAVSCVAISTELDMAVSGSEDGTVIIHTVRRGQFVAALRPLGATFPGPIFHLALGSEGQIVVQSSAWERPGAQVTYSLHLYSVNGKLRASLPLAEQPTALTVTEDFVLLGTAQCALHILQLNTLLPAAPPLPMKVAIRSVAVTKERSHVLVGLEDGKLIVVVAGQPSEVRSSQFARKLWRSSRRISQVSSGETEYNPTEAR

SEQ ID NO: 746360 - protein, 1475 aa, Homo sapiens
SALPCVHRVETWDVKDVVNCVGGMGALLPLLERVAAQPKEAEAGPAETHDLVGPELTSGHNTQGLVLPLGKSSEERMERNAVAAFLLMLRNFLQGHMVNQESLVQCQGPAIIGALLRKVPSWAMDMNVLMSAQLLMEQVAAEGSGPLLYLLYQHLLFNFHLWTLSDFAVRLGHIQYMSSIVREHRQKLRKKYGVQFILDALRTHYSPQRERPLAADDLRTVQTSLLGLAREFLVRSLSADDVQVTQTMLSFLAATGDDGQAVGALDLLLALLHGSLVQESLAVFLLEPGNLEVLLALLVRPGSLPLLPDRVCKILRRLQQNERLPERSRQRLRLRECGLQGLVACLPEGTVSPQLCQGLYKLFLGADCLNLSDLLAVVQLSLQADLSVRLDICRQLFHLIYGQPDVVRLLARQAGWQDVLTRLYVLEAATAGSPPPSSPESPTSPKPAPPKPPTESPAEPSDVFLPSEAPCPDPDGFYHALSPFCTPFDLGLERSSVGSGNTAGGGGSSGTLTPASQPGTPSPLDGPRPFPAAPGRHSSSLSNVLEDGSLPEPTISGDDTSNTSNPQQTSEEELCNLLTNVLFSVTWRGVEGSDEAAWRERGQVFSVLTQLGASATLVRPPDCIKRSLLEMMLESALTDIKEAPVGVLASLTQQALWLLRLLQDFLCAEGHGNQELWSEKLFEGVCSLLDRLGAWPHLANGTADLREMAQIGLRLVLGYILLEDPQLHAQAYVRLHMLLQTAVPARREEACYVLSKLEAALGRVLNTSSLESATDEAGSPLAAAAAAAAAERCSWLVPLVRTLLDRAYEPLGLQWGLPSLPPTNGSPTFFEDFQAFCATPEWRHFIDKQVQPTMSQFEMDTYAKSHDLMSGFWNACYDMLMSSGQRRQWERAQSRRAFQELVLEPAQRRARLEGLRYTAVLKQQATQHSMALLHWGALWRQLASPCGAWALRDTPIPRWKLSSAETYSRMRLKLVPNHHFDPHLEASALRDNLGEVPLTPTEEASLPLAVTKEAKVSTPPELLQEDQLGEDELAELETPMEAAELDEQREKLVLSAECQLVTVVAVVPGLLEVTTQNVYFYDGSTERVETEEGIGYDFRRPLAQLREVHLRRFNLRRSALELFFIDQANYFLNFPCKVGTTPVSSPSQTPRPQPGPIPPHTQVRNQVYSWLLRLRPPSQGYLSSRSPQEMLRASGLTQKWVQREISNFEYLMQLNTIAGRTYNDLSQYPVFPWVLQDYVSPTLDLSNPAVFRDLSKPIGVVNPKHAQLVREKYESFEDPAGTIDKFHYGTHYSNAAGVMHYLIRVEPFTSLHVQLQSGRFDCSDRQFHSVAAAWQARLESPADVKELIPEFFYFPDFLENQNGFDLGCLQLTNEKVGDVVLPPWASSPEDFIQQHRQALESEYVSAHLHEWIDLIFGYKQRGPAAEEALNVFYYCTYEALNLASPAARAPPPAGLAREAPPRSRREHPGVGSPGG

SEQ ID NO: 746361 - protein, 118 aa, Homo sapiens
IGYDFRRPLAQLREVHLRRFNLRRSALELFFIDQANYFLNFPCKVGTTPVSSPSQTPRPQPGPIPPHTQVRNQVYSWLLRLRPPSQGYLSSRSPQEMLRASGLTQVRALGVRDVKSGP

SEQ ID NO: 746362 - protein, 1978 aa, Homo sapiens
SALPCVHRVETWDVKDVVNCVGGMGALLPLLERVAAQPKEAEAGPAETHDLVGPELTSGHNTQGLVLPLGKSSEERMERNAVAAFLLMLRNFLQGHMVNQESLVQCQGPAIIGALLRKVPSWAMDMNVLMSAQLLMEQVAAEGSGPLLYLLYQHLLFNFHLWTLSDFAVRLGHIQYMSSIVREHRQKLRKKYGVQFILDALRTHYSPQRERPLAADDLRTVQTSLLGLAREFLVRSLSADDVQVTQTMLSFLAATGDDGQAVGALDLLLALLHGSLVQESLAVFLLEPGNLEVLLALLVRPGSLPLLPDRVCKILRRLQQNERLPERSRQRLRLRECGLQGLVACLPEGTVSPQLCQGLYKLFLGADCLNLSDLLAVVQLSLQADLSVRLDICRQLFHLIYGQPDVVRLLARQAGWQDVLTRLYVLEAATAGSPPPSSPESPTSPKPAPPKPPTESPAEPSDVFLPSEAPCPDPDGFYHALSPFCTPFDLGLERSSVGSGNTAGGGGSSGTLTPASQPGTPSPLDGPRPFPAAPGRHSSSLSNVLEDGSLPEPTISGDDTSNTSNPQQTSEEELCNLLTNVLFSVTWRGVEGSDEAAWRERGQVFSVLTQLGASATLVRPPDCIKRSLLEMMLESALTDIKEAPVGVLASLTQQALWLLRLLQDFLCAEGHGNQELWSEKLFEGVCSLLDRLGAWPHLANGTADLREMAQIGLRLVLGYILLEDPQLHAQAYVRLHMLLQTAVPARREEACYVLSKLEAALGRVLNTSSLESATDEAGSPLAAAAAAAAAERCSWLVPLVRTLLDRAYEPLGLQWGLPSLPPTNGSPTFFEDFQAFCATPEWRHFIDKQVQPTMSQFEMDTYAKSHDLMSGFWNACYDMLMSSGQRRQWERAQSRRAFQELVLEPAQRRARLEGLRYTAVLKQQATQHSMALLHWGALWRQLASPCGAWALRDTPIPRWKLSSAETYSRMRLKLVPNHHFDPHLEASALRDNLGEVPLTPTEEASLPLAVTKEAKVSTPPELLQEDQLGEDELAELETPMEAAELDEQREKLVLSAECQLVTVVAVVPGLLEVTTQNVYFYDGSTERVETEEGIGYDFRRPLAQLREVHLRRFNLRRSALELFFIDQANYFLNFPCKVGTTPVSSPSQTPRPQPGPIPPHTQVRNQVYSWLLRLRPPSQGYLSSRSPQEMLRASGLTQKWVQREISNFEYLMQLNTIAGRTYNDLSQYPVFPWVLQDYVSPTLDLSNPAVFRDLSKPIGVVNPKHAQLVREKYESFEDPAGTIDKFHYGTHYSNAAGVMHYLIRVEPFTSLHVQLQSGRFDCSDRQFHSVAAAWQARLESPADVKELIPEFFYFPDFLENQNGFDLGCLQLTNEKVGDVVLPPWASSPEDFIQQHRQALESEYVSAHLHEWIDLIFGYKQRGPAAEEALNVFYYCTYEGAVDLDHVTDERERKALEGIISNFGQTPCQLLKEPHPTRLSAEEAAHRLARLDTNSPSIFQHLDELKAFFAEVVSDGVPLVLALVPHRQPHSFITQGSPDLLVTVSASGLLGTHSWLPYDRNISNYFSFSKDPTMGSHKTQRLLSGPWVPGSGVSGQALAVAPDGKLLFSGGHWDGSLRVTALPRGKLLSQLSCHLGMNSLGAGENEAPGMGPGSEAGQGGCDSSVLPVPSPSHADVVTCLALDTCGIYLISGSRDTTCMVWRLLHQVCLVGSSVGPPEPRPAAHPSLSGLPVLSSSSLGQGLHFLSLRGQSSANPGPPQGGLSVGLAPKPVQVLYGHGAAVSCVAISTELDMAVSGSEDGTVIIHTVRRGQFVAALRPLGATFPGPIFHLALGSEGQIVVQSSAWERPGAQVTYSLHLYSVNGKLRASLPLAEQPTALTVTEDFVLLGTAQCALHILQLNTLLPAAPPLPMKVAIRSVAVTKERSHVLVGLEDGKLIVVVAGQPSEVRSSQFARKLWRSSRRISQVSSGETEYNPTEAR

SEQ ID NO: 746363 - protein, 674 aa, Homo sapiens
EFSPATRADYNDLSQYPVFPWVLQDYVSPTLDLSNPAVFRDLSKPIGVVNPKHAQLVREKYESFEDPAGTIDKFHYGTHYSNAAGVMHYLIRVEPFTSLHVQLQSGRFDCSDRQFHSVAAAWQARLESPADVKELIPEFFYFPDFLENQNGFDLGCLQLTNEKVGDVVLPPWASSPEDFIQQHRQALESEYVSAHLHEWIDLIFGYKQRGPAAEEALNVFYYCTYEGAVDLDHVTDERERKALEGIISNFGQTPCQLLKEPHPTRLSAEEAAHRLARLDTNSPSIFQHLDELKAFFAEVVSDGVPLVLALVPHRQPHSFITQGSPDLLVTVSASGLLGTHSWLPYDRNISNYFSFSKDPTMGSHKTQRLLSGPWVPGSGVSGQALAVAPDGKLLFSGGHWDGSLRVTALPRGKLLSQLSCHLDVVTCLALDTCGIYLISGSRDTTCMVWRLLHQGGLSVGLAPKPVQVLYGHGAAVSCVAISTELDMAVSGSEDGTVIIHTVRRGQFVAALRPLGATFPGPIFHLALGSEGQIVVQSSAWERPGAQVTYSLHLYSVNGKLRASLPLAEQPTALTVTEDFVLLGTAQCALHILQLNTLLPAAPPLPMKVAIRSVAVTKERSHVLVGLEDGKLIVVVAGQPSEVRSSQFARKLWRSSRRISQVSSGETEYNPTEAR

SEQ ID NO: 746364 - protein, 536 aa, Homo sapiens
DGPQLNDGPQLQRFDLGCLQLTNEKVGDVVLPPWASSPEDFIQQHRQALESEYVSAHLHEWIDLIFGYKQRGPAAEEALNVFYYCTYEGAVDLDHVTDERERKALEGIISNFGQTPCQLLKEPHPTRLSAEEAAHRLARLDTNSPSIFQHLDELKAFFAEVVSDGVPLVLALVPHRQPHSFITQGSPDLLVTVSASGLLGTHSWLPYDRNISNYFSFSKDPTMGSHKTQRLLSGPWVPGSGVSGQALAVAPDGKLLFSGGHWDGSLRVTALPRGKLLSQLSCHLDVVTCLALDTCGIYLISGSRDTTCMVWRLLHQGGLSVGLAPKPVQVLYGHGAAVSCVAISTELDMAVSGSEDGTVIIHTVRRGQFVAALRPLGATFPGPIFHLALGSEGQIVVQSSAWERPGAQVTYSLHLYSVNGKLRASLPLAEQPTALTVTEDFVLLGTAQCALHILQLNTLLPAAPPLPMKVAIRSVAVTKERSHVLVGLEDGKLIVVVAGQPSEVRSSQFARKLWRSSRRISQVSSGETEYNPTEAR

SEQ ID NO: 746365 - protein, 285 aa, Homo sapiens
TGLSYSVGGHWDGSLRVTALPRGKLLSQLSCHLDVVTCLALDTCGIYLISGSRDTTCMVWRLLHQGGLSVGLAPKPVQVLYGHGAAVSCVAISTELDMAVSGSEDGTVIIHTVRRGQFVAALRPLGATFPGPIFHLALGSEGQIVVQSSAWERPGAQVTYSLHLYSVNGKLRASLPLAEQPTALTVTEDFVLLGTAQCALHILQLNTLLPAAPPLPMKVAIRSVAVTKERSHVLVGLEDGKLIVVVAGQPSEVRSSQFARKLWRSSRRISQVSSGETEYNPTEAR

SEQ ID NO: 746366 - protein, 188 aa, Homo sapiens
MAVSGSEDGTVIIHTVRRGQFVAALRPLGATFPGPIFHLALGSEGQIVVQSSAWERPGAQVTYSLHLYSVNGKLRASLPLAEQPTALTVTEDFVLLGTAQCALHILQLNTLLPAAPPLPMKVAIRSVAVTKERSHVLVGLEDGKLIVVVAGQPSEVRSSQFARKLWRSSRRISQVSSGETEYNPTEAR

SEQ ID NO: 746367 - protein, 1896 aa, Homo sapiens
SALPCVHRVETWDVKDVVNCVGGMGALLPLLERVAAQPKEAEAGPAETHDLVGPELTSGHNTQGLVLPLGKSSEERMERNAVAAFLLMLRNFLQGHMVNQESLVQCQGPAIIGALLRKVPSWAMDMNVLMSAQLLMEQVAAEGSGPLLYLLYQHLLFNFHLWTLSDFAVRLGHIQYMSSIVREHRQKLRKKYGVQFILDALRTHYSPQRERPLAADDLRTVQTSLLGLAREFLVRSLSADDVQVTQTMLSFLAATGDDGQAVGALDLLLALLHGSLVQESLAVFLLEPGNLEVLLALLVRPGSLPLLPDRVCKILRRLQQNERLPERSRQRLRLRECGLQGLVACLPEGTVSPQLCQGLYKLFLGADCLNLSDLLAVVQLSLQADLSVRLDICRQLFHLIYGQPDVVRLLARQAGWQDVLTRLYVLEAATAGSPPPSSPESPTSPKPAPPKPPTESPAEPSDVFLPSEAPCPDPDGFYHALSPFCTPFDLGLERSSVGSGNTAGGGGSSGTLTPASQPGTPSPLDGPRPFPAAPGRHSSSLSNVLEDGSLPEPTISGDDTSNTSNPQQTSEEELCNLLTNVLFSVTWRGVEGSDEAAWRERGQVFSVLTQLGASATLVRPPDCIKRSLLEMMLESALTDIKEAPVGVLASLTQQALWLLRLLQDFLCAEGHGNQELWSEKLFEGVCSLLDRLGAWPHLANGTADLREMAQIGLRLVLGYILLEDPQLHAQAYVRLHMLLQTAVPARREEACYVLSKLEAALGRVLNTSSLESATDEAGSPLAAAAAAAAAERCSWLVPLVRTLLDRAYEPLGLQWGLPSLPPTNGSPTFFEDFQAFCATPEWRHFIDKQVQPTMSQFEMDTYAKSHDLMSGFWNACYDMLMSSGQRRQWERAQSRRAFQELVLEPAQRRARLEGLRYTAVLKQQATQHSMALLHWGALWRQLASPCGAWALRDTPIPRWKLSSAETYSRMRLKLVPNHHFDPHLEASALRDNLGEVPLTPTEEASLPLAVTKEAKVSTPPELLQEDQLGEDELAELETPMEAAELDEQREKLVLSAECQLVTVVAVVPGLLEVTTQNVYFYDGSTERVETEEGIGYDFRRPLAQLREVHLRRFNLRRSALELFFIDQANYFLNFPCKVGTTPVSSPSQTPRPQPGPIPPHTQVRNQVYSWLLRLRPPSQGYLSSRSPQEMLRASGLTQKWVQREISNFEYLMQLNTIAGRTYNDLSQYPVFPWVLQDYVSPTLDLSNPAVFRDLSKPIGVVNPKHAQLVREKYESFEDPAGTIDKFHYGTHYSNAAGVMHYLIRVEPFTSLHVQLQSGRFDCSDRQFHSVAAAWQARLESPADVKELIPEFFYFPDFLENQNGFDLGCLQLTNEKVGDVVLPPWASSPEDFIQQHRQALESEYVSAHLHEWIDLIFGYKQRGPAAEEALNVFYYCTYEGAVDLDHVTDERERKALEGIISNFGQTPCQLLKEPHPTRLSAEEAAHRLARLDTNSPSIFQHLDELKAFFAEVVSDGVPLVLALVPHRQPHSFITQGSPDLLVTVSASGLLGTHSWLPYDRNISNYFSFSKDPTMGSHKTQRLLSGPWVPGSGVSGQALAVAPDGKLLFSGGHWDGSLRVTALPRGKLLSQLSCHLDVVTCLALDTCGIYLISGSRDTTCMVWRLLHQGGLSVGLAPKPVQVLYGHGAAVSCVAISTELDMAVSGSEDGTVIIHTVRRGQFVAALRPLGATFPGPIFHLALGSEGQIVVQSSAWERPGAQVWGRGAQQRWRGSWDPVLADTPCFLQVTYSLHLYSVNGKLRASLPLAEQPTALTVTEDFVLLGTAQCALHILQLNTLLPAAPPLPMKVAIRSVAVTKERSHVLVGLEDGKLIVVVAGQPSEVRMGRGWGGPSPAEGPP

SEQ ID NO: 746368 - protein, 287 aa, Homo sapiens
LEDPQTRHRSLPSLSEPFSSCCIGSAGYRIDSTLAGTQDTRWGSPTSLEGELGAVAIFHEALQATALRTLCTLGPNETAPFKPEGELHELSTRLLLHYSPQVFGGPRGVVGSTVLLPRLPHSACHPLLPLTLAACPFPYPQACKNNICLDLSPSHGLDGRLTGHRVETWDVKDVVNCVGGMGALLPLLERVAAQPKEAEAGPAETHDLVGPELTSGHNTQGLVLPLGKSSEERMERNAVAAFLLMLRNFLQGHMVNQESLVQCQGPAIIGALLRKVQAGHGLNVSCL

SEQ ID NO: 746369 - protein, 532 aa, Homo sapiens
MELDLSPPHLSSSPEDLCPAPGTPPGTPRPPDTPLPEEVKRSQPLLIPTTGRKLREEERRATSLPSIPNPFPELCSPPSQSPILGGPSSARGLLPRDASRPHVVKVYSEDGACRSVEVAAGATARHVCEMLVQRAHALSDETWGLVECHPHLALERGLEDHESVVEVQAAWPVGGDSRFVFRKNFAKYELFKSSPHSLFPEKMVSSCLDAHTGISHEDLIQNFLNAGSFPEIQGFLQLRGSGRKLWKRFFCFLRRSGLYYSTKGTSKDPRHLQYVADVNESNVYVVTQGRKLYGMPTDFGFCVKPNKLRNGHKGLRIFCSEDEQSRTCWLAAFRLFKYGVQLYKNYQQAQSRHLHPSCLGSPPLRSASDNTLVAMDFSGHAGRVIENPREALSVALEEAQAWRKKTNHRLSLPMPASGTSLSAAIHRTQLWFHGRISREESQRLIGQQGLVDGLFLVRESQRNPQGFVLSLCHLQKVKHYLILPSEEEGRLYFSMDDGQTRFTDLLQLVEFHQLNRGILPCLLRHCCTRVAL

SEQ ID NO: 746370 - protein, 245 aa, Homo sapiens
MELDLSPPHLSSSPEDLCPAPGTPPGTPRPPDTPLPEEVKRSQPLLIPTTGRKLREEERRATSLPSIPNPFPELCSPPSQSPILGGPSSARGLLPRDASRPHVVKVYSEDGACRSVEVAAGATARHVCEMLVQRAHALSDETWGLVECHPHLALERGLEDHESVVEVQAAWPVGGDSRFVFRKNFAKYELFKSSPHSLFPEKMVSSCLDAHTGISHEDLIQNFLNAGKFLKIQGLFCKAGGLKDR

SEQ ID NO: 746371 - protein, 447 aa, Homo sapiens
MELDLSPPHLSSSPEDLCPAPGTPPGTPRPPDTPLPEEVKRSQPLLIPTTGRKLREEERRATSLPSIPNPFPELCSPPSQSPILGGPSSARGLLPRDASRPHVVKVYSEDGACRSVEVAAGATARHVCEMLVQRAHALSDETWGLVECHPHLALERGLEDHESVVEVQAAWPVGGDSRFVFRKNFAKYELFKSSPHSLFPEKMVSSCLDAHTGISHEDLIQNFLNAGSFPEIQGFLQLRGSGRKLWKRFFCFLRRSGLYYSTKGTSKDPRHLQYVADVNESNVYVVTQGRKLYGMPTDFGFCVKPNKLRNGHKGLRIFCSEDEQSRTCWLAAFRLFKYGVQLYKNYQQAQSRHLHPSCLGSPPLRSASDNTLVAMDFSGHAGRVIENPREALSVALEEAQAWRKKTNHRLSLPMPASGTSLSAACSWSGRVSGTPRALSSLCATCRK

SEQ ID NO: 746372 - protein, 493 aa, Homo sapiens
MELDLSPPHLSSSPEDLCPAPGTPPGTPRPPDTPLPEEVKRSQPLLIPTTGRKLREEERRATSLPSIPNPFPELCSPPSQSPILGGPSSARGLLPRDASRPHVVKVYSEDGACRSVEVAAGATARHVCEMLVQRAHALSDETWGLVECHPHLALERGLEDHESVVEVQAAWPVGGDSRFVFRKNFAKYELFKSSPHSLFPEKMVSSCLDAHTGISHEDLIQNFLNAGSFPEIQGFLQLRGSGRKLWKRFFCFLRRSGLYYSTKGTSKDPRHLQYVADVNESNVYVVTQGRKLYGMPTDFGFCVKPNKLRNGHKGLRIFCSEDEQSRTCWLAAFRLFKYGVQLYKNYQQAQSRHLHPSCLGSPPLRSASDNTLVAMDFSGHAGRVIENPREALSVALEEAQAWRKKTNHRLSLPMPASGTSLSAAIHRTQLWFHGRISREESQRLIGQQGLVDGLFLVRESQRNPQGFVLSLCHLQKVKHYLILPMCRSPGVLQ

SEQ ID NO: 746373 - protein, 540 aa, Homo sapiens
MELDLSPPHLSSSPEDLCPAPGTPPGTPRPPDTPLPEEVKRSQPLLIPTTGRKLREEERRATSLPSIPNPFPELCSPPSQSPILGGPSSARGLLPRDASRPHSCAIPGAQVVKVYSEDGACRSVEVAAGATARHVCEMLVQRAHALSDETWGLVECHPHLALERGLEDHESVVEVQAAWPVGGDSRFVFRKNFAKYELFKSSPHSLFPEKMVSSCLDAHTGISHEDLIQNFLNAGSFPEIQGFLQLRGSGRKLWKRFFCFLRRSGLYYSTKGTSKDPRHLQYVADVNESNVYVVTQGRKLYGMPTDFGFCVKPNKLRNGHKGLRIFCSEDEQSRTCWLAAFRLFKYGVQLYKNYQQAQSRHLHPSCLGSPPLRSASDNTLVAMDFSGHAGRVIENPREALSVALEEAQAWRKKTNHRLSLPMPASGTSLSAAIHRTQLWFHGRISREESQRLIGQQGLVDGLFLVRESQRNPQGFVLSLCHLQKVKHYLILPSEEEGRLYFSMDDGQTRFTDLLQLVEFHQLNRGILPCLLRHCCTRVAL

SEQ ID NO: 746374 - protein, 330 aa, Homo sapiens [sequence omitted]

SEQ ID NO: 746375 - protein, 493 aa, Homo sapiens; identical to SEQ ID NO: 746372

SEQ ID NO: 746376 - protein, 68 aa, Homo sapiens
GSFLDLALMYDSTLRITHPCAAPNACAAPPESCNETQDSQQPVLLTRPLQRLPGPQCVSLFPAQEVGG

SEQ ID NO: 746377 - protein, 270 aa, Homo sapiens [sequence omitted]

SEQ ID NO: 746378 - protein, 198 aa, Homo sapiens
MELDLSPPHLSSSPEDLCPAPGTPPGTPRPPDTPLPEEVKRSQPLLIPTTGRKLREEERRATSLPSIPNPFPELCSPPSQSPILGGPSSARGLLPRDASRPHVVKVYSEDGACRSVEVAAGATARHVCEMLVQRAHALSDETWGLVECHPHLALERGLEDHESVVEVQAAWPVGGDSRFVFRKNFAKYELFKSSPVSA

SEQ ID NO: 746379 - protein, 138 aa, Homo sapiens
YVADVNESNVYVVTQGRKLYGMPTDFGFCVKVKTWPGLAPGLGKQELLRPLDPARGFSAPIQTPRLLSLHPGLLETPGFSSAMWSRGRHVVLKADMGPVNFLSLQPNKLRNGHKGLRIFCSEDEQSRTCWLAAFRLFK

SEQ ID NO: 746380 - protein, 503 aa, Homo sapiens
MELDLSPPHLSSSPEDLCPAPGTPPGTPRPPDTPLPEEVKRSQPLLIPTTGSPILGGPSSARGLLPRDASRPHVVKVYSEDGACRSVEVAAGATARHVCEMLVQRAHALSDETWGLVECHPHLALERGLEDHESVVEVQAAWPVGGDSRFVFRKNFAKYELFKSSPHSLFPEKMVSSCLDAHTGISHEDLIQNFLNAGSFPEIQGFLQLRGSGRKLWKRFFCFLRRSGLYYSTKGTSKDPRHLQYVADVNESNVYVVTQGRKLYGMPTDFGFCVKPNKLRNGHKGLRIFCSEDEQSRTCWLAAFRLFKYGVQLYKNYQQAQSRHLHPSCLGSPPLRSASDNTLVAMDFSGHAGRVIENPREALSVALEEAQAWRKKTNHRLSLPMPASGTSLSAAIHRTQLWFHGRISREESQRLIGQQGLVDGLFLVRESQRNPQGFVLSLCHLQKVKHYLILPSEEEGRLYFSMDDGQTRFTDLLQLVEFHQLNRGILPCLLRHCCTRVAL

SEQ ID NO: 746381 - protein, 68 aa, Homo sapiens; identical to SEQ ID NO: 746376

SEQ ID NO: 746382 - protein, 532 aa, Homo sapiens; identical to SEQ ID NO: 746369

SEQ ID NO: 746383 - protein, 600 aa, Homo sapiens
MELDLSPPHLSSSPEDLCPAPGTPPGTPRPPDTPLPEEVKRSQPLLIPTTGRKLREEERRATSLPSIPNPFPELCSPPSQSPILGGPSSARGLLPRDASRPHVVKVYSEDGACRSVEVAAGATARHVCEMLVQRAHALSDETWGLVECHPHLALERGLEDHESVVEVQAAWPVGGDSRFVFRKNFAKYELFKSSPHSLFPEKMVSSCLDAHTGISHEDLIQNFLNAGSFPEIQGFLQLRGSGRKLWKRFFCFLRRSGLYYSTKGTSKDPRHLQYVADVNESNVYVVTQGRKLYGMPTDFGFCVKPNKLRNGHKGLRIFCSEDEQSRTCWLAAFRLFKYGVQLYKNYQQAQSRHLHPSCLGSPPLRSASDNTLVAMDFSGHAGRVIENPREALSVALEEAQAWRKKTNHRLSLPMPASGTSLSAAIHRTQLWFHGRISREESQRLIGQQGLVDGLFLVRESQRNPQGFVLSLCHLQKVKHYLILPSEEEGRLYFSMDDGQTRFTDLLQLVDGLWGAATGDGMRSGRVPPLQFSPLLLCLPQIENSPHSSPLLTPLLKGRPWVAPSPSPSSGGAALGQGIMGEVGAAQAVSRPTLCTDREAS

SEQ ID NO: 746384 - protein, 505 aa, Homo sapiens
MELDLSPPHLSSSPEDLCPAPGTPPGTPRPPDTPLPEEVKRSQPLLIPTTGRKLREEERRATSLPSIPNPFPELCSPPSQSPILGGPSSARGLLPRDASRPHVVKVYSEDGACRSVEVAAGATARHVCEMLVQRAHALSDETWGLVECHPHLALERGLEDHESVVEVQAAWPVGGDSRFVFRKNFAKYELFKSSPHSLFPEKMVSSCLDAHTGISHEDLIQNFLNAGSFPEIQGFLQLRGSGRKLWKRFFCFLRRSGLYYSTKGTSKDPRHLQYVADVNESNVYVVTQGRKLYGMPTDFGFCVKPNKLRNGHKGLRIFCSEDEQSRTCWLAAFRLFKYGVQLYKNYQQAQSRHLHPSCLGSPPLRSASDNTLVAMDFSGHAGRVIENPREALSVALEEAQAWRKKTNHRLSLPMPASGTSLSAAIHRTQLWFHGRISPLLLCLPQIENSPHSSPLLTPLLKGRPWVAPSPSPSSGGAALGQGIMGEVGAAQAVSRPTLCTDREAS

SEQ ID NO: 746385 - protein, 426 aa, Homo sapiens
MELDLSPPHLSSSPEDLCPAPGTPPGTPRPPDTPLPEEVKRSQPLLIPTTGRKLREEERRATSLPSIPNPFPELCSPPSQSPILGGPSSARGLLPRDASRPHVVKVYSEDGACRSVEVAAGATARHVCEMLVQRAHALSDETWGLVECHPHLALERGLEDHESVVEVQAAWPVGGDSRFVFRKNFAKYELFKSSPHSLFPEKMVSSCLDAHTGISHEDLIQNFLNAGSFPEIQGFLQLRGSGRKLWKRFFCFLRRSGLYYSTKGTSKDPRHLQYVADVNESNVYVVTQGRKLYGMPTDFGFCVKPNKLRNGHKGLRIFCSEDEQSRTCWLAAFRLFKYGVQLYKNYQQAQSRHLHPSCLGSPPLPQIENSPHSSPLLTPLLKGRPWVAPSPSPSSGGAALGQGIMGEVGAAQAVSRPTLCTDREAS

SEQ ID NO: 746386 - protein, 277 aa, Homo sapiens [sequence omitted]

SEQ ID NO: 746387 - protein, 122 aa, Homo sapiens
DEQSRTCWLAAFRLFKVRPWEWHGGLAWPEGSPALPSGSLRNEEGITALLSDNPQSKPEVIGSAHRRQKHSPGLGKSWSEGGVTATPPGPLDLKLSFSPHPQYGVQLYKNYQQAQSRHLHPS

SEQ ID NO: 746388 - protein, 464 aa, Homo sapiens
MDGTEGSAGQPGPAERSHRSSVSSVGARAADVLVYLADDTVVPLAVENLPSLSAHELHRAVREVLQLPDIALDVFALWLVSPLLEVQLKPKHQPYKLGRQWPELLLRFTSAPDDDVAMDEPFLQFRRNVFFPKRRELQIHDEEVLRLLYEEAKGNVLAARYPCDVEDCEALGALVCRVQLGPYQPGRPAACDLREKLDSFLPAHLCKRGQSLFAALRGRGARAGPGEQGLLNAYRQVQEVSSDGGCEAALGTHYRAYLLKCHELPFYGCAFFHGEVDKPAQGFLHRGGRKPVSVAISLEGVHVIDSREKHVLLGLRFQELSWDHTSPEEEEPILWLEFDGDSEGTPVNKLLKIYSKQAELMSSLIEYCIELSQAAEPAGPQDSATGSPSDPSSSLAPVQRPKLRRQGSVVSSRIQHLSTIDYVEDGKGIRRVKPKRTTSFFSRQLSLGQGSYTVVQPGDSLEQG

SEQ ID NO: 746389 - protein, 31 aa, Homo sapiens
MRRPASDLEIDIWMRGTQRHPKTQRCQQRQS

SEQ ID NO: 746390 - protein, 285 aa, Homo sapiens
MTTLTHRARRTEISKNSEKKMESEEDSNWEKSPDNEDSGDSKDIRLTLMEEVLLLGLKDKEGYTSFWNDCISSGLRGGILIELAMRGRIYLEPPTMRKKRLLDRKVLLKSDSPTGDVLLDETLKHIKATEPTETVQTWIELLTGETWNPFKLQYQLRNVRERIAKNLVEKGILTTEKQNFLLFDMTTHPVTNTTEKQRLVKKLQDSVLERWVNDPQRMDKRTLALLVLAHSSDVLENVFSSLTDDKYDVAMNRAKDLVELDPEVEGTKPSATEMIWAVLAAFNKS

SEQ ID NO: 746391 - protein, 285 aa, Homo sapiens; identical to SEQ ID NO: 746390

SEQ ID NO: 746392 - protein, 313 aa, Homo sapiens
MTTLTHRARRTEISKNSEKKMESEEDSNWEKSPDNEDSGDSKDIRLTLMEEVLLLGLKDKEGYTSFWNDCISSGLRGGILIELAMRGRIYLEPPTMRKKRLLDRKVLLKSDSPTGDVLLDETLKHIKATEPTETVQTWIELLTGETWNPFKLQYQLRNVRERIAKNLVEKGILTTEKQNFLLFDMTTHPVTNTTEKQRLVKKLQDSVLERWVNDPQRMDKRTLALLVLAHSSDVLENVFSSLTDDKYDVAMNRAKDLVELDPEVEGTKPSATILSFFLFVLDKSLALLPRLVLNSWAQAILPPQPPKVLRLLA

SEQ ID NO: 746393 - protein, 228 aa, Homo sapiens
MHCSGYTSFWNDCISSGLRGGILIELAMRGRIYLEPPTMRKKRLLDRKVLLKSDSPTGDVLLDETLKHIKATEPTETVQTWIELLTGETWNPFKLQYQLRNVRERIAKNLVEKGILTTEKQNFLLFDMTTHPVTNTTEKQRLVKKLQDSVLERWVNDPQRMDKRTLALLVLAHSSDVLENVFSSLTDDKYDVAMNRAKDLVELDPEVEGTKPSATEMIWAVLAAFNKS

SEQ ID NO: 746394 - protein, 285 aa, Homo sapiens; identical to SEQ ID NO: 746390

SEQ ID NO: 746395 - protein, 235 aa, Homo sapiens
RTNFAFLPHTLLIFIKLPGSDIASGSDVLSDVIPSIPSSPCLLPKKKNKHRNLDELPWSAMTNDEQVEYIEYLSRKVSTEMGLREQLDIIKIIDPSAQISPTDSEFIIELNCLTDEKLKQVRNYIKEHSPRQRPAREAWKRSNFSCASTSGVSGASASASSSSASMVSSASSSGSSVGNSASNSSANMSRAHSDSNLSASAAERIRDSKVKRLINTKLYLSILTLVLLHINFLKS

SEQ ID NO: 746396 - protein, 265 aa, Homo sapiens
RTNFAFLPHTLLIFIKLPGSDIASGSDVLSDVIPSIPSSPCLLPKKKNKHRNLDELPWSAMTNDEQVEYIEYLSRKVSTEMGLREQLDIIKIIDPSAQISPTDSEFIIELNCLTDEKLKQVRNYIKEHSPRQRPAREAWKRSNFSCASTSGVSGASASASSSSASMVSSASSSGSSVGNSASNSSANMSRAHSDSNLSASAAERIRDSKKRSKQRKLQQKAFRKRQLKEQRQARKERLSGLFLNEEVLSLKVTEEDHEADVDVLM

SEQ ID NO: 746397 - protein, 406 aa, Homo sapiens
GRDAQPASELRRAHPGASATADRLEWGQGRAREQPRAREGARARPSPTMSDEASAITSYEKFLTPEEPFPLLGPPRGVGTCPSEEPGCLDISDFGCQLSSCHRTDPLHRFHTNRWNLTSCGTSVASSEGSEELFSSVSVGDQDDCYSLLDDQDFTSFDLFPEGSVCSDVSSSISTYWDWSDSEFEWQLPGSDIASGSDVLSDVIPSIPSSPCLLPKKKNKHRNLDELPWSAMTNDEQVEYIEYLSRKVSTEMGLREQLDIIKIIDPSAQISPTDSEFIIELNCLTDEKLKQVRNYIKEHSPRQRPAREAWKRSNFSCASTSGVSGASASASSSSASMVSSASSSGSSVGNSASNSSANMSRAHSDSNLSASAAERIRDSKVKRLINTKLYLSILTLVLLHINFLKS

SEQ ID NO: 746398 - protein, 436 aa, Homo sapiens
GRDAQPASELRRAHPGASATADRLEWGQGRAREQPRAREGARARPSPTMSDEASAITSYEKFLTPEEPFPLLGPPRGVGTCPSEEPGCLDISDFGCQLSSCHRTDPLHRFHTNRWNLTSCGTSVASSEGSEELFSSVSVGDQDDCYSLLDDQDFTSFDLFPEGSVCSDVSSSISTYWDWSDSEFEWQLPGSDIASGSDVLSDVIPSIPSSPCLLPKKKNKHRNLDELPWSAMTNDEQVEYIEYLSRKVSTEMGLREQLDIIKIIDPSAQISPTDSEFIIELNCLTDEKLKQVRNYIKEHSPRQRPAREAWKRSNFSCASTSGVSGASASASSSSASMVSSASSSGSSVGNSASNSSANMSRAHSDSNLSASAAERIRDSKKRSKQRKLQQKAFRKRQLKEQRQARKERLSGLFLNEEVLSLKVTEEDHEADVDVLM

SEQ ID NO: 746399 - protein, 138 aa, Homo sapiens
SELISISPSQGDCFRGNICNLTPTWHRVGPEHISARWLCCSEANASLPCSCPCDVDAQSRVRPCPLSLHCLFLSLCLGWSVPPLHDPHPINSSGQNTACQSRISLSYQAFKEPSRHCFLPRKFSRKLFQLDNLNGVIF

SEQ ID NO: 746400 - protein, 1230 aa, Homo sapiens [sequence omitted]

SEQ ID NO: 746401 - protein, 1997 aa, Homo sapiens
MALLIHLKTVSELRGRGDRIAKVTFRGQSFYSRVLENCEDVADFDETFRWPVASSIDRNEMLEIQVFNYSKVFSNKLIGTFRMVLQKVVEESHVEVTDTLIDDNNAIIKTSLCVEVRYQATDGTVGSWDDGDFLGDESLQEEEKDSQETDGLLPGSRPSSRPPGEKSFRRAGRSVFSAMKLGKNRSHKEEPQRPDEPAVLEMEDLDHLAIRLGDGLDPDSVSLASVTALTTNVSNKRSKPDIKMEPSAGRPMDYQVSITVIEARQLVGLNMDPVVCVEVGDDKKYTSMKESTNCPYYNEYFVFDFHVSPDVMFDKIIKISVIHSKNLLRSGTLVGSFKMDVGTVYSQPEHQFHHKWAILSDPDDISSGLKGYVKCDVAVVGKGDNIKTPHKANETDEDDIEGNLLLPEGVPPERQWARFYVKIYRAEGLPRMNTSLMANVKKAFIGENKDLVDPYVQVFFAGQKGKTSVQKSSYEPLWNEQVVFTDLFPPLCKRMKVQIRDSDKVNDVAIGTHFIDLRKISNDGDKGFLPTLGPAWVNMYGSTRNYTLLDEHQDLNEGLGEGVSFRARLLLGLAVEIVDTSNPELTSSTEVQVEQATPISESCAGKMEEFFLFGAFLEASMIDRRNGDKPITFEVTIGNYGNEVDGLSRPQRPRPRKEPGDEEEVDLIQNASDDEAGDAGDLASVSSTPPMRPQVTDRNYFHLPYLERKPCIYIKSWWPDQRRRLYNANIMDHIADKLEEGLNDIQEMIKTEKSYPERRLRGVLEELSCGCCRFLSLADKDQGHSSRTRLDRERLKSCMRELENMGQQARMLRAQVKRHTVRDKLRLCQNFLQKLRFLADEPQHSIPDIFIWMMSNNKRVAYARVPSKDLLFSIVEEETGKDCAKVKTLFLKLPGKRGFGSAGWTVQAKVELYLWLGLSKQRKEFLCGLPCGFQEVKAAQGLGLHAFPPVSLVYTKKQAFQLRAHMYQARSLFAADSSGLSDPFARVFFINQSQCTEVLNETLCPTWDQMLVFDNLELYGEAHELRDDPPIIVIEIYDQDSMGKADFMGRTFAKPLVKMADEAYCPPRFPPQLEYYQIYRGNATAGDPLAAFELLQIGPAGKADLPPINGPVDVDRGPIMPVPMGIRPVLSKYRVEVLFWGLRDLKRVNLAQVDRPRVDIECAGKGVQSSLIHNYKKNPNFNTLVKWFEVDLPENELLHPPLNIRVVDCRAFGRYTLVGSHAVSSLRRFIYRPPDRSAPSWNTTVRLLRRCRVLCNGGSSSHSTGEVVVTMEPEVPIKKLETMVKLDATSEAVVKVDVAEEEKEKKKKKKGTAEEPEEEEPDESMLDWWSKYFASIDTMKEQLRQQEPSGIDLEEKEEVDNTEGLKGSMKGKEKARAAKEEKKKKTQSSGSGQGSEAPEKKKPKIDELKVYPKELESEFDNFEDWLHTFNLLRGKTGDDEDGSTEEERIVGRFKGSLCVYKVPLPEDVSREAGYDSTYGMFQGIPSNDPINVLVRVYVVRATDLHPADINGKADPYIAIRLGKTDIRDKENYISKQLNPVFGKSFDIEASFPMESMLTVAVYDWDLVGTDDLIGETKIDLENRFYSKHRATCGIAQTYSTHGYNIWRDPMKPSQILTRLCKDGKVDGPHFGPPGRVKVANRVFTGPSEIEDENGQRKPTDEHVALLALRHWEDIPRAGCRLVPEHVETRPLLNPDKPGIEQGRLELWVDMFPMDMPAPGTPLDISPRKPKKYELRVIIWNTDEVVLEDDDFFTGEKSSDIFVRGWLKGQQEDKQDTDVHYHSLTGEGNFNWRYLFPFDYLAAEEKIVISKKESMFSWDETEYKIPARLTLQIWDADHFSADDFLGAIELDLNRFPRGAKTAKQCTMEMATGEVDVPLVSIFKQKRVKGWWPLLARNENDEFELTGKVEAELHLLTAEEAEKNPVGLARNEPDPLEKPNRPDTSFIWFLNPLKSARYFLWHTYRWLLLKLLLLLLLLLLLALFLYSVPGYLVKKILGA

SEQ ID NO: 746402 - protein, 1306 aa, Homo sapiens
MTDTQDGPSESSQIMRSLTPLINREEAFGEAGEAGLWPSITHTPDSQEEGLNDIQEMIKTEKSYPERRLRGVLEELSCGCCRFLSLADKDQGHSSRTRLDRERLKSCMRELENMGQQARMLRAQVKRHTVRDKLRLCQNFLQKLRFLADEPQHSIPDIFIWMMSNNKRVAYARVPSKDLLFSIVEEETGKDCAKVKTLFLKLPGKRGFGSAGWTVQAKVELYLWLGLSKQRKEFLCGLPCGFQEVKAAQGLGLHAFPPVSLVYTKKQAFQLRAHMYQARSLFAADSSGLSDPFARVFFINQSQCTEVLNETLCPTWDQMLVFDNLELYGEAHELRDDPPIIVIEIYDQDSMGKADFMGRTFAKPLVKMADEAYCPPRFPPQLEYYQIYRGNATAGDPLAAFELLQIGPAGKADLPPINGPVDVDRGPIMPVPMGIRPVLSKYRVEVLFWGLRDLKRVNLAQVDRPRVDIECAGKGVQSSLIHNYKKNPNFNTLVKWFEVDLPENELLHPPLNIRVVDCRAFGRYTLVGSHAVSSLRRFIYRPPDRSAPSWNTTVRLLRRCRVLCNGGSSSHSTGEVVVTMEPEVPIKKLETMVKLDATSEAVVKVDVAEEEKEKKKKKKGTAEEPEEEEPDESMLDWWSKYFASIDTMKEQLRQQEPSGIDLEEKEEVDNTEGLKGSMKGKEKARAAKEEKKKKTQSSGSGQGSEAPEKKKPKIDELKVYPKELESEFDNFEDWLHTFNLLRGKTGDDEDGSTEEERIVGRFKGSLCVYKVPLPEDVSREAGYDSTYGMFQGIPSNDPINVLVRVYVVRATDLHPADINGKADPYIAIRLGKTDIRDKENYISKQLNPVFGKSFDIEASFPMESMLTVAVYDWDLVGTDDLIGETKIDLENRFYSKHRATCGIAQTYSTHGYNIWRDPMKPSQILTRLCKDGKVDGPHFGPPGRVKVANRVFTGPSEIEDENGQRKPTDEHVALLALRHWEDIPRAGCRLVPEHVETRPLLNPDKPGIEQGRLELWVDMFPMDMPAPGTPLDISPRKPKKYELRVIIWNTDEVVLEDDDFFTGEKSSDIFVRGWLKGQQEDKQDTDVHYHSLTGEGNFNWRYLFPFDYLAAEEKIVISKKESMFSWDETEYKIPARLTLQIWDADHFSADDFLGAIELDLNRFPRGAKTAKQCTMEMATGEVDVPLVSIFKQKRVKGWWPLLARNENDEFELTGKVEAELHLLTAEEAEKNPVGLARNEPDPLEKPNRPDTSFIWFLNPLKSARYFLWHTYRWLLLKLLLLLLLLLLLALFLYSVPGYLVKKILGA

SEQ ID NO: 746403 - protein, 1230 aa, Homo sapiens [sequence omitted]

SEQ ID NO: 746404 - protein, 510 aa, Homo sapiens
MGALLRQPFSPFQATDLHPADINGKADPYIAIRLGKTDIRDKENYISKQLNPVFGKSFDIEASFPMESMLTVAVYDWDLVGTDDLIGETKIDLENRFYSKHRATCGIAQTYSTHGYNIWRDPMKPSQILTRLCKDGKVDGPHFGPPGRVKVANRVFTGPSEIEDENGQRKPTDEHVALLALRHWEDIPRAGCRLVPEHVETRPLLNPDKPGIEQGRLELWVDMFPMDMPAPGTPLDISPRKPKKYELRVIIWNTDEVVLEDDDFFTGEKSSDIFVRGWLKGQQEDKQDTDVHYHSLTGEGNFNWRYLFPFDYLAAEEKIVISKKESMFSWDETEYKIPARLTLQIWDADHFSADDFLGAIELDLNRFPRGAKTAKQCTMEMATGEVDVPLVSIFKQKRVKGWWPLLARNENDEFELTGKVEAELHLLTAEEAEKNPVGLARNEPDPLEKPNRPDTSFIWFLNPLKSARYFLWHTYRWLLLKLLLLLLLLLLLALFLYSVPGYLVKKILGA

SEQ ID NO: 746405 - protein, 464 aa, Homo sapiens
MDGTEGSVGQPGPTERSHRSSVSSVGARAADVLVYLADDTVVPLAVENLPSLRAHELHCAVREVLKLPDIALDVFALWLVSPLLEVQLKPKNQPYKLGRQWPELLLRFTSAPDDDVAMDEPFLQFRRNVFFPKGRELQIPDEEVLRLLYEEAKGNVLAARYLCDVEDCEALGALVCRVQLVTYQPDWPAACDLREKLDSFLPAHLCKRGQGLFAALRGRGARAGPGEQSLLNAYRKVQEVSSDGGCEAALGTHYRAYLLKCHKLPFYGCAFFHGEVDKPAQGFLHRGGRKSVSVAISLEGVHVVDSREKHVLLGLCFQELSWDHTSPEEEEPILWLEFDRDSGVTPVNKLLKIYSKQAELMSSLIEYCIELSQAAEPAGPQDSATGSPSDLSSSPAPVQRPKLRRQGSVVSSRIQHLSTIAYVEDGKGIRRVKTKSTTSFFSQQLSLGQGSYTVVQPSDSLEQG

SEQ ID NO: 746406 - protein, 176 aa, Homo sapiens
MERRLIKKEMKKLLGDYIGIRLRENEFDPKGRRQLTFLDDMAHYDLAISVALQWLDPSEDLTWLEWEELKIPLHGRPIYPNRREREAMILSSYAGILMNSIPIEEVFKIYGADSSADSGTIKVPRVSSLRLSLHPFAMLTAPKAAAYARKQGHLENWNCTMELHNRFSGSRREASS

SEQ ID NO: 746407 - protein, 214 aa, Homo sapiens
MERRLIKKEMKKLLGDYIGIRLRENEFDPKGRRQLTFLDDMAHYDLAISVALQWLDPSEDLTWLEWEELKIPLHGRPIYPNRREREAMILSSYAGILMNSIPIEEVFKIYGADSSADSGTIKVPRVSSLRLSLHPFAMLTAPKAAAYARKQVETGFHRGLDLLTSRSARLGLPKRWDYRLEPPRPAQLLGHLENWNCTMELHNRFSGSRREASS

SEQ ID NO: 746408 - protein, 193 aa, Homo sapiens
MERRLIKKEMKKLLGDYIGIRLRENEFDPKGRRQLTFLDDMAHYDLAISVALQWLDPSEDLTWLEWEELKIPLHGRPIYPNRREREAMILSSYAGILMNSIPIEEVFKIYGADSSADSGTIKVPRVSSLRLSLHPFAMLTAPKAAAYARKQGVKSRKVTTNKNATSISAKEANATEWKSSQRFSDTQPKHKVT

SEQ ID NO: 746409 - protein, 193 aa, Homo sapiens; identical to SEQ ID NO: 746408

SEQ ID NO: 746410 - protein, 342 aa, Homo sapiens
MDLTYIPEDLSSCPKFVNKSCPPTNRSFHVQVIMYSVMTGAMIITIRKLGYNGFHIAFQTASLSHKLSDPLHGNQDFLLGFVIMPYSIMRSVESCWYFGDGFCKFHTSFDMMLRLTSIFHLCSIAIDRFYAVCYPLHYTTKMTNSTIKQLLAFCWSVPALFSFGLVLSEADVSGMQSYKILVACFNFCALTFNKFWGTILFTTCFFTPGSIMVGIYGKIFIVSKQHARVISHVPENTKGAVKKHLSKKKDRKAAKTLGIVMGVFLACWLPCFLAVLIDPYLDYSTPILILDLLVWLRYFNSTCNPLIHGFFNPWFQKAFKYIVSGKIFSSHSETANLFPEAH

SEQ ID NO: 746411 - protein, 342 aa, Homo sapiens; identical to SEQ ID NO: 746410

SEQ ID NO: 746412 - protein, 104 aa, Homo sapiens
MTRTLLRNGRLALYRTALPHQQEAKDSPCLWSVPLTFLFYLLLIHKSRTFHSLVKPLSPTLELSDGLLLSQLLLEDATDEKTRPSLRVPSKGKSEKIQNNSKGL

SEQ ID NO: 746413 - protein, 123 aa, Homo sapiens
MSILIIEAFYGGSHKQLVDLLQEELGDCVVYTLPAKKWHWRARTSALYFSQTIPISEHYRTLFASSVLNLTELAALRPDLGKLKKILYFHENQLIYPVKKCQERDFQYGYNQILSCLGEHERW

SEQ ID NO: 746414 - protein, 193 aa, Homo sapiens
MSILIIEAFYGGSHKQLVDLLQEELGDCVVYTLPAKKWHWRARTSALYFSQTIPISEHYRTLFASSVLNLTELAALRPDLGKLKKILYFHENQLIYPVKKCQERDFQYGYNQILSCLVADVVVFNSVFNMESFLTSMGKFMKLIPDHRPKDLESIIRPKCQVIYFPIRFPDVSRFMPKHKTSHLKKMLGLKDM

SEQ ID NO: 746415 - protein, 193 aa, Homo sapiens; identical to SEQ ID NO: 746414

SEQ ID NO: 746416 - protein, 72 aa, Homo sapiens
AAAGEGHGVSASPAGPRRWPGGRDKEEEEEEGISALARLDICKGTSVYLDHQIVLQEDHREERIFILLQKLQ

SEQ ID NO: 746417 - protein, 109 aa, Homo sapiens
CAAVRTALGMGRHAVAFCAFCKLVVFELRFFGAYMSCVLVFCGPALRFFLAQAERTGGGTSPSRGRREAGRPGWPELAGVLRRPPGCPALGPLQCEPQAFLTESFASGS

SEQ ID NO: 746418 - protein, 83 aa, Homo sapiens
MGLHFYISINSVLWQYAGIFYHVLFTAVWVSKMIDISKEKEAAFFKFHQIISLLLKVRFLHFYLIIISCIHTSIVDNNSLLFF

SEQ ID NO: 746419 - protein, 73 aa, Homo sapiens
LNDNSDTTYQNLWDTEKAVLRGKFIALNVYTKKPERAQIGNLRSRLKELEKLEQSKHKPSIRKEITKIRAELN

SEQ ID NO: 746420 - protein, 101 aa, Homo sapiens
NFFFSFSETEFCSVAQARVQWYNHGSLQVLAGSSNPPTLASQVAVTTATHHYTQLIFLFFVEMESHHVDRLVSNSWAQEILLPWPLNCWDYRCEPPHLAKI

SEQ ID NO: 746421 - protein, 1454 aa, Homo sapiens
MPGPPALRRRLLLLLLVLLIAGSAGAAPLPQTGAGEAPPAAEVSSSFVILCVCSLIILIVLIANCVSCCKDPEIDFKEFEDNFDDEIDFTPPAEDTPSVQSPAEVFTLSVPNISLPAPSQFQPSVEGLKSQVARHSLNYIQEIGNGWFGKVLLGEIYTGTSVARVIVKELKASANPKEQDTFLKNGEPYYILQHPNILQCVGQCVEAIPYLLVFEFCDLGDLKAYLRSEQEHMRGDSQTMLLQRMACEVAAGLAAMHKLHFLHSDLALRNCFLTSDLNVKVGDYGIGFSRYKEDYIETDDKKVFPLRWTAPELVTSFQDRLLTADQTKYSNIWSLGVTLWELFDNAAQPYSNLSNLDVLNQVIRERDTKLPKPQLEQPYSDRWYEVLQFCWLSPEKRPAAEDVHRLLTYLRLQSQRDSEVDFEQQWNALKPNTNSRDSSNNAAFPILDHFARDRLGREMEEVLTVTETSQGLSFEYVWEAAKHDHFDERSRGHLDEGLSYTSIFYPVEVFESSLSDPGPGKQDDSGQDVPLRVPGVVPVFDAHNLSVGSDYYIQLEEKSGSNLELDYPPALLTTDMDNPERTGPELSQLTALRSVELEESSTDEDFFQSSTDPKDSSLPGDLHVTSGPESPFNNIFNDVDKSEDLPSHQKIFDLMELNGVQADFKPATLSSSLDNPKESVITGHFEKEKPRKIFDSEPLCLSDNLMHQDNFDPLNVQELSENFLFLQEKNLLKGSLSSKEHINDLQTELKNAGFTEAMLETSCRNSLDTELQFAENKPGMSLLQENVSTKGDDTDVMLTGDTLSTSLQSSPEVQVPPTSFETEETPRRVPPDSLPTQGETQPTCLDVIVPEDCLHQDISPDAVTVPVEILSTDARTHSLDNRSQDSPGESEETLRLTESDSVLADDILASRVSVGSSLPELGQELHNKPFSEDHHSHRRLEKNLEAVETLNQLNSKDAAKEAGLVSALSSDSTSQDSLLEDSLSAPFPASEPSLETPDSLESVDVHEALLDSLGSHTPQKLVPPDKPADSGYETENLESPEWTLHPAPEGTADSEPATTGDGGHSGLPPNPVIVISDAGDGHRGTEVTPETFTAGSQGSYRDSAYFSDNDSEPEKRSEEVPGTSPSALVLVQEQPLPEPVLPEQSPAAQDSCLEARKSQPDESCLSALHNSSDLELRATPEPAQTGVPQQVHPTEDEASSPWSVLNAELSSGDDFETQDDRPCTLASTGTNTNELLAYTNSALDKSLSSHSEGPKLKEPDIEGKYLGKLGVSGMLDLSEDGMDADEEDENSDDSDEDLRAFNLHSLSSESEDETEHPVPIILSNEDGRHLRSLLKPTAANAPDPLPEDWKKEKKAVTFFDDVTVYLFDQETPTKELGPCGGEACGPDLSGPAPASGSPYLSRCINSESSTDEEGGGFEWDDDFSPDPFMSKTTSNLLSSKPSLPPTLPAFPSHT

SEQ ID NO: 746422 - protein, 104 aa, Homo sapiens
MWESQAGAASEGKDRKGGSGGAGLKTPASVPVVQRTCHPRHACLIILKTQLCRLASSLLNRKQRRRRKGLGGCQRARSGPRLLPWSGAPAPSARAATSTRHLLT

SEQ ID NO: 746423 - protein, 1503 aa, Homo sapiens
MPGPPALRRRLLLLLLVLLIAGSAGAAPLPQTGAGEAPPAAEVSSSFVILCVCSLIILIVLIANCVSCCKDPEIDFKEFEDNFDDEIDFTPPAEDTPSVQSPAEVFTLSVPNISLPAPSQFQPSVEGLKSQVARHSLNYIQEIGNGWFGKVLLGEIYTGTSVARVIVKELKASANPKEQDTFLKNGEPYYILQHPNILQCVGQCVEAIPYLLVFEFCDLGDLKAYLRSEQEHMRGDSQTMLLQRMACEVAAGLAAMHKLHFLHSDLALRNCFLTSDLNVKVGDYGIGFSRYKEDYIETDDKKVFPLRWTAPELVTSFQDRLLTADQTKYSNIWSLGVTLWELFDNAAQPYSNLSNLDVLNQVIRERDTKLPKPQLEQPYSDRWYEVLQFCWLSPEKRPAAEDVHRLLTYLRLQSQRDSEVDFEQQWNALKPNTNSRDSSNNAAFPILDHFARDRLGREMEEVLTVTETSQGLSFEYVWEAAKHDHFDERSRGHLDEGLSYTSIFYPVEVFESSLSDPGPGKQDDSGQDVPLRVPGVVPVFDAHNLSVGSDYYIQLEEKSGSNLELDYPPALLTTDMDNPERTGPELSQLTALRSVELEESSTDEDFFQSSTDPKDSSLPGDLHVTSGPESPFNNIFNDVDKSEDLPSHQKIFDLMELNGVQADFKPATLSSSLDNPKESVITGHFEKEKPRKIFDSEPLCLSDNLMHQDNFDPLNVQELSENFLFLQEKNLLKGSLSSKEHINDLQTELKNAGFTEAMLETSCRNSLDTELQFAENKPGMSLLQENVSTKGDDTDVMLTGDTLSTSLQSSPEVQVPPTSFETEETPRRVPPDSLPTQGETQPTCLDVIVPEDCLHQDISPDAVTVPVEILSTDARTHSLDNRSQDSPGESEETLRLTESDSVLADDILASRVSVGSSLPELGQELHNKPFSEDHHSHRRLEKNLEAVETLNQLNSKDAAKEAGLVSALSSDSTSQDSLLEDSLSAPFPASEPSLETPDSLESVDVHEALLDSLGSHTPQKLVPPDKPADSGYETENLESPEWTLHPAPEGTADSEPATTGDGGHSGLPPNPVIVISDAGDGHRGTEVTPETFTAGSQGSYRDSAYFSDNDSEPEKRSEEVPGTSPSALVLVQEQPLPEPVLPEQSPAAQDSCLEARKSQPDESCLSALHNSSDLELRATPEPAQTGVPQQVHPTEDEASSPWSVLNAELSSGDDFETQDDRPCTLASTGTNTNELLAYTNSALDKSLSSHSEGPKLKEPDIEGKYLGKLGVSGMLDLSEDGMDADEEDENSDDSDEDLRAFNLHSLSSESEDETEHPVPIILSNEDGRHLRSLLKPTAANAPDPLPEDWKKEKKAVTFFDDVTVYLFDQETPTKELGPCGGEACGPDLSGPAPASGSPYLSRCINSESSTDEEGGGFEWDDDFSPDPFMSKTTSNLLSSKPSLQTSKYFSPPPPARSTEQSWPHSAPYSRFSISPANIASFSLTHLTDSDIEQGGSSEDGEKD

SEQ ID NO: 746424 - protein, 354 aa, Homo sapiens
MRYTTVPSVRPTALATKKLDLWRLPPFLIIHLKRFQFVNDQWIKSQKIVKFPRESFDPSAFLVPRDPALCQHQPLTPQGDELSKPRILAREVKKVDVQSLAGEEDMLLSKSPSSLSANISSSPKGSPSSSRKSGTSCPSSKNSSPNSCPRTLGRSKGRLRLPQIGSKNKLSSSKKNLDASKENGAGQICELADALSRGHMRGGSQPELVTPQDHEVALGNGFLYEHEAYGNGYSNGQLGNHSEEDSTDDQREDTHIKPIYNLYAISCHSGILSGGHYVTYAKNPNCKWYCYNGSICEEHHPDEIDTDSAYILFYEQQRIDYAQFLPKIDGKKMADTSSMDEDFESDYEKYCVLQ

SEQ ID NO: 746425 - protein, 415 aa, Homo sapiens
HYANEKLSFSSPHLLICTKVTVGPSVVDEHESVEQSWRVQVEPINLDSCLRAFTSEEELGEDEIYYCSKCKTHCLATKKLDLWRLPPFLIIHLKRFQFVNDQWIKSQKIVKFPRESFDPSAFLVPRDPALCQHQPLTPQGDELSKPRILAREVKKVDVQSLAGEEDMLLSKSPSSLSANISSSPKGSPSSSRKSGTSCPSSKNSSPNSCPRTLGRSKGRLRLPQIGSKNKLSSSKKNLDASKENGAGQICELADALSRGHMRGGSQPELVTPQDHEVALGNGFLYEHEAYGNGYSNGQLGNHSEEDSTDDQREDTHIKPIYNLYAISCHSGILSGGHYVTYAKNPNCKWYCYNGSICEEHHPDEIDTDSAYILFYEQQRIDYAQFLPKIDGKKMADTSSMDEDFESDYEKYCVLQ

SEQ ID NO: 746426 - protein, 415 aa, Homo sapiens; identical to SEQ ID NO: 746425

SEQ ID NO: 746427 - protein, 415 aa, Homo sapiens; identical to SEQ ID NO: 746425

SEQ ID NO: 746428 - protein, 415 aa, Homo sapiens; identical to SEQ ID NO: 746425

SEQ ID NO: 746429 - protein, 416 aa, Homo sapiens
HYANEKLSFSSPHLLICTKVTVGPSVVDEHESVEQSWRVQVEPINLDSCLRAFTSEEELGEDEIYYCSKCKTHCLATKKLDLWRLPPFLIIHLKRFQFVNDQWIKSQKIVKFPRESFDPSAFLVPRDPALCQHQPLTPQGDELSKPRILAREVKKVDVQSLAGEEDMLLSKSPSSLSANISSSPKGSPSSSRKSGTSCPSSKNSSPNSCPRTLGRSKGRLRLPQIGSKNKLSSSKKNLDASKENGAGQICELADALSRGHMRGGSQPELVTPQDHEVALGNGFLYEHEAYGNGYSNGQLGNHSEEDSTDDQREDTHIKPIYNLYAISCHSGILSGGHYVTYAKNPNCKWYCYNGSICEEHHPDEIDTDSAYILFYEQQRIDYAQFLPKIDGKKMADTSSMDEDFESDYEKEMTPCS

SEQ ID NO: 746430 - protein, 415 aa, Homo sapiens; identical to SEQ ID NO: 746425

SEQ ID NO: 746431 - protein, 392 aa, Homo sapiens
HYANEKLSFSSPHLLICTKVTVGPSVVDEHESVEQSWRVQVEPINLDSCLRAFTSEEELGEDEIYYCSKCKTHCLATKKLDLWRLPPFLIIHLKRFQFVNDQWIKSQKIVKFPRESFDPSAFLVPRDPALCQHQPLTPQGDELSKPRILAREVKKVDVQSLAGEEDMLLSKSPSSLSANISSSPKGSPSSSRKSGTSCPSSKNSSPNSCPRTLGRSKGRLRLPQIGSKNKLSSSKKNLDASKENGAGQICELADALSRGHMRGGSQPELVTPQDHEVALGNGFLYEHEAYGNGYSNGQLGNHSEEDSTDDQREDTHIKPIYNLYAISCHSGILSGGHYVTYAKNPNCKWYCYNGSICEYAQFLPKIDGKKMADTSSMDEDFESDYEKYCVLQ

SEQ ID NO: 746432 - protein, 415 aa, Homo sapiens; identical to SEQ ID NO: 746425

SEQ ID NO: 746433 - protein, 391 aa, Homo sapiens
MNASSRNVFDTLIRVLTESMFKHLRKWVVTRFFGHSRQRARLVSKDGRCNIEFGNVEAQSRFIFFVDIWTTVLDLKWRYKMTIFITAFLGSWFFFGLLWYAVAYIHKDLPEFHPSANHTPCVENINGLTSAFLFSLETQVTIGYGFRCVTEQCATAIFLLIFQSILGVIINSFMCGAILAKISRPKKRAKTITFSKNAVISKRGGKLCLLIRVANLRKSLLIGSHIYGKLLKTTVTPEGETIILDQININFVVDAGNENLFFISPLTIYHVIDHNSPFFHMAAETLLQQDFELVVFLDGTVESTSATCQVRTSYVPEEVLWGYRFAPIVSKTKEGKYRVDFHNFSKTVEVETPHCAMCLYNEKDVRARMKRGYDNPNFILSEVNETDDTKM

SEQ ID NO: 746434 - protein, 102 aa, Homo sapiens
MAKISSPTETERCIESLIAVFQKYAGKDGYNRNLSKTEFLSFMNTELAAFTKNQKDPGVLDHMKKLDVSSDGQLDFPKFLNLIGGLAVACHDSFLKAVPSQK

SEQ ID NO: 746435 - protein, 1059 aa, Homo sapiens
MKESSLQNSSCSLGKETKKENMFLQSSMLTCIFLLISGSCELCAEENFSRSYPCDEKKQNDSVIAECSNRRLQEVPQTVGKYVTELDLSDNFITHITNESFQGLQNLTKINLNHNPNVQHQNGNPGIQSNGLNITDGAFLNLKNLRELLLEDNQLPQIPSGLPESLTELSLIQNNIYNITKEGISRLINLKNLYLAWNCYFNKVCEKTNIEDGVFETLTNLELLSLSFNSLSHVPPKLPSSLRKLFLSNTQIKYISEEDFKGLINLTLLDLSGNCPRCFNAPFPCVPCDGGASINIDRFAFQNLTQLRYLNLSSTSLRKINAAWFKNMPHLKVLDLEFNYLVGEIASGAFLTMLPRLEILDLSFNYIKGSYPQHINISRNFSKLLSLRALHLRGYVFQELREDDFQPLMQLPNLSTINLGINFIKQIDFKLFQNFSNLEIIYLSENRISPLVKDTRQSYANSSSFQRHIRKRRSTDFEFDPHSNFYHFTRPLIKPQCAAYGKALDLSLNSIFFIGPNQFENLPDIACLNLSANSNAQVLSGTEFSAIPHVKYLDLTNNRLDFDNASALTELSDLEVLDLSYNSHYFRIAGVTHHLEFIQNFTNLKVLNLSHNNIYTLTDKYNLESKSLVELVFSGNRLDILWNDDDNRYISIFKGLKNLTRLDLSLNRLKHIPNEAFLNLPASLTELHINDNMLKFFNWTLLQQFPRLELLDLRGNKLLFLTDSLSDFTSSLRTLLLSHNRISHLPSGFLSEVSSLKHLDLSSNLLKTINKSALETKTTTKLSMLELHGNPFECTCDIGDFRRWMDEHLNVKIPRLVDVICASPGDQRGKSIVSLELTTCVSDVTAVILFFFTFFITTMVMLAALAHHLFYWDVWFIYNVCLAKVKGYRSLSTSQTFYDAYISYDTKDASVTDWVINELRYHLEESRDKNVLLCLEERDWDPGLAIIDNLMQSINQSKKTVFVLTKKYAKSWNFKTAFYLALQRLMDENMDVIIFILLEPVLQHSQYLRLRQRICKSSILQWPDNPKAEGLFWQTLRNVVLTENDSRYNNMYVDSIKQY

SEQ ID NO: 746436 - protein, 1041 aa, Homo sapiens
MENMFLQSSMLTCIFLLISGSCELCAEENFSRSYPCDEKKQNDSVIAECSNRRLQEVPQTVGKYVTELDLSDNFITHITNESFQGLQNLTKINLNHNPNVQHQNGNPGIQSNGLNITDGAFLNLKNLRELLLEDNQLPQIPSGLPESLTELSLIQNNIYNITKEGISRLINLKNLYLAWNCYFNKVCEKTNIEDGVFETLTNLELLSLSFNSLSHVPPKLPSSLRKLFLSNTQIKYISEEDFKGLINLTLLDLSGNCPRCFNAPFPCVPCDGGASINIDRFAFQNLTQLRYLNLSSTSLRKINAAWFKNMPHLKVLDLEFNYLVGEIASGAFLTMLPRLEILDLSFNYIKGSYPQHINISRNFSKLLSLRALHLRGYVFQELREDDFQPLMQLPNLSTINLGINFIKQIDFKLFQNFSNLEIIYLSENRISPLVKDTRQSYANSSSFQRHIRKRRSTDFEFDPHSNFYHFTRPLIKPQCAAYGKALDLSLNSIFFIGPNQFENLPDIACLNLSANSNAQVLSGTEFSAIPHVKYLDLTNNRLDFDNASALTELSDLEVLDLSYNSHYFRIAGVTHHLEFIQNFTNLKVLNLSHNNIYTLTDKYNLESKSLVELVFSGNRLDILWNDDDNRYISIFKGLKNLTRLDLSLNRLKHIPNEAFLNLPASLTELHINDNMLKFFNWTLLQQFPRLELLDLRGNKLLFLTDSLSDFTSSLRTLLLSHNRISHLPSGFLSEVSSLKHLDLSSNLLKTINKSALETKTTTKLSMLELHGNPFECTCDIGDFRRWMDEHLNVKIPRLVDVICASPGDQRGKSIVSLELTTCVSDVTAVILFFFTFFITTMVMLAALAHHLFYWDVWFIYNVCLAKVKGYRSLSTSQTFYDAYISYDTKDASVTDWVINELRYHLEESRDKNVLLCLEERDWDPGLAIIDNLMQSINQSKKTVFVLTKKYAKSWNFKTAFYLALQRLMDENMDVIIFILLEPVLQHSQYLRLRQRICKSSILQWPDNPKAEGLFWQTLRNVVLTENDSRYNNMYVDSIKQY

SEQ ID NO: 746437 - protein, 52 aa, Homo sapiens
MKISQQAQLAAAEKFKVQGEAVSNIQENTQTPTVQEESEEEEVDETGVEVKD

SEQ ID NO: 746438 - protein, 104 aa, Homo sapiens
MPTIRAGVDATVHPHCISPPHGQRHTLAHIPSTFDCWGMQARVCLEPQGWDLSPKEPTPPLPGWALAGSTFFPHHIPDPCPAHMHMLFPVSRALACGSLPPMHS

SEQ ID NO: 746439 - protein, 126 aa, Homo sapiens
MKAVWAFILQTGTNSSMLFVLPVQPCWEGLGELPTRRDSCCFGKLRKNRGLTLSSHFTSGEMRRERRGVWVTPWVWGPGKGLYGGGSWEGTVSGSTPVGWGGGAPLYHRTSPLRGPSYVWVLWVGD

SEQ ID NO: 746440 - protein, 67 aa, Homo sapiens [sequence omitted]

SEQ ID NO: 746441 - protein, 166 aa, Homo sapiens
MSPNGSIPPIHVPPGYISQVIEDSTGVRRVVVTPQSPECYPPSYPSAMSPTHHLPPYLTHHPHFIHNSHTAYYPPVTGPGDMPPQFFPQHHLPHTIYGEQKLYHFMECQATSPEKTSTASLLHKKLKDRQIDRQNRLNRPPSSIYKSSCTTVYNGYGKGHSGGSGG

SEQ ID NO: 746442 - protein, 168 aa, Homo sapiens
AAAAGLGEPAAGSSGGGAGRGGKERATRCVGQRSSGQSVTPRGASAGDRAGGRNLRPEAARRGRADRLVPAAGLGPAGVGRACHSRQKVGPRAVPANFPRGPGPGVPWEPEDPGPPSRETGLRRPAAPLAGRLPGVRGRSWSFWNLSSHPAIPDEGKQWHFIQTVPFA

SEQ ID NO: 746443 - protein, 319 aa, Homo sapiens
IRNPVSSRSDPVTLNLLPKLPKPYITREDQYSKPPHKKLKDRQIDRQNRLNSPPSSIYKSSCTTVYNGYGKGHSGGSGGGGSGSGPGIKKTERRARSSPKSNDSDLQEYELEVKRVQDILSGIEKPQVSNIQARAVVLSWAPPVGLSCGPHSGLSFPYSYEVALSDKGRDGKYKIIYYSGEELECNLKDLRPATDYHVRVYAMYNSVKGSCSEPVSFTTHSCAPECPFPPKLAHRSKSSLTLQWKAPIDNGSKITNYLLEWDEGKRNSGFRQCFFGSQKHCKLTKLCPAMGYTFRLAARNDIGTRYDVSLSSCPSAFGW

SEQ ID NO: 746444 - protein, 363 aa, Homo sapiens
RLYLEYPLLRTRTCGLSCGPHSGLSFPYSYEVALSDKGRDGKYKIIYYSGEELECNLKDLRPATDYHVRVYAMYNSVKGSCSEPVSFTTHSCAPECPFPPKLAHRSKSSLTLQWKAPIDNGSKITNYLLEWDEGKRNSGFRQCFFGSQKHCKLTKLCPAMGYTFRLAARNDIGTSGYSQEVVCYTLGNIPQMPSAPRLVRAGITWVTLQWSKPEGCSPEEVITYTLEIQEDENDNLFHPKYTGEDLTCTVKNLKRSTQYKFRLTASNTEGKSCPSEVLVCTTSPDRPGPPTRPLVKGPVTSHGFSVKWDPPKDNGGSEILKYLLEITDGNSEASQWEVAYSGSATEYTFTHLKPGTLYNSEHA

SEQ ID NO: 746445 - protein, 254 aa, Homo sapiens
IRNPVSSRSDPVTLNLLPKLPKPYITREDQYSKPPHKKLKDRQIDRQNRLNSPPSSIYKSSCTTVYNGYGKGQVVEVAEAAAVVVPELRKQSDEQEAAQSRMIQTCKVIEDSTGVRRVVVTPQSPECYPPSYPSAMSPTHHLPPYLTHHPHFIHNSHTAYYPPVTGPGDMPPQFFPQHHLPHTIYGEQKLYHFMECQATSPEKTSTASLLHKKLKDRQIDRQNRLNRPPSSIYKSSCTTVYNGYGKGHSGGSGG

SEQ ID NO: 746446 - protein, 493 aa, Homo sapiens
IRNPVSSRSDPVTLNLLPKLPKPYITREDQYSKPPHKKLKDRQIDRQNRLNSPPSSIYKSSCTTVYNGYGKGHSGGSGGGGSGSGPGIKKTERRARSSPKSNDSDLQEYELEVKRVQDILSGIEKPQVSNIQARAVVLSWAPPVGLSCGPHSGLSFPYSYEVALSDKGRDGKYKIIYYSGEELECNLKDLRPATDYHVRVYAMYNSVKGSCSEPVSFTTHSCAPECPFPPKLAHRSKSSLTLQWKAPIDNGSKITNYLLEWDEGKRNSGFRQCFFGSQKHCKLTKLCPAMGYTFRLAARNDIGTSGYSQEVVCYTLGNIPQMPSAPRLVRAGITWVTLQWSKPEGCSPEEVITYTLEIQEDENDNLFHPKYTGEDLTCTVKNLKRSTQYTFRLTASNTEGKSCPSEVLVCTTSPDRPGPPTRPLVKGPVTSHGFSVKWDPPKDNGGSEILKYLLEITDGNSEASQWEVAYSGSATEYTFTHLKPGTLYNSEHA

SEQ ID NO: 746447 - protein, 272 aa, Homo sapiens
IRNPVSSRSDPVTLNLLPKLPKPYITREDQYSKPPHKKLKDRQIDRQNRLNSPPSSIYKSSCTTVYNGYGKGHSGGSGGGGSGSGPGIKKTERRARSSPKSNDSDLQEYELEVKRVQDILSGIEKPQVSNIQARAVVLSWAPPVGLSCGPHSGLSFPYSYEVALSDKGRDGKYKIIYYSGEELECNLKDLRPATDYHVRVYAMYNSVKGSCSEPVSFTTHSCAPECPFPPKLAHRSKSSLTLQWKAPIDNGSKITNYLLEWDEVSLFSYSPI

SEQ ID NO: 746448 - protein, 258 aa, Homo sapiens
SGVSSSKLLRLDGGSQLREFSMNSTSQVMMTDQIPLELPPLLNGEVAMMPHLVNGDAAQQVILVQVNPGETFTIRAEDGTLQCIQGPAEVPMMSPNGSIPPIHVPPGYISQVIEDSTGVRRVVVTPQSPECYPPSYPSAMSPTHHLPPYLTHHPHFIHNSHTAYYPPVTGPGDMPPQFFPQHHLPHTIYGEQKLYHFMECQATSPEKTSTASLLHKKLKDRQIDRQNRLNRPPSSIYKSSCTTVYNGYGKGHSGGSGG

SEQ ID NO: 746449 - protein, 142 aa, Homo sapiens
FRMNGDMPHVPITTLAGIASLTDLLNQLPLPSPLPATTTKSLLFNARTAEEVNCLLACRDDNLVSQLVHSLNQVSTDHIELKDNLGSDDPEGDIPVLLQAVLARSPNVFREKSMQNRYVQSGMMMSQYKLSQNSMHSSPASS

SEQ ID NO: 746450 - protein, 81 aa, Homo sapiens
AIQRPKGAHCDLALGDPGMISLPPGTGPNPRGPGETLCPAGPMGDSSLYVRVRGPALFLPRTWPGEGGTRKIAVRDAQPGS

SEQ ID NO: 746451 - protein, 1359 aa, Homo sapiens
MVGEGPYLISDLDQRGRRRSFAERYDPSLKTMIPVRPCARLAPNPVDDAGLLSFATFSWLTPVMVKGYRQRLTVDTLPPLSTYDSSDTNAKRFRVLWDEEVARVGPEKASLSHVVWKFQRTRVLMDIVANILCIIMAAIGPVILIHQILQQTERTSGKVWVGIGLCIALFATEFTKVFFWALAWAINYRTAIRLKVALSTLVFENLVSFKTLTHISVGEVLNILSSDSYSLFEAALFCPLPATIPILMVFCAAYAFFILGPTALIGISVYVIFIPVQMFMAKLNSAFRRSAILVTDKRVQTMNEFLTCIRLIKMYAWEKSFTNTIQDIRRRERKLLEKAGFVQSGNSALAPIVSTIAIVLTLSCHILLRRKLTAPVAFSVIAMFNVMKFSIAILPFSIKAMAEANVSLRRMKKILIDKSPPSYITQPEDPDTVLLLANATLTWEHEASRKSTPKKLQNQKRHLCKKQRSEAYSERSPPAKGATGPEEQSDSLKSVLHSISFVVRKGKILGICGNVGSGKSSLLAALLGQMQLQKGVVAVNGTLAYVSQQAWIFHGNVRENILFGEKYDHQRYQHTVRVCGLQKDLSNLPYGDLTEIGERGLNLSGGQRQRISLARAVYSDRQLYLLDDPLSAVDAHVGKHVFEECIKKTLRGKTVVLVTHQLQFLESCDEVILLEDGEICEKGTHKELMEERGRYAKLIHNLRGLQFKDPEHLYNAAMVEAFKESPAEREEDAGIIVLAPGNEKDEGKESETGSEFVDTKVPEHQLIQTESPQEGTVTWKTYHTYIKASGGYLLSLFTVFLFLLMIGSAAFSNWWLGLWLDKGSRMTCGPQGNRTMCEVGAVLADIGQHVYQWVYTASMVFMLVFGVTKGFVFTKTTLMASSSLHDTVFDKILKSPMSFFDTTPTGRLMNRFSKDMDELDVRLPFHAENFLQQFFMVVFILVILAAVFPAVLLVVASLAVGFFILLRIFHRGVQELKKVENVSRSPWFTHITSSMQGLGIIHAYGKKESCITYHLLYFNCALRWFALRMDVLMNILTFTVALLVTLSFSSISTSSKGLSLSYIIQLSGLLQVCVRTGTETQAKFTSVELLREYISTCVPECTHPLKVGTCPKDWPSCGEITFRDYQMRYRDNTPLVLDSLNLNIQSGQTVGIVGRTGSGKSSLGMALFRLVEPASGTIFIDEVDICILSLEDLRTKLTVIPQDPVLFVGTVRYNLDPFESHTDEMLWQVLERTFMRDTIMKLPEKLQAEVTENGENFSVGERQLLCVARALLRNSKIILLDEATASMDSKTDTLVQNTIKDAFKGCTVLTIAHRLNTVLNCDHVLVMENGKVIEFDKPEVLAEKPDSAFAMLLAAEVRL

SEQ ID NO: 746452 - protein, 1359 aa, Homo sapiens; identical to SEQ ID NO: 746451

SEQ ID NO: 746453 - protein, 233 aa, Homo sapiens
MRYRDNTPLVLDSLNLNIQSGQTVGIVGRTGSGKSSLGMALFRLVEPASGTIFIDEVDICILSLEDLRTKLTVIPQDPVLFVGTVRYNLDPFESHTDEMLWQVLERTFMRDTIMKLPEKLQAEVTENGENFSVGERQLLCVARALLRNSKIILLDEATASMDSKTDTLVQNTIKDAFKGCTVLTIAHRLNTVLNCDHVLVMENGKVIEFDKPEVLAEKPDSAFAMLLAAEVRL

SEQ ID NO: 746454 - protein, 60 aa, Homo sapiens
HSFSSVKTTHYCLTGCPSDPGLDSVLALSGFTCPHAPPSRPWFMYPGLQDPLPRQTLALF

SEQ ID NO: 746455 - protein, 506 aa, Homo sapiens
ECVTQPFPRDQAERVALRSHSSRTSMASAASVTSLADEVNCPICQGTLREPVTIDCGHNFCRACLTRYCEIPGPDLEESPTCPLCKEPFRPGSFRPNWQLANVVENIERLQLVSTLGLGEEDVCQEHGGKIYFFCEDDEMQLCVVCREAGEHATHTMRFLEDAAAPYREQIHKCLKCLRKEREEIQEIQSRENKRMQVLLTQVSTKRQQVISEFAHLRKFLEEQQSILLAQLESQDGDILRQRDEFDLLVAGEICRFSALIEELEEKNERPARELLTDIRSTLIRCETRKCRKPVAVSPELGQRIRDFPQQALPLQREMKMFLEKLCFELDYEPAHISLDPQTSHPKLLLSEDHQRAQFSSKWQNSPDNPQRFDRATCVLAHTGITGGRHTWVVSIDLAHGASCTVGVVSEDVQRKGELRLRPEEGVWAVRLAWGFVSALGSFPTRLTLKEQPRQVRVSLDYEVGWVTFTNAVTREPIYTFTASFTRKVIPFFGLWGRGSSFSLSS

SEQ ID NO: 746456 - protein, 780 aa, Homo sapiens
MQKSSALKEHSWGAWSEMELEKIQVELDLKYQPPEGATGAWSEEDFGAPIQDSFELIIPNVGFQELEPGEAQLERRAVALGRRLARSLGQQDDEENELELELEQDLDDEPDVELSGVMFSPLKSRARALAHGDPFQVSRAQDFQVGVTVLEAQKLVGVNINPYVAVQVGGQRRVTATQRGTSCPFYNEYFLFEFHDTRLRLQDLLLEITVSGVGVTSVLQRRGDEKAAGLTPPSPKAFHSQTLPFMATRIGTFRMDLGIILDQPGMESSPYGDSARTRALEIDPAVTPHGPLYTHFGEGHLWRRLNSWHFRPSLLSQRSPGHCPHSDSLTATLCVPPVAPYPWLAPSPLDGQFYQRWVPLHDPRDTRAGTKGFIKVTLSVRARGDLPPPMLPPAPGHCSDIEKGAGMRWGGGHGSGGGRGARIRGGAEIPVSPPPLGAPSPRNLLLPRGVPAERPWARLRVRLYRAEGLPALRLGLLGSLVRALHDQRVLVEPYVRVSFLGQEGETSVSAEAAAPEWNEQLSFVELFPPLTRSLRLQLRDDAPLVDAALATHVPDLRRISHPGRAAGFNPTFGPAWVPLYGSPPGAGLRDSLQGLNEGVGQGIWFRGRLLLAVSMQVLEGRAEPEPPQAQQGSTLSRLTRKKKKKARRDQTPKAVPQHLDASPGAEGPEIPRAMEVEVEELLPLPENVLAPCEDFLLFGVLFEATMIDPTVASQPISFEISIGRAGRLEEQLGRGSRAGEGTEGAAVEAQPLLGARPEEEKEEEELGTHAQRPEPMDGSG

SEQ ID NO: 746457 - protein, 736 aa, Homo sapiens
MQKSSALKEHSWGAWSEMELEKIQVELDLKYQPPEGATGAWSEEDFGAPIQDSFELIIPNVGFQELEPGEAQLERRAVALGRRLARSLGQQDDEENELELELEQDLDDEPDVELSGVMFSPLKSRARALAHGDPFQVSRAQDFQVGVTVLEAQKLVGVNINPYVAVQVGGQRRVTATQRGTSCPFYNEYFLFEFHDTRLRLQDLLLEITVSGVGVTSVLQRRGDEKAAGLTPPSPKAFHSQTLPFMATRIGTFRMDLGIILDQPGMESSPYGDSARTRALEIDPAVTPHGPLYTHFGEGHLWRRLNSWHFRPSLLSQRSPGHCPHSDSLTATLCVPPVAPYPWLAPSPLDGQFYQRWVPLHDPRDTRAGTKGFIKVTLSVRARGDLPPPMLPPAPGHCSDIEKGAGMRWGGGHGSGGGRGARIRGGAEIPVSPPPLGAPSPRNLLLPRGVPAERPWARLRVRLYRAEGLPALRLGLLGSLVRALHDQRVLVEPYVRVSFLGQEGETSVSAEAAAPEWNEQLSFVELFPPLTRSLRLQLRDDAPLVDAALATHVPDLRRISHPGRAAGFNPTFGPAWVPLYGSPPGAGLRDSLQGLNEGVGQGIWFRGRLLLAVSMQVLEGRAEPEPPQAQQGSTLSRLTRKKKKKARRDQTPKAVPQHLDASPGAEGPEIPRAMEVEVEELLPLPENVLAPCEDFLLFGVLFEATMIDPTVASQPISFEISIGVWPSRTPECHFRP

SEQ ID NO: 746458 - protein, 876 aa, Homo sapiens
QRKCQCHWDHGSDGNACNDYTGLTGTHDRQVKLTFRGFTQKTRKIHCGPEADIGELFRWPHYGAPLAGECLSVQVVNCSRVFSLRPLGTLVISLQQLQNAGHLVLREALVDENLQVSPIQVELDLKYQPPEGATGAWSEEDFGAPIQDSFELIIPNVGFQELEPGEAQLERRAVALGRRLARSLGQQDDEENELELELEQDLDDEPDVELSGVMFSPLKSRARALAHGDPFQVSRAQDFQVGVTVLEAQKLVGVNINPYVAVQVGGQRRVTATQRGTSCPFYNEYFLFEFHDTRLRLQDLLLEITVSGVGVTSVLQRRGDEKAAGLTPPSPKAFHSQTLPFMATRIGTFRMDLGIILDQPGMESSPYGDSARTRALEIDPAVTPHGPLYTHFGEGHLWRRLNSWHFRPSLLSQEALAIVRHSDSLTATLCVPPVAPYPWLAPSPLDGQFYQRWVPLHDPRDTRAGTKGFIKVTLSVRARGDLPPPMLPPAPGHCSDIEKWAGMRWGGGHGSGGGRGARIRGGAEIPVSPPPLGAPSPRNLLLPRGVPAERPWARLRVRLYRAEGLPALRLGLLGSLVRALHDQRVLVEPYVRVSFLGQEGETSVSAEAAAPEWNEQLSFVELFPPLTRSLRLQLRDDAPLVDAALATHVPDLRRISHPGRAAGFNPTFGPAWVPLYGSPPGAGLRDSLQGLNEGVGQGIWFRGRLLLAVSMQVLEGRAEPEPPQAQQGSTLSRLTRKKKKKARRDQTPKAVPQHLDASPGAEGPEIPRAMEVEVEELLPLPENVLAPCEDFLLFGVLFEATMIDPTVASQPISFEISIGRAGRLEEQLGRGSRAGEGTEGAAVEAQPLLGARPEEEKEEEELGTHAQRPEPMDGSG

SEQ ID NO: 746459 - protein, 729 aa, Homo sapiens
MGDGFQACPLRVFPIRPGEAQLERRAVALGRRLARSLGQQDDEENELELELEQDLDDEPDVELSGVMFSPLKSRARALAHGDPFQVSRAQDFQVGVTVLEAQKLVGVNINPYVAVQVGGQRRVTATQRGTSCPFYNEYFLFEFHDTRLRLQDLLLEITVSGVGVTSVLQRRGDEKAAGLTPPSPKAFHSQTLPFMATRIGTFRMDLGIILDQPGMESSPYGDSARTRALEIDPAVTPHGPLYTHFGEGHLWRRLNSWHFRPSLLAREALAIVRHSDSLTATLCVPPVAPYPWLAPSPLDGQFYQRWVPLHDPRDTRAGTKGFIKVTLSVRARGDLPPPMLPPAPGHCSDIEKGAGMRWGGGHGSGGGRGARIRGGAEIPVSPPPLGAPSPRNLLLPRGVPAERPWARLRVRLYRAEGLPALRLGLLGSLVRALHDQRVLVEPYVRVSFLGQEGETSVSAEAAAPEWNEQLSFVELFPPLTRSLRLQLRDDAPLVDAALATHVPDLRRISHPGRAAGFNPTFGPAWVPLYGSPPGAGLRDSLQGLNEGVGQGIWFRGRLLLAVSMQVLEGRAEPEPPQAQQGSTLSRLTRKKKKKARRDQTPKAVPQHLDASPGAEGPEIPRAMEVEVEELLPLPENVLAPCEDFLLFGVLFEATMIDPTVASQPISFEISIGRAGRLEEQLGRGSRAGEGTEGAAVEAQPLLGARPEEEKEEEELGTHAQRPEPMDGSG

SEQ ID NO: 746460 - protein, 225 aa, Homo sapiens
MEAARHDLKEPGFNPTFGPAWVPLYGSPPGAGLRDSLQGLNEGVGQGIWFRGRLLLAVSMQVLEGRAEPEPPQAQQGSTLSRLTRKKKKKARRDQTPKAVPQHLDASPGAEGPEIPRAMEVEVEELLPLPENVLAPCEDFLLFGVLFEATMIDPTVASQPISFEISIGRAGRLEEQLGRGSRAGEGTEGAAVEAQPLLGARPEEEKEEEELGTHAQRPEPMDGSG

SEQ ID NO: 746461 - protein, 84 aa, Homo sapiens
RLLLAVSMQVLEGRAEPEPPQAQQGSTLSRLTRKKKKKARRDQTPKAVPQHLDASPGAEGPEIPRAMEVEVEELLPLPEVGAGG

SEQ ID NO: 746462 - protein, 102 aa, Homo sapiens
LRRSLCRLGWSGVAQSWLTATSASQVAAILLPQPPGVAGTTDMCHHAWLIFCVFLVEMGFHHVGQAGLELLTSGDLPISASQSAGITGVSHRAQLVLTDNSS

SEQ ID NO: 746463 - protein, 163 aa, Homo sapiens
QALLLTVQSPDVLFLRTQVVTPQEVPIAPQAPHVPPPHSPGRVLLTPHQSACALLRSSLKARSLSPLACGKWSSRTEAPQSPEAPPGRLFPGCNTGSRLKELCFVGAIWEFPPSMKCAGALRRGGATLGSGDIKSGTGSGGSSPLALFSFRCGGSRISRGCGR

SEQ ID NO: 746464 - protein, 448 aa, Homo sapiens
MDHQDPYSVQATAAIAAAITFLILFTIFGNALVILAVLTSRSLRAPQNLFLVSLAAADILVATLIIPFSLANELLGYWYFRRTWCEVYLALDVLFCTSSIVHLCAISLDRYWAVSRALEYNSKRTPRRIKCIILTVWLIAAVISLPPLIYKGDQGPQPRGRPQCKLNQEAWYILASSIGSFFAPCLIMILVYLRIYLIAKRSNRRGPRAKGGPGQGESKQPRPDHGGALASAKLPALASVASAREVNGHSKSTGEKEEGETPEDTGTRALPPSWAALPNSGQGQKEGVCGASPEDEAKEEEEEEEEECEPQAVPVSPASACSPPLQQPQGSRVLATLRGQVLLGRGVGAIGGQWWRRRAQLTREKRFTFVLAVVIGVFVLCWFPFFFSYSLGAICPKHCKVPHGLFQFFFWIGYCNSSLNPVIYTIFNQDFRRAFRRILCRPWTQTAW

SEQ ID NO: 746465 - protein, 341 aa, Homo sapiens
LRSRPWEWSGGSVVMWLDRRGWLRVLGHWRYDLRRPSFTRTWSGDKGPMAETVSTQVGTEGGLRASHQQNGDAGGDAKVELSPGPPKPAGREVEPAPVGGEHPSAAAPGPGKHKKRRGATRERVVPPPKKRRTGVSFGDEHFAETSYYFEGGLRKVRPYYFDFRTYCKGRWVGHSLLHVFSTEFRAQPLAYYEAAVRAGRLQLNEKPVQDLNIVLKDNDFLRNTVHRHEPPVTAEPIRLLAENEDVVVVDKPSSIPVHPCGRFRHNTVIFILGKEHQLKELHPLHRLDRLTSGVLMFAKTAAVSERIHEQVRDRQVSQAFVSYRPLLGLTNALCQKGIMEF

SEQ ID NO: 746466 - protein, 219 aa, Homo sapiens
LRSRPWEWSGGSVVMWLDRRGWLRVLGHWRYDLRRPSFTRTWSGDKGPMAETVSTQVGTEGGLRASHQQNGDAGGDAKVELSPGPPKPAGREVEPAPVGGEHPSAAAPGPGKHKKRRGATRERVVPPPKKRRTGVSFGDEHFAETSYYFEGGLRKVRPYYFDFRTYCKGRWVGHSLLHVFSTEFRAQPLAYYEAAVRAGRLQLNEKPVQDLNIVLKVES

SEQ ID NO: 746467 - protein, 485 aa, Homo sapiens
LRSRPWEWSGGSVVMWLDRRGWLRVLGHWRYDLRRPSFTRTWSGDKGPMAETVSTQVGTEGGLRASHQQNGDAGGDAKVELSPGPPKPAGREVEPAPVGGEHPSAAAPGPGKHKKRRGATRERVVPPPKKRRTGVSFGDEHFAETSYYFEGGLRKVRPYYFDFRTYCKGRWVGHSLLHVFSTEFRAQPLAYYEAAVRAGRLQLNEKPVQDLNIVLKDNDFLRNTVHRHEPPVTAEPIRLLAENEDVVVVDKPSSIPVHPCGRFRHNTVIFILGKEHQLKELHPLHRLDRLTSGVLMFAKTAAVSERIHEQVRDRQLEKEYVCRVEGEFPTEEVTCKEPILVVSYKVGVCRVDPRGKPCETVFQRLSYNGQSSVVRCRPLTGRTHQIRVHLQFLGHPILNDPIYNSVAWGPSRGRGGYIPKTNEELLRDLVAEHQAKQSLDVLDLCEGDLSPGLTDSTAPSSELGKDDLEELAAAAQKMEGLLLGL

SEQ ID NO: 746468 - protein, 559 aa, Homo sapiens
LRSRPWEWSGGSVVMWLDRRGWLRVLGHWRYDLRRPSFTRTWSGDKGPMAETVSTQVGTEGGLRASHQQNGDAGGDAKVELSPGPPKPAGREVEPAPVGGEHPSAAAPGPGKHKKRRGATRERVVPPPKKRRTGVSFGDEHFAETSYYFEGGLRKVRPYYFDFRTYCKGRWVGHSLLHVFSTEFRAQPLAYYEAAVRAGRLQLNEKPVQDLNIVLKDNDFLRNTVHRHEPPVTAEPIRLLAENEDVVVVDKPSSIPVHPCGRFRHNTVIFILGKEHQLKELHPLHRLDRLTSGVLMFAKTAAVSERIHEQVRDRQLEKEYVCRVEGEFPTEEVTCKEPILVVSYKVGVCRVDPRGKPCETVFQRLSYNGQSSVVRCRPLTGRTHQIRVHLQFLGHPILNDPIYNSVAWGPSRGRGGYIPKTNEELLRDLVAEHQAKQSLDVLDLCEGDLSPGLTDSTAPSSELGKDDLEELAAAAQKMEEVAEAAPQELDTIALASEKAVETDVMNQETDPLCAECRLVRQDPLPQDLVMFLHALRYKGPGFEYFSPMPAWAQDDWQKD

SEQ ID NO: 746469 - protein, 559 aa, Homo sapiens; identical to SEQ ID NO: 746468

SEQ ID NO: 746470 - protein, 67 aa, Homo sapiens
RYHQFHCQRTLNPSRAWQGAGCPPFGLSITRAENPLLSPLLFLQAFRYAASPRIAESIQSYPNSLGE

SEQ ID NO: 746471 - protein, 67 aa, Homo sapiens
TEKDRRLMPGEILDRVTHVGDWRPPEESSRSVFRMFLYREERGRPVTTAPVPHGLAPVDINYLYFHA

SEQ ID NO: 746472 - protein, 127 aa, Homo sapiens
MPSCDPGPGPACLPTKTFRSYLPRCHRTYSCVHCRAHLAKHDELISKSFQGSHGRAYLFNSVVNVGCGPAEQRLLLTGLHSVADIFCESCKTTLGWKYEQAFETSQKYKEGKYIIEMSHMVKDNGWD

SEQ ID NO: 746473 - protein, 127 aa, Homo sapiens; identical to SEQ ID NO: 746472

SEQ ID NO: 746474 - protein, 228 aa, Homo sapiens
MAASVPVGFSLWKMVEAASAPGGRNTDSLALAPEAWIGCQVTSISIWFSSGGALAGQPPNTSPALKHGSSQPAPLLHLRPSLRGLHGASPSSPPGIVLQPVMPSCDPGPGPACLPTKTFRSYLPRCHRTYSCVHCRAHLAKHDELISKSFQGSHGRAYLFNSVVNVGCGPAEQRLLLTGLHSVADIFCESCKTTLGWKYEQAFETSQKYKEGKYIIEMSHMVKDNGWD

SEQ ID NO: 746475 - protein, 127 aa, Homo sapiens; identical to SEQ ID NO: 746472

SEQ ID NO: 746476 - protein, 156 aa, Homo sapiens
AAPALEPLSRLRGRPGVCPLLAESRCRRFKGRGKDEEALCGLRQPLCHVVLPIPPPRLPRLPPPPRARQAPSLLRSSVHPRFVWLTQFSSPLPPMQKGDSVATRPQPLFLVNLKWGFPEWVLAPQGTPHRPPGCRRETQAVLSVLWSAPFKSSEVV

SEQ ID NO: 746477 - protein, 309 aa, Homo sapiens
EAEETNGPDRDEERNRKREAGRIGNLGASDLHTGQGHSAVPRGHPSHPRHPDIWNFGCQESSLMQAAWLLGALVVPQLLGFGHGARGAEREWEGGWGGAQEEEREREALMLKHLQEALGLPAGRGDENPAGTVEGKEDWEMEEDQGEEEEEEATPTPSSGPSPSPTPEDIVTYILGRLAGLDAGLHQLHVRLHALDTRVVELTQGLRQLRNAAGDTRDAVQALQEAQGRAEREHGRLEGCLKGLRLGHKCFLLSRDFEGAQPSASPHPLSPDQPNGGTLENCVAQASDDGSWWDHDCQRRLYYVCEFPF

SEQ ID NO: 746478 - protein, 386 aa, Homo sapiens
EAEETNGPDRDEERNRKREAGRIGNLGASDLHTGQGHSAVPRGHPSHPRHPDIWNFGCQESSLMQAAWLLGALVVPQLLGFGHGARGAEREWEGGWGGAQEEEREREALMLKHLQEALGLPAGRGDENPAGTVEGKEDWEMEEDQGEEEEEEATPTPSSGPSPSPTPEDIVTYILGRLAGLDAGLHQLHVRLHALDTRVVELTQGLRQLRNAAGDTRDAVQALQEAQGRAEREHGRLEGCLKGLRLGHKCFLLSRDFEAQAAAQARCTARGGSLAQPADRQQMEALTRYLRAALAPYNWPVWLGVHDRRAEGLYLFENGQRVSFFAWHRSPRPELGAQPSASPHPLSPDQPNGGTLENCVAQASDDGSWWDHDCQRRLYYVCEFPF

SEQ ID NO: 746479 - protein, 302 aa, Homo sapiens
EAEETNGPDRDEERNRKREAGRIGNLGASDLHTGQGHSAVPRGHPSHPRHPDIWNFGCQESSLMQAAWLLGALVVPQLLGFGHGARGAEREWEGGWGGAQEEEREREALMLKHLQEALGLPAGRGDENPAGTVEGKEDWEMEEDQGEEEEEEATPTPSSGPSPSPTPEDIVTYILGRLAGLDAGLHQLHVRLHALDTRVVELTQGLRQLRNAAGDTRDAVQALQEAQGRAEREHGRLEGCLKGLRLGHKCFLLSRDFEAQAAAQARCTARGGSLAQPADRQQMEALTRYCQRRLYYVCEFPF

SEQ ID NO: 746480 - protein, 386 aa, Homo sapiens; identical to SEQ ID NO: 746478

SEQ ID NO: 746481 - protein, 386 aa, Homo sapiens; identical to SEQ ID NO: 746478

SEQ ID NO: 746482 - protein, 237 aa, Homo sapiens
EAEETNGPDRDEERNRKREAGRIGNLGASDLHTGQGHSAVPRGHPSHPRHPDIWNFGCQESSLMQAAGPLAGLDAGLHQLHVRLHALDTRVVELTQGLRQLRNAAGDTRDAVQALQEAQGRAEREHGRLEGCLKGLRLGHKCFLLSRDFEAQAAAQARCTARGGSLAQPADRQQMEALTRYLRAALAPYNWPVWLGVHDRRAEGLYLFGRPAQRLAASAQPGPAQRWHARELRGAGL

SEQ ID NO: 746483 - protein, 463 aa, Homo sapiens [sequence omitted]

SEQ ID NO: 746484 - protein, 104 aa, Homo sapiens; identical to SEQ ID NO: 746438

SEQ ID NO: 746485 - protein, 104 aa, Homo sapiens; identical to SEQ ID NO: 746438

SEQ ID NO: 746486 - protein, 104 aa, Homo sapiens; identical to SEQ ID NO: 746438

SEQ ID NO: 746487 - protein, 104 aa, Homo sapiens; identical to SEQ ID NO: 746438

SEQ ID NO: 746488 - protein, 1134 aa, Homo sapiens
NSQKDVRPKASGGLFEGLGLASAPWGLTWLDIVYRPGRRGGPVRVAPPGAAPGTSVLEEARVAPVAKKTMNKSENLLFAGSSLASQVHAAAVNGDKGALQRLIVGNSALKDKEDQFGRTPLMYCVLADRLDCADALLKAGADVNKTDHSQRTALHLAAQKGNYRFMKLLLTRRANWMQKDLEEMTPLHLTTRHRSPKCLALLLKFMAPGEVDTQDKNKQTALHWSAYYNNPEHVKLLIKHDSNIGIPDVEGKIPLHWAANHKDPSAVHTVRCILDAAPTESLLNWQDYEGRTPLHFAVADGNVTVVDVLTSYESCNITSYDNLFRTPLHWAALLGHAQIVHLLLERNKSGTIPSDSQGATPLHYAAQSNFAETVKVFLKHPSVKDDSDLEGRTSFMWAAGKGSDDVLRTMLSLKSDIDINMADKYGGTALHAAALSGHVSTVKLLLENNAQVDATDVMKHTPLFRACEMGHKDVIQTLIKGGARVDLVDQDGHSLLHWAALGGNADVCQILIENKINPNVQDYAGRTPLQCAAYGGYINCMAVLMENNADPNIQDKEGRTALHWSCNNGYLDAIKLLLDFAAFPNQMENNEERYTPLDYALLGERHEVIQFMLEHGALSIAAIQDIAAFKIQAVYKGYKVRKAFRDRKNLLMKHEQLRKDAAAKKREEENKRKEAEQQKGRRSPDSCRPQALPCLPSTQDVPSRQSRAPSKQPPAGNVAQGPEPRDSRGSPGGSLGGALQKEQHVSSDLQGTNSRRPNETAREHSKGQSACVHFRPNEGSDGSRHPGVPSVEKSRGETAGDERCAKGKGFVKQPSCIRVAGPDEKGEDSRRAAASLPPHDSHWKPSRRHDTEPKAKCAPQKRRTQELRGGRCSPAGSSRPGSARGEAVHAGQNPPHHRTPRNKVTQAKLTGGLYSHLPQSTEELRSGARRLETSTLSEDFQVSKETDPAPGPLSGQSVNIDLLPVELRLQIIQRERRRKELFRKKNKAAAVIQRAWRSYQLRKHLSHLRHMKQLGAGDVDRWRQESTALLLQVWRKELELKFPQTTAVSKAPKSPSKGTSGTKSTKHSVLKQIYGCSHEGKIHHPTRSVKASSVLRLNSVSNLQCIHLLENSGRSKNFSYNLQSATQPKNKTKP

SEQ ID NO: 746489 - protein, 895 aa, Homo sapiens
MNKSENLLFAGSSLASQVHAAAVNGDKGALQRLIVGNSALKDKEDQFGRTPLMYCVLADRLDCADALLKAGADVNKTDHSQRTALHLAAQKGNYRFMKLLLTRRANWMQKDLEEMTPLHLTTRHRSPKCLALLLKFMAPGEVDTQDKNKQTALHWSAYYNNPEHVKLLIKHDSNIGIPDVEGKIPLHWAANHKDPSAVHTVRCILDAAPTESLLNWQDYEGRTPLHFAVADGNVTVVDVLTSYESCNITSYDNLFRTPLHWAALLGHAQIVHLLLERNKSGTIPSDSQGATPLHYAAQSNFAETVKVFLKHPSVKDDSDLEGRTSFMWAAGKGSDDVLRTMLSLKSDIDINMADKYGGTALHAAALSGHVSTVKLLLENNAQVDATDVMKHTPLFRACEMGHKDVIQTLIKGGARVDLVDQDGHSLLHWAALGGNADVCQILIENKINPNVQDYAGRTPLQCAAYGGYINCMAVLMENNADPNIQDKEGRTALHWSCNNGYLDAIKLLLDFAAFPNQMENNEERYTPLDYALLGERHEVIQFMLEHGALSIAAIQDIAAFKIQAVYKGYKVRKAFRDRKNLLMKHEQLRKDAAAKKREEENKRKEAEQQKGRRSPDSCRPQALPCLPSTQDVPSRQSRAPSKQPPAGNVAQGPEPRDSRGSPGGSLGGALQKEQHVSSDLQGTNSRRPNETAREHSKGQSACVHFRPNEGSDGSRHPGVPSVEKSRELRLQIIQRERRRKELFRKKNKAAAVIQRAWRSYQLRKHLSHLRHMKQLGAGDVDRWRQESTALLLQVWRKELELKFPQTTAVSKAPKSPSKGTSGTKSTKHSVLKQIYGCSHEGKIHHPTRSVKASSVLRLNSVSNLQCIHLLENSGRSKNFSYNLQSATQPKNKTKP

SEQ ID NO: 746490 - protein, 170 aa, Homo sapiens
NSQKDVRPKASGGLFEGLGLASAPWGLTWLDIVYRPGRRGGPVRVAPPGAAPGTSVLEEARVAPVAKKTMNKSENLLFAGSSLASQVHAAAVNGDKGALQRLIVGNSALKDKEDQFGRTPLMYCVLADRLDCADALLKAGADVNKTDHSQRTALHLAAQKALRTISTGRI

SEQ ID NO: 746491 - protein, 826 aa, Homo sapiens
MNKSENLLFAGSSLASQVHAAAVNGDKGALQRLIVGNSALKDKEDQFGRTPLMYCVLADRLDCADALLKAGADVNKTDHSQRTALHLAAQKGNYRFMKLLLTRRANWMQKDLEEMTPLHLTTRHRSPKCLALLLKFMAPGEVDTQDKNKQTALHWSAYYNNPEHVKLLIKHDSNIGIPDVEGKIPLHWAANHKDPSAVHTVRCILDAAPTESLLNWQDYEGRTPLHFAVADGNVTVVDVLTSYESCNITSYDNLFRTPLHWAALLGHAQIVHLLLERNKSGTIPSDSQGATPLHYAAQSNFAETVKVFLKHPSVKDDSDLEGRTSFMWAAGKGSDDVLRTMLSLKSDIDINMADKYGGTALHAAALSGHVSTVKLLLENNAQVDATDVMKHTPLFRACEMGHKDVIQTLIKGGARVDLVDQDGHSLLHWAALGGNADVCQILIENKINPNVQDYAGRTPLQCAAYGGYINCMAVLMENNADPNIQDKEGRTALHWSCNNGYLDAIKLLLDFAAFPNQMENNEERYTPLDYALLGERHEVIQFMLEHGALSIAAIQDIAAFKIQAVYKGYKVRKAFRDRKNLLMKHEQLRKDAAAKKREEENKRKEAEQQKGRRSPDSCRPQALPCLPSTQDVPSRQSRAPSKQPPAGNVAQGPEPRDSRGSPGGSLGGALQKEQHVSSDLQGTNSRRPNETAREHSKGQSACVHFRPNEGSDGSRHPGVPSVEKSRELRLQIIQRERRRKELFRKKNKAAAVIQRAWRSYQLRKHLSHLRHMKQLGAGDVDRWRQESTALLLQVWRKELELKFPQTTAVSKVARASSGLGVFYVVP

SEQ ID NO: 746492 - protein, 1406 aa, Homo sapiens
MWSLTASEGESTTAHFFLGAGDEGLGTRGIGMRPEESDSELLEDEEDEVPPEPQIIVGICAMTKKSKSKPMTQILERLCRFDYLTVVILGEDVILNEPVENWPSCHCLISFHSKGFPLDKAVAYSKLRNPFLINDLAMQYYIQDRREVYRILQEEGIDLPRYAVLNRDPARPEECNLIEGEDQVEVNGAVFPKPFVEKPVSAEDHNVYIYYPSSAGGGSQRLFRKIGSRSSVYSPESSVRKTGSYIYEEFMPTDGTDVKVYTVGPDYAHAEARKSPALDGKVERDSEGKEIRYPVMLTAMEKLVARKVCVAFKQTVCGFDLLRANGHSFVCDVNGFSFVKNSMKYYDDCAKILGNTIMRELAPQFQIPWSIPTEAEDIPIVPTTSGTMMELRCVIAIIRHGDRTPKQKMKMEVKHPRFFALFEKHGGYKTGKLKLKRPEQLQEVLDITRLLLAELEKEPGGEIEEKTGKLEQLKSVLEMYGHFSGINRKVQLTYYPHGVKASNEGQDPQRETLAPSLLLVLKWGGELTPAGRVQAEELGRAFRCMYPGGQGDYAGFPGCGLLRLHSTFRHDLKIYASDEGRVQMTAAAFAKGLLALEGELTPILVQMVKSANMNGLLDSDGDSLSSCQHRVKARLHHILQQDAPFGPEDYDQLAPTRSTSLLNSMTIIQNPVKVCDQVFALIENLTHQIRERMQDPRSVDLQLYHSETLELMLQRWSKLERDFRQKSGRYDISKIPDIYDCVKYDVQHNGSLGLQGTAELLRLSKALADVVIPQEYGISREEKLEIAVGFCLPLLRKILLDLQRTHEDESVNKLHPLYSRGVLSPGRHVRTRLYFTSESHVHSLLSVFRYGGLLDETQDAQWQRALDYLSAISELNYMTQIVIMLYEDNTQDPLSEERFHVELHFSPGVKGVEEEGSAPAGCGFRPASSENEEMKTNQGSMENLCPGKASDEPDRALQTSPQPPEGPGLPRRSPLIRNRKAGSMEVLSETSSSRPGGYRLFSSSRPPTEMKQSGLGFEGCSMVPTIYPLETLHNALSLRQVSEFLSRVCQRHTDAQAQASAALFDSMHSSQASDNPFSPPRTLHSPPLQLQQRSEKPPWLETRFCHVGQAGLELLTSSDLPASASQSAGITGVSHRTQPDSSGPSSTVSSAGPSSPTTVDGNSQFGFSDQPSLNSHVAEEHQGLGLLQETPGSGAQELSIEGEQELFEPNQSPQVPPMETSQPYEEVSQPCQEVPDISQPCQDISEALSQPCQKVPDISQQCQENHDNGNHTCQEVPHISQPCQKSSQLCQKVSEEVCQLCLENSEEVSQPCQGVSVEVGKLVHKFHVGVGSLVQETLVEVGSPAEEIPEEVIQPYQEFSVEVGRLAQETSAINLLSQGIPEIDKPSQEFPEEIDLQAQEVPEEIN

SEQ ID NO: 746493 - protein, 105 aa, Homo sapiens
LRLLPSHLMVHPPEQGPFDLHGQTLLHSASRGCCVAELFRFWRPMSRCSNRVFLGPDTQSCSHTLDQLLTLRPGLPPSIFLSERDWKRVAVFFPAWHIHTLAYGS

SEQ ID NO: 746494 - protein, 115 aa, Homo sapiens
MNSGVCLCVLMAVLAAGALTQPVPPADPAGSGLQRAEEAPRRQLRVSQRTDGESRAHLGALLARYIQQARKAPSGRMSIVKNLQNLDPSHRISDRDYMGWMDFGRRSAEEYEYPS

SEQ ID NO: 746495 - protein, 115 aa, Homo sapiens; identical to SEQ ID NO: 746494

SEQ ID NO: 746496 - protein, 115 aa, Homo sapiens; identical to SEQ ID NO: 746494

SEQ ID NO: 746497 - protein, 368 aa, Homo sapiens
SVQCIAFQYSTVLTKSSLNKGCSNKPTTVNKRSVNVNAASGGVQNSGIVREAPATSIATVLPQPMTSAMGKGTVAVQEKAGLPRSINTDTLSKETDSGKNQDFSSFDDTGKSSLGDMFSPIRDDAVVNKGSDESIGKGDGFDFLPQLNSVFPPRKNPVTSSTSVLHSSPLNVFMGSPGKEENENRDLTAESKKIYMGKQESKDSFKQLAKLVTSGAESGNLNTSPSSNQTRNSEKFEKPENEIEAQLICEPPINGSSTPNPKIASSVTAGVASSLSEKIADSIGNNRQNAPLTSIQIRFIQNMIQETLDDFREACHRDIVNLQVEMIKQFHMQLNEMHSLLERYSVNEGLVAEIERLREENKRLRAHF

SEQ ID NO: 746498 - protein, 368 aa, Homo sapiens; identical to SEQ ID NO: 746497

SEQ ID NO: 746499 - protein, 654 aa, Homo sapiens
SAPLSVSQTTLPQSSSTPVLPRARETPVTSFQTSTMTSFMTMLHSSQTADLKSQSTPHQEKVITESKSPSLVSLPTESTKAVTTNSPLPPSLTESSTEQTLPATSTNLAQMSPTFTTTILKTSQPLMTTPGTLSSTASLVTGPIAVQTTAGKQLSLTHPEILVPQISTEGGISTERNRVIVDATTGLIPLTSVPTSAKEMTTKLGVTAEYSPASRSLGTSPSPQTTVVSTAEDLAPKSATFAVQSSTQSPTTLSSSASVNSCAVNPCLHNGECVADNTSRGYHCRCPPSWQGDDCSVDVNECLSNPCPSTATCNNTQGSFICKCPVGYQLEKGICNLVRTFVTEFKLKRTFLNTTVEKHSDLQEVENEITKTLNMCFSALPSYIRSTVHASRESNAVVISLQTTFSLASNVTLFDLADRMQKCVNSCKSSAEVCQLLGSQRRIFRAGSLCKRKSPECDKDTSICTDLDGVALCQCKSGYFQFNKMDHSCRACEDGYRLENETCMSCPFGLGGLNCGNPYQLITVVIAAAGGGLLLILGIALIVTCCRKNKNDISKLIFKSGDFQMSPYAEYPKNPRSQEWGREAIEMHENGSTKNLLQMTDVYYSPTSVRNPELERNGLYPAYTGLPGSRHSCIFPGQYNPSFISDESRRRDYF

SEQ ID NO: 746500 - protein, 654 aa, Homo sapiens; identical to SEQ ID NO: 746499

SEQ ID NO: 746501 - protein, 654 aa, Homo sapiens; identical to SEQ ID NO: 746499

SEQ ID NO: 746502 - protein, 654 aa, Homo sapiens; identical to SEQ ID NO: 746499

SEQ ID NO: 746503 - protein, 314 aa, Homo sapiens
MEFTDRNYTLVTEFILLGFPTRPELQIVLFLMFLTLYAIILIGNIGLMLLIRIDPHLQTPMYFFLSNLSFVDLCYFSDIVPKMLVNFLSENKSISYYGCALQFYFFCTFADTESFILAAMAYDRYVAICNPLLYTVVMSRGICMRLIVLSYLGGNMSSLVHTSFAFILKYCDKNVINHFFCDLPPLLKLSCTDTTINEWLLSTYGSSVEIICFIIIIISYFFILLSVLKIRSFSGRKKTFSTCASHLTSVTIYQGTLLFIYSRPSYLYSPNTDKIISVFYTIFIPVLNPLIYSLRNKDVKDAAEKVLRSKVDSS

SEQ ID NO: 746504 - protein, 385 aa, Homo sapiens
ESVELGTVTSAYQVPSLSTRLTRTDGIMEHITKIPNEAAHRGTIRPVKGPQTSTSPASPKGLHTGGTKRMETTTTALKTTTTALKTTSRATLTTSVYTPTLGTLTPLNASMQMASTIPTEMMITTPYVFPDVPETTSSLATSLGGGGLGWLWEFWKLPSFVAQANRAQGQRQSPRGVTPPLSPIRSPIFYGRPIAILPISVAASITAQRHRRYKALVASEPLSVRLYRLGLAYLAFTGPLAYSALCNTAATLSYVAETFGSFLNWFSFFPLLGRLMEFVLLLPYRIWRLLMGETGFNSSCFQEWAKLYEFVHSFQDEKRQLAYQVLGLSEGATNEEIHRSYQELVKVWHPDHNLDQTEEAQRHFLEIQAAYEVLSQPRKPWGSRR

SEQ ID NO: 746505 - protein, 341 aa, Homo sapiens
MAKGLLVTYALWAVGGPAGLHHLYLGRDSHALLWMLTLGGGGLGWLWEFWKLPSFVAQANRAQGQRQSPRGVTPPLSPIRFAAQVIVGIYFGLVALISLSSMVNFYIVALPLAVGLGVLLVAAVGNQTSDFKNTLGSAFLTSPIFYGRPIAILPISVAASITAQRHRRYKALVASEPLSVRLYRLGLAYLAFTGPLAYSALCNTAATLSYVAETFGSFLNWFSFFPLLGRLMEFVLLLPYRIWRLLMGETGFNSSCFQEWAKLYEFVHSFQDEKRQLAYQVLGLSEGATNEEIHRSYQELVKVWHPDHNLDQTEEAQRHFLEIQAAYEVLSQPRKPWGSRR

SEQ ID NO: 746506 - protein, 385 aa, Homo sapiens; identical to SEQ ID NO: 746504

SEQ ID NO: 746507 - protein, 341 aa, Homo sapiens; identical to SEQ ID NO: 746505

SEQ ID NO: 746508 - protein, 122 aa, Homo sapiens
RRAPPHLMGFRTFLVETGFRCVGRAGLQLLTVSDPPASASRGAGIADGVLLTQCSMVPRLECSGVISATTSTSQPPVLAPQSAEIAASARPLPRLGSEERLCLAAHRLGCEEPLCLAAQSGK

SEQ ID NO: 746509 - protein, 83 aa, Homo sapiens
PSPSLSTVSLSLSFHGFHGLPLPLFPRSPSHAKPKLDCAAAISAHCNVSAWPPIVWDVRSPSAWLPSLESEECLCPAAIPSRK

SEQ ID NO: 746510 - protein, 621 aa, Homo sapiens
MRNLFEQLVRGAEILKEGNELQFIQLVKDFEDFFKKWERTDYELGKYKDLLIKAETERSALDVKLKHAHNQVDADIQRRRRAEANCEKLEQQIQLIGEMFLCDISGSIQLSGEQKSALAFLNRGQPSSSNAGNKRLSISDESGSILSGISFDKTDESLDCDSSLVKTFKRKQREKRCSSSRQFVDGPSGPVKETRSIGSTVDQGNESIVAKTTVTVPKDGGPIKAVPTIETVPYWTRSQRKTGTLQPWNSDPTLNSRQLEPRTETDNVGTPQSNRGMCLNDFVSKTVIKPEFYVPCGKQIKFGKLSLKCQDCCVISRPECRDHCPLPCIPTLIGTPVKIGEGMLADFVSQTFPMIPRIVVHCVNEIEQRGLTETGLYRILGCDSTVKLKEKFLRVKTVPLVSKVDDIHAICSLLKDFLRNFKEPLLTFRLNKAFMEAAEITDEDNSISAMYQAVGELPQANRDTLVFLMIHLQRVAQSPYTKMNVANLAEVFGSTIVAHAVPNPEPVTMLQDIKCQPKVVERLPSLPLEYWSQFSIVEQKNIDPLHVTENSNAFSTPDIKVSLLGPVTTPDHQLLKTPSSSSLSQGVCSTLTKNTPRFGSKGKSATNLGRQGNLFASSMLK

SEQ ID NO: 746511 - protein, 70 aa, Homo sapiens
RILRTFGGPHPKVLLYSSLEDVSETEKGQRQGAMTRQLQGQEETVMKRVIGWRILEDELQFPKIKNVPKE

SEQ ID NO: 746512 - protein, 120 aa, Homo sapiens
VCTLDCFERVFAGLACACQVQLPAEAQLRAVPIGLVLAQVWPIRALLPGRASLSSSGHCQPSCPGTLLQFSFELIFLKAPDIHFSSYSSPSSPLFKALPQRHTGTELRITNKETLIQERK

SEQ ID NO: 746513 - protein, 225 aa, Homo sapiens
MAGTGLVAGEVVVDALPYFDQGYEAPGVREAAAALVEEETRRYRPTKNYLSYLTAPDYSAFETDIMRNEFERLAARQPIELLSMKRYELPAPSSGQKNDITAWQECVNNSMAQLEHQAVRIENLELMSQHGCNAWKVYNENLVHMIEHAQKELQKLRKHIQDLNWQRKNMQLTAGSKLREMESNWVSLVSKNYEIERTIVQLENEIYQIKQQHGEANKENIRQDF

SEQ ID NO: 746514 - protein, 157 aa, Homo sapiens [sequence omitted]

SEQ ID NO: 746515 - protein, 74 aa, Homo sapiens
QAPAELNITEFTQTQKTQANLRSSEWRAQVWWLERLWWMRCRILIKVMKPLVCGKRLQRWWRRKLADTDLLRTT

SEQ ID NO: 746516 - protein, 225 aa, Homo sapiens; identical to SEQ ID NO: 746513

SEQ ID NO: 746517 - protein, 409 aa, Homo sapiens
LELGGGQLEPQAAALLEMLSRLSGLANVVLHELSGDDDTDQNMRAPLDPELHQESDMEFNNTTQEDVQERLAYAEQLVVELKDIIRQKDVQLQQKDEALQEERKAADNKIKKLKLHAKAKLTSLNKYIEEMKAQGGTVLPTEPQSEEQLSKHDKSSTEEEMEIEKIKHKLQEKEELISTLQAQLYSGTGLVAGEVVVDALPYFDQGYEAPGVREAAAALVEEETRRYRPTKNYLSYLTAPDYSAFETDIMRNEFERLAARQPIELLSMKRYELPAPSSGQKNDITAWQECVNNSMAQLEHQAVRIENLELMSQHGCNAWKVYNENLVHMIEHAQKELQKLRKHIQDLNWQRKNMQLTAGSKLREMESNWVSLVSKNYEIERTIVQLENEIYQIKQQHGEANKENIRQDF

SEQ ID NO: 746518 - protein, 159 aa, Homo sapiens
GGVQRSPDRRDTNGMLSMKRYELPAPSSGQKNDITAWQECVNNSMAQLEHQAVRIENLELMSQHGCNAWKVYNENLVHMIEHAQKELQKLRKHIQDLNWQRKNMQLTAGSKLREMESNWVSLVSKNYEIERTIVQLENEIYQIKQQHGEANKENIRQDF

SEQ ID NO: 746519 - protein, 115 aa, Homo sapiens
MAQLEHQAVRIENLELMSQHGCNAWKVYNENLVHMIEHAQKELQKLRKHIQDLNWQRKNMQLTAGSKLREMESNWVSLVSKNYEIERTIVQLENEIYQIKQQHGEANKENIRQDF

SEQ ID NO: 746520 - protein, 399 aa, Homo sapiens
LELGGGQLEPQAAALLEMLSRLSGLANVVLHELSGDDDTDQNMRAPLDPELHQESDMEFNNTTQEDVQERLAYAEQLVVELKDIIRQKDVQLQQKDEALQEERKAADNKIKKLKLHAKAKLTSLNKYIEEMKAQGGTVLPTEPQSEEQLSKHDKSSTEEEMEIEKIKHKLQEKEELISTLQAQLTRAQVWWLERLWWMRCRILIKAAALVEEETRRYRPTKNYLSYLTAPDYSAFETDIMRNEFERLAARQPIELLSMKRYELPAPSSGQKNDITAWQECVNNSMAQLEHQAVRIENLELMSQHGCNAWKVYNENLVHMIEHAQKELQKLRKHIQDLNWQRKNMQLTAGSKLREMESNWVSLVSKNYEIERTIVQLENEIYQIKQQHGEANKENIRQDF

SEQ ID NO: 746521 - protein, 225 aa, Homo sapiens; identical to SEQ ID NO: 746513

SEQ ID NO: 746522 - protein, 232 aa, Homo sapiens
MAGTGLVAGEVVVDALPYFDQGYEAPGVREAAAALVEEETRRYRPTKNYLSYLTAPDYSAFETDIMRNEFERLAARQPIELLSMKRYELPAPSSGQKNDITAWQECVNNSMAQLEHQAVRIENLELMSQHGCNAWKVYNENLVHMIEHAQKELQKLRKHIQDLNWQRKNMQLTAGSKLREMESNWGLWAVRICRLNGLCPAMTHDIYQLSSNMERQPRHIRRILKHLQVTCV

SEQ ID NO: 746523 - protein, 225 aa, Homo sapiens; identical to SEQ ID NO: 746513

SEQ ID NO: 746524 - protein, 225 aa, Homo sapiens; identical to SEQ ID NO: 746513

SEQ ID NO: 746525 - protein, 160 aa, Homo sapiens
MRNEFERLAARQPIELLSMKRYELPAPSSGQKNDITAWQECVNNSMAQLEHQAVRIENLELMSQHGCNAWKVYNENLVHMIEHAQKELQKLRKHIQDLNWQRKNMQLTAGSKLREMESNWVSLVSKNYEIERTIVQLENEIYQIKQQHGEANKENIRQDF

SEQ ID NO: 746526 - protein, 226 aa, Homo sapiens
MVRERGMQLHGGRRRSVVSIDRAVTEERYSAGYLVHKAPEYHILTYRKLDINGKCNLERDLGWTRTRPRVVHCGSRYEKRIMTLTEQYELPAPSSGQKNDITAWQECVNNSMAQLEHQAVRIENLELMSQHGCNAWKVYNENLVHMIEHAQKELQKLRKHIQDLNWQRKNMQLTAGSKLREMESNWVSLVSKNYEIERTIVQLENEIYQIKQQHGEANKENIRQDF

SEQ ID NO: 746527 - protein, 173 aa, Homo sapiens
RAHFSRELPEETREAYERLLKRQNQRGRALFQDIKKPTVDKYQSTVGSGSFCLLEPTVQMGTKKEIGTQRVITEPEGGKVLRRHELLGGRVLLGSCWLIPGQATSPPGPGFSSVNEGVDPDLPLRLLHASRAICSLSFPCSRLLLPSPMLGLSPPGHSSQPWTSSQPWTSSQP

SEQ ID NO: 746528 - protein, 140 aa, Homo sapiens
MQTSACKLRRGRVQAGSFCLLEPTVQMGTKKEIGTQRVITEPEGGKVLRRHELLGGRVLLGSCWLIPGQATSPPGPGFSSVNEGVDPDLPLRLLHASRAICSLSFPCSRLLLPSPMLGLSPPGHSSQPWTSSQPWTSSQP

SEQ ID NO: 746529 - protein, 86 aa, Homo sapiens
MLCVSGFTSNLYSSKKDDKMKEISRTSNWGSSFSEKSGCMQTHPSMNLDCRDVTYVMNLLLIASSSSSSMTKKKIVTMNTSLGQNK

SEQ ID NO: 746530 - protein, 107 aa, Homo sapiens
MAVPAASKGGTSDPSHSFPARHLNPAPNISIGFLNKSILRAQFSPPRDSWRTHAELRVVRRVWGALGRREKTPHSTATSSLPETALGRRGSRAGNLAQVLVGPRAAA

SEQ ID NO: 746531 - protein, 78 aa, Homo sapiens
FCAVEPLGLSWAVVGSWGGRAGAGEGKSKSWKRSRGVVNQTSRPPEGLVQTYRRDLLEVRIVFVCLSIVAEWGNGERT

SEQ ID NO: 746532 - protein, 106 aa, Homo sapiens [sequence omitted]

SEQ ID NO: 746533 - protein, 318 aa, Homo sapiens
EKDQLSFSVSAPTLNQLPPNIRCPPESLYLGPILKFGSKEQKQAWVTPFTSGDKIGCFALSEPGNGSDAGAASTTARAEGDSWVLNGTKAWITNAWEASAAVVFASTDRALQNKGISAFLVPMPTPGLTLGKKEDKLGIRGSSTANLIFEDCRIPKDSILGEPGMGFKIAMQTLDMGRIGIASQALGIAQTALDCAVNYAENRMAFGAPLTKLQVIQFKLADMALALESARLLTWRAAMLKDNKKPFIKEAAMAKLAASEAATAISHQAIQILGGMGYVTEMPAERHYRDARITEIYEGTSEIQRLVIAGHLLRSYRS

SEQ ID NO: 746534 - protein, 378 aa, Homo sapiens
TGRSRAELCLSPMAAALLARASGPARRALCPRAWRQLHTIYQSVELPETHQMLLQTCRDFAEKELFPIAAQVDKEHLFPAAQVKKMGGLGLLAMDVPEELGGAGLDYLAYAIAMEEISRGCASTGVIMSVNNSLYLGPILKFGSKEQKQAWVTPFTSGDKIGCFALSEPGNGSDAGAASTTARAEGDSWVLNGTKAWITNAWEASAAVVFASTDRALQNKGISAFLVPMPTPGLTLGKKEDKLGIRGSSTANLIFEDCRIPKDSILGEPGMGFKIAMFKLADMALALESARLLTWRAAMLKDNKKPFIKEAAMAKLAASEAATAISHQAIQILGGMGYVTEMPAERHYRDARITEIYEGTSEIQRLVIAGHLLRSYRS

SEQ ID NO: 746535 - protein, 424 aa, Homo sapiens
TGRSRAELCLSPMAAALLARASGPARRALCPRAWRQLHTIYQSVELPETHQMLLQTCRDFAEKELFPIAAQVDKEHLFPAAQVKKMGGLGLLAMDVPEELGGAGLDYLAYAIAMEEISRGCASTGVIMSVNNSLYLGPILKFGSKEQKQAWVTPFTSGDKIGCFALSEPGNGSDAGAASTTARAEGDSWVLNGTKAWITNAWEASAAVVFASTDRALQNKGISAFLVPMPTPGLTLGKKEDKLGIRGSSTANLIFEDCRIPKDSILGEPGMGFKIAMQTLDMGRIGIASQALGIAQTALDCAVNYAENRMAFGAPLTKLQVIQFKLADMALALESARLLTWRAAMLKDNKKPFIKEAAMAKLAASEAATAISHQAIQILGGMGYVTEMPAERHYRDARITEIYEGTSEIQRLVIAGHLLRSYRS

SEQ ID NO: 746536 - protein, 424 aa, Homo sapiens; identical to SEQ ID NO: 746535

SEQ ID NO: 746537 - protein, 1011 aa, Homo sapiens
MQKPSGLKPPGRGGKHSSPMGRTSTGSASSSAAVAASSKEGSPLHKQSSGPSSSPAAAAAPEKPGPKAAEVGDDFLGDFVVGERVWVNGVKPGVVQYLGETQFAPGQWAGVVLDDPVGKNDGAVGGVRYFECPALQGIFTRPSKLTRQPTAEGSGSDAHSVESLTAQNLSLHSGTATPPLTSRVIPLRESVLNSSVKTGNESGSNLSDSGSVKRGEKDLRLGDRVLVGGTKTGVVRYVGETDFAKGEWCGVELDEPLGKNDGAVAGTRYFQCPPKFGLFAPIHKVIRIGFPSTSPAKAKKTKRMAMGVSALTHSPSSSSISSVSSVASSVGGRPSRSGLLTETSSRYARKISGTTALQEALKEKQQHIEQLLAERDLERAEVAKATSHICEVEKEIALLKAQHEQYVAEAEEKLQRARLLVESVRKEKVDLSNQLEEERRKVEDLQFRVEEESITKGDLELTTVAEKSRVLQLEEELTLRRGEIEELQQCLLHSGPPPPDHPDAAEILRLRERLLSASKEHQRESGVLRDKYEKALKAYQAEVDKLRAANEKYAQEVAGLKDKVQQATSENMGLMDNWKSKLDSLASDHQKSLEDLKATLNSGPGAQQKEIGELKAVMEGIKMEHQLELGNLQAKHDLETAMHVKEKEALREKLQEAQEELAGLQRHWRAQLEVQASQHRLELQEAQDQRRDAELRVHELEKLDVEYRGQAQAIEFLKEQISLAEKKMLDYERLQRAEAQGKQEVESLREKLLVAENRLQAVEALCSSQHTHMIESNDISEETIRTKETVEGLQDKLNKRDKEVTALTSQTEMLRAQVSALESKCKSGEKKVDALLKEKRRLEAELETVSRKTHDASGQLVLISQELLRKERSLNELRVLLLEANRHSPGPERDLSREVHKAEWRIKEQKLKDDIRGLREKLTGLDKEKSLSDQRRYSLIDPSSAPELLRLQHQLMSTEDALRDALDQAQQVEKLMEAMRSCPDKAQTIGNSGSANGIHQQDKAQKQEDKH

SEQ ID NO: 746538 - protein, 121 aa, Homo sapiens
LIGEMPQEDLHAVVKNCFAVVNSSVSEGMSAAILEAMDLEVPVLARNIPGNAAVVKHEVTGLLFSNPQEFVHLAKRLVSDPALEKEIVVNGREYVRMYHSWQVERDTYQQLIRKLEGSTED

SEQ ID NO: 746539 - protein, 189 aa, Homo sapiens
LCVPPTQILVHIGFLTEESGDVFSPRVLKGGPLGEMVQWADILTALYVLGHGLRVTVSLKELQSNLGVPPGRGSCPLTMPLPFDLIYTDYHGLQQMKRHMGLSFKKYRCRIRVIDTFGTEPAYNHEEYATLHGYRTNWGYWNLNPKQFMTMFPHTPDNSFMGFVSEELNETEKRLIKGGKASNMAVVYG

SEQ ID NO: 746540 - protein, 412 aa, Homo sapiens
SLKELLQSNLGVPPGRGSCPLTMPLPFDLIYTDYHGLQQMKRHMGLSFKKYRCRIRVIDTFGTEPAYNHEEYATLHGYRTNWGYWNLNPKQFMTMFREEKFLGILNKYMEIHGTVYYESQRPPEVPAFVKNHGLLPQPEFQQLLRKAKLFIGFGFPYEGPAPLEAIANGCIFLQSRFSPPHSSLNHEFFRGKPTSREVFSQHPYAENFIGKPHVWTVDYNNSEEFEAAIKAIMRTQVDPYLPYEYTCEGMLERIHAYIQHQDFCRAPDPALPEAHAPQSPFVLAPNATHLEWARNTSLAPGAWPPAHALRAWLAVPGRACTDTCLDHGLICEPSFFPFLNSQDAFLKLQVPCDSTESEMNHLYPAFAQPGQECYLQKEPLLFSCAGSNTKYRRLCPCRDFRKGQVALCQGCL

SEQ ID NO: 746541 - protein, 217 aa, Homo sapiens
GSLGMAQDVRAHQTSTPNAEHGRAPTAGPSPAPCVCPSLPQVDPYLPYEYTCEGMLERIHAYIQHQDFCRAPDPALPEAHAPQSPFVLAPNATHLEWARNTSLAPGAWPPAHALRAWLAVPGRACTDTCLDHGLICEPSFFPFLNSQDAFLKLQVPCDSTESEMNHLYPAFAQPGQECYLQKEPLLFSCAGSNTKYRRLCPCRDFRKGQVALCQGCL

SEQ ID NO: 746542 - protein, 412 aa, Homo sapiens; identical to SEQ ID NO: 746540

SEQ ID NO: 746543 - protein, 130 aa, Homo sapiens
STMFCSSSLMGVISDMTQTKEAIVSASSLPMSIIIVGVGPAMFEAMEELDGDDVRVSSRGRYAERDIVQFVPFRDYVDRSGNQVLSMARLAKDVLAEIPEQLLSYMRTRDIQPRPPPPANPSPIPAPEQP

SEQ ID NO: 746544 - protein, 104 aa, Homo sapiens
MKLAALLGLCVALSCSSAAAFLVGSAKPVAQPVAALESAAEAGAGTLANPLGTLNPLKLLLSSLGIPVNHLIEGSQKCVAELGPQAVGAVKALKALLGALTVFG

SEQ ID NO: 746545 - protein, 104 aa, Homo sapiens; identical to SEQ ID NO: 746544

SEQ ID NO: 746546 - protein, 104 aa, Homo sapiens; identical to SEQ ID NO: 746544

SEQ ID NO: 746547 - protein, 101 aa, Homo sapiens
MKLAALLGLCVALSCSSAAAFLVGSAKPVAQPVAALESAAEAGAGTLANPLGTLNPLKLLLSSLGIPVNHLIEGSQKCVTLSLGQTGQHSPRDSPGKFLPH

SEQ ID NO: 746548 - protein, 121 aa, Homo sapiens
ARASLPGQPQNCTRGVPALRQGCFPSCPSKPCPWEKPGSPGGNWVGRIRAAGAGKAEVAPRGCASPGDASGTAPLPLPTEPAAAAPPPEFLVAGLGALKLGFCFPGGPDSVWLSRDWSIYT

SEQ ID NO: 746549 - protein, 261 aa, Homo sapiens
LGLSGIEAEENFEEDSHRPLINGGENEDEYEPNYSIQDDSSVAQVKAISFYQACCLPGVIPYSLAYACLKLVNYSFFFWLPFYLSNNFGWKEAEADKLSIWYDVGGIIGGTLQGFISDVLQKRAPVLALSLLLAVGSLIGYSRSPNDKSINALLMTVTGFFIGGPSNMISSAISADLGRQELIQRSSEALATVTGIVDGSGSIGAAVGQYLVSLIRDKLGWMWVFYFFILMTSCTIVFISPLIVREIFSLVLRRQAHILRE

SEQ ID NO: 746550 - protein, 241 aa, Homo sapiens
LGLSGIEAEENFEEDSHRPLINGGENEDEYEPNYSIQDDSSVAQVKAISFYQACCLPGVIPYSLAYACLKLVNYSFFFWLPFYLSNNFGWKEAEADKLSIWYDVGGIIGGTLQGFISDVLQKRAPVLALSLLLAVGSLIGYSRSPNDKSINALLMTVTGFFIGGPSNMISSAISADLGRQELIQRSSEALATVTGIVDGSGSIGAAVGQYLVSLIRDKLGWMWVFYFFILMLRRQAHILRE

SEQ ID NO: 746551 - protein, 67 aa, Homo sapiens
EDYRETTSKETGSHIEGVTGARETERTMSATSGPLGLRVCPNLGLSRSSSLILDCQASLNTASHLRC

SEQ ID NO: 746552 - protein, 239 aa, Homo sapiens
LGLSGIEAEENFEEDSHRPLINGGENEDEYEPNYSIQDDSSVAQVKAISFYQACCLPGVIPYSLAYACLKLVNYSFFFWLPFYLSNNFGWKEAEADKLSIWYDVGGIIGGTLQGFISDVLQKRAPVLALSLLLAVGSLIGYSRSPNDKSINALLMTVTGFFIGGPSNMISSAISADLGRQELIQRSSEALATVTGIVDGSGSIGAAVGQTSCTIVFISPLIVREIFSLVLRRQAHILRE

SEQ ID NO: 746553 - protein, 269 aa, Homo sapiens
GPSALLPPLLQPPPLPPPCRQVCGKLSVVAAAMGRKSSKAKEKKQKRLEERAAMDAVCAKVDAANRLGDPLEAFPVFKKYDRNGLNVSIECKRVSGLEPATVDWAFDLTKTNMQTMYEQSEWGWKDREKREEMTDDRAWYLIAWENSSVPVAFSHFRFDVECGDEVLYCYEVQLESKVRRKGLGKFLIQILQLMANSTQMKKVMLTVFKHNHGAYQFFREALQFEIDDSSPSMSGCCGEDCSYEILSRRTKFGDSHHSHAGGHCGGCCH

SEQ ID NO: 746554 - protein, 269 aa, Homo sapiens; identical to SEQ ID NO: 746553

SEQ ID NO: 746555 - protein, 157 aa, Homo sapiens
MQTMYEQSEWGWKDREKREEMTDDRAWYLIAWENSSVPVAFSHFRFDVECGDEVLYCYEVQLESKVRRKGLGKFLIQILQLMANSTQMKKVMLTVFKHNHGAYQFFREALQFEIDDSSPSMSGCCGEDCSYEILSRRTKFGDSHHSHAGGHCGGCCH

SEQ ID NO: 746556 - protein, 194 aa, Homo sapiens
MGCCGCSGGCGSGCGGCGSGCGGCGSGCGGCGSSCCVPICCCKPVCCCVPACSCSSCGSCGGSKGGRGSCGGSKGDCGSCGGSKGGCGSCGCSQCSCYKPCCCSSGCGSSCCQSSCCKPCCSQSSCCKPCSCSSGCGSSCCQSSCCKPCCSQSSCCKPCCCSSGCGSSCCQSSCCKPCCSQSSCCVPICCQCKI

SEQ ID NO: 746557 - protein, 299 aa, Homo sapiens
MLRLFYFSAIIASVILNFVGIIMNLFITVVNCKTWVKSHRISSSDRILFSLGITRFLMLGLFLVNTIYFVSSNTERSVYLSAFFVLCFMFLDSSSVWFVTLLNILYCVKITNFQHSVFLLLKRNISPKIPRLLLACVLISAFTTCLYITLSQASPFPELVTTRNNTSFNISEGILSLVVSLVLSSSLQFIINVTSASLLIHSLRRHIQKMQKNATGFWNPQTEAHVGAMKLMVYFLILYIPYSVATLVQYLPFYAGMDMGTKSICLIFATLYSPGHSVLIIITHPKLKTTAKKILCFKK

SEQ ID NO: 746558 - protein, 601 aa, Homo sapiens [sequence omitted]

SEQ ID NO: 746559 - protein, 618 aa, Homo sapiens
RRRSRAGWRAAGWRRRHGGAESGAETRPPIRVTVKTPKDKEEIVICDRASVKEFKEEISRRFKAQQDQLVLIFAGKILKDGDTLNQHGIKDGLTVHLVIKTPQKAQDPAAATASSPSTPDPASAPSTTPASPATPAQPSTSGSASSDAGSGSRRSSGGGPSPGAGEGSPSATASILSGFGGILGLGSLGLGSANFMELQQQMQRQLMSNPEMLSQIMENPLVQDMMSNPDLMRHMIMANPQMQQLMERNPEISHMLNNPELMRQTMELARNPAMMQEMMRNQDRALSNLESIPGGYNALRRMYTDIQEPMFSAAREQFGNNPFSSLAGNSDSSSSQPLRTENREPLPNPWSPSPPTSQAPGSGGEGTGGSGTSQVHPTVSNPFGINAASLGSGMFNSPEMQALLQQISENPQLMQNVISAPYMRSMMQTLAQNPDFAAQMMVNVPLFAGNPQLQEQLRLQLPVFLQQMQNPESLSILTNPRAMQALLQIQQGLQTLQTEAPGLVPSLGSFGMSRTPAPSAGSNAGSTPEAPTSSPATPATSSPTGASSAQQQLMQQMIQLLAGSGNSQVQTPEVRFQQQLEQLNSMGFINREANLQALIATGGDINAAIERLLGSQLS

SEQ ID NO: 746560 - protein, 684 aa, Homo sapiens
RRRSRAGWRAAGWRRRHGGAESGAETRPPIRVTVKTPKDKEEIVICDRASVKEFKEEISRRFKAQQDQLVLIFAGKILKDGDTLNQHGIKDGLTVHLVIKTPQKAQDPAAATASSPSTPDPASAPSTTPASPATPAQPSTSGSASSDAGSGSRRSSGGGPSPGAGEGSPSATASILSGFGGILGLGSLGLGSANFMELQQQMQRQLMSNPEMLSQIMENPLVQDMMSNPDLMRHMIMANPQMQQLMERNPEISHMLNNPELMRQTMELARNPAMMQEMMRNQDRALSNLESIPGGYNALRRMYTDIQEPMFSAAREQFGNNPFSSLAGNSDSSSSQPLRTENREPLPNPWSPSPPTSQAPGSGGEGTGGSGTSQVHPTVSNPFGINAASLGSGMFNSPEMQALLQQISENPQLMQNVISAPYMRSMMQTLAQNPDFAAQMMVNVPLFAGNPQLQEQLRLQLPVFLQQMQNPESLSILTNPRAMQALLQIQQGLQTLQTEAPGLVPRWGRGAGGQQGSSNFSPSTLLSATLSASFVSLRVCFPVSSNCFSFWIHILIPFLDAISYLLVSLAYSLGSFGMSRTPAPSAGSNAGSTPEAPTSSPATPATSSPTGASSAQQQLMQQMIQLLAGSGNSQVQTPEVRFQQQLEQLNSMGFINREANLQALIATGGDINAAIERLLGSQLS

SEQ ID NO: 746561 - protein, 601 aa, Homo sapiens [sequence omitted]

SEQ ID NO: 746562 - protein, 407 aa, Homo sapiens
MLAVEAGGAVVGGPLRGLGRDPPVLLRPYSMQQLMERNPEISHMLNNPELMRQTMELARNPAMMQEMMRNQDRALSNLESIPGGYNALRRMYTDIQEPMFSAAREQFGNNPFSSLAGNSDSSSSQPLRTENREPLPNPWSPSPPTSQAPGSGGEGTGGSGTSQVHPTVSNPFGINAASLGSGMFNSPEMQALLQQISENPQLMQNVISAPYMRSMMQTLAQNPDFAAQMMVNVPLFAGNPQLQEQLRLQLPVFLQQMQNPESLSILTNPRAMQALLQIQQGLQTLQTEAPGLVPSLGSFGMSRTPAPSAGSNAGSTPEAPTSSPATPATSSPTGASSAQQQLMQQMIQLLAGSGNSQVQTPEVRFQQQLEQLNSMGFINREANLQALIATGGDINAAIERLLGSQLS

SEQ ID NO: 746563 - protein, 178 aa, Homo sapiens
MVNVPLFAGNPQLQEQLRLQLPVFLQQMQNPESLSILTNPRAMQALLQIQQGLQTLQTEAPGLVPSLGSFGMSRTPAPSAGSNAGSTPEAPTSSPATPATSSPTGASSAQQQLMQQMIQLLAGSGNSQVQTPEVRFQQQLEQLNSMGFINREANLQALIATGGDINAAIERLLGSQLS

SEQ ID NO: 746564 - protein, 618 aa, Homo sapiens; identical to SEQ ID NO: 746559

SEQ ID NO: 746565 - protein, 144 aa, Homo sapiens
RRRSRAGWRAAGWRRRHGGAESGAETRPPIRVTVKTPKDKEEIVICDRASVKEFKEEISRRFKAQQDQLVLIFAGKILKDGDTLNQHGIKDGLTVHLVIKTPQKAQDPAAATASSPSTPDPASAPSTTPASPATPAAAPLLSGF

SEQ ID NO: 746566 - protein, 331 aa, Homo sapiens
RRRSRAGWRAAGWRRRHGGAESGAETRPPIRVTVKTPKDKEEIVICDRASVKEFKEEISRRFKAQQDQLVLIFAGKILKDGDTLNQHGIKDGLTVHLVIKTPQKAQDPAAATASSPSTPDPASAPSTTPASPATPAQPSTSGSASSDAGSGSRRSSGGGPSPGAGEGSPSATASILSGFGGILGLGSLGLGSANFMELQQQMQRQLMSNPEMLSQIMENPLVQDMMSNPDLMRHMIMANPQMQQLMERNPEISHMLNNPELMRQTMELARNPAMMQEMMRNQDPESLLRADSWAEKEECGEQPALHSNPPQPYCMTVTYFYLCFKTYRASH

SEQ ID NO: 746567 - protein, 597 aa, Homo sapiens
EEEEPGGLAGGRVAAAAWRSRERGRDEAPHSGHRQDPQGQGGNCDLRSSLGQGGKILKDGDTLNQHGIKDGLTVHLVIKTPQKAQDPAAATASSPSTPDPASAPSTTPASPATPAQPSTSGSASSDAGSGSRRSSGGGPSPGAGEGSPSATASILSGFGGILGLGSLGLGSANFMELQQQMQRQLMSNPEMLSQIMENPLVQDMMSNPDLMRHMIMANPQMQQLMERNPEISHMLNNPELMRQTMELARNPAMMQEMMRNQDRALSNLESIPGGYNALRRMYTDIQEPMFSAAREQFGNNPFSSLAGNSDSSSSQPLRTENREPLPNPWSPSPPTSQAPGSGGEGTGGSGTSQVHPTVSNPFGINAASLGSGMFNSPEMQALLQQISENPQLMQNVISAPYMRSMMQTLAQNPDFAAQMMVNVPLFAGNPQLQEQLRLQLPVFLQQMQNPESLSILTNPRAMQALLQIQQGLQTLQTEAPGLVPSLGSFGMSRTPAPSAGSNAGSTPEAPTSSPATPATSSPTGASSAQQQLMQQMIQLLAGSGNSQVQTPEVRFQQQLEQLNSMGFINREANLQALIATGGDINAAIERLLGSQLS

SEQ ID NO: 746568 - protein, 601 aa, Homo sapiens [sequence omitted]

SEQ ID NO: 746569 - protein, 464 aa, Homo sapiens
RRRSRAGWRAAGWRRRHGGAESGAETRPPIRVTVKTPKDKEEIVICDRASVKESNPEMLSQIMENPLVQDMMSNPDLMRHMIMANPQMQQLMERNPEISHMLNNPELMRQTMELARNPAMMQEMMRNQDRALSNLESIPGGYNALRRMYTDIQEPMFSAAREQFGNNPFSSLAGNSDSSSSQPLRTENREPLPNPWSPSPPTSQAPGSGGEGTGGSGTSQVHPTVSNPFGINAASLGSGMFNSPEMQALLQQISENPQLMQNVISAPYMRSMMQTLAQNPDFAAQMMVNVPLFAGNPQLQEQLRLQLPVFLQQMQNPESLSILTNPRAMQALLQIQQGLQTLQTEAPGLVPSLGSFGMSRTPAPSAGSNAGSTPEAPTSSPATPATSSPTGASSAQQQLMQQMIQLLAGSGNSQVQTPEVRFQQQLEQLNSMGFINREANLQALIATGGDINAAIERLLGSQLS

SEQ ID NO: 746570 - protein, 618 aa, Homo sapiens; identical to SEQ ID NO: 746559

SEQ ID NO: 746571 - protein, 575 aa, Homo sapiens
RRRSRAGWRAAGWRRRHGGAESGAETRPPIRVTVKTPKDKEEIVICDRASVKEFKEEISRRFKAQQDQLVLIFAGKILKDGDTLNQHGIKDGLTVHLVIKTPQKAQDPAAATASSPSTPDPASAPSTTPASPATPAQPSTSGSASSDAGSGSRRSSGGGPSPGAGEGSPSATASILSGFGGILGLGSLGLGSANFMELQQQMQRQLMSNPEMLSQIMENPLVQDMMSNPDLMRHMIMANPQMQQLMERNPEISHMLNNPELMRQTMELARNPAMMQEMMRNQDRALSNLESIPGGYNALRRMYTDIQEPMFSAAREQFGNNPFSSLAGNSDSSSSQPLRTENREPLPNEREDKRKTRREEKRTKKEKREKTSKENNKNEQKNTKKKKEQTKKTGQGEEEQSESEADGQRRHKRKGTKRKNRRSEESKTKEEASRSNDQGKEKHTATKQKNRKNESKNRKKQNTGRQEKNTQTEEEQSTKTRTETTKTERPEDTRKKEKKRKRRRKATTERKERRRHDAKRQREKKTGHERTEKKKRSRKQETSKHKKESRKNKKANKASQHRRAQRGEQDEEEKK

SEQ ID NO: 746572 - protein, 44 aa, Homo sapiens
MMQEMMRNQDRALSNLESIPGGYNALRRMYTDIQEPMFSAAREQ

SEQ ID NO: 746573 - protein, 108 aa, Homo sapiens
ALVFQSGGITSISHHAQLHCKHVCFLGAAGRVILLKPNHVVSLCFPESSVVSYLIQNKSPSPFSSRQCSQSVTLEAIVPPCSSPLLSTVLLPALRHTWPLCLCTCSSL

SEQ ID NO: 746574 - protein, 68 aa, Homo sapiens
TETGSWLTASRESGYQSQNHKELNSAKNLNELGSGILPRRAQPGHHLNFGLRNRKQRIHSSPPGSTEL

SEQ ID NO: 746575 - protein, 212 aa, Homo sapiens
REPRAQGSESPISASPEASAISMMASPFALLMALVVLSCKSSCSLGCDLPETHSLDNRRTLMLLAQMSRISPSSCLMDRHDFGFPQEEFDGNQFQKAPAISVLHELIQQIFNLFTTKDSSAAWDEDLLDKFCTELYQQLNDLEACVMQEERVGETPLMNADSILAVKKYFRRITLYLTEKKYSPCAWEVVRAEIMRSLSLSTNLQERLRRKE

SEQ ID NO: 746576 - protein, 329 aa, Homo sapiens
MAAQYGSMSFNPSTPGASYGPGRQEPRNSQLRIVLVGKTGAGKSATGNSILGRKVFHSGTAAKSITKKCEKRSSSWKETELVVVDTPGIFDTEVPNAETSKEIIRCILLTSPGPHALLLVVPLGRYTEEEHKATEKILKMFGERARSFMILIFTRKDDLGDTNLHDYLREAPEDIQDLMDIFGDRYCALNNKATGAEQEAQRAQLLGLIQRVVRENKEGCYTNRMYQRAEEEIQKQTQAMQELHRVELEREKARIREEYEEKIRKLEDKVEQEKRKKQMEKKLAEQEAHYAVRQQRARTEVESKDGILELIMTALQIASFILLRLFAED

SEQ ID NO: 746577 - protein, 258 aa, Homo sapiens
LTSSLLLFLNILAEYCVQNQRGVQDPDFSGPGRQEPRNSQLRIVLVGKTGAGKSATGNSILGRKVFHSGTAAKSITKKCEKRSSSWKETELVVVDTPGIFDTEVPNAETSKEIIRCILLTSPGPHALLLVVPLGRYTEEEHKATEKILKMFGERARSFMILIFTRKDDLGDTNLHDYLREAPEDIQDLMDIFGDRYCALNNKATGAEQEAQRAQLLGLIQRVVRENKEGCYTNRMYTGIRMKLEYETTNSGTVPLVNM

SEQ ID NO: 746578 - protein, 432 aa, Homo sapiens
MRPWALAVTRWPPSAPVGQRRFSAGPGSTPGQLWGSPGLEGPLASPPARDERLPSQQPPSRPPHLPVEERRASAPAGGSPRMLHPATQQSPFMVDLHEQVHQGPVPLSYTVTTVTTQGFPLPTGQHIPGCSAQQLPACSVMFSGQHYPLCCLPPPLIQACTMQQLPVPYQAYPHLISSDHYILHPPPPAPPPQPTHMAPLGQFVSLQTQHPRMPLQRLDNDVDLRGDQPSLGSFTYSTSAPGPALSPSVPLHYLPHDPLHQELSFGVPYSHMMPRRLSTQRYRLQQPLPPPPPPPPPPPYYPSFLPYFLSMLPMSPTAMGPTISLDLDVDDVEMENYEALLNLAERLGDAKPRGLTKADIEQLPSYRFNPDSHQSEQTLCVVCFSDFEARQLLRVLPCNHEFHTKCVDKWLKANRTCPICRADASEVPREAE

SEQ ID NO: 746579 - protein, 137 aa, Homo sapiens
MGREWPRPAPSLLPAFPELVPGSAQRGVPAISPCICQAPKTPSLVCLPARPPRSCLSVPDRVSLLCTLRSLLFLLALSARGPLPQWGRWRSLAPGWADRAPSWVRRSHALKWRALCPGGTARCVDRRCHEPFPEPQG

SEQ ID NO: 746580 - protein, 327 aa, Homo sapiens
MEWRNHSGRVSEFVLLGFPAPAPLQVLLFALLLLAYVLVLTENTLIIMAIRNHSTLHKPMYFFLANMSFLEIWYVTVTIPKMLAGFVGSKQDHGQLISFEGCMTQLYFFLGLGCTECVLLAVMAYDRYMAICYPLHYPVIVSGRLCVQMAAGSWAGGFGISMVKVFLISGLSYCGPNIINHFFCDVSPLLNLSCTDMSTAELTDFILAIFILLGPLSVTGASYVAITGAVMHIPSAAGRYKAFSTCASHLTVVIIFYAASIFIYARPKALSAFDTNKLVSVLYAVIVPLLNPIIYCLRNQEVKRALCCTLHLYQHQDPDPKKASRNV

SEQ ID NO: 746581 - protein, 73 aa, Homo sapiens [sequence omitted]

SEQ ID NO: 746582 - protein, 136 aa, Homo sapiens; identical to SEQ ID NO: 741065

SEQ ID NO: 746583 - protein, 216 aa, Homo sapiens
EKPSPTIHWRTHTKENIYECSKCGKSFRGKSHLSVHQRIHTGEKPYECSICGKTFSGKSHLSVHHRTHTGEKPYECRRCGKAFGEKSTLIVHQRMHTGEKPYKCNECGKAFSEKSPLIKHQRIHTGERPYECTDCKKAFSRKSTLIKHQRIHTGEKPYKCSECGKAFSVKSTLIVHHRTHTGEKPYECVRRSDGPFTKSTSSNLLNASRILLDHIS

SEQ ID NO: 746584 - protein, 214 aa, Homo sapiens
EKPSPTIHWRTHTKENIYECSKCGKSFRGKSHLSVHQRIHTGEKPYECSICGKTFSGKSHLSVHHRTHTGEKPYECRRCGKAFGEKSTLIVHQRMHTGEKPYKCNECGKAFSEKSPLIKHQRIHTGERPYECTDCKKAFSRKSTLIKHQRIHTGEKPYKCSECGKAFSVKSTLIVHHRTHTGEKPYECRDCGKAFSGKSTLIKHQRSHTGDKNL

SEQ ID NO: 746585 - protein, 564 aa, Homo sapiens
PEPHGAAGSGRTVKPRRRRRRRRRRPGRERGALWRRVSGAPGGGGGRAARDHLSSPHHGRTEGAAAEGSQGAPAGFQYLSTGIAMTPALREATAKGISFSSLPSTMESDKMLYMESPRTVDEKLKGDTFSQMLGFPTPEPTLNTNFVNLKHFGSPQSSKHYQTVFLMRSNSTLNKHNENYKQKKLGEPSCNKLKNILYNGSNIQLSKICLSHSEEFIKKEPLSDTTSQCMKDVQIILDSNITKDTNVDKVQLQNCKWYQENALLDKVTDAEIKKGLLHCTQKKIVPGHSNVPVSSSAAEKEEEVHARLLHCVSKQKILLSQARRTQKHLQMLLAKHVVKHYGQQMKLSMKHQLPKMKTFHEPTTILGNSLPKCTEIKPEVNTLTAENKLWDDAKNGFARCTAAEIQRFAFSATGLLSHVEEGLDSDATDSSSDDDLDEYTLRKNVAVNCSTEWKWLVDRARVGSRWTWLQAQISDLECKIQQLTDIHRQIRASKGIVVLEECQLPKDILKKQMQFADQAASLNILGNPQVPQECQDPVPEQDFEMSPSSPTLLLRNIEKQVKSK

SEQ ID NO: 746586 - protein, 601 aa, Homo sapiens
PEPHGAAGSGRTVKPRRRRRRRRRRPGRERGALWRRVSGAPGGGGGRAARDHLSSPHHGRTEGAAAEGSQGAPAGFQYLSTGIAMTPALREATAKGISFSSLPSTMESDKMLYMESPRTVDEKLKGDTFSQMLGFPTPEPTLNTNFVNLKHFGSPQSSKHYQTVFLMRSNSTLNKHNENYKQKKLGEPSCNKLKNILYNGSNIQLSKICLSHSEEFIKKEPLSDTTSQCMKDVQIILDSNITKDTNVDKVQLQNCKWYQENALLDKVTDAEIKKGLLHCTQKKIVPGHSNVPVSSSAAEKEEEVHARLLHCVSKQKILLSQARRTQKHLQMLLAKHVVKHYGQQMKLSMKHQLPKMKTFHEPTTILGNSLPKCTEIKPEVNTLTAENKLWDDAKNGFARCTAAEIQRFAFSATGLLSHVEEGLDSDATDSSSDDDLDEYTLRKNVAVNCSTEWKWLVDRARVGSRWTWLQAQISDLECKIQQLTDIHRQIRASKGIVVLEECQLPKDILKKQMQFADQAASLNILGNPQVPQECQDPVPEQDFEMSPSSPTLLLRNIEKQSAQLTEIINSLIAPLNLSPTSSPLSSKSCSHKCLANGIYRR

SEQ ID NO: 746587 - protein, 183 aa, Homo sapiens
DKVTDAEIKKGLLHCTQKKIVPGHSNVPVSSSAAEKEEEVHARLLHCVSKQKILLSQARRTQKHLQMLLAKHVVKHYGQQMKLSMKHQLPKMKTFHEPTTILGNSLPKCTEIKPEVNTLTAENKLWDDAKNGFARCTAAEIQRFAFSATGLLSHVEEGLDSDATDSSSDDDLDEYTLRKNVAV

SEQ ID NO: 746588 - protein, 634 aa, Homo sapiens
PEPHGAAGSGRTVKPRRRRRRRRRRPGRERGALWRRVSGAPGGGGGRAARDHLSSPHHGRTEGAAAEGSQGAPAGFQYLSTGIAMTPALREATAKGISFSSLPSTMESDKMLYMESPRTVDEKLKGDTFSQMLGFPTPEPTLNTNFVNLKHFGSPQSSKHYQTVFLMRSNSTLNKHNENYKQKKLGEPSCNKLKNILYNGSNIQLSKICLSHSEEFIKKEPLSDTTSQCMKDVQIILDSNITKDTNVDKVQLQNCKWYQENALLDKVTDAEIKKGLLHCTQKKIVPGHSNVPVSSSAAEKEEEVHARLLHCVSKQKILLSQARRTQKHLQMLLAKHVVKHYGQQMKLSMKHQLPKMKTFHEPTTILGNSLPKCTEIKPEVNTLTAENKLWDDAKNGFARCTAAEIQRFAFSATGLLSHVEEGLDSDATDSSSDDDLDEYTLRKNVAVNCSTEWKWLVDRARVGSRWTWLQAQISDLECKIQQLTDIHRQIRASKGIVVLEECQLPKDILKKQMQFADQAASLNILGNPQVPQECQDPVPEQDFEMSPSSPTLLLRNIEKQSAQLTEIINSLIAPLNLSPTSSPLSSKSCSHKCLANGIYRRTQRTRESIMQDETRESIMQDENKLCYMPATQRI

SEQ ID NO: 746589 - protein, 246 aa, Homo sapiens
RVGAGPAPQPLLLAELLPPPGGRADARSWGRRGGAGGAAAGLTGPMRRKEKRLLQAVALVLAALVLLPNVGLWALYRERQPDGTPGGSGAAVAPAAGQGSHSRQKKTFFLGDGQKLKDWHDKEAIRRDAQRVGNGEQGRPNPMTDAERVDQAYRENGFNIYVSDKISLNRSLPDIRHPNCNSKRYLETLPNTSIIIPFHNEGWSSLLRTVHSVLNRSPPELVAEIVLVDDFSDRDLPTASTPSPFV

SEQ ID NO: 746590 - protein, 586 aa, Homo sapiens
RVGAGPAPQPLLLAELLPPPGGRADARSWGRRGGAGGAAAGLTGPDEAEEKRLLQAVALVLAALVLLPNVGLWALYRERQPDGTPGGSGAAVAPAAGQGSHSRQKKTFFLGDGQKLKDWHDKEAIRRDAQRVGNGEQGRPNPMTDAERVDQAYRENGFNIYVSDKISLNRSLPDIRHPNCNSKRYLETLPNTSIIIPFHNEGWSSLLRTVHSVLNRSPPELVAEIVLVDDFSDRDRIARNRKTIVCPMIDVIDHDDFRYETQAGDAMRGAFDWEMYYKRIPIPPELQKADPSDPFESPVMAGGLFAVDRKWFWELGGYDPGLEIWGGEQYEISFKVWMCGGRMEDIPCSRVGHIYRKYVPYKVPAGVSLARNLKRVAEVWMDEYAEYIYQRRPEYRHLSAGDVAVQKKLRSSLNCKSFKWFMTKIAWDLPKFYPPVEPPAAAWGEIRNVGTGLCADTKHGALGSPLRLEGCVRGRGEAAWNNMQVFTFTWREDIRPGDPQHTKKFCFDAISHTSPVTLYDCHSMKGNQLWKYRKDKTLYHPVSGSCMDCSESDHRIFMNTCNPSSLTQQWLFEHTNSTVLEKFNRN

SEQ ID NO: 746591 - protein, 463 aa, Homo sapiens
DCINAADCITPRVTASNAASLLRTVHSVLNRSPPELVAEIVLVDDFSDREHLKKPLEDYMALFPSVRILRTKKREGLIRTRMLGASVATGDVITFLDSHCEANVNWLPPLLDRIARNRKTIVCPMIDVIDHDDFRYETQAGDAMRGAFDWEMYYKRIPIPPELQKADPSDPFESPVMAGGLFAVDRKWFWELGGYDPGLEIWGGEQYEISFKVWMCGGRMEDIPCSRVGHIYRKYVPYKVPAGVSLARNLKRVAEVWMDEYAEYIYQRRPEYRHLSAGDVAVQKKLRSSLNCKSFKWFMTKIAWDLPKFYPPVEPPAAAWGEIRNVGTGLCADTKHGALGSPLRLEGCVRGRGEAAWNNMQVFTFTWREDIRPGDPQHTKKFCFDAISHTSPVTLYDCHSMKGNQLWKYRKDKTLYHPVSGSCMDCSESDHRIFMNTCNPSSLTQQWLFEHTNSTVLEKFNRN

SEQ ID NO: 746592 - protein, 196 aa, Homo sapiens
ERLKVLPTAQGKLYQDDLKVNPANVSHLVSPFTWQGPGGHLKAPQWSTSSLFPFQIRNVGTGLCADTKHGALGSPLRLEGCVRGRGEAAWNNMQVFTFTWREDIRPGDPQHTKKFCFDAISHTSPVTLYDCHSMKGNQLWKYRKDKTLYHPVSGSCMDCSESDHRIFMNTCNPSSLTQQWLFEHTNSTVLEKFNRN

SEQ ID NO: 746593 - protein, 517 aa, Homo sapiens
RRLRGSPTPNPMTDAERVDQAYRENGFNIYVSDKISLNRSLPDIRHPNCNSKRYLETLPNTSIIIPFHNEGWSSLLRTVHSVLNRSPPELVAEIVLVDDFSDREHLKKPLEDYMALFPSVRILRTKKREGLIRTRMLGASVATGDVITFLDSHCEANVNWLPPLLDRIARNRKTIVCPMIDVIDHDDFRYETQAGDAMRGAFDWEMYYKRIPIPPELQKADPSDPFESPVMAGGLFAVDRKWFWELGGYDPGLEIWGGEQYEISFKVWMCGGRMEDIPCSRVGHIYRKYVPYKVPAGVSLARNLKRVAEVWMDEYAEYIYQRRPEYRHLSAGDVAVQKKLRSSLNCKSFKWFMTKIAWDLPKFYPPVEPPAAAWGEIRNVGTGLCADTKHGALGSPLRLEGCVRGRGEAAWNNMQVFTFTWREDIRPGDPQHTKKFCFDAISHTSPVTLYDCHSMKGNQLWKYRKDKTLYHPVSGSCMDCSESDHRIFMNTCNPSSLTQQWLFEHTNSTVLEKFNRN

SEQ ID NO: 746594 - protein, 517 aa, Homo sapiens; identical to SEQ ID NO: 746593

SEQ ID NO: 746595 - protein, 274 aa, Homo sapiens
MLAWRDGELEAETSSSLFLLAMQVWMCGGRMEDIPCSRVGHIYRKYVPYKVPAGVSLARNLKRVAEVWMDEYAEYIYQRRPEYRHLSAGDVAVQKKLRSSLNCKSFKWFMTKIAWDLPKFYPPVEPPAAAWGEIRNVGTGLCADTKHGALGSPLRLEGCVRGRGEAAWNNMQVFTFTWREDIRPGDPQHTKKFCFDAISHTSPVTLYDCHSMKGNQLWKYRKDKTLYHPVSGSCMDCSESDHRIFMNTCNPSSLTQQWLFEHTNSTVLEKFNRN

SEQ ID NO: 746596 - protein, 517 aa, Homo sapiens; identical to SEQ ID NO: 746593

SEQ ID NO: 746597 - protein, 648 aa, Homo sapiens
RVGAGPAPQPLLLAELLPPPGGRADARSWGRRGGAGGAAAGLTGPDEAEEKRLLQAVALVLAALVLLPNVGLWALYRERQPDGTPGGSGAAVAPAAGQGSHSRQKKTFFLGDGQKLKDWHDKEAIRRDAQRVGNGEQGRPNPMTDAERVDQAYRENGFNIYVSDKISLNRSLPDIRHPNCNSKRYLETLPNTSIIIPFHNEGWSSLLRTVHSVLNRSPPELVAEIVLVDDFSDREHLKKPLEDYMALFPSVRILRTKKREGLIRTRMLGASVATGDVITFLDSHCEANVNWLPPLLDRIARNRKTIVCPMIDVIDHDDFRYETQAGDAMRGAFDWEMYYKRIPIPPELQKADPSDPFESPVMAGGLFAVDRKWFWELGGYDPGLEIWGGEQYEISFKVWMCGGRMEDIPCSRVGHIYRKYVPYKVPAGVSLARNLKRVAEVWMDEYAEYIYQRRPEYRHLSAGDVAVQKKLRSSLNCKSFKWFMTKIAWDLPKFYPPVEPPAAAWGEIRNVGTGLCADTKHGALGSPLRLEGCVRGRGEAAWNNMQVFTFTWREDIRPGDPQHTKKFCFDAISHTSPVTLYDCHSMKGNQLWKYRKDKTLYHPVSGSCMDCSESDHRIFMNTCNPSSLTQQWLFEHTNSTVLEKFNRN

SEQ ID NO: 746598 - protein, 274 aa, Homo sapiens; identical to SEQ ID NO: 746595

SEQ ID NO: 746599 - protein, 586 aa, Homo sapiens; identical to SEQ ID NO: 746590

SEQ ID NO: 746600 - protein, 111 aa, Homo sapiens [sequence omitted]

SEQ ID NO: 746601 - protein, 122 aa, Homo sapiens
RIPAALTSTRKGVEEQLAQLRCEMEQQSQEYQILLDVKTRLEQEIATYRRLLEGEDAHLSSQQASGQSYSSREVFTSSSSSSSRQTRPDVMNNVLHLHSRPAGFVSVRIPYIDSQAHNSPLL

SEQ ID NO: 746602 - protein, 187 aa, Homo sapiens
HPFPIYPSTFSSLSQLLARSPPSSGTMTTCSRQFTSSSSMKGSCGIGGGIGGGSSRISSVLAGGSCRAPSTYGGGLSVSSSRFSSGGAYGLGGGYGGGFSSSSSSFGSGFGGGYGGGLGAGFGGGLGAGFGGGFAGGDGLLVGSEKVTMQNLNDRLASYLDKVRALEEANADLEVKIRDWYQRQRPC

SEQ ID NO: 746603 - protein, 98 aa, Homo sapiens
MSPNLHSTRSYCKTEGVASHTASGGVILPPDSARDDYLTHRCYRTRNQRASHRRGPSLRQGALHCPLWRVRPPDVARRMQPALLIPPPPGHHATVLEV

SEQ ID NO: 746604 - protein, 106 aa, Homo sapiens
RYPACCLPWMWQRSTTAGPAPLRDGAAEPGVQDPAGREDAAGAGDRPPTAACWRARTPTSPPPSSPLDRSHARDVTSSSRQIRTKVMDVHDGKVVSTHEQVLRTKN

SEQ ID NO: 746605 - protein, 93 aa, Homo sapiens
DASDWWLDGDGIESINYLGQYSHFHDIDSSFHERGMFSICLCPLLVRGDQASPDMQNLNDRLASYLDKVRALEEANADLEVKIRDWYQRQRPC

SEQ ID NO: 746606 - protein, 101 aa, Homo sapiens
GPLVIEAIDVGFHTDINGLRRVLDETDPGQELTWRCRLKEPEGGAGLPEEEPRGGDECPERPGGWRCQWTYMDNGPKWTMDLNGHMDLNGDGPKWTMDLNG

SEQ ID NO: 746607 - protein, 85 aa, Homo sapiens
MAIVALGIPLFSNYTLQTGRLGTFGEWPGSPREVVAEGPFSVSLCPDWGCYPKSLISFKGSAASSASLPWAQEGGDRDGVHPYVA

SEQ ID NO: 746608 - protein, 233 aa, Homo sapiens
GTPTRKHFPFFGEKNLLTRSSLLGTMTTCSRQFTSSSSMKGSCGIGGGIGGGSSRISSVLAGGSCRAPSTYGGGLSVSSRFSSGGACGLGGGYGGGFSSSSSFGSGFGGGYGGGLGAGFGGGLGAGFGGGFAGGDGLLVGSEKVTMQNLNDRLASYLDKVRALEEANADLEVKIRDWYQRQRPSEIKDYSPYFKTIEDLRNKIIAATIENAQPILQIDNARLAADDFRTKYET

SEQ ID NO: 746609 - protein, 233 aa, Homo sapiens; identical to SEQ ID NO: 746608

SEQ ID NO: 746610 - protein, 233 aa, Homo sapiens; identical to SEQ ID NO: 746608

SEQ ID NO: 746611 - protein, 233 aa, Homo sapiens; identical to SEQ ID NO: 746608

SEQ ID NO: 746612 - protein, 233 aa, Homo sapiens; identical to SEQ ID NO: 746608

SEQ ID NO: 746613 - protein, 233 aa, Homo sapiens; identical to SEQ ID NO: 746608

SEQ ID NO: 746614 - protein, 233 aa, Homo sapiens; identical to SEQ ID NO: 746608

SEQ ID NO: 746615 - protein, 233 aa, Homo sapiens; identical to SEQ ID NO: 746608

SEQ ID NO: 746616 - protein, 233 aa, Homo sapiens; identical to SEQ ID NO: 746608

SEQ ID NO: 746617 - protein, 380 aa, Homo sapiens
RVVPARNFGIVSFFQPTAHSLTSLLGTMTTCSRQFTSSSSMKGSCGIGGGIGGGSSRISSVLAGGSCRAPSTYGGGLSVSSRFSSGGACGLGGGYGGGFSSSSSFGSGFGGGYGGGLGAGFGGGLGAGFGGGFAGGDGLLVGSEKVTMQNLNDRLASYLDKVRALEEANADLEVKIRDWYQRQRPSEIKDYSPYFKTIEDLRNKIIAATIENAQPILQIDNARLAADDFRTKYEHELALRQTVEADVNGLRRVLDELTLARTDLEMQIEGLKEELAYLRKNHEEEMLALRGQTGGDVNVEMDAAPGVDLSRILNEMRDQYEQMAEKNRRDAETWFLSKTEELNREVATNSELVQSGKQRDLGAPDAPCRTWRLSCSPSSA

SEQ ID NO: 746618 - protein, 233 aa, Homo sapiens; identical to SEQ ID NO: 746608

SEQ ID NO: 746619 - protein, 403 aa, Homo sapiens
RVVPARNFGIVSFFQPTAHSLTSLLGTMTTCSRQFTSSSSMKGSCGIGGGIGGGSSRISSVLAGGSCRAPSTYGGGLSVSSRFSSGGACGLGGGYGGGFSSSSSFGSGFGGGYGGGLGAGFGGGLGAGFGGGFAGGDGLLVGSEKVTMQNLNDRLASYLDKVRALEEANADLEVKIRDWYQRQRPSEIKDYSPYFKTIEDLRNKHLRNPGGKTKREFFPFPNKGPPNQRVGGTKCHMPILQIDNARLAADDFRTKYEHELALRQTVEADVNGLRRVLDELTLARTDLEMQIEGLKEELAYLRKNHEEEMLALRGQTGGDVNVEMDAAPGVDLSRILNEMRDQYEQMAEKNRRDAETWFLSKTEELNREVATNSELVQSGKQRDLGAPDAPCRTWRLSCSPSSA

SEQ ID NO: 746620 - protein, 232 aa, Homo sapiens
MAVASAAAAALVVASGEDMVVALVLASVVAWVLALVASEIKDYSPYFKTIEDLRNKIIAATIENAQPILQIDNARLAADDFRTKYEHELALRQTVEADVNGLRRVLDELTLARTDLEMQIEGLKEELAYLRKNHEEEMLALRGQTGGDVNVEMDAAPGVDLSRILNEMRDQYEQMAEKNRRDAETWFLSKTEELNREVATNSELVQSGKQRDLGAPDAPCRTWRLSCSPSSA

SEQ ID NO: 746621 - protein, 500 aa, Homo sapiens
RVVPARNFGIVSFFQPTAHSLTSLLGTMTTCSRQFTSSSSMKGSCGIGGGIGGGSSRISSVLAGGSCRAPSTYGGGLSVSSRFSSGGACGLGGGYGGGFSSSSSFGSGFGGGYGGGLGAGFGGGLGAGFGGGFAGGDGLLVGSEKVTMQNLNDRLASYLDKVRALEEANADLEVKIRDWYQRQRPSEIKDYSPYFKTIEDLRNKIIAATIENAQPILQIDNARLAADDFRTKYEHELALRQTVEADVNGLRRVLDELTLARTDLEMQIEGLKEELAYLRKNHEEEMLALRGQTGGDVNVEMDAAPGVDLSRILNEMRDQYEQMAEKNRRDAETWFLSKTEELNKEVASNSELVQSSRSEVTELRRVLQGLEIELQSQLSMKASLENSLEETKGRYCMQLSQIQGLIGSVEEQLAQLRCEMEQQSQEYQILLDVKTRLEQEIATYRRLLEGEDAHLSSQQASGQSYSSREVFTSSSSSSSRQTRPILKEQSSSSFSQGQSS

SEQ ID NO: 746622 - protein, 500 aa, Homo sapiens; identical to SEQ ID NO: 746621

SEQ ID NO: 746623 - protein, 500 aa, Homo sapiens; identical to SEQ ID NO: 746621

SEQ ID NO: 746624 - protein, 500 aa, Homo sapiens; identical to SEQ ID NO: 746621

SEQ ID NO: 746625 - protein, 233 aa, Homo sapiens; identical to SEQ ID NO: 746608

SEQ ID NO: 746626 - protein, 233 aa, Homo sapiens; identical to SEQ ID NO: 746608

SEQ ID NO: 746627 - protein, 500 aa, Homo sapiens; identical to SEQ ID NO: 746621

SEQ ID NO: 746628 - protein, 233 aa, Homo sapiens; identical to SEQ ID NO: 746608

SEQ ID NO: 746629 - protein, 233 aa, Homo sapiens; identical to SEQ ID NO: 746608

SEQ ID NO: 746630 - protein, 233 aa, Homo sapiens; identical to SEQ ID NO: 746608

SEQ ID NO: 746631 - protein, 233 aa, Homo sapiens; identical to SEQ ID NO: 746608

SEQ ID NO: 746632 - protein, 600 aa, Homo sapiens
RVVPARNFGIVSFFQPTAHSLTSLLGTMTTCSRQFTSSSSMKGSCGIGGGIGGGSSRISSVLAGGSCRAPSTYGGGLSVSSRFSSGGACGLGGGYGGGFSSSSSFGSGFGGGYGGGLGAGFGGGLGAGFGGGFAGGDGLLVGSEKVTMQNLNDRLASYLDKVRALEEANADLEVKIRDWYQRQRPSEIKDYSPYFKTIEDLRNKIIAATIENAQPILQIDNARLAADDFRTKYEHELALRQTVEADVNGLRRVLDELTLARTDLEMQIEGLKEELAYLRKNHEEEMLALRGQTGGDVNVEMDAAPGVDLSRILNEMRDQYEQMAEKNRRDAETWFLSKTEELNKEVASNSELVQSSRSEVTELRRVLQGLEIELQSQLSMDEGPSTAAAPKSPVMATTPSKSHSLVPPFFSQDGTRDSWDRYIDRETKPWNSGLAFLHIVWPISTPTGIKIQASLKKHAQRPGGTGVTTSMDSFSLSHLQKASLENSLEETKGRYCMQLSQIQGLIGSVEEQLAQLRCEMEQQSQEYQILLDVKTRLEQEIATYRRLLEGEDAHLSSQQASGQSYSSREVFTSSSSSSSRQTRPILKEQSSSSFSQGQSS

SEQ ID NO: 746633 - protein, 233 aa, Homo sapiens; identical to SEQ ID NO: 746608

SEQ ID NO: 746634 - protein, 233 aa, Homo sapiens; identical to SEQ ID NO: 746608

SEQ ID NO: 746635 - protein, 233 aa, Homo sapiens; identical to SEQ ID NO: 746608

SEQ ID NO: 746636 - protein, 381 aa, Homo sapiens
RVVPARNFGIVSFFQPTAHSLTSLLGTMTTCSRQFTSSSSMKGSCGIGGGIGGGSSRISSVLAGGSCRAPSTYGGGLSVSSRFSSGGACGLGGGYGGGFSSSSSFGSGFGGGYGGGLGAGFGGGLGAGFGGGFAGGDGLLVGSEKVTMQNLNDRLASYLDKVRALEEANADLEVKIRDWYQRQRPSEIKDYSPYFKTIEDLRNKIIAATIENAQPILQIDNARLAADDFRTKYEHELALRQTVEADVNGLRRVLDELTLARTDLEMQIEGLKEELAYLRKNHEEEMLALRGQTGGDVNVEMDAAPGVDLSRILNEMRDQYEQMAEKNRRDAETWFLSKTEELNKEVASNSELVQSSRSEVTELRRVLQGLEIELQSQLSMV

SEQ ID NO: 746637 - protein, 233 aa, Homo sapiens; identical to SEQ ID NO: 746608

SEQ ID NO: 746638 - protein, 233 aa, Homo sapiens; identical to SEQ ID NO: 746608

SEQ ID NO: 746639 - protein, 512 aa, Homo sapiens
MVPARNFGIVSFFQPTAHSLTSLLGTMTTCSRQFTSSSSMKGSCGIGGGIGGGSSRISSVLAGGSCRAPSTYGGGLSVSSRFSSGGACGLGGGYGGGFSSSSSFGSGFGGGYGGGLGAGFGGGLGAGFGGGFAGGDGLLVGSEKVTMQNLNDRLASYLDKVRALEEANADLEVKIRDWYQRQRPSEIKDYSPYFKTIEDLRNKIIAATIENAQPILQIDNARLAADDFRTKYEHELALRQTVEADVNGLRRVLDELTLARTDLEMQIEGLKEELAYLRKNHEEEMLALRGQTGGDVNVEMDAAPGVDLSRILNEMRDQYEQMAEKNRRDAETWFLSKTEELNKEVASNSELVQSSRSEVTELRRVLQGLEIELQSQLSMKASLENSLEETKGRYCMQLSQIQGLIGSVEEQLAQLRCEMEQQSQEYQILLDVKTRLEQEIATYRRLLEGEDAHLSSQQASGQSYSSREVFTSSSSSSSRQTRPILKEQSSSSFSQGQTASTTASCPPAGLTS

SEQ ID NO: 746640 - protein, 340 aa, Homo sapiens
RVVPARNFGIVSFFQPTAHSLTSLLGTMTTCSRQFTSSSSMKGSCGIGGGIGGGSSRISSVLAGGSCRAPSTYGGGLSVSSRFSSGGACGLGGGYGGGFSSSSSFGSGFGGGYGGGLGAGFGGGLGAGFGGGFAGGDGLLVGSEKVTMQNLNDRLASYLDKVRALEEANADLEVKIRDWYQRQRPLPRQYHAERIENMREEIIAATIENAQPILQSQLSMKASLENSLEETKGRYCMQLSQIQGLIGSVEEQLAQLRCEMEQQSQEYQILLDVKTRLEQEIATYRRLLEGEDAHLSSQQASGQSYSSREVFTSSSSSSSRQTRPILKEQSSSSFSQGQSS

SEQ ID NO: 746641 - protein, 473 aa, Homo sapiens
RVVPARNFGIVSFFQPTAHSLTSLLGTMTTCSRQFTSSSSMKGSCGIGGGIGGGSSRISSVLAGGSCRAPSTYGGGLSVSSRFSSGGACGLGGGYGGGFSSSSSFGSGFGGGYGGGLGAGFGGGLGAGFGGGFAGGDGLLVGSEKVTMQNLNDRLASYLDKVRALEEANADLEVKIRDWYQRQRPSEIKDYSPYFKTIEDLRNKIIAATIENAQPILQIDNARLAADDFRTKYEHELALRQTVEADVNGLRRVLDELTLARTDLEMQIEGLKEELAYLRKNHEEEMLALRGQTGGDVNVEMDAAPGVDLSRILNEMRDQYEQMAEKNRRDAETWFLSKTEELNREVATNSELVQSGKQRDLGAPDAPCRTWRLSCSPSSAWSGIVPGRVVHPGLAGRERPHSLIVDSLSLPHRKHPWRTAWRRPKVATALQLAQIQETDWQRGGAYLQVLHGARSSEISLFPLHQLAVGATSR

SEQ ID NO: 746642 - protein, 233 aa, Homo sapiens; identical to SEQ ID NO: 746608

SEQ ID NO: 746643 - protein, 299 aa, Homo sapiens
RVVPARNFGIVSFFQPTAHSLTSLLGTMTTCSRQFTSSSSMKGSCGIGGGIGGGSSRISSVLAGGSCRAPSTYGGGLSVSSRFSSGGACGLGGGYGGGFSSSSSFGSGFGGGYGGGLGAGFGGGLGAGFGGGFAGGDGLLVGSEKVTMQNLNDRLASYLDKVRALEEANADLEVKIRDWYQRQRPSEIKDYSPYFKTIEDLRNKIIAATIENAQPILQIDNARLAADDFRTKYEHELALRQTVEADVNGLRRVLDELTLARTDLEMQIEGLKEELAYLRKNHEELKRSDPGKMVTAEDW

SEQ ID NO: 746644 - protein, 214 aa, Homo sapiens
RVVPARNFGIVSFFQPTAHSLTSLLGTMTTCSRQFTSSSSMKGSCGIGGGIGGGSSRISSVLAGGSCRAPSTYGGGLSVSSRFSSGGACGLGGGYGGGFSSSSSFGSGFGGGYGGGLGAGFGGGLGAGFGGGFAGGDGLLVGSEKVTMQNLNDRLASYLDKVRALEEANADLEVKIRDWYQRQRPSEIKDYSPYFKTIEDLRNKIMTVKEIRLH

SEQ ID NO: 746645 - protein, 157 aa, Homo sapiens
MVGWGQRARDKEWGGPPSRASRPRASESSGLQPEDLTSVLARYEHELALRQTVEADVNGLRRVLDELTLARTDLEMQIEGLKEELAYLRKNHEEGTVAAGFRGGRLVWWGCQMHPGPGEKSAELTASCHPFPGDACSERSDRRRCERGDGCCTWRGP

SEQ ID NO: 746646 - protein, 505 aa, Homo sapiens
RPVPAPSAHRPPPVSEPRDLQVLRPRLRAGPAWWLSGGARGSSGTCGVRGRRGPERSPARETWTETRPATTRGLRMKPSLLCRPLSCFLMLLPWPLATLTSTTLWQCPPGEEPDLDPGQGTLCRPCPPGTFSAAWGSSPCQPHARCSLWRRLEAQVGMATRDTLCGDCWPGWFGPWGVPRVPCQPCSWAPLGTHGCDEWGRRARRGVEVAAGASSGGETRQPGNGTRAGGPEETAAQYAVIAIVPVFCLMGLLGILVCNLLKRKGYHCTAHKEVGPGPGGGGSGINPAYRTEDANEDTIGVLVRLITEKKENAAALEELLKEYHSKQLVQTSHRPVSKLPPAPPNVPHICPHRHHLHTVQGLASLSGPCCSRCSQKKWPEVLLSPEAVAATTPVPSLLPNPTRVPKAGAKAGRQGEITILSVGRFRVARIPEQRTSSMVSEVKTITEAGPSWGDLPDSPQPGLPPEQQALLGSGGSRTKWLKPPAENKAEENRYVVRLSESNLVI

SEQ ID NO: 746647 - protein, 485 aa, Homo sapiens
GSAHLPGPAGDSFKRRAGCAAVRALAEPGRGAESNGEPSWSCRGAARPATTRGLRMKPSLLCRPLSCFLMLLPWPLATLTSTTLWQCPPGEEPDLDPGQGTLCRPCPPGTFSAAWGSSPCQPHARCSLWRRLEAQVGMATRDTLCGDCWPGWFGPWGVPRVPCQPCSWAPLGTHGCDEWGRRARRGVEVAAGASSGGETRQPGNGTRAGGPEETAAQYAVIAIVPVFCLMGLLGILVCNLLKRKGYHCTAHKEVGPGPGGGGSGINPAYRTEDANEDTIGVLVRLITEKKENAAALEELLKEYHSKQLVQTSHRPVSKLPPAPPNVPHICPHRHHLHTVQGLASLSGPCCSRCSQKKWPEVLLSPEAVAATTPVPSLLPNPTRVPKAGAKAGRQGEITILSVGRFRVARIPEQRTSSMVSEVKTITEAGPSWGDLPDSPQPGLPPEQQALLGSGGSRTKWLKPPAENKAEENRYVVRLSESNLVI

SEQ ID NO: 746648 - protein, 285 aa, Homo sapiens
MKVIWASLSLDPTFAGALGGLSPKCTCSGPLRRPGLPSAGRSWFSSGVRLPPLPQDSGPFFSPGINPAYRTEDANEDTIGVLVRLITEKKENAAALEELLKEYHSKQLVQTSHRPVSKLPPAPPNVPHICPHRHHLHTVQGLASLSGPCCSRCSQKKWPEVLLSPEAVAATTPVPSLLPNPTRVPKAGAKAGRQGEITILSVGRFRVARIPEQRTSSMVSEVKTITEAGPSWGDLPDSPQPGLPPEQQALLGSGGSRTKWLKPPAENKAEENRYVVRLSESNLVI

SEQ ID NO: 746649 - protein, 485 aa, Homo sapiens; identical to SEQ ID NO: 746647

SEQ ID NO: 746650 - protein, 485 aa, Homo sapiens; identical to SEQ ID NO: 746647

SEQ ID NO: 746651 - protein, 161 aa, Homo sapiens
VCAPSRPSRRFIQKARRLRGCPGARRAGPRRRVERGAELELPRRSQAGDHQGPEDEAKSAVPAPVLLPYAAALASRHPDINNPLAVPTWGGARPGPRAGHIMQALPPRHLLSCMGLQPMPAPCPLQPLEEAGGPGGHGNSRYTLWRLLAWVSQRECGEGSW

SEQ ID NO: 746652 - protein, 303 aa, Homo sapiens
MPVAAFGGGWRPRWAWQLEIHSVETAGLGINPAYRTEDANEDTIGVLVRLITEKKENAAALEELLKEYHSKQLVQTSHRPVSKCVGWWEITGPKPTLTSLPPGDLPLGSPSSHPVPCWGLLPLAWPMATSACAPCRLPPAPPNVPHICPHRHHLHTVQGLASLSGPCCSRCSQKKWPEVLLSPEAVAATTPVPSLLPNPTRVPKAGAKAGRQGEITILSVGRFRVARIPEQRTSSMVSEVKTITEAGPSWGDLPDSPQPGLPPEQQALLGSGGSRTKWLKPPAENKAEENRYVVRLSESNLVI

SEQ ID NO: 746653 - protein, 245 aa, Homo sapiens
RPVPAPSAHRPPPVSEPRDLQVLRPRLRAGPAWWLSGGARGSSGTCGVRGRRGPERSPARETLDRDQAGDHQGPEDEAKSAVPAPVLLPYAAALASRHPDINNPLAVPTWGGARPGPRAGHIMQALPPRHLLSCMGLQPMPAPCPLQPLEEAGGPGGHGNSRYTLWRLLAWVVWALGGSPRSMSTMFGGETRQPGNGTRAGGPEETAAQYAVIAIVPVFCLSILFLLFIETHHCPILVSPPPSMC

SEQ ID NO: 746654 - protein, 146 aa, Homo sapiens
TVTSFPRSTGRGACQAQPCLLIPPHRRRRNVFTSFFSVAKGACFQGVVLYGVWVLTRERFLAGVPVRCHFPFWLLEPGSFFILYLRGQSFLITLHPLAREVPATRSKVLSRHSGPARLAGGLRSSPGLLPEEPGWGCLLANAANKK

SEQ ID NO: 746655 - protein, 114 aa, Homo sapiens
QLLGSSSLPTSASQVAGTPGISQCIIEPICSTCLDWGTSAASVSLQNTGKHSTHRSLWSRHSTQMRIPQLQEILQKEVRELPGDAQVLRGLSDVIASSCGCCDLCPVFVSLISL

SEQ ID NO: 746656 - protein, 37 aa, Homo sapiens
MGAPFCHLLIEPRGCCDCESCCPVCCLLARPTQWGHQ

SEQ ID NO: 746657 - protein, 108 aa, Homo sapiens
QIWRHALPDFKLYYKAIVTKTTWYWLKNRHIDQWNRTEKPEINPKTYSQLIFNKANKNIKWGKDITFSKCCWYNWQATCGRMKLDPHLSPYTKINAKRIKDLNLRTKL

SEQ ID NO: 746658 - protein, 246 aa, Homo sapiens
SGLSRGSAAGGRALGRPWPGRRVACVGSAGDSGGSGAGGACATAWVCEMAADISESSGADCKGDPRNSAKLDADYPLRVLYCGVCSLPTEYCEYMPDVAKCRQWLEKNFPNEFAKLTVENSPKQEAGISEGQGTAGEEEEKKKQKRGGRGQIKQKKKTVPQKVTIAKIPRAKKKYVTRVCGLATFEIDLKEAQRFFAQKFSCGASVTGEDEIIIQGDFTDDIIDVIQEKWPEVDDDSIEDLGEVKK

SEQ ID NO: 746659 - protein, 246 aa, Homo sapiens; identical to SEQ ID NO: 746658

SEQ ID NO: 746660 - protein, 976 aa, Homo sapiens
SVSRSMLFVFLKAIMMLGDAKIGNNSVSSLKNDDFTMRGLRCDGNADDIWTASQNPKSCGKSISIETANLREYARYVLRTICQQEWVGEHCLKEPERLCTDKELILDPVLSNMQAQKLLQLICYPHGIKECTEGDNLQRQHIKRILQNLEQWTLRQSWLELQLMIKQCLKDPGSGSVAEMNNLLDNIAKATIEVFQQSADLNNSSNSGMSLFNPNSIGSADTSSTRQNGIKTFLSSSERRGVWLVAPLIARLPTSVQGRVLKAAGEELEKGQHLGSSSKKERDRQKQKSMSLLSQQPFLSLVLTCLKGQDEQREGLLTSLQNQVNQILSNWREERYQDDIKARQMMHEALQLRLNLVGGMFDTVQRSTQWTTDWALLLLQIITSGTVDMHTNNELFTTVLDMLGVLINGTLASDLSNASPGGSEENKRAYMNLVKKLKKELGDKRSESIDKVRQLLPLPKQTCDVITCEPMGSLIDTKGNKIAGFDSIDKKQGLQVSTKQKVSPWDLFEGQKNPAPLSWAWFGTVRVDRRVIKYEEQHHLLLYHTHPMPKPRSYYLQPLPLPPEEEEEEPTSPVSQEPERKSAELSDQGKTTTDEEKKTKGRKRKTKSSSRVDEYPQSNIYRVPPNYSPISSQMMHHPQSTLWGYNLVGQPQQPGFFLQNQSLTPGGSRLDPAGSFVPTNTKQALSNMLQRRSGAMMQPPSLHAITSQQQLIQMKLLQQQQQQRLLRQAQTRPFQQGQPGDQAALFAAQARPSPQLPQYPGLQQAQTMPQGYTMYGTQMPLQQTSQQQAGSVVLSPSYNSRAYPAAHSNPVLMERLRQIQQQPSGYVQQQASPYLQPLTGSQRLNHQALQQSPLVGGGIDAVLTSAHPNLPSVPLPQDPMRPRQPQVRQQQRLLQMQQPQQPQPQQPPQPQQSSQSQSQTLGLQAMQPQQPLFPRQGLQQTQQQQQTAALVRQLQKQLSSNQPQQGVTPYGHPSHF

SEQ ID NO: 746661 - protein, 1435 aa, Homo sapiens
FSVFQDESSSHECNQRTILLYGVGKERDEARHQLKKITKDILKILNKKSTTETGVGDEGQKARKNKQETFPTLETVFTKLQLLSYFDQHQVTSQISNNVLEQITSFASGTSYHLPLAHHIQLIFDLMEPALNINGLIDFAIQLLNELSVVEAELLLKSSSLAGSYTTGLCVCIVAVLRRYHSCLILNPDQTAQVFEGLCGVVKHVVNPSECSSPERCILAYLYDLYVSCSHLRSKFGDLFSSACSKVKQTIYNNVMPANSNLRWDPDFMMDFIENPSARSINYSMLGKILSDNAANRYSFVCNTLMNVCMGHQDAGRINDIANFSSELTACCTVLSSEWLGVLKALCCSSNHVWGFNDVLCTVDVSDLSFHDSLATFIAILIARQCFSLEDVVQHVALPSLLAAACGDADAEPGARMTCRLLLHLFRAPQACFLPQATGKPFPGIRSSCDRHLLAAAHNSIEVGAVFAVLKAIMMLGDAKIGNNSVSSLKNDDFTMRGLRCDGNADDIWTASQNPKSCGKSISIETANLREYARYVLRTICQQEWVGEHCLKEPERLCTDKELILDPVLSNMQAQKLLQLICYPHGIKECTEGDNLQRQHIKRILQNLEQWTLRQSWLELQLMIKQCLKDPGSGSVAEMNNLLDNIAKATIEVFQQSADLNNSSNSGMSLFNPNSIGSADTSSTRQNGIKTFLSSSERRGVWLVAPLIARLPTSVQGRVLKAAGEELEKGQHLGSSSKKERDRQKQKSMSLLSQQPFLSLVLTCLKGQDEQREGLLTSLQNQVNQILSNWREERYQDDIKARQMMHEALQLRLNLVGGMFDTVQRSTQWTTDWALLLLQIITSGTVDMHTNNELFTTVLDMLGVLINGTLASDLSNASPGGSEENKRAYMNLVKKLKKELGDKRSESIDKVRQLLPLPKQTCDVITCEPMGSLIDTKGNKIAGFDSIDKKQGLQVSTKQKVSPWDLFEGQKNPAPLSWAWFGTVRVDRRVIKYEEQHHLLLYHTHPMPKPRSYYLQPLPLPPEEEEEEPTSPVSQEPERKSAELSDQGKTTTDEEKKTKGRKRKTKSSSRVDEYPQSNIYRVPPNYSPISSQMMHHPQSTLWGYNLVGQPQQPGFFLQNQSLTPGGSRLDPAGSFVPTNTKQALSNMLQRRSGAMMQPPSLHAITSQQQLIQMKLLQQQQQQRLLRQAQTRPFQQGQPGDQAALFAAQARPSPQLPQYPGLQQAQTMPQGYTMYGTQMPLQQTSQQQAGSVVLSPSYNSRAYPAAHSNPVLMERLRQIQQQPSGYVQQQASPYLQPLTGSQRLNHQALQQSPLVGGGIDAVLTSAHPNLPSVPLPQDPMRPRQPQVRQQQRLLQMQQPQQPQPQQPPQPQQSSQSQSQTLGLQAMQPQQPLFPRQGLQQTQQQQQTAALVRQLQKQLSSNQPQQGVTPYGHPSHF

SEQ ID NO: 746662 - protein, 291 aa, Homo sapiens
MIPIQLTVFFMIIYVLESLTIIVQSSLIVAVLGREWLQVRRLMPVDMILISLGISRFCLQWASMLNNFCSYFNLNYVLCNLTITWEFFNILTFWLNSLLTVFYCIKVSSFTHHIFLWLRWRILRLFPWILLGSLMITCVTIIPSAIGNYIQIQLLTMEHLPRNSTVTDKLENFHQYQFQAHTVALVIPFILFLASTIFLMASLTKQIQHHSTGHCNPSMKARFTALRSLAVLFIVFTSYFLTILITIIGTLFDKRCWLWVWEAFVYAFILMHSTSLMLSSPTLKRILKGKC

SEQ ID NO: 746663 - protein, 109 aa, Homo sapiens
KTLQSKLGTPPGFTYEIELSLFSLLITLLSPHPQVSSLRSGNMPYLLLYLQGPAQCGPSEALNNHLLNDSICHRISEGKTGPFRFVECFQAFLSTSHLIYMERTSRDCY

SEQ ID NO: 746664 - protein, 114 aa, Homo sapiens
RQENHLNLGGGGCSEPRSYHCTPAWVTERDSVSKKKKTQKPTNKQNKTPMQLKLIDNWVKKERQLNRKQTVGLKQKWLKIARSRQFSQELLSRKQSLGKSKKNPTQSNLPFISR

SEQ ID NO: 746665 - protein, 129 aa, Homo sapiens
HSFIHSFIKGKRLGDRAFRKRVFVFSPGRVMALPGRRSRPARAQSWRRVAVGRRDFRVGGILNAAMAQTVQNVTLSLTLPITCHICLGKVMGDCGHSYKTGLDKSLAGAEGRLVRGRGRGVRRGDGRKR

SEQ ID NO: 746666 - protein, 752 aa, Homo sapiens
HSFIHSFIKGKRLGDRAFRKRVFVFSPGRVMALPGRRSRPARAQSWRRVAVRQPVICINNHVFCSICIDLWLKNNSQCPACRVPITPENPCKEIIGGTSESEPMLSHTVRKHLRKTRLELLHKEYEDEIDCLQKEVEELKSKNLSLESQIKTILDPLTLVQGNQNEDKHLVTDNPSKINPETVAEWKKKLRTANEIYEKVKDDVDKLKEANKKLKLENGGLVRENLRLKAEVDNRSPQKFGRFAVAALQSKVEQYERETNRLKKALERSDKYIEELESQVAQLKNSSEEKEAMNSICQTALSADGKGSKGSEEDVVSKNQGDSARKQPGSSTSSSSHLAKPSSSRLCDTSSARQESTSKADLNCSKNKDLYQEQVEVMLDVTDTSMDTYLEREWGNKPSDCVPYKDEELYDLPAPCTPLSLSCLQLSTPENRESSVVQAGGSKKHSNHLRKLVFDDFCDSSNVSNKDSSEDDISRSENEKKSECFSSPKTGFWDCCSTSYAQNLDFESSEGNTIANSVGEISSKLSEKSGLCLSKRLNSIRSFEMNRTRTSSEASMDAAYLDKISELDSMMSESDNSKSPCNNGFKSLDLDGLSKSSQGSEFLEEPDKLEEKTELNLSKGSLTNDQLENGSEWKPTSFFLLSPSDQEMNEDFSLHSSSCPVTNEIKPPSCLFQTEFSQGILLSSSHRLFEDQRFGSSLFKMSSEMHSLHNHLQSPWSTSFVPEKRNKNVNQSTKRKIQSSLSSASPSKATKS

SEQ ID NO: 746667 - protein, 791 aa, Homo sapiens
HSFIHSFIKGKRLGDRAFRKRVFVFSPGRVMALPGRRSRPARAQSWRRVAVGRRDFRVGGILNAAMAQTVQNVTLSLTLPITCHICLGKVRQPVICINNHVFCSICIDLWLKNNSQCPACRVPITPENPCKEIIGGTSESEPMLSHTVRKHLRKTRLELLHKEYEDEIDCLQKEVEELKSKNLSLESQIKTILDPLTLVQGNQNEDKHLVTDNPSKINPETVAEWKKKLRTANEIYEKVKDDVDKLKEANKKLKLENGGLVRENLRLKAEVDNRSPQKFGRFAVAALQSKVEQYERETNRLKKALERSDKYIEELESQVAQLKNSSEEKEAMNSICQTALSADGKGSKGSEEDVVSKNQGDSARKQPGSSTSSSSHLAKPSSSRLCDTSSARQESTSKADLNCSKNKDLYQEQVEVMLDVTDTSMDTYLEREWGNKPSDCVPYKDEELYDLPAPCTPLSLSCLQLSTPENRESSVVQAGGSKKHSNHLRKLVFDDFCDSSNVSNKDSSEDDISRSENEKKSECFSSPKTGFWDCCSTSYAQNLDFESSEGNTIANSVGEISSKLSEKSGLCLSKRLNSIRSFEMNRTRTSSEASMDAAYLDKISELDSMMSESDNSKSPCNNGFKSLDLDGLSKSSQGSEFLEEPDKLEEKTELNLSKGSLTNDQLENGSEWKPTSFFLLSPSDQEMNEDFSLHSSSCPVTNEIKPPSCLFQTEFSQGILLSSSHRLFEDQRFGSSLFKMSSEMHSLHNHLQSPWSTSFVPEKRNKNVNQSTKRKIQSSLSSASPSKATKS

SEQ ID NO: 746668 - protein, 791 aa, Homo sapiens; identical to SEQ ID NO: 746667

SEQ ID NO: 746669 - protein, 276 aa, Homo sapiens
HSFIHSFIKGKRLGDRAFRKRVFVFSPGRVMALPGRRSRPARAQSWRRVAVGRRDFRVGGILNAAMAQTVQNVTLSLTLPITCHICLGKVRQPVICINNHVFCSICIDLWLKNNSQCPACRVPITPENPCKEIIGGTSESEPMLSHTVRKHLRKTRLELLHKEYEDEIDCLQKEVEELKSKNLSLESQIKTILDPLTLVQGNQNEDKHLVTDNPSKINPETVAEWKKKLRTANEIYEKVKDDVDKLKERNKNVNQSTKRKIQSSLSSASPSKATKS

SEQ ID NO: 746670 - protein, 387 aa, Homo sapiens
MPTTIEREFEELDTQRRWQPLYLEIRNESHDYPHRVAKFPENRNRNRYRDVSPYDHSRVKLQNAENDYINASLVDIEEAQRSYILTQGPLPNTCCHFWLMVWQQKTKAVVMLNRIVEKESVKCAQYWPTDDQEMLFKETGFSVKLLSEDVKSYYTVHLLQLENINSGETRTISHFHYTTWPDFGVPESPASFLNFLFKVRESGSLNPDHGPAVIHCSAGIGRSGTFSLVDTCLVLMEKGDDINIKQVLLNMRKYRMGLIQTPDQLRFSYMAIIEGAKCIKGDSSIQKRWKELSKEDLSPAFDHSPNKIMTEKYNGNRIGLEEEKLTGDRCTGLSSKMQDTMEENSESALRKRIREDRKATTAQKVQQMKQRLNENERKRKRPRLTDT

SEQ ID NO: 746671 - protein, 415 aa, Homo sapiens
MPTTIEREFEELDTQRRWQPLYLEIRNESHDYPHRVAKFPENRNRNRYRDVSPYDHSRVKLQNAENDYINASLVDIEEAQRSYILTQGPLPNTCCHFWLMVWQQKTKAVVMLNRIVEKESVKCAQYWPTDDQEMLFKETGFSVKLLSEDVKSYYTVHLLQLENINSGETRTISHFHYTTWPDFGVPESPASFLNFLFKVRESGSLNPDHGPAVIHCSAGIGRSGTFSLVDTCLVLMEKGDDINIKQVLLNMRKYRMGLIQTPDQLRFSYMAIIEGAKCIKGDSSIQKRWKELSKEDLSPAFDHSPNKIMTEKYNGNRIGLEEEKLTGDRCTGLSSKMQDTMEENSESALRKRIREDRKATTAQKVQQMKQRLNENERKRKRWLYWQPILTKMGFMSVILVGAFVGWTLFFQQNAL

SEQ ID NO: 746672 - protein, 282 aa, Homo sapiens
LRLGTRPVLNRPRVEDVKSYYTVHLLQLENINSGETRTISHFHYTTWPDFGVPESPASFLNFLFKVRESGSLNPDHGPAVIHCSAGIGRSGTFSLVDTCLVLMEKGDDINIKQVLLNMRKYRMGLIQTPDQLRFSYMAIIEGAKCIKGDSSIQKRWKELSKEDLSPAFDHSPNKIMTEKYNGNRIGLEEEKLTGDRCTGLSSKMQDTMEENSESALRKRIREDRKATTAQKVQQMKQRLNENERKRKRTRLTDTNIHDLSNMATRLSPSTIRRLLIYELDVC

SEQ ID NO: 746673 - protein, 410 aa, Homo sapiens
MPTTIEREFEELDTQRRWQPLYLEIRNESHDYPHRVAKFPENRNRNRYRDVSPYDHSRVKLQNAENDYINASLVDIEEAQRSYILTQGPLPNTCCHFWLMVWQQKTKAVVMLNRIVEKESVKCAQYWPTDDQEMLFKETGFSVKLLSEDVKSYYTVHLLQLENINYIENLWITLYLKLLMLDVKRSLKSGETRTISHFHYTTWPDFGVPESPASFLNFLFKVRESGSLNPDHGPAVIHCSAGIGRSGTFSLVDTCLVLMEKGDDINIKQVLLNMRKYRMGLIQTPDQLRFSYMAIIEGAKCIKGDSSIQKRWKELSKEDLSPAFDHSPNKIMTEKYNGNRIGLEEEKLTGDRCTGLSSKMQDTMEENSESALRKRIREDRKATTAQKVQQMKQRLNENERKRKRPRLTDT

SEQ ID NO: 746674 - protein, 156 aa, Homo sapiens
GKQNGSGNSAIAILMARSSEDGYGTIPSPISVIGSQAYMAIIEGAKCIKGDSSIQKRWKELSKEDLSPAFDHSPNKIMTEKYNGNRIGLEEEKLTGDRCTGLSSKMQDTMEENSESALRKRIREDRKATTAQKVQQMKQRLNENERKRKRPRLTDT

SEQ ID NO: 746675 - protein, 387 aa, Homo sapiens; identical to SEQ ID NO: 746670

SEQ ID NO: 746676 - protein, 305 aa, Homo sapiens
MPTTIEREFEELDTQRRWQPLYLEIRNESHDYPHRVAKFPENRNRNRYRDVSPYDHSRVKLQNAENDYINASLVDIEEAQRSYILTQGPLPNTCCHFWLMVWQQKTKAVVMLNRIVEKESVKCAQYWPTDDQEMLFKETGFSVKLLSEDVKSYYTVHLLQLENINSGETRTISHFHYTTWPDFGVPESPASFLNFLFKVRESGSLNPDHGPAVIHCSAGIGRSGTFSLVDTCLVLMEKGDDINIKQVLLNMRKYRMGLIQTPDQLRFSYMAIIEGAKCIKGDSSIQVNFIQVLNHIYLLNTHSIK

SEQ ID NO: 746677 - protein, 80 aa, Homo sapiens
ERNDSLKLHRYTALRKRIREDRKATTAQKVQQMKQRLNENERKRKRWLYWQPILTKMGFMSVILVGAFVGWTLFFQQNAL

SEQ ID NO: 746678 - protein, 379 aa, Homo sapiens
MPYGCSIPRWQPVYLEIRNESHDYPHRVAKFPENRNRNRYRDVSPYDHSRVKLQNAENDYINASLVDIEEAQRSYILTQGPLPNTCCHFWLMVWQQKTKAVVMLNRIVEKESVKCAQYWPTDDQEMLFKETGFSVKLLSEDVKSYYTVHLLQLENINSGETRTISHFHYTTWPDFGVPESPASFLNFLFKVRESGSLNPDHGPAVIHCSAGIGRSGTFSLVDTCLVLMEKGDDINIKQVLLNMRKYRMGLIQTPDQLRFSYMAIIEGAKCIKGDSSIQKRWKELSKEDLSPAFDHSPNKIMTEKYNGNRIGLEEEKLTGDRCTGLSSKMQDTMEENSESALRKRIREDRKATTAQKVQQMKQRLNENERKRKRPRLTDT

SEQ ID NO: 746679 - protein, 248 aa, Homo sapiens
SRVQTICHFSLPSSWDYRHAPLCPDKSGETRTISHFHYTTWPDFGVPESPASFLNFLFKVRESGSLNPDHGPAVIHCSAGIGRSGTFSLVDTCLVLMEKGDDINIKQVLLNMRKYRMGLIQTPDQLRFSYMAIIEGAKCIKGDSSIQKRWKELSKEDLSPAFDHSPNKIMTEKYNGNRIGLEEEKLTGDRCTGLSSKMQDTMEENSESALRKRIREDRKATTAQKVQQMKQRLNENERKRKRPRLTDT

SEQ ID NO: 746680 - protein, 415 aa, Homo sapiens
MPTTIEREFEELDTQRRWQPLYLEIRNESHDYPHRVAKFPENRNRNRYRDVSPYDHSRVKLQNAENDYINASLVDIEEAQRSYILTQGPLPNTCCHFWLMVWQQKTKAVVMLNRIVEKESVKCAQYWPTDDQEMLFKETGFSVKLLSEDVKSYYTVHLLQLENINSGETRTISHFHYTTWPDFGVPESPASFLNFLFKVRESGSLNPDHGPAVIHCSAGIGRSGTFSLVDTCLVLMEKGDDINIKQVLLNMRKYRMGLIQTPDQLRFSYMAIIEGAKCIKGDSSIQKRWKELSKEDLSPAFDHSPNKIMTEKYNGNRIGLEEEKLTGDRCTGLSSKMQDTMEENSESALRKRIREDRKATTAQKVQQMKQRLNENERKRKRTRLTDTNIHDLSNMATRLSPSTIRRLLIYELDVC

SEQ ID NO: 746681 - protein, 215 aa, Homo sapiens
LAISRRRQRLLEERHGADQARWSKPQRESGSGREVVWGEGRRQSRGGAGCGPFWRTLIECPKLPGMCVDPSSLRSPAGVKLHTCLHSTLPVPKRAHRRRKNGCQHLPTMVQESVTFKDVAILFTQEEWGQLSPAQRALYRDVMLENYSNLVSLGLLGPKPDTFSQLEKREVWMPEDTPGGFCLDGVSLCYQAGACSEPRSRHCTPAWATEQDFIS

SEQ ID NO: 746682 - protein, 230 aa, Homo sapiens
LAISRRRQRLLEERHGADQARWSKPQRESGSGREVVWGEGRRQSRGGAGCGPFWRTLIECPKLPGMCVDPSSLRSPAGVKLHTCLHSTLPVPKRAHRRRKNGCQHLPTMVQESVTFKDVAILFTQEEWGQLSPAQRALYRDVMLENYSNLVSLGLLGPKPDTFSQLEKREVWMPEDTPGGFCLDWMTMPASKKSTVKAEIPEEELDQWTIKERFSSSSHWKCASLLEWQC

SEQ ID NO: 746683 - protein, 1353 aa, Homo sapiens
MLDPSSSEEESDEIVEEESGKEVLGSAPSGARLSPSRTSEGSAGSAGLGGGGAGAGAGVGAGGGGGSGASSGGGAGGLQPSSRAGGGRPSSPSPSVVSEKEKEELERLQKEEEERKKRLQLYVFVMRCIAYPFNAKQPTDMARRQQKISKQQLQTVKDRFQAFLNGETQIMADEAFMNAVQSYYEVFLKSDRVARMVQSGGCSANDSREVFKKHIEKRVRSLPEIDGLSKETVLSSWMAKFDAIYRGEEDPRKQQARMTASAASELILSKEQLYEMFQNILGIKKFEHQLLYNACQLDNPDEQAAQIRRELDGRLQMADQIARERKFPKFVSKEMENMYIEELKSSVNLLMANLESMPVSKGGEFKLQKLKRSHNASIIDMGEESENQLSKSDVVLSFSLEVVIMEVQGLKSLAPNRIVYCTMEVEGGEKLQTDQAEASKPTWGTQGDFSTTHALPAVKVKLFTESTGVLALEDKELGRVILHPTPNSPKQSEWHKMTVSKNCPDQDLKIKLAVRMDKPQNMKHSGYLWAIGKNVWKRWKKRFFVLVQVSQYTFAMCSYREKKAEPQELLQLDGYTVDYTDPQPGLEGGRAFFNAVKEGDTVIFASDDEQDRILWVQAMYRATGQSHKPVPPTQVQKLNAKGGNVPQLDAPISQFYADRAQKHGMDEFISSNPCNFDHASLFEMVQRLTLDHRLNDSYSCLGWFSPGQVFVLDEYCARNGVRGCHRHLCYLRDLLERAENGAMIDPTLLHYSFAFCASHVHGNRPDGIGTVTVEEKERFEEIKERLRVLLENQITHFRYCFPFGRPEGAVKATLSLVERVLMKDIVTPVPQEEVKTVIRKCLEQAALVNYSRLSEYAKIEENQKDAENVGRLITPAKKLEDTIRLAELVIEVLQQNEEHHAEPHVDKGEAFAWWSDLMVEHAETFLSLFAVDMDAALEVQPPDTWDSFPLFQLLNDFLRTDYNLCNGKFHKHLQDLFAPLVVRYVDLMESSIAQSIHRGFERESWEPVKSLTSNLPNVNLPNVNLPKVPNLPVNIPLGIPQMPTFSAPSWMAAIYDADNGSGTSEDLFWKLDALQTFIRDLHWPEEEFGKHLEQRLKLMASDMIESCVKRTRIAFEVKLQKTSRSTDFRVPQSICTMFNVMVDAKAQSTKLCSMEMGQEHQYHSKIDELIEETVKEMITLLVAKFVTILEGVLAKLSRYDEGTLFSSFLSFTVKAASKYVDVPKPGMDVADAYVTFVRHSQDVLRDKVNEEMYIERLFDQWYNSSMNVICTWLTDRMDLQLHIYQLKTLIRMVKKTYRDFRLQGVLDSTLNSKTYETIRNRLTVEEATASVSEGGGLQGISMKDSDEEDEEDD

SEQ ID NO: 746684 - protein, 512 aa, Homo sapiens
GSEATLSLLERVLMKDIVTPVPQEEVKTVIRKCLEQAALVNYSRLSEYAKIEGKKREMYEHPVFCLASQVMDLTIQNQKDAENVGRLITPAKKLEDTIRLAELVIEVLQQNEEHHAEAFAWWSDLMVEHAETFLSLFAVDMDAALEVQPPDTWDSFPLFQLLNDFLRTDYNLCNGKFHKHLQDLFAPLVVRYVDLMESSIAQSIHRGFERESWEPVNNGSGTSEDLFWKLDALQTFIRDLHWPEEEFGKHLEQRLKLMASDMIESCVKRTRIAFEVKLQKTSRSTDFRVPQSICTMFNVMVDAKAQSTKLCSMEMGQEHQYHSKIDELIEETVKEMITLLVAKFVTILEGVLAKLSRYDEGTLFSSFLSFTVKAASKYVDVPKPGMDVADAYVTFVRHSQDVLRDKVNEEMYIERLFDQWYNSSMNVICTWLTDRMDLQLHIYQLKTLIRMVKKTYRDFRLQGVLDSTLNSKTYETIRNRLTVEEATASVSEGGGLQGISMKDSDEEDEEDD

SEQ ID NO: 746685 - protein, 806 aa, Homo sapiens
GPQRRQDKESRSGMVPSFFGLCDKGDVEFICVEDQGLLGGVRVPVSLVKQLEEPGSNVHRDSHDDANDGPQLNDGPQLNDGPQLNDGPQLNDGPQLNDGPQLNDGPQLDAPISQFYADRAQKHGMDEFISSNPCNFDHASLFEMVQRLTLDHRLNDSYSCLGWFSPGQVFVLDEYCARNGVRGCHRHLCYLRDLLERAENGAMIDPTLLHYSFAFCASHVHGNRPDGIGTVTVEEKERFEEIKERLRVLLENQITHFRYCFPFGRPEGAVKATLSLVERVLMKDIVTPVPQEEVKTVIRKCLEQAALVNYSRLSEYAKIEENQKDAENVGRLITPAKKLEDTIRLAELVIEVLQQNEEHHAEAFAWWSDLMVEHAETFLSLFAVDMDAALEVQPPDTWDSFPLFQLLNDFLRTDYNLCNGKFHKHLQDLFAPLVVRYVDLMESSIAQSIHRGFERESWEPVKSLTSNLPNVNLPNVNLPKVPNLPVNIPLGIPQMPTFSAPSWMAAIYDADNGSGTSEDLFWKLDALQTFIRDLHWPEEEFGKHLEQRLKLMASDMIESCVKRTRIAFEVKLQKTSRSTDFRVPQSICTMFNVMVDAKAQSTKLCSMEMGQEHQYHSKIDELIEETVKEMITLLVAKFVTILEGVLAKLSRYDEGTLFSSFLSFTVKAASKYVDVPKPGMDVADAYVTFVRHSQDVLRDKVNEEMYIERLFDQWYNSSMNVICTWLTDRMDLQLHIYQLKTLIRMVKKTYRDFRLQGVLDSTLNSKTYETIRNRLTVEEATASVSEGGGLQGISMKDSDEEDEEDD

SEQ ID NO: 746686 - protein, 434 aa, Homo sapiens
MDAENVGRLITPAKKLEDTIRLAELVIEVLQQNEEHHAEAFAWWSDLMVEHAETFLSLFAVDMDAALEVQPPDTWDSFPLFQLLNDFLRTDYNLCNGKFHKHLQDLFAPLVVRYVDLMESSIAQSIHRGFERESWEPVNNGSGTSEDLFWKLDALQTFIRDLHWPEEEFGKHLEQRLKLMASDMIESCVKRTRIAFEVKLQKTSRSTDFRVPQSICTMFNVMVDAKAQSTKLCSMEMGQEHQYHSKIDELIEETVKEMITLLVAKFVTILEGVLAKLSRYDEGTLFSSFLSFTVKAASKYVDVPKPGMDVADAYVTFVRHSQDVLRDKVNEEMYIERLFDQWYNSSMNVICTWLTDRMDLQLHIYQLKTLIRMVKKTYRDFRLQGVLDSTLNSKTYETIRNRLTVEEATASVSEGGGLQGISMKDSDEEDEEDD

SEQ ID NO: 746687 - protein, 138 aa, Homo sapiens
MFSCFFTEKPGMDVADAYVTFVRHSQDVLRDKVNEEMYIERLFDQWYNSSMNVICTWLTDRMDLQLHIYQLKTLIRMVKKTYRDFRLQGVLDSTLNSKTYETIRNRLTVEEATASVSEGGGLQGISMKDSDEEDEEDD

SEQ ID NO: 746688 - protein, 720 aa, Homo sapiens
MENMYIEELKSSVNLLMANLESMPVSKGGEFKLQKLKRSHNASIIDMGEESENQLSKSDVVLSFSLEVVIMEVQGLKSLAPNRIVYCTMEVEGGEKLQTDQAEASKPTWGTQGDFSTTHALPAVKVKLFTESTGVLALEDKELGRVILHPTPNSPKQSEWHKMTVSKNCPDQDLKIKLAVRMDKPQNMKHSGYLWAIGKNVWKRWKKRFFVLVQVSQYTFAMCSYREKKAEPQELLQLDGYTVDYTDPQPGLEGGRAFFNAVKEGDTVIFASDDEQDRILWVQAMYRATGQSHKPVPPTQVQKLNAKGGNVPQLDAPISQFYADRAQKHGMDEFISSNPCNFDHASLFEMVQRLTLDHRLNDSYSCLGWFSPGQVFVLDEYCARNGVRGCHRHLCYLRDLLERAENGAMIDPTLLHYSFAFCASHVHGNRPDGIGTVTVEEKERFEEIKERLRVLLENQITHFRYCFPFGRPEGAVKATLSLVERVLMKDIVTPVPQEEVKTVIRKCLEQAALVNYSRLSEYAKIEENQKDAENVGRLITPAKKLEDTIRLAELVIEVLQQNEEHHAEAFAWWSDLMVEHAETFLSLFAVDMDAALEVQPPDTWDSFPLFQLLNDFLRTDYNLCNGKFHKHLQDLFAPLVVRYVDLMESSIAQSIHRGFERESWEPVNNGSGTSEDLFWKLDALQTFIRDLHWPEEEFGKHLEQRLKLMASDMIESCVKR

SEQ ID NO: 746689 - protein, 483 aa, Homo sapiens
MENMYIEELKSSVNLLMANLESMPVSKGGEFKLQKLKRSHNASIIDMGEESENQLSKSDVVLSFSLEVVIMEVQGLKSLAPNRIVYCTMEVEGGEKLQTDQAEASKPTWGTQGDFSTTHALPAVKVKLFTESTGVLALEDKELGRVILHPTPNSPKQSEWHKMTVSKNCPDQDLKIKLAVRMDKPQNMKHSGYLWAIGKNVWKRWKKRFFVLVQVSQYTFAMCSYREKKAEPQELLQLDGYTVDYTDPQPGLEGGRAFFNAVKEGDTVIFASDDEQDRILWVQAMYRATGQSHKPVPPTQVQKLNAKGGNVPQLDAPISQFYADRAQKHGMDEFISSNPCNFDHASLFEMVQRLTLDHRLNDSYSCLGWFSPGQVFVLDEYCARNGVRGCHRHLCYLRDLLERAENGAMIDPTLLHYSFAFCASHVHGNSQQMHVYLSGLPPNTDPEGSKTPSPPEPEAKKDTKKESKKRKDSKTQANQELKR

SEQ ID NO: 746690 - protein, 457 aa, Homo sapiens
MLDPSSSEEESDEIVEEESGKEVLGSAPSGARLSPSRTSEGSAGSAGLGGGGAGAGAGVGAGGGGGSGASSGGGAGGLQPSSRAGGGRPSSPSPSVVSEKEKEELERLQKEEEERKKRLQLYVFVMRCIAYPFNAKQPTDMARRQQKISKQQLQTVKDRFQAFLNGETQIMADEAFMNAVQSYYEVFLKSDRVARMVQSGGCSANDSREVFKKHIEKRVRSLPEIDGLSKETVLSSWMAKFDAIYRGEEDPRKQQARMTASAASELILSKEQLYEMFQNILGIKKFEHQLLYNACQLDNPDEQAAQIRRELDGRLQMADQIARERKFPKFVSKEMENMYIEELKSSVNLLMANLESMPVSKGGEFKLQKLKRSHNASIIDMGEESENQLSKSDVVLSFSLEVVIMEVQGLKSLAPNRIVYCTMEVEGGEKLQTDQAEASKPTVIRRNRREQLPHSAI

SEQ ID NO: 746691 - protein, 434 aa, Homo sapiens; identical to SEQ ID NO: 746686

SEQ ID NO: 746692 - protein, 1012 aa, Homo sapiens
MENMYIEELKSSVNLLMANLESMPVSKGGEFKLQKLKRSHNASIIDMGEESENQLSKSDVVLSFSLEVVIMEVQGLKSLAPNRIVYCTMEVEGGEKLQTDQAEASKPTWGTQGDFSTTHALPAVKVKLFTESTGVLALEDKELGRVILHPTPNSPKQSEWHKMTVSKNCPDQDLKIKLAVRMDKPQNMKHSGYLWAIGKNVWKRWKKRFFVLVQVSQYTFAMCSYREKKAEPQELLQLDGYTVDYTDPQPGLEGGRAFFNAVKEGDTVIFASDDEQDRILWVQAMYRATGQSHKPVPPTQVQKLNAKGGNVPQLDAPISQFYADRAQKHGMDEFISSNPCNFDHASLFEMVQRLTLDHRLNDSYSCLGWFSPGQVFVLDEYCARNGVRGCHRHLCYLRDLLERAENGAMIDPTLLHYSFAFCASHVHGNRPDGIGTVTVEEKERFEEIKERLRVLLENQITHFRYCFPFGRPEGAVKATLSLVERVLMKDIVTPVPQEEVKTVIRKCLEQAALVNYSRLSEYAKIEENQKDAENVGRLITPAKKLEDTIRLAELVIEVLQQNEEHHAEAFAWWSDLMVEHAETFLSLFAVDMDAALEVQPPDTWDSFPLFQLLNDFLRTDYNLCNGKFHKHLQDLFAPLVVRYVDLMESSIAQSIHRGFERESWEPVKSLTSNLPNVNLPNVNLPKVPNLPVNIPLGIPQMPTFSAPSWMAAIYDADNGSGTSEDLFWKLDALQTFIRDLHWPEEEFGKHLEQRLKLMASDMIESCVKRTRIAFEVKLQKTSRSTDFRVPQSICTMFNVMVDAKAQSTKLCSMEMGQEHQYHSKIDELIEETVKEMITLLVAKFVTILEGVLAKLSRYDEGTLFSSFLSFTVKAASKYVDVPKPGMDVADAYVTFVRHSQDVLRDKVNEEMYIERLFDQWYNSSMNVICTWLTDRMDLQLHIYQLKTLIRMVKKTYRDFRLQGVLDSTLNSKTYETIRNRLTVEEATASVSEGGGLQGISMKDSDEEDEEDD

SEQ ID NO: 746693 - protein, 416 aa, Homo sapiens
MDAENVGRLITPAKKLEDTIRLAELVIEVLQQNEEHHAEAFAWWSDLMVEHAETFLSLFAVDMDAALEVQPPDTWDSFPLFQLLNDFLRTDYNLCNGKFHKHLQDLFAPLVVRYVDLMESSIAQSIHRGFERESWEPVNNGSGTSEDLFWKLDALQTFIRDLHWPEEEFGKHLEQRLKLMASDMIESCVKRTRIAFEVKLQKTSRSTDFRVPQSICTMFNVMVDAKAQSTKLCSMEMGQEHQYHSKIDELIEETVKEMITLLVAKFVTILEGVLAKLSRYDEGTLFSSFLSFTVKAASKYVDVPKPGMDVADAYVTFVRHSQDVLRDKVNEEMYIERLFDQWYNSSMNVICTWLTDRMDLQLHIYQLKTLIRMVKKTYETIRNRLTVEEATASVSEGGGLQGISMKDSDEEDEEDD

SEQ ID NO: 746694 - protein, 177 aa, Homo sapiens
MITLLVAKFVTILEGVLAKLSRYDEGTLFSSFLSFTVKAASKYVDVPKPGMDVADAYVTFVRHSQDVLRDKVNEEMYIERLFDQWYNSSMNVICTWLTDRMDLQLHIYQLKTLIRMVKKTYRDFRLQGVLDSTLNSKTYETIRNRLTVEEATASVSEGGGLQGISMKDSDEEDEEDD

SEQ ID NO: 746695 - protein, 525 aa, Homo sapiens
MENMYIEELKSSVNLLMANLESMPVSKGGEFKLQKLKRSHNASIIDMGEESENQLSKSDVVLSFSLEVVIMEVQGLKSLAPNRIVYCTMEVEGGEKLQTDQAEASKPTWGTQGDFSTTHALPAVKVKLFTESTGVLALEDKELGRVILHPTPNSPKQSEWHKMTVSKNCPDQDLKIKLAVRMDKPQNMKHSGYLWAIGKNVWKRWKKRFFVLVQVSQYTFAMCSYREKKAEPQELLQLDGYTVDYTDPQPGLEGGRAFFNAVKEGDTVIFASDDEQDRILWVQAMYRATGQSHKPVPPTQVQKLNAKGGNVPQLDAPISQFYADRAQKHGMDEFISSNPCNFDHASLFEMVQRLTLDHRLNDSYSCLGWFSPGQVFVLDEYCARNGVRGCHRHLCYLRDLLERAENGAMIDPTLLHYSFAFCASHVHGNSQQMHVYLSGLPPNTDPEGSKTPSPPEPEAKKDTKKESKKRKDSKTQANQELKRPDGIGTVTVEEKERFEEIKERLRVLLENQITHFRYRLSIWST

SEQ ID NO: 746696 - protein, 274 aa, Homo sapiens
MLHHHCRRNPELQEELQIQAAVAAGDVHTVRKMLEQGYSPNGRDANGWTLLHFSAARGKERCVRVFLEHGADPTVKDLIGGFTALHYAAMHGRARIARLMLESEYRSDIINAKSNDGWTPLHVAAHYGRDSFVRLLLEFKAEVDPLSDKGTTPLQLAIIRERSSCVKILLDHNANIDIQNGFLLRYAVIKSNHSYCRMFLQRGADTNLGRLEDGQTPLHLSALRDDVLCARMLYNYGADTNTRNYEGQTPLAVSISISGSSRPCLDFLQEVTSM

SEQ ID NO: 746697 - protein, 318 aa, Homo sapiens
MLHHHCRRNPELQEELQIQAAVAAGDVHTVRKMLEQGYSPNGRDANGWTLLHFSAARGKERCVRVFLEHGADPTVKDLIGGFTALHYAAMHGRARIARLMLESEYRSDIINAKSNDGWTPLHVAAHYGRDSFVRLLLEFKAEVDPLSDKGTTPLQLAIIRERSSCVKILLDHNANIDIQNGFLLRYAVIKSNHSYCRMFLQRGADTNLGRLEDGQTPLHLSALRDDVLCARMLYNYGADTNTRNYEGQTPLAVSISISGSSRPCLDFLQEVTRQPRNLQDLCRIKIRQCIGLQNLKLLDELPIAKVMKDYLKHKFDDI

SEQ ID NO: 746698 - protein, 318 aa, Homo sapiens; identical to SEQ ID NO: 746697

SEQ ID NO: 746699 - protein, 318 aa, Homo sapiens
MVNQSSTPGFLLLGFSEHPGLERTLFVVVFTSYLLTLVGNTLIILLSALDPKLHSPMYFFLSNLSFLDLCFTTSCVPQMLVNLWGPKKTISFLDCSVQIFIFLSLGTTECILLTVMAFDRYVAVCQPLHYATIIHPRLCWQLASVAWVIGLVESVVQTPSTLHLPFCPDRQVDDFVCEVPALIRLSCEDTSYNEIQVAVASVFILVVPLSLILVSYGAITWAVLRINSAKGRRKAFGTCSSHLTVVTLFYSSVIAVYLQPKNPYAQERGKFFGLFYAVGTPSLNPLIYTLRNKEVTRAFRRLLGKEMGLHTKLRESCL

SEQ ID NO: 746700 - protein, 122 aa, Homo sapiens
VKSLIDTGQPQHVGDGVITQIYLTEGLEALPAGRLSKALEDRRDWSAEWGGIEGKMEIEPERAPNARTCSSPRIRSSRRTRPKTSRWGTPKSLEEQHPHDPLCSFRQKDLLPLFVQLFVFLK

SEQ ID NO: 746701 - protein, 446 aa, Homo sapiens
AATPRALECEPIVARRLKGQYPSEPFNMAEDVSSAAPSPRGCADGRDADPTEEQMAETERNDEEQFECQELLECQVQVGAPEEEEEEEEDAGLVAEAEAVAAGWMLDFLCLSLCRAFRDGRSEDFRRTRNSAEAIIHGLSSLTACQLRTIYICQFLTRIAAGKTLDAQFENDERITPLESALMIWGSIEKEHDKLHEEIQNLIKIQAIAVCMENGNFKEAEEVFERIFGDPNSHMPFKSKLLMIISQKDTFHSFFQHFSYNHMMEKIKSYVNYVLSEKSSTFLMKAAAKVVESKRTRTITSQDKPSGNDVEMETEANLDTRKRSHKNLFLSKLQHGTQQQDLNKKERRVGTPQSTKKKKESRRATESRIPVSKSQPVTPEKHRARKRQAWLWEEDKNLRSGVRKYGEGNWSKILLHYKFNNRTSVMLKDRWRTMKKLKLISSDSED

SEQ ID NO: 746702 - protein, 466 aa, Homo sapiens
AATPRALECEPIVARRLKGQYPSEPFNMAEDVSSAAPSPRGCADGRDADPTEEQMAETERNDEEQFECQELLECQVQVGAPEEEEEEEEDAGLVAEAEAVAAGWMLDFLCLSLCRAFRDGRSEDFRRTRNSAEAIIHGLSSLTACQLRTIYICQFLTRIAAGKTLDAQFENDERITPLESALMIWGSIEKEHDKLHEEIQNLIKIQAIAVCMENGNFKEAEEVFERIFGDPNSHMPFKSKLLMIISQKDTFHSFFQHFSYNHMMEKIKSYVNYVLSEKSSTFLMKAAAKVVESKRTRTITSQDKPSGNDVEMETEANLDTRKSVSDKQSAVTESSEGTVSLLRSHKNLFLSKLQHGTQQQDLNKKERRVGTPQSTKKKKESRRATESRIPVSKSQPVTPEKHRARKRQAWLWEEDKNLRSGVRKYGEGNWSKILLHYKFNNRTSVMLKDRWRTMKKLKLISSDSED

SEQ ID NO: 746703 - protein, 471 aa, Homo sapiens
AATPRALECEPIVARRLKGQYPSEPFNMAEDVSSAAPSPRGCADGRDADPTEEQMAETERNDEEQFECQELLECQVQVGAPEEEEEEEEDAGLVAEAEAVAAGWMLDFLCLSLCRAFRDGRSEDFRRTRNSAEVKTFMGAETGYLKSSPPNTGWQEMFTIIHGLSSLTACQLRTIYICQFLTRIAAGKTLDAQFENDERITPLESALMIWGSIEKEHDKLHEEIQNLIKIQAIAVCMENGNFKEAEEVFERIFGDPNSHMPFKSKLLMIISQKDTFHSFFQHFSYNHMMEKIKSYVNYVLSEKSSTFLMKAAAKVVESKRTRTITSQDKPSGNDVEMETEANLDTRKRSHKNLFLSKLQHGTQQQDLNKKERRVGTPQSTKKKKESRRATESRIPVSKSQPVTPEKHRARKRQAWLWEEDKNLRSGVRKYGEGNWSKILLHYKFNNRTSVMLKDRWRTMKKLKLISSDSED

SEQ ID NO: 746704 - protein, 446 aa, Homo sapiens; identical to SEQ ID NO: 746701

SEQ ID NO: 746705 - protein, 272 aa, Homo sapiens
MEPSNKTLIKIQAIAVCMENGNFKEAEEVFERIFGDPNSHMPFKSKLLMIISQKDTFHSFFQHFSYNHMMEKIKSYVNYVLSEKSSTFLMKAAAKVVESKRTRTITSQDKPSGNDVEMETEANLDTRKSVSDKQSAVTESSEGTVSLLRSHKNLFLSKLQHGTQQQDLNKKERRVGTPQSTKKKKESRRATESRIPVSKSQPVTPEKHRARKRQAWLWEEDKNLRSGVRKYGEGNWSKILLHYKFNNRTSVMLKDRWRTMKKLKLISSDSED

SEQ ID NO: 746706 - protein, 384 aa, Homo sapiens
AATPRALECEPIVARRLKGQYPSEPFNMAEDVSSAAPSPRGCADGRDADPTEEQMAETERNDEEQFECQELLECQVQVGAPEEEEEEEEDAGLVAEAEAVAAGWMLDFLCLSLCRAFRDGRSEDFRRTRNSAEAIIHGLSSLTACQLRTIYICQFLTRIAAGKTLDAQFENDERITPLESALMIWGSIEKEHDKLHEEIQNLIKIQAIAVCMENGNFKEAEEVFERIFGDPNSHMPFKSKLLMIISQKDTFHSFFQHFSYNHMMEKIKSYVNYVLSEKSSTFLMKAAAKVVESKRTRTITSQDKPSGNDVEMETEANLDTRKRSHKNLFLSKLQHGTQQQDLNKKERRVGTPQITYICLTKLTMNKKEGVRKGLCFLVLLKHYR

SEQ ID NO: 746707 - protein, 108 aa, Homo sapiens
SAGTVTVATTAAVEFPGDQGTRETGRKEKTQGSGPLSQNPGDPFPVTRCFSWSPRAHSCSPLDIELYLVQAGDTRVRDMANSPQPWWHFKLWSSTPFYLLLVNSQRPQ

SEQ ID NO: 746708 - protein, 628 aa, Homo sapiens
MALRARALYDFRSENPGEISLREHEVLSLCSEQDIEGWLEGVNSRGDRGLFPASYVQVIRAPEPGPAGDGGPGAPARYANVPPGGFEPLPVAPPASFKPPPDAFQALLQPQQAPPPSTFQPPGAGFPYGGGALQPSPQQLYGGYQASQGSDDDWDDEWDDSSTVADEPGALGSGAYPDLDGSSSAGVGAAGRYRLSTRSDLSLGSRGGSVPPQHHPSGPKSSATVSRNLNRFSTFVKSGGEAFVLGEASGFVKDGDKLCVVLGPYGPEWQENPYPFQCTIDDPTKQTKFKGMKSYISYKLVPTHTQVPVHRRYKHFDWLYARLAEKFPVISVPHLPEKQATGRFEEDFISKRRKGLIWWMNHMASHPVLAQCDVFQHFLTCPSSTDEKAWKQGKRKAEKDEMVGANFFLTLSTPPAAALDLQEVESKIDGFKCFTKKMDDSALQLNHTANEFARKQVTGFKKEYQKVGQSFRGLSQAFELDQQAFSVGLNQAIAFTGDAYDAIGELFAEQPRQDLDPVMDLLALYQGHLANFPDIIHVQKGKAWPLEQVIWSVLCRLKGATLTAVPLWVSDSYSTGEEASRDVDAWVFSLECKLDCSTGSFLLEYLALGNEYSFSKVQRVPLMTVLSF

SEQ ID NO: 746709 - protein, 122 aa, Homo sapiens
EMGSCPGTQAGLELLTSGDPPAWASQSAGITGVSHCARLVCACCIKFGKSFFAARHVVLINTVVYLSIMWYISSDIYFQYLLDYKGRLLRSCFLIIFGVIGPQGFKRRLDCALHVGFIHCPN

SEQ ID NO: 746710 - protein, 169 aa, Homo sapiens
MRECNGVILAHCSLRLLGSSNSPVSASRVAGITGACHHAQLISVFLVETGFHHIGQAGLELLTSGDPPAWASQSAGITGVSHCARLVCACCIKFGKSFFAARHVVLINTVVYLSIMWYISSDIYFQYLLDYKGRLLRSCFLIIFGVIGPQGFKRRLDCALHVGFIHCPN

SEQ ID NO: 746711 - protein, 317 aa, Homo sapiens
MSKSLKKLVEESREKNQPEVDMSDRGISNMLDVNGLFTLSHITQLVLSHNKLTMVPPNIAELKNLEVLNFFNNQIEELPTQISSLQKLKHLNLGMNRLNTLPRGFGSLPALEVLDLTYNNLSENSLPGNFFYLTTLRALYLSDNDFEILPPDIGKLTKLQILSLRDNDLISLPKEIGELTQLKELHIQGNRLTVLAPELGNLDLTGQKQVFKAENNPWVTPIADQFQLGRVPCFEYIRSETYKSSTADHMQANQKPPKHDTDKSKTDQPENPGSQNRLGRDGIGGFQHLLFSDDYLSWPVSIIPCACSRYYHNHLRS

SEQ ID NO: 746712 - protein, 268 aa, Homo sapiens
GAETGRVRCSVPVLQGVRAAGVRSAEACGCTPIVLGATFRVTLSHITQLVLSHNKLTMVPPNIAELKNLEVLNFFNNQIEELPTQISSLQKLKHLNLGMNRLNTLPRGFGSLPALEVLDLTYNNLSENSLPGNFFYLTTLRALYLSDNDFEILPPDIGKQVFKAENNPWVTPIADQFQLGRVPCFEYIRSETYKSSTADHMQANQKPPKHDTDKSKTDQPENPGSHDSLGRDGIGGFQHLLFSDDYLSWPVSIIPCACSRYYHNHLRS

SEQ ID NO: 746713 - protein, 299 aa, Homo sapiens
MSKSLKKLVEESREKNQPEVDMSDRGISNMLDVNGLFTLSHITQLVLSHNKLTMVPPNIAELKNLEVLNFFNNQIEELPTQISSLQKLKHLNLGMNRLNTLPRGFGSLPALEVLDLTYNNLSVSDNDFEILPPDIGKLTKLQILSLRDNDLISLPKEIGELTQLKELHIQGNRLTVLAPELGNLDLTGQKQVFKAENNPWVTPIADQFQLGRVPCFEYIRSETYKSSTGDHMQANQKPPKHDSDKSKKDQPENPGSQNSLGRDGIAGFQHLLFSHDYLTWPVSIIPCACSRYYHNHLRS

SEQ ID NO: 746714 - protein, 318 aa, Homo sapiens
GAETGRVRCSVPVLQGVRAAGVRSAEACGCTPIVLGATFRVTLSHITQLVLSHNKLTMVPPNIAELKNLEVLNFFNNQIEELPTQISSLQKLKHLNLGMNRLNTLPRGFGSLPALEVLDLTYNNLSENSLPGNFFYLTTLRALYLSDNDFEILPPDIGKLTKLQILSLRDNDLISLPKEIGELTQLKELHIQGNRLTVLAPELGNLDLTGQKQVFKAENNPWVTPIADQFQLGRVPCFEYIRSETYKSSTADHMQANQKPPKHDTDKSKTDQPENPGSQNRLGRDGIGGFQHLLFSDIISLGRFQLSHVPVAVITITT

SEQ ID NO: 746715 - protein, 303 aa, Homo sapiens
GAETGRVRCSVPVLQGVRAAGVRSAEACGCTPIVLGATFRVTLSHITQLVLSHNKLTMVPPNIAELKNLEVLNFFNNQIEELPTQISSLQKLKHLNLGMNRLNTLPRGFGSLPALEVLDLTYNNLSVSDNDFEILPPDIGKLTKLQILSLRDNDLISLPKEIGELTQLKELHIQGNRLTVLAPELGNLDLTGQKQVFKAENNPWVTPIADQFQLGRVPCVEYIRSETYKSSTGDHMQANQKPPKHDTDKSKTDQPENPGSQNRLGRDGIGGFQHLLFSDDYLSWPVSIIPCACSRYYHNHLRS

SEQ ID NO: 746716 - protein, 478 aa, Homo sapiens
MDTSDLFASCRKGDVGRVRYLLEQRDVEVNVRDKWDSTPLYYACLCGHEELVLYLLANGARCEANTFDGERCLYGALSDPIRRALRDYKQVTASCRRRDYYDDFLQRLLEQGIHSDVVFVVHGKPFRVHRCVLGARSAYFANMLDTKWKGKSVVVLRHPLINPVAFGALLQYLYTGRLDIGVEHVSDCERLAKQCQLWDLLSDLEAKCEKVSEFVASKPGTCVKVLTIEPPPADPRLREDMALLADCALPPELRGDLWELPFPCPDGFNSCPDICFRVAGCSFLCHKAFFCGRSDYFRALLDDHFRESEEPATSGGPPAVTLHGISPDVFTHVLYYMYSDHTELSPEAAYDVLSVADMYLLPGLKRLCGRSLAQMLDEDTVVGVWRVAKLFRLARLEDQCTEYMAKVIEKLVEREDFVEAVKEEAAAVAARQETDSIPLVDDIRFHVASTVQTYSAIEEAQQRLRALEDLLVSIGLDC

SEQ ID NO: 746717 - protein, 498 aa, Homo sapiens
RAGRGGAERVYIRRVRGFAARGRSARVPSSAPWTPATCSPAAGRGMWAECGTCWSSETWRYYACLCGHEELVLYLLANGARCEANTFDGERCLYGALSDPIRRALRDYKQVTASCRRRDYYDDFLQRLLEQGIHSDVVFVVHGKPFRVHRCVLGARSAYFANMLDTKWKGKSVVVLRHPLINPVAFGALLQYLYTGRLDIGVEHVSDCERLAKQCQLWDLLSDLEAKCEKVSEFVASKPGTCVKVLTIEPPPADPRLREDMALLADCALPPELRGDLWELPFPCPDGFNSCPDICFRVAGCSFLCHKAFFCGRSDYFRALLDDHFRESEEPATSGGPPAVTLHGISPDVFTHVLYYMYSDHTELSPEAAYDVLSVADMYLLPGLKRLCGRSLAQMLDEDTVVGVWRVAKLFRLARLEDQCTEYMAKVIEKLVEREDFVEAVKEEAAAVAARQETDSIPLVDDIRFHVASTVQTYSAIEEAQQRLRALEDLLVSIGLDC

SEQ ID NO: 746718 - protein, 104 aa, Homo sapiens
RAGRGGAERVYIRRVRGFAARGRSARVPSSAPWTPATCSPAAGRGMWAECDHEPVLTQALTSFLPRYLLEQRDVEVLCLLVWARGAGTLPSGQWSPLRGQHLRW

SEQ ID NO: 746719 - protein, 206 aa, Homo sapiens
ERGGAGLSVFTSAGCAASPPEVVRLGYHPPRHGHQRPVRQLQEGGCGPSAVRTSQPGEGAGGGRPRNASGPGTGGWAAAERRAPLPGHSPRSAPAGQTTRTPAAAPQRKRAGAGTLMAIDPRRASCKKGLLSGGPKAQKWAERRRATVRPGRARTSDPPGAGRGYRPGTPDVAPFSRALWTWRGEHLEPIIGLRSLRIRKLLTQLK

SEQ ID NO: 746720 - protein, 336 aa, Homo sapiens
MLDTKWKGKSVVVLRHPLINPVAFGALLQYLYTGRLDIGVEHVSDCERLAKQCQLWDLLSDLEAKCEKVSEFVASKPGTCVKVLTIEPPPADPRLREDMALLADCALPPELRGDLWELPFPCPDGFNSCPDICFRVAGCSFLCHKAFFCGRSDYFRALLDDHFRESEEPATSGGPPAVTLHGISPDVFTHVLYYMYSDHTELSPEAAYDVLSVADMYLLPGLKRLCGRSLAQMLDEDTVVGVWRVAKLFRLARLEDQCTEYMAKVIEKLVEREDFVEAVKEEAAAVAARQETDSIPLVDDIRFHVASTVQTYSAIEEAQQRLRALEDLLVSIGLDC

SEQ ID NO: 746721 - protein, 336 aa, Homo sapiens; identical to SEQ ID NO: 746720

SEQ ID NO: 746722 - protein, 508 aa, Homo sapiens
MDTSDLFASCRKGDVGRVRYLLEQRDVEVNVRDKWDSTPLYYACLCGHEELVLYLLANGARCEANTFDGERCLYGALSDPIRRALRDYKQVTASCRRRDYYDDFLQRLLEQGIHSDVVFVVHGKPFRVHRCVLGARSAYFANMLDTKWKGKSVVVLRHPLINPVAFGALLQYLYTGRLDIGVEHVSDCERLAKQCQLWDLLSDLEAKCEKVSEFVASKPGTCVKVLTIEPPPADPRLREDMALLADCALPPELRGDLWELPFPCPDGFNSCPDICFRVAGCSFLCHKAFFCGRSDYFRALLDDHFRESEEPATSGGPPAVTLHGISPDVFTHVLYYMYSDHTEGGSGRAGDGTQPVLPWAERERQGPGGLWKGPAGPMVDVLRRLEGRLWDFGFFFQVEEALLGSRERMSDEPVSQTLHTCQPLGILSFSSRRVEGGWGQPPLCGAADPWGSGFPVSSSLAACLCLQLPQGVRKPRLQGSSRVLKVCSARVCERERECVCACAWLRAL

SEQ ID NO: 746723 - protein, 406 aa, Homo sapiens
CGESARLWPALGSECSEEWGGAVPSILPPGLSLPRLLEQGIHSDVVFVVHGKPFRVHRCVLGARSAYFANMLDTKWKGKSVVVLRHPLINPVAFGALLQYLYTGRLDIGVEHVSDCERLAKQCQLWDLLSDLEAKCEKVSEFVASKPGTCVKVLTIEPPPADPRLREDMALLADCALPPELRGDLWELPFPCPDGFNSCPDICFRVAGCSFLCHKAFFCGRSDYFRALLDDHFRESEEPATSGGPPAVTLHGISPDVFTHVLYYMYSDHTELSPEAAYDVLSVADMYLLPGLKRLCGRSLAQMLDEDTVVGVWRVAKLFRLARLEDQCTEYMAKVIEKLVEREDFVEAVKEEAAAVAARQETDSIPLVDDIRFHVASTVQTYSAIEEAQQRLRALEDLLVSIGLDC

SEQ ID NO: 746724 - protein, 508 aa, Homo sapiens; identical to SEQ ID NO: 746722

SEQ ID NO: 746725 - protein, 508 aa, Homo sapiens; identical to SEQ ID NO: 746722

SEQ ID NO: 746726 - protein, 508 aa, Homo sapiens; identical to SEQ ID NO: 746722

SEQ ID NO: 746727 - protein, 392 aa, Homo sapiens
MDTSDLFASCRKGDVGRVRYLLEQRDVEVNVRDKWDSTPLYYACLCGHEELVLYLLANGARCEANTFDGERCLYGALSDPIRRALRDYKQVTASCRRRDYYDDFLQRLLEQGIHSDVVFVVHGKPFRVHRCVLGARSAYFANMLDTKWKGKSVVVLRHPLINPVAFGALLQYLYTGRLDIGVEHVSDCERLAKQCQLWDLLSDLEAKCEKVSEFVTCSTTCTATTLSGGSGRAGDGTQPVLPWAERERQGPGGLWKGPAGPMVDVLRRLEGRLWDFGFFFQVEEALLGSRERMSDEPVSQTLHTCQPLGILSFSSRRVEGGWGQPPLCGAADPWGSGFPVSSSLAACLCLQLPQGVRKPRLQGSSRVLKVCSARVCERERECVCACAWLRAL

SEQ ID NO: 746728 - protein, 121 aa, Homo sapiens [sequence omitted]

SEQ ID NO: 746729 - protein, 121 aa, Homo sapiens [sequence omitted]

SEQ ID NO: 746730 - protein, 515 aa, Homo sapiens
MDTSDLFASCRKGDVGRVRYLLEQRDVEVNVRDKWDSTPLYYACLCGHEELVLYLLANGARCEANTFDGERCLYGALSDPIRRALRDYKQVTASCRRRDYYDDFLQRLLEQGIHSDVVFVVHGKPFRVHRCVLGARSAYFANMLDTKWKGKSVVVLRHPLINPVAFGALLQYLYTGRLDIGVEHVSDCERLAKQCQLWDLLSDLEAKCEKVSEFVASKPGTCVKVLTIEPPPADPRLREDMALLADCALPPELRGDLWELPFPCPDGFNSCPDICFRVAGCSFLCHKCLCPPVAPGPSPLPEPPSSSSGDRPWPSHFLSPASPRAFFCGRSDYFRALLDDHFRESEEPATSGGPPAVTLHGISPDVFTHVLYYMYSDHTELSPEAAYDVLSVADMYLLPGLKRLCGRSLAQMLDEDTVVGVWRVAKLFRLARLEDQCTEYMAKVIEKLVEREDFVEAVKEEAAAVAARQETDSIPLVDDIRFHVASTVQTYSAIEEAQQRLRALEDLLVSIGLDC

SEQ ID NO: 746731 - protein, 423 aa, Homo sapiens
MDTSDLFASCRKGDVGRVRYLLEQRDVEVNVRDKWDSTPLYYACLCGHEELVLYLLANGARCEANTFDGERCLYGALSDPIRRALRDYKQVTASCRRRDYYDDFLQRLLEQGIHSDVVFVVHGKPFRVHRCVLGARSAYFANMLDTKWKGKSVVVLRHPLINPVAFGALLQYLYTGRLDIGVEHVSDCERLAKQCQLWDLLSDLEAKCEKVSEFVASKPGTCVKVLTIEPPPADPRLREDMALLADCALPPELRGDLWELPFPCPDGFNSCPDICFRVAGCSFLCHKAFFCGRSDYFRALLDDHFRESEEPATSGGPPAVTLHGISPDVFTHVLYYMYSDHTELSPEAAYDVLSVADMYLLPGLKRLCGRSLAQMLDEDTVVGVWRVAKLFRLARLEDQCTEYMAKVIEKKVGQWSAVGGKEG

SEQ ID NO: 746732 - protein, 142 aa, Homo sapiens [sequence omitted]

SEQ ID NO: 746733 - protein, 220 aa, Homo sapiens
MEGQECRGSQAPTDQPRGLWGPAAVPVHRAFFCGRSDYFRALLDDHFRESEEPATSGGPPAVTLHGISPDVFTHVLYYMYSDHTELSPEAAYDVLSVADMYLLPGLKRLCGRSLAQMLDEDTVVGVWRVAKLFRLARLEDQCTEYMAKVIEKLVEREDFVEAVKEEAAAVAARQETDSIPLVDDIRFHVASTVQTYSAIEEAQQRLRALEDLLVSIGLDC

SEQ ID NO: 746734 - protein, 121 aa, Homo sapiens [sequence omitted]

SEQ ID NO: 746735 - protein, 64 aa, Homo sapiens
MALLADCALPPELRVSAGLVGRKGVLGWQAVTGSPDTWAQFLVWSWTSYFPFLNLVVHFCEQLL

SEQ ID NO: 746736 - protein, 336 aa, Homo sapiens; identical to SEQ ID NO: 746720

SEQ ID NO: 746737 - protein, 206 aa, Homo sapiens
MDTSDLFASCRKGDVGRVRYLLEQRDVEVNVRDKWDSTPLYYACLCGHEELVLYLLANGARCEANTFDGERCLYGALSDPIRRALRDYKQVTASCRRRDYYDDFLQRLLEQGIHSDVVFVVHGKPFRVHRCVLGARSAYFANMLDTKWKGKSVVVLRHPLINPVAFGALLQYLYTVTPWVQGRRRGSGPSFWTAVHLGVAGLTFHL

SEQ ID NO: 746738 - protein, 261 aa, Homo sapiens
MDTSDLFASCRKGDVGRVRYLLEQRDVEVNVRDKWDSTPLYYACLCGHEELVLYLLANGARCEANTFDGERCLYGALSDPIRRALRDYKQVTASCRRRDYYDDFLQRLLEQGIHSDVVFVVHGKPFRVHRCVLGARSAYFANMLDTKWKGKSVVVLRHPLINPVAFGALLQYLYTGRLDIGVEHVSDCERLAKQCQLWDLLSDLEAKCEKVSEFVASKPGTCVKVLTIEPPPADPRLREDMALLADCALPPELRGLFLWPQ

SEQ ID NO: 746739 - protein, 236 aa, Homo sapiens
MDTSDLFASCRKGDVGRVRYLLEQRDVEVNVRDKWDSTPLYYACLCGHEELVLYLLANGARCEANTFDGERCLYGALSDPIRRALRDYKQVTASCRRRDYYDDFLQRLLEQGIHSDVVFVVHGKPFRVHRCVLGARSAYFANMLDTKWKGKSVVVLRHPLINPVAFGALLQYLYTGRLDIGVEHVSDCERLAKQCQLWDLLSDLEAKCEKVSEFVTCSTTCTATTLSCPPRQPMMC

SEQ ID NO: 746740 - protein, 432 aa, Homo sapiens
MDTSDLFASCRKGDVGRVRYLLEQRDVEVNVRDKWDSTPLYYACLCGHEELVLYLLANGARCEANTFDGERCLYGALSDPIRRALRDYKQVTASCRRRDYYDDFLQRLLEQGIHSDVVFVVHGKPFRVHRCVLGARSAYFANMLDTKWKGKSVVVLRHPLINPVAFGALLQYLYTGRLDIGVEHVSDCERLAKQCQLWDLLSDLEAKCEKVSEFVASKPGTCVKVLTIEPPPADPRLREDMALLADCALPPELRGDLWELPFPCPDGFNSCPDICFRVAGCSFLCHKAFFCGRSDYFRALLDDHFRESEEPATSGGPPAVTLHGISPDVFTHVLYYMYSDHTELSPEAAYDVLSVADMYLLPGLKRLCGRSLAQMLDEDTVVGVWRVAKLFRLARLEDQCTEYMAKVIEKELSWRQACVCVCVQLFFLLPAH

SEQ ID NO: 746741 - protein, 460 aa, Homo sapiens
MDTSDLFASCRKGDVGRVRYLLEQRDVEVNVRDKWDSTPLYYACLCGHEELVLYLLANGARCEANTFDGERCLYGALSDPIRRALRDYKQVTASCRRRDYYDDFLQRLLEQGIHSDVVFVVHGKPFRVHRCVLGARSAYFANMLDTKWKGKSVVVLRHPLINPVAFGALLQYLYTGRLDIGVEHVSDCERLAKQCQLWDLLSDLEAKCEKVSEFVASKPGTCVKVLTIEPPPADPRLREDMALLADCALPPELRGDLWELPFPCPDGFNSCPDICFRVAGCSFLCHKCLCPPVAPGPSPLPEPPSSSSGDRPWPSHFLSPASPRAFFCGRSDYFRALLDDHFRESEEPATSGGPPAVTLHGISPDVFTHVLYYMYSDHTELSPEAAYDVLSVADMYLLPGLKRLCGRSLAQMLDEDTVVGVWRVAKLFRLARLEDQCTEYMAKVIEKKVGQWSAVGGKEG

SEQ ID NO: 746742 - protein, 217 aa, Homo sapiens
MEGSFSDGGALPEGLAEEAEPQGAAWSGDSGTVSQSHSSASGPWEDEGAEDGAPGRDLPLLRRAAAGYAACLLPGAGARPEVEALDASLEDLLTRVDEFVGMLDMLRGDSSHVVSEGVPRIHAKAAEMRRIYSRIDRLEAFVRMVGGRVARMEEQVTKAEAELGTFPRAFKKLLHTMNVPSLFSKSAPSRPQQAGYEAPVLFRTEDYFPCCSERPQL

SEQ ID NO: 746743 - protein, 217 aa, Homo sapiens; identical to SEQ ID NO: 746742

SEQ ID NO: 746744 - protein, 101 aa, Homo sapiens
QDMQKFKNEVNTLEEEFLALKKENVQLHKEVEEEMEKHRSNSTELSGTLTDGTTVGNDDDGLNQQIPRKENEEHDSLQIKQLMKRTRSKTKYILRLTLLTQ

SEQ ID NO: 746745 - protein, 369 aa, Homo sapiens
MFCVTPPELETKMNITKGGLVLFSANSNSSCMELSKKIAERLGVEMGKVQVYQEPNRETRVQIQESVRGKDVFIIQTVSKDVNTTIMELLIMVYACKTSCAKSIIGVIPYFPYSKQCKMRKRGSIVSKLLASMMCKAGLTHLITMDLHQKEIQGFFNIPVDNLRASPFLLQYIQEEIPDYRNAVIVAKSPASAKRAQSFAERLRLGIAVIHGEAQDAESDLVDGRHSPPMVRSVAAIHPSLEIPMLIPKEKPPITVVGDVGGRIAIIVDDIIDDVDSFLAAAETLKERGAYKIFVMATHGLLSSDAPRRIEESAIDEVVVTNTIPHEVQKLQCPKIKTVDISMILSEAIRRIHNGESMSYLFRNIGLDD

SEQ ID NO: 746746 - protein, 369 aa, Homo sapiens; identical to SEQ ID NO: 746745

SEQ ID NO: 746747 - protein, 369 aa, Homo sapiens; identical to SEQ ID NO: 746745

SEQ ID NO: 746748 - protein, 369 aa, Homo sapiens; identical to SEQ ID NO: 746745

SEQ ID NO: 746749 - protein, 369 aa, Homo sapiens; identical to SEQ ID NO: 746745

SEQ ID NO: 746750 - protein, 283 aa, Homo sapiens
MELLIMVYACKTSCAKSIIGVIPYFPYSKQCKMRKRGSIVSKLLASMMCKAGLTHLITMDLHQKEIQGFFNIPVDNLRASPFLLQYIQEEIPDYRNAVIVAKSPASAKRAQSFAERLRLGIAVIHGEAQDAESDLVDGRHSPPMVRSVAAIHPSLEIPMLIPKEKPPITVVGDVGGRIAIIVDDIIDDVDSFLAAAETLKERGAYKIFVMATHGLLSSDAPRRIEESAIDEVVVTNTIPHEVQKLQCPKIKTVDISMILSEAIRRIHNGESMSYLFRNIGLDD

SEQ ID NO: 746751 - protein, 283 aa, Homo sapiens; identical to SEQ ID NO: 746750

SEQ ID NO: 746752 - protein, 283 aa, Homo sapiens; identical to SEQ ID NO: 746750

SEQ ID NO: 746753 - protein, 140 aa, Homo sapiens
MVRSVAAIHPSLEIPMLIPKEKPPITVVGDVGGRIAIIVDDIIDDVDSFLAAAETLKERGAYKIFVMATHGLLSSDAPRRIEESAIDEVVVTNTIPHEVQKLQCPKIKTVDISMILSEAIRRIHNGESMSYLFRNIGLDD

SEQ ID NO: 746754 - protein, 351 aa, Homo sapiens
MFCVTPPELETKMNITKGGLVLFSANSNSSCMELSKKIAERLGVEMGKVQVYQEPNRETRVQIQESVRGKDVFIIQTVSKDVNTTIMELLIMVYACKTSCAKSIIGVIPYFPYSKQCKMRKRGSIVSKLLASMMCKAGLTHLITMDLHQKEIQGFFNIPVDNLRASPFLLQYIQEEIPDYRNAVIVAKSPASAKRAQSFAERLRLGIAVIHGEAQDAESDLVDGRHSPPMVRSVAAIHPSLEIPMLIPKEKPPITVVGDVGGRIAIIVDDIIDDVDSFLAAAETLKERGAYKIFVMATHGLLSSDAPRRIEESAIDEVVVTNTIPHEVQKLQCPKIKTVDISMIRNIGLDD

SEQ ID NO: 746755 - protein, 156 aa, Homo sapiens
MGHGDGDMGPCRLHKAKWKSRFFTVNVGRPFFFPGCLTYYCRSAHIHSFPSVLWQDDIIDDVDSFLAAAETLKERGAYKIFVMATHGLLSSDAPRRIEESAIDEVVVTNTIPHEVQKLQCPKIKTVDISMILSEAIRRIHNGESMSYLFRNIGLDD

SEQ ID NO: 746756 - protein, 369 aa, Homo sapiens; identical to SEQ ID NO: 746745

SEQ ID NO: 746757 - protein, 369 aa, Homo sapiens; identical to SEQ ID NO: 746745

SEQ ID NO: 746758 - protein, 283 aa, Homo sapiens; identical to SEQ ID NO: 746750

SEQ ID NO: 746759 - protein, 382 aa, Homo sapiens
MTGSENWKTKKVLMFCVTPPELETKMNITKGGLVLFSANSNSSCMELSKKIAERLGVEMGKVQVYQEPNRETRVQIQESVRGKDVFIIQTVSKDVNTTIMELLIMVYACKTSCAKSIIGVIPYFPYSKQCKMRKRGSIVSKLLASMMCKAGLTHLITMDLHQKEIQGFFNIPVDNLRASPFLLQYIQEEIPDYRNAVIVAKSPASAKRAQSFAERLRLGIAVIHGEAQDAESDLVDGRHSPPMVRSVAAIHPSLEIPMLIPKEKPPITVVGDVGGRIAIIVDDIIDDVDSFLAAAETLKERGAYKIFVMATHGLLSSDAPRRIEESAIDEVVVTNTIPHEVQKLQCPKIKTVDISMILSEAIRRIHNGESMSYLFRNIGLDD

SEQ ID NO: 746760 - protein, 355 aa, Homo sapiens
MPAQKGREPSRGTAEEESILMRKQAQRVEMTCPRLQASGGLNPETRVQIQESVRGKDVFIIQTVSKDVNTTIMELLIMVYACKTSCAKSIIGVIPYFPYSKQCKMRKRGSIVSKLLASMMCKAGLTHLITMDLHQKEIQGFFNIPVDNLRASPFLLQYIQEEIPDYRNAVIVAKSPASAKRAQSFAERLRLGIAVIHGEAQDAESDLVDGRHSPPMVRSVAAIHPSLEIPMLIPKEKPPITVVGDVGGRIAIIVDDIIDDVDSFLAAAETLKERGAYKIFVMATHGLLSSDAPRRIEESAIDEVVVTNTIPHEVQKLQCPKIKTVDISMILSEAIRRIHNGESMSYLFRNIGLDD

SEQ ID NO: 746761 - protein, 140 aa, Homo sapiens; identical to SEQ ID NO: 746753

SEQ ID NO: 746762 - protein, 76 aa, Homo sapiens
QDMQKFKNEVNTLEEEFLALKKENVQLHKEVEEEMEKHRSNSTELSGTLTDGTTVGNDDDGLNQQIPRKENEEHDR

SEQ ID NO: 746763 - protein, 399 aa, Homo sapiens
MNTRNRVVNSGLGASPASRPTRDPQDPSGRQGELSPVEDQREGLEAAPKGPSRESVVHAGQRRTSAYTLIAPNINRRNEIQRIAEQELANLEKWKEQNRAKPVHLVPRRLGGSQSETEVRQKQQLQLMQSKYKQKLKREESVRIKKEAEEAELQKMKAIQREKSNKLEEKKRLQENLRREAFREHQQYKTAEFLSKLNTESPDRSACQSAVCGPQSSTWARSWAYRDSLKAEENRKLQKMKDEQHQKSELLELKRQQQEQERAKIHQTEHRRVNNAFLDRLQGKSQPGGLEQSGGCWNMNSGNSWGSLLVFSRHLRVYEKILTPIWPSSTDLEKPHEMLFLNVILFSLTVFTLISTAHTLDRAVRSDWLLLVLIYACLEELIPELIFNLYCQGNATLFF

SEQ ID NO: 746764 - protein, 162 aa, Homo sapiens
ENHLNEKQEQRSMGDLFPSNKLEEKKRLQENLRREAFREHQQYKTAEFLSKLNTESPDRSACQSAVCGPQSSTWARSWAYRDSLKAEENRKLQKMKDEQHQKSELLELKRQQQEQERAKIHQTEHRRVNNAFLDRLQGKSQPGGLEQSGGCWNMNSGNSWGI

SEQ ID NO: 746765 - protein, 307 aa, Homo sapiens
MNTRNRVVNSGLGASPASRPTRDPQDPSGRQGELSPVEDQREGLEAAPKGPSRESVVHAGQRRTSAYTLIAPNINRRNEIQRIAEQELANLEKWKEQNRAKPVHLVPRRLGGSQSETEVRQKQQLQLMQSKYKQKLKREESVRIKKEAEEAELQKMKAIQREKSNKLEEKKRLQENLRREAFREHQQYKTAEFLSKLNTESPDRSACQSAVCGPQSSTWARSWAYRDSLKAEENRKLQKMKDEQHQKSELLELKRQQQEQERAKIHQTEHRRVNNAFLDRLQGKSQPGGLEQSGGCWNMNSGNSWGI

SEQ ID NO: 746766 - protein, 272 aa, Homo sapiens
MNTRNRVVNSGLGASPASRPTRDPQDPSGRQGELSPVEDQREGLEAAPKGPSRESVVHAGQRREEQAYVPARLADKLASYNQRSGAERVRSTSAYTLIAPNINRRNEIQRIAEQELANLEKWKEQNRAKPVHLVPRRLGGSQSETEVRQKQQLQLMQSKYKQKLKREESVRIKKEAEEAELQKMKAIQREKSNKLEEKKRLQENLRREAFREHQQYKTAEFLSKLNTESPDRSACQSAVCGPQSSTWKLPILPRDHSVPKKLGYRAFSKGRR

SEQ ID NO: 746767 - protein, 318 aa, Homo sapiens
MNTRNRVVNSGLGASPASRPTRDPQDPSGRQGELSPVEDQREGLEAAPKGPSRESVVHAGQRRTSAYTLIAPNINRRNEIQRIAEQELANLEKWKEQNRAKPVHLVPRRLGGSQSETEVRQKQQLQLMQSKYKQKLKREESVRIKKEAEEAELQKMKAIQREKSNKLEEKKRLQENLRREAFREHQQYKTAEFLSKLNTESPDRSACQSAVCGPQSSTWKLPILPRDHSWARSWAYRDSLKAEENRKLQKMKDEQHQKSELLELKRQQQEQERAKIHQTEHRRVNNAFLDRLQGKSQPGGLEQSGGCWNMNSGNSWGI

SEQ ID NO: 746768 - protein, 169 aa, Homo sapiens
MNTRNRVVNSGLGASPASRPTRDPQDPSGRQGELSPVEDQREGLEAAPKGPSRESVVHAGQRRTSAYTLIAPNINRRNEIQRIAEQELANLEKWKEQNRAKPVHLVPRRLGGSQSETEVRQKQQLQLMQSKYKQKLKREESVRIKKEAEEAELQKMKPNTACSRLISGS

SEQ ID NO: 746769 - protein, 222 aa, Homo sapiens
MVKCCSAIGCASRCLPNSKLKGLTFHVFPTDENIKRKWVLAMKRLDVNAAGIWEPKKGDVLCSRHFKKTDFDRSAPNIKLKPGVIPSIFDSPYHLQGKREKLHCRKNFTLKTVPATNYNHHLVGASSCIEEFQSQFIFEHSYSVMDSPKKLKHKLDHVIGELEDTKESLRNVLDREKRFQKSLRKTIRELKDECLISQETANRLDTFCWDCCQESIEQDYIS

SEQ ID NO: 746770 - protein, 222 aa, Homo sapiens; identical to SEQ ID NO: 746769

SEQ ID NO: 746771 - protein, 222 aa, Homo sapiens; identical to SEQ ID NO: 746769

SEQ ID NO: 746772 - protein, 181 aa, Homo sapiens
MKRLDVNAAGIWEPKKGDVLCSRHFKKTDFDRSAPNIKLKPGVIPSIFDSPYHLQGKREKLHCRKNFTLKTVPATNYNHHLVGASSCIEEFQSQFIFEHSYSVMDSPKKLKHKLDHVIGELEDTKESLRNVLDREKRFQKSLRKTIRELKDECLISQETANRLDTFCWDCCQESIEQDYIS

SEQ ID NO: 746773 - protein, 222 aa, Homo sapiens; identical to SEQ ID NO: 746769

SEQ ID NO: 746774 - protein, 83 aa, Homo sapiens
GGGVGGEAAPGSGGPAPTGYERAGEAGPAAPAPPAHGPPGSRFRGRRRGVGAGQGRGLRRSRLSCWVGVGPSAWGLRQCPTPR

SEQ ID NO: 746775 - protein, 117 aa, Homo sapiens
MKFQYKEVHPFEYRKKEGEKIRKKYPDRVPLIVEKAPKARVPDLDRRKYLVPSDLTDGQFYLLIRKRIHLRPEDALFFFVNNTIPPTSATMGQLYEDSHEEDDFLYVAYSNESVYGK

SEQ ID NO: 746776 - protein, 460 aa, Homo sapiens
MNTSAPPAVSPNITVLAPGKGPWQVAFIGITTGLLSLATVTGNLLVLISFKVNTELKTVNNYFLLSLACADLIIGTFSMNLYTTYLLMGHWALGTLACDLWLALDYVASNASVMNLLLISFDRYFSVTRPLSYRAKRTPRRAALMIGLAWLVSFVLWAPAILFWQYLVGERTVLAGQCYIQFLSQPIITFGTAMAAFYLPVTVMCTLYWRIYRETENRARELAALQGSETPGKGGGSSSSSERSQPGAEGSPETPPGRCCRCCRAPRLLQAYSWKEEEEEDEGSMESLTSSEGEEPGSEVVIKMPMVDPEAQAPTKQPPRSSPNTVKRPTKKGRDRAGKGQKPRGKEQLAKRKTFSLVKEKKAARTLSAILLAFILTWTPYNIMVLVSTFCKDCVPETLWELGYWLCYVNSTINPMCYALCNKAFRDTFRLLLLCRWDKRRWRKIPKRPGSVHRTPSRQC

SEQ ID NO: 746777 - protein, 101 aa, Homo sapiens
GLVVVISTLQGLEIFPRTCPTYSKTSTNQPAPYLLFCRRCRPLPVNSVDLVSQVRTATQWALEENARTQCVLSFRNFSVWPGVVAHACNPSTLGGQGRGIT

SEQ ID NO: 746778 - protein, 316 aa, Homo sapiens
LLLFYTEKGNDVGSVYKKYPQGRGLRRTSSSIDLPRKDTVCSSQEWVAKYGLKKLKLEISRCMGPNCTHQKSGQRSASAKHCSIFPSVEIHGVVRHIQWTPREMEVYIRHLEKVLRRYVQRLQWLLSGSRRLFGTVLESKVCILLDTSGSMGPYLQQVKTELVLLIWEQLRKCCDSFNLLSFAESLQSWQDTLVETTDAACHEAMQWVTHLQAQGSTSILQALLKAFSFHDLEGLYLLTDGKPDTSCSLVLNEVQKLREKRDVKVHTISLNCSDRAAVEFLRKLASFTGGRYHCPVGEDTLSKIHSLLTKGFINEK

SEQ ID NO: 746779 - protein, 625 aa, Homo sapiens
RTRTRDGGGKMAESGGSSGGAGGGGAFGAGPGPERPNSTADKNGALKCTFSAPSHSTSLLQGLATLRAQGQLLDVVLTINREAFPAHKVVLAACSDYFRAMFTGGMREASQDVIELKGVSARGLRHIIDFAYSAEVTLDLDCVQDVLGAAVFLQMLPVVELCEEFLKAAMSVETCLNIGQMATTFSLASLRESVDAFTFRHFLQIAEEEDFLRLPLERLVFFLQSNRLQSCAEIDLFRAAVRWLQHDPARRPRASHVLCHIRFPLMQSSELVDSVQTLDIMVEDVLCRQYLLEAFNYQVLPFRQHEMQSPRTAVRSDVPSLVTFGGTPYTDSDRSVSSKVYQLPEPGARHFRELTEMEVGCSHTCVAVLDNFVYVAGGQHLQYRSGEGAVDACYRYDPHLNRWLRLQAMQESRIQFQLNVLCGMVYATGGRNRAGSLASVERYCPRRNEWGYACSLKRRTWGHAGAASGGRLYISGGYGISVEDKKALHCYDPVADQWEFKAPMSEPRVLHAMVGAGGRIYALGGRMDHVDRCFDVLAVEYYVPETDQWTSVSPMRAGQSEAGCCLLERKIYIVGGYNWRLNNVTGIVQVYNTDTDEWERDLHFPESFAGIACAPVLLPRAGTRR

SEQ ID NO: 746780 - protein, 625 aa, Homo sapiens; identical to SEQ ID NO: 746779

SEQ ID NO: 746781 - protein, 975 aa, Homo sapiens
MDLNSASTVVLQVLTQATSQDTAVLKPAEEQLKQWETQPGFYSVLLNIFTNHTLDINVRWLAVLYFKHGIDRYWRRVAPHALSEEEKTTLRAGLITNFNEPINQIATQIAVLIAKVARLDCPRQWPELIPTLIESVKVQDDLRQHRALLTFYHVTKTLASKRLAADRKLFYDLASGIYNFACSLWNHHTDTFLQEVSSGNEAAILSSLERTLLSLKVLRKLTVNGFVEPHKNMEVMGFLHGIFERLKQFLECSRSIGTDNVCRDRLEKTIILFTKVLLDFLDQHPFSFTPLIQRSLEFSVSYVFTEVGEGVTFERFIVQCMNLIKMIVKNYAYKPSKNFEDSSPETLEAHKIKMAFFTYPTLTEICRRLVSHYFLLTEEELTMWEEDPEGFTVEETGGDSWKYSLRPCTEVLFIDIFHEYNQTLTPVLLEMMQTLQGPTNVEDMNALLIKDAVYNAVGLAAYELFDSVDFDQWFKNQLLPELQVIHNRYKPLRRRVIWLIGQWISVKFKSDLRPMLYEAICNLLQDQDLVVRIETATTLKLTVDDFEFRTDQFLPYLETMFTLLFQLLQQVTECDTKMHVLHVLSCVIERVNMQIRPYVGCLVQYLPLLWKQSEEHNMLRCAILTTLIHLVQGLGADSKNLYPFLLPVIQLSTDVSQPPHVYLLEDGLELWLVTLENSPCITPELLRIFQNMSPLLELSSENLRTCFKIINGYIFLSSTEFLQTYAVGLCQSFCELLKEITTEGQVQVLKVVENALKVNPILGPQMFQPILPYVFKGIIEGERYPVVMSTYLGVMGRVLLQNTSFFSSLLNEMAHKFNQEMDQLLGNMIEMWVDRMDNITQPERRKLSALALLSLLPSDNSVIQDKFCGIINISVEGLHDVMTEDPETGTYKDCMLMSHLEEPKVTEDEEPPTEQDKRKKMLALKDPVHTVSLQQFIYEKLKAQQEMLGEQGFQSLMETVDTEIVTQLQEFLQGF

SEQ ID NO: 746782 - protein, 232 aa, Homo sapiens [sequence omitted]

SEQ ID NO: 746783 - protein, 196 aa, Homo sapiens
MCGLQFSLPCLRLFLVVTCYLLLLLHKEILGCSSVCQLCTGRQINCRNLGLSSIPKNFPESTVFLYLTGNNISYINESELTGLHSLVALYLDNSNILYVYPKAFVQLRHLYFLFLNNNFIKRLDPGIFKGLLNLRNLYLQYNQVSFVPRGVFNDLVSVQYLNLQRNRLTVLGSGTFVGMVALRILDLSNNNILRIS

SEQ ID NO: 746784 - protein, 975 aa, Homo sapiens; identical to SEQ ID NO: 746781

SEQ ID NO: 746785 - protein, 951 aa, Homo sapiens
MDLNSASTVVLQVLTQATSQDTAVLKPAEEQLKQWETQPGFYSVLLNIFTNHTLDINVRWLAVLYFKHGIDRYWRRVAPHALSEEEKTTLRAGLITNFNEPINQIATQIAVLIAKVARLDCPRQWPELIPTLIESVKVQDDLRQHRALLTFYHVTKTLASKRLAADRKLFYDLASGIYNFACSLWNHHTDTFLQEVSSGNEAAILSSLERTLLSLKVLRKLTVNGFVEPHKNMEVMGFLHGIFERLKQFLECTLDFLDQHPFSFTPLIQRSLEFSVSYVFTEVGEGVTFERFIVQCMNLIKMIVKNYAYKPSKNFEDSSPETLEAHKIKMAFFTYPTLTEICRRLVSHYFLLTEEELTMWEEDPEGFTVEETGGDSWKYSLRPCTEVLFIDIFHEYNQTLTPVLLEMMQTLQGPTNVEDMNALLIKDAVYNAVGLAAYELFDSVDFDQWFKNQLLPELQVIHNRYKPLRRRVIWLIGQWISVKFKSDLRPMLYEAICNLLQDQDLVVRIETATTLKLTVDDFEFRTDQFLPYLETMFTLLFQLLQQVTECDTKMHVLHVLSCVIERVNMQIRPYVGCLVQYLPLLWKQSEEHNMLRCAILTTLIHLVQGLGADSKNLYPFLLPVIQLSTDVSQPPHVYLLEDGLELWLVTLENSPCITPELLRIFQNMSPLLELSSENLRTCFKIINGYIFLSSTEFLQTYAVGLCQSFCELLKEITTEGQVQVLKVVENALKVNPILGPQMFQPILPYVFKGIIEGERYPVVMSTYLGVMGRVLLQNTSFFSSLLNEMAHKFNQEMDQLLGNMIEMWVDRMDNITQPERRKLSALALLSLLPSDNSVIQDKFCGIINISVEGLHDVMTEDPETGTYKDCMLMSHLEEPKVTEDEEPPTEQDKRKKMLALKDPVHTVSLQQFIYEKLKAQQEMLGEQGFQSLMETVDTEIVTQLQEFLQGF

SEQ ID NO: 746786 - protein, 975 aa, Homo sapiens; identical to SEQ ID NO: 746781

SEQ ID NO: 746787 - protein, 284 aa, Homo sapiens [sequence omitted]

SEQ ID NO: 746788 - protein, 106 aa, Homo sapiens
MTTADGWTTFRRQDAGERKCQAVGSTLQTSPDTNHHHPNTEGSMDKGQLVLGPKHQLQLLDPGKRGRAPVTAPWAPLLFHSQGHPPSSWCPIPRQTGPPLAEDLQS

SEQ ID NO: 746789 - protein, 386 aa, Homo sapiens
TRKRLAGQCGREKSRADRLGAPVLAHPKMAERQEEQRGSPPLRAEGKADAEVKLILYHWTHSFSSQKVRLVIAEKALKCEEHDVSLPLSEHNEPWFMRLNSTGEVPVLIHGENIICEATQIIDYLEQTFLDERTPRLMPDKESMYYPRVQHYRELLDSLPMDAYTHGCILHPELTVDSMIPAYATTRIRSQIGNTESELKKLAEENPDLQEAYIAKQKRLKSKLLDHDNVKYLKKILDELEKVLDQVETELQRRNEETPEEGQQPWLCGESFTLADVSLAVTLHRLKFLGFARRNWGNGKRPNLETYYERVLKRKTFNKVLGHVNNILISAVLPTAFRVAKKRAPKVLGTTLVVGLLAGVGYFAFMLFRKRLGSMILAFRPRPNYF

SEQ ID NO: 746790 - protein, 386 aa, Homo sapiens; identical to SEQ ID NO: 746789

SEQ ID NO: 746791 - protein, 249 aa, Homo sapiens
MPDKESMYYPRVQHYRELLDSLPMDAYTHGCILHPELTVDSMIPAYATTRIRSQIGNTESELKKLAEENPDLQEAYIAKQKRLKSKLLDHDNVKYLKKILDELEKVLDQVETELQRRNEETPEEGQQPWLCGESFTLADVSLAVTLHRLKFLGFARRNWGNGKRPNLETYYERVLKRKTFNKVLGHVNNILISAVLPTAFRVAKKRAPKVLGTTLVVGLLAGVGYFAFMLFRKRLGSMILAFRPRPNYF

SEQ ID NO: 746792 - protein, 290 aa, Homo sapiens
MRLNSTGEVPVLIHGENIICEATQIIDYLEQTFLDERTPRLMPDKESMYYPRVQHYRELLDSLPMDAYTHGCILHPELTVDSMIPAYATTRIRSQIGNTESELKKLAEENPDLQEAYIAKQKRLKSKLLDHDNVKYLKKILDELEKVLDQVETELQRRNEETPEEGQQPWLCGESFTLADVSLAVTLHRLKFLGFARRNWGNGKRPNLETYYERVLKRKTFNKVLGHVNNILISAVLPTAFRVAKKRAPKVLGTTLVVGLLAGVGYFAFMLFRKRLGSMILAFRPRPNYF

SEQ ID NO: 746793 - protein, 249 aa, Homo sapiens; identical to SEQ ID NO: 746791

SEQ ID NO: 746794 - protein, 373 aa, Homo sapiens
TPKGIGLGRRARERSQKKGKPRPFEGKRGKGRPRRVKVNSVTNLERISFQLSKRVRLVIAEKALKCEEHDVSLPLSEHNEPWFMRLNSTGEVPVLIHGENIICEATQIIDYLEQTFLDERTPRLMPDKESMYYPRVQHYRELLDSLPMDAYTHGCILHPELTVDSMIPAYATTRIRSQIGNTESELKKLAEENPDLQEAYIAKQKRLKSKLLDHDNVKYLKKILDELEKVLDQVETELQRRNEETPEEGQQPWLCGESFTLADVSLAVTLHRLKFLGFARRNWGNGKRPNLETYYERVLKRKTFNKVLGHVNNILISAVLPTAFRVAKKRAPKVLGTTLVVGLLAGVGYFAFMLFRKRLGSMILAFRPRPNYF

SEQ ID NO: 746795 - protein, 249 aa, Homo sapiens; identical to SEQ ID NO: 746791

SEQ ID NO: 746796 - protein, 386 aa, Homo sapiens; identical to SEQ ID NO: 746789

SEQ ID NO: 746797 - protein, 1062 aa, Homo sapiens
REPRRAGRWGRGCTYESRDARVQSEGGGMASVFMCGVEDLLFSGSRFVWNLTVSTLRRWYTERLRACHQVLRTWCGLQDVYQMTEGRHCQVHLLDDRRLELLVQPKLLARELLDLVASHFNLKEKEYFGITFIDDTGQQNWLQLDHRVLDHDLPKKPGPTILHFAVRFYIESISFLKDKTTVELFFLNAKACVHKGQIEVESETIFKLAAFILQEAKGDYTSDENARKDLKTLPAFPTKTLQEHPSLAYCEDRVIEHYLKIKGLTRGQAVVQYMKIVEALPTYGVHYYAVKDKQGLPWWLGISYKGIGQYDIQDKVKPRKLFQWKQLENLYFREKKFAVEVHDPRRISVSRRTFGQSGLFVQTWYANSSLIKSIWVMAISQHQFYLDRKQSKAKIPSARSLDEIAMDLTETGTQRASKLVTLEAKSQFIMASNGSLISSGSQDSEVSEEQKREKILELKKKEKLLQEKLLKKVEELKKICLREAELTGKMPKEYPLNIGEKPPQVRRRVGTAFKLDDNLLPSEEDPALQELESNFLIQQKLVEAAKKLANEPDLCKTVKKKRKQDYTDAMKKLQEIENAINEYRIRCGKKPSQKATVLPEDIIPSESSSLSDTTTYDDPSDAFTFPGQRSSSVPHSPRILPPKSLGIERIHFRKSSINEQFVDTRQSREMLSTHSSPYKTLERRPQGGRSMPTTPVLTRNAYSSSHLEPESSSQHCRQRSGSLESQSHLLSEMDSDKPFFSLSKSQRSSSTEILDDGSSYTSQSSTEYYCVTPVTGPYYTTQTLDTRTRGRRRSKKQNVSTSNSGSMPNLAQKDSLRNGVYSKSQEPPSSSYYIAGYTPYAECDFYYSGGYVYENDTEGQYSVNPSYRSSAHYGYERQRDYSRSFHEDEVDRVPHNPYATLRLPRKAAAKSEHITKNIHKALVAEHLRGWYQRASGQKDQGHSPQTSFDSDRGSQRCLGFAGLQVPCSPSSRASLYSSVSSTNASGNWRTQLTIGLSDYETPAHSSYTSCYGNVYNPLPSPSRQYTEISQLDGTDGNQLEDNLESSEQRLFWHEDSKPGTLV

SEQ ID NO: 746798 - protein, 283 aa, Homo sapiens
TLRTDSYQLGSNTGQLETEMTEGRHCQVHLLDDRRLELLVQPKLLARELLDLVASHFNLKEKEYFGITFIDDTGQQNWLQLDHRVLDHDLPKKPGPTILHFAVRFYIESISFLKDKTTVELFFLNAKACVHKGQIEVESETIFKLAAFILQEAKGDYTSDENARKDLKTLPAFPTKTLQEHPSLAYCEDRVIEHYLKIKGLTRGQAVVQYMKIVEALPTYGVHYYAVKDKQGLPWWLGISYKGIGQYDIQDKVKPRKLFQWKRLENLYFREKKFAVEVHDPRR

SEQ ID NO: 746799 - protein, 171 aa, Homo sapiens
REPRRAGRWGRGCTYESRDARVQSEGGGMASVFMCGVEDLLFSGSRFVWNLTVSTLRRWYTERLRACHQVLRTWCGLQDVYQISTSAKAFWIISHSSTFASPTPVWSPHKIRSHHVVQTGLELLASSNLPTSASQSPGIYRHEPPHLASPPFYFLPWLSQPGIREGGGPQW

SEQ ID NO: 746800 - protein, 989 aa, Homo sapiens
MSRGHGGSEMTEGRHCQVHLLDDRRLELLVQPKLLARELLDLVASHFNLKEKEYFGITFIDDTGQQNWLQLDHRVLDHDLPKKPGPTILHFAVRFYIESISFLKDKTTVELFFLNAKACVHKGQIEVESETIFKLAAFILQEAKGDYTSDENARKDLKTLPAFPTKTLQEHPSLAYCEDRVIEHYLKIKGLTRGQAVVQYMKIVEALPTYGVHYYAVKDKQGLPWWLGISYKGIGQYDIQDKVKPRKLFQWKQLENLYFREKKFAVEVHDPRRISVSRRTFGQSGLFVQTWYANSSLIKSIWVMAISQHQFYLDRKQSKAKIPSARSLDEIAMDLTETGTQRASKLVTLEAKSQFIMASNGSLISSGSQDSEVSEEQKREKILELKKKEKLLQEKLLKKVEELKKICLREAELTGKMPKEYPLNIGEKPPQVRRRVGTAFKLDDNLLPSEEDPALQELESNFLIQQKLVEAAKKLANEPDLCKTVKKKRKQDYTDAMKKLQEIENAINEYRIRCGKKPSQKATVLPEDIIPSESSSLSDTTTYDDPSDAFTFPGQRSSSVPHSPRILPPKSLGIERIHFRKSSINEQFVDTRQSREMLSTHSSPYKTLERRPQGGRSMPTTPVLTRNAYSSSHLEPESSSQHCRQRSGSLESQSHLLSEMDSDKPFFSLSKSQRSSSTEILDDGSSYTSQSSTEYYCVTPVTGPYYTTQTLDTRTRGRRRSKKQNVSTSNSGSMPNLAQKDSLRNGVYSKSQEPPSSSYYIAGYTPYAECDFYYSGGYVYENDTEGQYSVNPSYRSSAHYGYERQRDYSRSFHEDEVDRVPHNPYATLRLPRKAAAKSEHITKNIHKALVAEHLRGWYQRASGQKDQGHSPQTSFDSDRGSQRCLGFAGLQVPCSPSSRASLYSSVSSTNASGNWRTQLTIGLSDYETPAHSSYTSCYGNVYNPLPSPSRQYTEISQLDGTDGNQLEDNLESSEQRLFWHEDSKPGTLV

SEQ ID NO: 746801 - protein, 127 aa, Homo sapiens
MGREKKCLPTTNSLNPNTPSLNSVFTSNLYNQDSIPQTTVPWKITATSAENRVTFRVRFDSDAGSHVRQGFRTVASAHLAGCWLHHTLPSTNSPKNRWIRKPTAPGSELWASPKPDNICVPCSCFRT

SEQ ID NO: 746802 - protein, 848 aa, Homo sapiens
GKTVQMGQELQGEVVIIITDQYGNQIQAFSPSSLSSLSIAGVGLDSSNLKTTFQENTQSISVRGIKFIPGPPGNKDLCFTWREFSDFIRVQLISGPPAKLLLIDWPELKESIPVINGRDLQNPIIVQLCDQWDNPAPVQHVKISLTKASNLKLMPSNQQHKTDEKGRANLGVFSVFAPRGEHTLQVKAIYNKSIIEGPIIKLMILPDPEKPVRLNVKYDKDASFLAGGLFTDFMISVISEDDSIIKNINPARISMKMWKLSTSGNRPPANAETFSCNKIKDNDKEDGCFYFRDKVIPNKVGTYCIQFGFMMDKTNILNSEQVIVEVLPNQPVKLVPKIKPPTPAVSNVRSVASRTLVRDLHLSITDDYDNHTGIDLVGTIIATIKGSNEEDTDTPLFIGKVRTLEFPFVNGSAEIMSLVLAESSPGRDSTEYFIVFEPRLPLLSRTLEPYILPFMFYNDVKKQQQMAALTKEKDQLSQSIVMYKSLFEASQQLLNEMKCQVEEARLKEAQLRNELKIHNIDIPTTQQVPHIEALLKRKLSEQEELKKKPRRSCTLPNYTKGSGDVLGKIAHLAQIEDDRAAMVISWHLASDMDCVVTLTTDAARRIYDETQGRQQVLPLDSIYKKTLPDWKRSLPHFRNGKLYFKPIGDPVFARDLLTFPDNVEHCETVFGMLLGDTIILDNLDAANHYRKEVVKITHCPTLLTRDGDRIRSNGKFGGLQNKAPPMDKLRGMVFGAPVPKQCLILGEQIDLLQQYRSAVCKLDSVNKDLNSQLEYLRTPDMRKKKQELDEHEKNLKLIEEKLGMTPIRKCNDSLRHSPKVETTDCPVPPKRMRREATRQNRIITKTDV

SEQ ID NO: 746803 - protein, 848 aa, Homo sapiens; identical to SEQ ID NO: 746802

SEQ ID NO: 746804 - protein, 186 aa, Homo sapiens
HLLTFLVFGMLLGDTIILDNLDAANHYRKEVVKITHCPTLLTRDGDRIRSNGKFGGLQNKAPPMDKLRGMVFGAPVPKQCLILGEQIDLLQQYRSAVCKLDSVNKDLNSQLEYLRTPDMRKKKQELDEHEKNLKLIEEKLGMTPIRKCNDSLRHSPKVETTDCPVPPKRMRREATRQNRIITKTDV

SEQ ID NO: 746805 - protein, 848 aa, Homo sapiens; identical to SEQ ID NO: 746802

SEQ ID NO: 746806 - protein, 539 aa, Homo sapiens
MMDKTNILNSEQVIVEVLPNQPVKLVPKIKPPTPAVSNVRSVASRTLVRDLHLSITDDYDNHTGIDLVGTIIATIKGSNEEDTDTPLFIGKVRTLEFPFVNGSAEIMSLVLAESSPGRDSTEYFIVFEPRLPLLSRTLEPYILPFMFYNDVKKQQQMAALTKEKDQLSQSIVMYKSLFEASQQLLNEMKCQVEEARLKEAQLRNELKIHNIDIPTTQQVPHIEALLKRKLSEQEELKKKPRRSCTLPNYTKGSGDVLGKIAHLAQIEDDRAAMVISWHLASDMDCVVTLTTDAARRIYDETQGRQQVLPLDSIYKKTLPDWKRSLPHFRNGKLYFKPIGDPVFARDLLTFPDNVEHCETVFGMLLGDTIILDNLDAANHYRKEVVKITHCPTLLTRDGDRIRSNGKFGGLQNKAPPMDKLRGMVFGAPVPKQCLILGEQIDLLQQYRSAVCKLDSVNKDLNSQLEYLRTPDMRKKKQELDEHEKNLKLIEEKLGMTPIRKCNDSLRHSPKVETTDCPVPPKRMRREATRQNRIITKTDV

SEQ ID NO: 746807 - protein, 848 aa, Homo sapiens; identical to SEQ ID NO: 746802

SEQ ID NO: 746808 - protein, 300 aa, Homo sapiens
GKTVQMGQELQGEVVIIITDQYGNQIQAFSPSSLSSLSIAGVGLDSSNLKTTFQENTQSISVRGIKFIPGPPGNKDLCFTWREFSDFIRVQLISGPPAKLLLIDWPELKESIPVINGRDLQNPIIVQLCDQWDNPAPVQHVKISLTKASNLKLMPSNQQHKTDEKGRANLGVFSVFAPRGEHTLQVKAIYNKSIIEGPIIKLMILPDPEKPVRLNVKYDKDASFLAGGLFTDFMISVISEDDSIIKNINPARISMKMWKLSTSGNRPPANAETFSCNKIKDNDKEDGCFYFRYFSKHFIF

SEQ ID NO: 746809 - protein, 235 aa, Homo sapiens
DNWHKGRKAGGKRRPCHKKRKYELGRPAANSKTDPCRIHTVRVRGGNKKYCAPRLDVGNFSWGSRVIVAPVITKRSSECGSYQLRSTTETQHVCRHREHPWLTAIASQSRPSEAGSTQYAHECVARFPHYCRLAPWGPYSKGSMKLDLRCRNDRGCFENQKEGCLKKNFTRETIEVNRDKRNAKMSSLLGEQFQQGKLLACIASRPGQCGRADGYVLEGKELEFYLRKIKAQKGK

SEQ ID NO: 746810 - protein, 844 aa, Homo sapiens
MAACEGRRSGALGSSQSDFLTPPVGGAPWAVATTVVMYPPPPPPPHRDFISVTLSFGESYDNSKSWRRRSCWRKWKQLSRLQRNMILFLLAFLLFCGLLFYINLADHWKALAFRLEEEQKMRPEIAGLKPANPPVLPAPQKADTDPENLPEISSQKTQRHIQRGPPHLQIRPPSQDLKDGTQEEATKRQEAPVDPRPEGDPQRTVISWRGAVIEPEQGTELPSRRAEVPTKPPLPPARTQGTPVHLNYRQKGVIDVFLHAWKGYRKFAWGHDELKPVSRSFSEWFGLGLTLIDALDTMWILGLRKEFEEARKWVSKKLHFEKDVDVNLFESTIRILGGLLSAYHLSGDSLFLRKAEDFGNRLMPAFRTPSKIPYSDVNIGTGVAHPPRWTSDSTVAEVTSIQLEFRELSRLTGDKKFQEAVEKVTQHIHGLSGKKDGLVPMFINTHSGLFTHLGVFTLGARADSYYEYLLKQWIQGGKQETQLLEDYVEAIEGVRTHLLRHSEPSKLTFVGELAHGRFSAKMDHLVCFLPGTLALGVYHGLPASHMELAQELMETCYQMNRQMETGLSPEIVHFNLYPQPGRRDVEVKPADRHNLLRPETVESLFYLYRVTGDRKYQDWGWEILQSFSRFTRVPSGGYSSINNVQDPQKPEPRDKMESFFLGETLKYLFLLFSDDPNLLSLDAYVFNTEAQPSAYLDPCLGWMAAGVGTSGGQRHLAGSVAFSKGPRSTGNRQVAQALNWLWAPPRLCFNQDTVRTSEAVSLGVMRGGLGRWSLRLLPPEDTNHDSRLLKPEQVSVGRPEGGFEVVPGTGVTEWTAQGAALPGLVKPQMSPIQGSGGAAVTPEA

SEQ ID NO: 746811 - protein, 137 aa, Homo sapiens
LRGLLTAARVAAGSCWRKWKQLSRLQRNMILFLLAFLLFCGLLFYINLADHWKALAFRLEEEQKMRPEIAGLKPANPPVLPAPQKADTDPENLPEISSQKTQRHIQRGPPHLQIRLAALSTACYPDTFPGHGPVKRS

SEQ ID NO: 746812 - protein, 154 aa, Homo sapiens
MAACEGRRSGALGSSQSDFLTPPVGGAPWAVATTVVMYPPPPPPPHRDFISVTLSFGESYDNSKSWRRRSCWRKWKQLSRLQRNMILFLLAFLLFCGLLFYINLADHWKALAFRLEEETRCPKKVKIKIKLGREIVTLKLTDSTDCTSFSSPGL

SEQ ID NO: 746813 - protein, 160 aa, Homo sapiens
MAACEGRRSGALGSSQSDFLTPPVGGAPWAVATTVVMYPPPPPPPHRDFISVTLSFGESYDNSKSWRRRSCWRKWKQLSRLQRNMILFLLAFLLFCGLLFYINLADHWKALAFRLEEEQKMRPEIAGLKPANPPVLPAPQKADTDPENLPEISSQNFETH

SEQ ID NO: 746814 - protein, 126 aa, Homo sapiens [sequence omitted]

SEQ ID NO: 746815 - protein, 315 aa, Homo sapiens
MGLTEGVFLILSGTQFTLGILVNCFIELVNGSSWFKTKRMSLSDFIITTLALLRIILLCIILTDSFLIEFSPNTHDSGIIMQIIDVSWTFTNHLSIWLATCLGVLYCLKIASFSHPTFLWLKWRVSRVMVWMLLGALLLSCGSTASLINEFKLYSVFRGIEATRNVTEHFRKKRSEYYLIHVLGTLWYLPPLIVSLASYSLLIFSLGRHTRQMLQNGTSSRDPTTEAHKRAIRIILSFFFLFLLYFLAFLIASFGNFLPKTKMAKMIGEVMTMFYPAGHSFILILGNSKLKQTFVVMLRCESGHLKPGSKGPIFS

SEQ ID NO: 746816 - protein, 300 aa, Homo sapiens
RSYISQIRRGVRRRVKQVFGLRRPRPRQKPVRRQWAARLIFSLARTLPKPAPSSGSRAHRWPPAVSGAHGAALIGLAAQASSRSNMNLVGSYAHHHHHHHPHPAHPMLHEPFLFGPASRCHQERPYFQSWLLSPADAAPDFPAGGPPPAAAAAATAYGPDARPGQSPGRLEALGGRLGRRKGSGPKKERRRTESINSAFAELRECIPNVPADTKLSKIKTLRLATSYIAYLMDVLAKDAQSGDPEAFKAELKKADGGRESKRKRELQQHEGFPPALGPVEKRIKGRTGWPQQVWALELNQ

SEQ ID NO: 746817 - protein, 48 aa, Homo sapiens
KILEENLESTLLDMNLGKERLTKSPKAIATKTIIGKWDLTKLNSFCTA

SEQ ID NO: 746818 - protein, 1636 aa, Homo sapiens
AGLLLDTIKRPALQGLCLCLDFQFDTVVKDRPTILSKLLLLHFLKQDIPALSWEFFVNRFETLSLEAQLHLDCNKEFPFPTTITAVRTNVANLSDAALWKIKRARFARNRQKSVRSLRDSVKGPVESKRALSLPETLTSKIPMRLTRHEQSAPALGGTPEQTPGQQSPENDNTIKDLLPEDAGIDHQTVHQLITVLMKFMAKDESSAESDISSAKAFNTVKRHLYVLLGYDQQEGCFMIAPQKMRLSTCFNAFIAGIAQVMDYNINLGKHLLPLVVQVLKYCSCPQLRHYFQQPPRCSLWSLKPHIRQMWLKALLVILYKYPYRDCDISKILLHLIHITVNTLNAQYHSCKPHATAGPLYSDNSNISRYSEKEKEEDSVFDESDIHDTPTGPCNKESQTFFARLKRIGGSKMVKYQPVEMNVQRSEIELAEYRETGALQDSLLHCVREESIPKKKLRSFKQKSLDIGNADSLLFTLDEHRRKSCIDRCDIEKPPTQAAYIAQRPNDPGRSRQNSATRPDNSEIPENPAMEGFPDARRPVIPEVRLNCMETFEVKVDSPVKPAPKEDLDLIDLSSDSTSGPEKHSILSTSDSDSLVFEPLPPLRIVESDEEEETMNQGDDGPSGKNAASSPSIPSHPSVLSLSTAPLVQVSVEDCSKDFSSKDSGNNQSAGNTDSALITLEDPMDAEGSSKPEELPEFSCGSPLTLKQKRDLLQKSFALPEMSLDDHPDPGTEGEKPGELMPSSGAKTVLLKVPEDAENPTESEKPDTSAESDTEQNPERKVEEDGAEESEFKIQIVPRQRKQRKIAVSAIQREYLDISFNILDKLGEQKDPDPSTKGLSTLEMPRESSSAPTLDAGVPETSSHSSISTQYRQMKRGSLGVLTMSQLMKRQLEHQSSAPHNISNWDTEQIQPGKRQCNVPTCLNPDLEGQPLRMRGATKSSLLSAPSIVSMFVPAPEEFTDEQPTVMTDKCHDCGAILEEYDEETLGLAIVVLSTFIHLSPDLAAPLLLDIMQSVGRLASSTTFSNQAESMMVPGNAAGVAKQFLRCIFHQLAPNGIFPQLFQSTIKDGTFLRTLASSLMDFNELSSIAALSQLLEGLNNKKNLPAGGAMIRCLENIATFMEALPMDSPSSLWTTISNQFQTFFAKLPCVLPLKCSLDSSLRIMICLLKIPSTNATRSLLEPFSKLLSFVIQNAVFTLAYLVELCGLCYRAFTKERDKFYLSRSVVLELLQALKLKSPLPDTNLLLLVQFICADAGTKLAESTILSKQMIASVPGCGTAAMECVRQYINEVLDFMADMHTLTKLKSHMKTCSQPLHEDTFGGHLKVGLAQIAAMDISRGNHRDNKAVIRYLPWLYHPPSAMQQGPKEFIECVSHIRLLSWLLLGSLTHNAVCPNASSPCLPIPLDAGSHVADHLIVILIGFPEQSKTSVLHMCSLFHAFIFAQLWTVYCEQSAVATNLQNQNEFSFTAILTALEFWSRVTPSILQLMAHNKVMVEMVCLHVISLMEALQECNSTIFVKLIPMWLPMIQSNIKHLSAGLQLRLQAIQNHVNHHSLRTLPGSGQSSAGLAALRKWLQCTQFKMAQVEIPVLGSSLSILSSMSGLLGAQCQHSGLAIMGLKTNNLIQAGWGTYWYCTFSF

SEQ ID NO: 746819 - protein, 1636 aa, Homo sapiens; identical to SEQ ID NO: 746818

SEQ ID NO: 746820 - protein, 1523 aa, Homo sapiens
AGLLLDTIKRPALQGLCLCLDFQFDTVVKDRPTILSKLLLLHFLKQDIPALSWEFFVNRFETLSLEAQLHLDCNKEFPFPTTITAVRTNVANLSDAALWKIKRARFARNRQKSVRSLRDSVKGPVESKRALSLPETLTSKIPMRLTRHEQSAPALGGTPEQTPGQQSPENDNTIKDLLPEDAGIDHQTVHQLITVLMKFMAKDESSAESDISSAKAFNTVKRHLYVLLGYDQQEGCFMIAPQKMRLSTCFNAFIAGIAQVMDYNINLGKHLLPLVVQVLKYCSCPQLRHYFQQPPRCSLWSLKPHIRQMWLKALLVILYKYPYRDCDISKILLHLIHITVNTLNAQYHSCKPHATAGPLYSDNSNISRYSEKEKEEDSVFDESDIHDTPTGPCNKESQTFFARLKRIGGSKMVKYQPVEMNVQRSEIELAEYRETGALQDSLLHCVREESIPKKKLRSFKQKSLDIGNADSLLFTLDEHRRKSCIDRCDIEKPPTQAAYIAQRPNDPGRSRQNSATRPDNSEIPENPAMEGFPDARRPVIPEVRLNCMETFEVKVDSPVKPAPKEDLDLIDLSSDSTSGPEKHSILSTSDSDSLVFEPLPPLRIVESDEEEETMNQGDDGPSGKNAASSPSIPSHPSVLSLSTAPLVQVSVEDCSKDFSSKDSGNNQSAGNTDSALITLEDPMDAEGSSKPEELPEFSCGSPLTLKQKRDLLQKSFALPEMSLDDHPDPGTEGEKPGELMPSSGAKTVLLKVPEDAENPTESEKPDTSAESDTEQNPERKVEEDGAEESEFKIQIVPRQRKQRKIAVSAIQREYLDISFNILDKLGEQKDPDPSTKGLSTLEMPRESSSAPTLDAGVPETSSHSSISTQYRQMKRGSLGVLTMSQLMKRQLEHQSSAPHNISNWDTEQIQPGKRQCNVPTCLNPDLEGQPLRMRGATKSSLLSAPSIVSMFVPAPEEFTDEQPTVMTDKCHDCGAILEEYDEETLGLAIVVLSTFIHLSPDLAAPLLLDIMQSVGRLASSTTFSNQAESMMVPGNAAGVAKQFLRCIFHQLAPNGIFPQLFQSTIKDGTFLRTLASSLMDFNELSSIAALSQLLEGLNNKKNLPAGGAMIRCLENIATFMEALPMDSPSSLWTTISNQFQTFFAKLPCVLPLKCSLDSSLRIMICLLKIPSTNATRSLLEPFSKLLSFVIQNAVFTLAYLVELCGLCYRAFTKERDKFYLSRSVVLELLQALKLKSPLPDTNLLLLVQFICADAGTKLAESTILSKQMIASVPGCGTAAMECVRQYINEVLDFMADMHTLTKLKSHMKTCSQPLHEDTFGGHLKVGLAQIAAMDISRGNHRDNKAVIRYLPWLYHPPSAMQQGPKEFIECVSHIRLLSWLLLGSLTHNAVCPNASSPCLPIPLDAGSHVADHLIVILIGFPEQSKTSVLHMCSLFHAFIFAQLWTVYCEQSAVATNLQNQNEFSFTAILTALEFWSRVTPSILQLMAHNKVVSSQTSFPSEMESQSVHTTPNPHTPCFHRSQL

SEQ ID NO: 746821 - protein, 313 aa, Homo sapiens
MEGKNLTSISECFLLGFSEQLEEQKPLFGSFLFMYLVTVAGNLLIILVIITDTQLHTPMYFFLANLSLADACFVSTTVPKMLANIQIQSQAISYSGCLLQLYFFMLFVMLEAFLLAVMAYDCYVAICHPLHYILIMSPGLCIFLVSASWIMNALHSLLHTLLMNSLSFCANHEIPHFFCDINPLLSLSCTDPFTNELVIFITGGLTGLICVLCLIISYTNVFSTILKIPSAQGKRKAFSTCSSHLSVVSLFFGTSFCVDFSSPSTHSAQKDTVASVMYTVVTPMLNPFIYSLRNQEIKSSLRKLIWVRKIHSP

SEQ ID NO: 746822 - protein, 105 aa, Homo sapiens
PFFKALLVKTNRLWPQTSDGPGPSLGTCWRGRSRELHPARGTAPLPSAQLFCLVFGGQAAGRLPCSCQSFLQEAGELRQTHLRRAYQPWGTVRLDDVCTLQVVGT

SEQ ID NO: 746823 - protein, 164 aa, Homo sapiens
MLADKPFFLVLEEDGTTVETEEYFQALAGDTVFMVLQKGQKWQPPSEQGTRHPLSLSHKPAKKIDVARVTFDLYKLNPQDFIGCLNVKATFYDTYSLSYDLHCCGAKRIMKEAFRWALFSMQATGHVLLGTSCYLQQLLDATEEGQPPKGKASSLIPTCLKILQ

SEQ ID NO: 746824 - protein, 101 aa, Homo sapiens
GQDRAGAHSSHVLSLSVPWTRTVNCGTAHPRPDENTGASLSFSFVSGISCALFYFVGCRASRGCRASRGCRASRGCRASRGCRASRGCRASRGCRASRGGT

SEQ ID NO: 746825 - protein, 348 aa, Homo sapiens
HPRHPPAQPLSAQRYPLSLGIPCGTRVHEISQNQQVCAVQTKTQSVTPGAGRQLCLPLGFLLLLFETESGSVIQARMQWHDLGSLQPPLPGFKRLSCLSLLSTWYYRHPPPRLANFCIFSRDRFRHVGQAGLELLTSSDLSSASQSAGITGVSYLPGLFPWAFKKQSWMEVVQVLTKPAGNPSCMYPQGTFVIPLLVTAHRDPTQFKDPDCFNPTNFLDKGKFQDNDAFMPFASGAGRGGRGPAWTGSGVPGAHCAPVYPAKQMCLGTGLAHSGIFLFLTATLQRFCLLPVVRPGTINLTCSALAWAVSPQTSSSSQWPAEVRLHYGGLTGPQTSIPSSVNKGPKLQM

SEQ ID NO: 746826 - protein, 124 aa, Homo sapiens
LQQCTQEHAKEIPRFLLQLVSPAAILDNSPAFLNVVETNPFKHLTHLSLKLLPGNDVEIKKFLAGCLKCSKEEKLSLMQSLDDATKQLDFTRKTLAEKKQELDKLRNEWASHTAALTNKHSQEL

SEQ ID NO: 746827 - protein, 104 aa, Homo sapiens
MYDPCLHPSENLFSLPASPGAPQVFLCFSTEPANSHKQPLRYQPLPLQPLLIQLLQGCPHPASQSSFPPAPVTIGKETSVYRLSPPLKKIEQGSCLSAHCCLFV

SEQ ID NO: 746828 - protein, 85 aa, Homo sapiens
ESAGAEDSDDPETRPNGEKGERRDAMDYKVMNTTMSSLQDLKDFKPLAVTKHKATLLEQRREAGWEEAPSFGQTIDHLLRCPGSC

SEQ ID NO: 746829 - protein, 565 aa, Homo sapiens
MRPRSALPRLLLPLLLLPAAGPAQFHGEKGISIPDHGFCQPISIPLCTDIAYNQTIMPNLLGHTNQEDAGLEVHQFYPLVKVQCSPELRFFLCSMYAPVCTVLEQAIPPCRSICERARQGCEALMNKFGFQWPERLRCEHFPRHGAEQICVGQNHSEDGAPALLTTAPPPGLQPGAGGTPGGPGGGGAPPRYATLEHPFHCPRVLKVPSYLSYKFLGERDCAAPCEPARPDGSMFFSQEETRFARLWILTWSVLCCASTFFTVTTYLVDMQRFRYPERPIIFLSGCYTMVSVAYIAGFVLQERVVCNERFSEDGYRTVVQGTKKEGCTILFMMLYFFSMASSIWWVILSLTWFLAAGMKWGHEAIEANSQYFHLAAWAVPAVKTITILAMGQIDGDLLSGVCFVGLNSLDPLRGFVLAPLFVYLFIGTSFLLAGFVSLFRIRTIMKHDGTKTEKLERLMVRIGVFSVLYTVPATIVIACYFYEQAFREHWERSWVSQHCKSLAIPCPAHYTPRMSPDFTVYMIKYLMTLIVGITSGFWIWSGKTLHSWRKFYTRLTNSRHGETTV

SEQ ID NO: 746830 - protein, 565 aa, Homo sapiens; identical to SEQ ID NO: 746829

SEQ ID NO: 746831 - protein, 229 aa, Homo sapiens
AAASKVCKEAREAAAGPAQFHGEKGISIPDHGFCQPISIPLCTDIAYNQTILAMGQIDGDLLSGVCFVGLNSLDPLRGFVLAPLFVYLFIGTSFLLAGFVSLFRIRTIMKHDGTKTEKLERLMVRIGVFSVLYTVPATIVIACYFYEQAFREHWERSWVSQHCKSLAIPCPAHYTPRMSPDFTVYMIKYLMTLIVGITSGFWIWSGKTLHSWRKFYTRLTNSRHGETTV

SEQ ID NO: 746832 - protein, 128 aa, Homo sapiens
RPILSATVTKRKATCTRENQTEINKPKAKRCLNSAVGEHEKVINNQKEKEDFHSYLPIIDPILSKSKSYKNEVTPSSTTASVARKRKSDGSMEDANVRVAITEHTEVREIKRIHFSPSEPKTSAVKKT

SEQ ID NO: 746833 - protein, 550 aa, Homo sapiens
AETGTCSRGCRSPGAWRGRGRGRRAQNRLGHPSPWLFEPGPDRDVIMDHHVSTIKPRRIQNQNVIHRLERRRISSGKTRHLLKSMSTRAARQQRTYCRDTKEKSCPMAMTSVSVNIRGRLFERFFVLLHITNVAANGEHLNRECSLFTDDCRCVIVGSAAYLPDEPHPPFFEVYRNSESVTPNPRSPLEDYSLHIIDLHTGRLCDTRTFKCDKVVLSHNQGLYLYKNILAILSVQQQTIHVFQVTPEGTFIDVRTIGRFCYEDDLLTVSAVFPEVQRDSQTGMANPFRDPFINSLKHRLLVYLWRRAEQDGSAMAKRRFFQYFDQLRQLRMWKMQLLDENHLFIKYTSEDVVTLRVTDPSQASFFVVYNMVTTEVIAVFENTSDELLELFENFCDLFRNATLHSEVQFPCSASSNNFARQIQRRFKDTIINAKYGGHTEAVRRLLGQLPISAQSYSGSPYLDLSLFSYDDKWVSVMERPKTCGDHPIRFYARDSGLLKFEIQAGLLGRPINHTVRRLVAFTFHPFEPFAISVQRTNAEYVVNFHMRHCCT

SEQ ID NO: 746834 - protein, 596 aa, Homo sapiens
AETGTCSRGCRSPGAWRGRGRGRRAQNRLGHPSPWLFEPGPDRDVIMDHHVSTIKPRRIQNQNVIHRLERRRISSGKAGTHWHQVRVFHQNVFPNFTVVNVEKPPCFLRKFSPDGRYFIAFSSDQTSLEIYEYQGCQAAEDLLQGYEGEILSNGNDQRSVNIRGRLFERFFVLLHITNVAANGEHLNRECSLFTDDCRCVIVGSAAYLPDEPHPPFFEVYRNSESVTPNPRSPLEDYSLHIIDLHTGRLCDTRTFKCDKVVLSHNQGLYLYKNILAILSVQQQTIHVFQVTPEGTFIDVRTIGRFCYEDDLLTVSAVFPEVQRDSQTGMANPFRDPFINSLKHRLLVYLWRRAEQDGSAMAKRRFFQYFDQLRQLRMWKMQLLDENHLFIKYTSEDVVTLRVTDPSQASFFVVYNMVTTEVIAVFENTSDELLELFENFCDLFRNATLHSEVQFPCSASSNNFARQIQRRFKDTIINAKYGGHTEAVRRLLGQLPISAQSYSGSPYLDLSLFSYDDKWVSVMERPKTCGDHPIRFYARDSGLLKFEIQAGLLGRPINHTVRRLVAFTFHPFEPFAISVQRTNAEYVVNFHMRHCCT

SEQ ID NO: 746835 - protein, 402 aa, Homo sapiens
AETGTCSRGCRSPGAWRGRGRGRRAQNRLGHPSPWLFEPGPDRDVIMDHHVSTIKPRRIQNQNVIHRLERRRISSGKAGTHWHQVRVFHQNVFPNFTVVNVEKPPCFLRKFSPDGRYFIAFSSDQTSLEIYEYQGCQAAEDLLQGYEGEILSNGNDQRSVNIRGRLFERFFVLLHITNVAANGEHLNRECSLFTDDCRCVIVGSAAYLPDEPHPPFFEVYRNSESVTPNPRSPLEDYSLHIIDLHTGRLCDTRTFKCDKVVLSHNQGLYLYKNILAILSVQQQTIHVFQVTPEGTFIDVGPRLVEITQSGSMPGTRACSSLRSRRGYWAAPSTTQCDALLPSPFTLLSLSLFLCRGLMLSMLSTSICDTAARRCLTRARLSGLPRLCHSLISVDSKAKAPDY

SEQ ID NO: 746836 - protein, 132 aa, Homo sapiens
PTRPRTRGSTHASENRLGHPSPWLFEPGPDRCWEYSKELDQFPALWYGGTDTKKRCDNGSSCFYHQASKNPKPKCHSPLGTPADQFRQDQTSLEIYEYQGCQAAEDLLQGYEGEILSNGNDQRHLSLWCTIW

SEQ ID NO: 746837 - protein, 561 aa, Homo sapiens
MVGQILKRDVIMDHHVSTIKPRRIQNQNVIHRLERRRISSGKAGTHWHQVRVFHQNVFPNFTVVNVEKPPCFLRKFSPDGRYFIAFSSDQTSLEIYEYQGCQAAEDLLQGYEGEILSNGNDQRSVNIRGRLFERFFVLLHITNVAANGEHLNRECSLFTDDCRCVIVGSAAYLPDEPHPPFFEVYRNSESVTPNPRSPLEDYSLHIIDLHTGRLCDTRTFKCDKVVLSHNQGLYLYKNILAILSVQQQTIHVFQVTPEGTFIDVRTIGRFCYEDDLLTVSAVFPEVQRDSQTGMANPFRDPFINSLKHRLLVYLWRRAEQDGSAMAKRRFFQYFDQLRQLRMWKMQLLDENHLFIKYTSEDVVTLRVTDPSQASFFVVYNMVTTEVIAVFENTSDELLELFENFCDLFRNATLHSEVQFPCSASSNNFARQIQRRFKDTIINAKYGGHTEAVRRLLGQLPISAQSYSGSPYLDLSLFSYDDKWVSVMERPKTCGDHPIRFYARDSGLLKFEIQAGLLGRPINHTVRRLVAFTFHPFEPFAISVQRTNAEYVVNFHMRHCCT

SEQ ID NO: 746838 - protein, 231 aa, Homo sapiens
MVGQILKRDVIMDHHVSTIKPRRIQNQNVIHRLERRRISSGKASFFVVYNMVTTEVIAVFENTSDELLELFENFCDLFRNATLHSEVQFPCSASSNNFARQIQRRFKDTIINAKYGGHTEAVRRLLGQLPISAQSYSGSPYLDLSLFSYDDKWVSVMERPKTCGDHPIRFYARDSGLLKFEIQAGLLGRPINHTVRRLVAFTFHPFEPFAISVQRTNAEYVVNFHMRHCCT

SEQ ID NO: 746839 - protein, 119 aa, Homo sapiens
MRHKYQDGVDQIEKKPGKIQQRLGTVAHACNPSTLGGQGGQITWDQVFENSLANMANPRFDQNIEISLVWWRVPVIPAIQEGEAKNGLNSGGGGCSELRSCNCTLAGQERDSISKIKLK

SEQ ID NO: 746840 - protein, 234 aa, Homo sapiens
MRWAAPGKKTSGLQQKNIEVKTKKNKQKTPGNGDGGSTSETPQPPRKKRAQVDPTVENEETFMNRVEVKVKIPEELKPWLVDDWPLKQAKQLFYLPAEKNVDSILEDYANYKKSHGNTDNKEYAVNEVVAGIKEYFNLMLGTQLLNKFERPQYAEILADCPDAPMSQVYGVPHLLRLSVQIGAMLAYTPLNEKSLALLLNYLHDFLKYLAKNSATLFSASDYEVALPEYHRKAV

SEQ ID NO: 746841 - protein, 124 aa, Homo sapiens
MSLEQKSQHCKPEEGLDTQEEALGLVGVQAATTEEQEAVSSSSPLVPGTLGEVPAAGSPGPLKSPQGASAIPTAIDFTLWRQSIKGSSNQEEEGPSTSPDPESVFRAALSKKVADLIHFLLLKY

SEQ ID NO: 746842 - protein, 401 aa, Homo sapiens
MSLTHNKNFRKLLKEITGETALRLTELNTKEFAGFQIGLLNKDLKPQTYRNAYDIPRRGLLDQLTRMRSNLLKTHKFIVGQDEDSLHSVPVAQMGNYQEYLKTLASPLREIDPDQPKRLHTFGNPFKQDKKGMMIDEADEFVAGPQNKVKRPGEPNSPMSSKRRRSMSLLLRKPQTPPTVTNHVGGKGPPSASWFPSYPNLIKPTLVHTDATIIHDGHEEKMENGQITPDGFLSKSAPSELINMTGDLMPPNQVDSLSDDFTSLSKDGLIQKPGSNAFVGGAKNCSLSVDDQKDPVASTLGAMPNTLQITPAMAQGINADIKHQLMKEVRKFGRKYERIFILLEEVQGPLEMKKQFVEFTIKEAARFKRRVLIQYLEKVLEKINSHHLHNNISHINSRSSC

SEQ ID NO: 746843 - protein, 541 aa, Homo sapiens
MASMRVVKELEDLQKKPPPYLRNLSSDDANVLVWHCSPPTHDLFKVHKLKPNLKWRQAFDSYLKTLPPYYLLPLKKALRMMGAPNLISDNLDCGLSYSVISYLKKLSQQTKLESERILASVGKKPPQEIGIKVKNHSGGGMSLTHNKNFRKLLKEITGETALRLTELNTKEFAGFQIGLLNKDLKPQTYRNAYDIPRRGLLDQLTRMRSNLLKTHKFIVGQDEDSLHSVPVAQMGNYQEYLKTLASPLREIDPDQPKRLHTFGNPFKQDKKGMMIDEADEFVAGPQNKVKRPGEPNSPMSSKRRRSMSLLLRKPQTPPTVTNHVGGKGPPSASWFPSYPNLIKPTLVHTDATIIHDGHEEKMENGQITPDGFLSKSAPSELINMTGDLMPPNQVDSLSDDFTSLSKDGLIQKPGSNAFVGGAKNCSLSVDDQKDPVASTLGAMPNTLQITPAMAQGINADIKHQLMKEVRKFGRKYERIFILLEEVQGPLEMKKQFVEFTIKEAARFKRRVLIQYLEKVLEKINSHHLHNNISHINSRSSC

SEQ ID NO: 746844 - protein, 339 aa, Homo sapiens
MSLTHNKNFRKLLKEITGETALRLTELNTKEFAGFQIGLLNKDLKPQTYRNAYDIPRRGLLDQLTRMRSNLLKTHKFIVGQDEDSLHSVPVAQMGNYQEYLKTLASPLREIDPDQPKRLHTFGNPFKQDKKGMMIDEADEFVAGPQNKVKRPGEPNSPMSSKRRRNATIIHDGHEEKMENGQITPDGFLSKSAPSELINMTGDLMPPNQVDSLSDDFTSLSKDGLIQKPGSNAFVGGAKNCSLSVDDHPAMAQGINADIKHQLMKEVRKFGRKYERIFILLEEVQGPLEMKKQFVEFTIKEAARFKRRVLIQYLEKVLEKINSHHLHNNISHINSRSSC

SEQ ID NO: 746845 - protein, 397 aa, Homo sapiens
MSLTHNKNFRKLLKEITGETALRLTELNTKEFAGFQIGLLNKDLKPQTYRNAYDIPRRGLLDQLTRMRSNLLKTHKFIVGQDEDSLHSVPVAQMGNYQEYLKTLASPLREIDPDQPKRLHTFGNPFKQDKKGMMIDEADEFVAGPQNKVKRPGEPNSPMSSKRRRSMSLLLRKPQTPPTVTNHVGGKGPPSASWFPSYPNLIKPTLVHTDATIIHDGHEEKMENGQITPDGFLSKSAPSELINMTGDLMPPNQVDSLSDDFTSLSKDGLIQKPGSNAFVGGAKNCSLSVDDQKDPVASTLGAMPNTLQITPAMAQGINADIKHQLMKEVRKFGRKYERIFILLEEVQGPLEMKKQFVEFTIKEAARFKRRVLIQYLEKRHYKVHLRLPPTSDICSCM

SEQ ID NO: 746846 - protein, 399 aa, Homo sapiens
AQGRPPAAEAMRVLVRRCWGPPLAHGARRGRPSPQWRALARLGWEDCRDSRVREKPPWRVLFFGTDQFAREALRALHAARENKEEELIDKLEVVTMPSPSPKGLPVKQYAVQSQLPVYEWPDVGSGEYDVGVVASFGRLLNEALILKFPYGILNVHPSCLPRWRGPAPVIHTVLHGDTVTGVTIMQIRPKRFDVGPILKQETVPVPPKSTAKELEAVLSRLGANMLISVLKNLPESLSNGRQQPMEGATYAPKISAGTSCIKWEEQTSEQIFRLYRAIGNIIPLQTLWMANTIKLLDLVEVNSSVLADPKLTGQALIPGSVIYHKQSQILLVYCKDGWIGVRSVMLKKSLTATDFYNGYLHPWYQKNSQAQPSQCRFQTLRLPTKKKQKKTVAMQQCIE

SEQ ID NO: 746847 - protein, 149 aa, Homo sapiens
AQGRPPAAEAMRVLVRRCWGPPLAHGARRGRPSPQWRALARLGWEDCRDSRVREKPPWRVLFFGTDQFAREALRALHAARENKEEELIDKLEVVTMPSPSPKGLPVKQYAVQSQLPVYEWPDVGSGEYDVGVVASFGRLLNEALILKFP

SEQ ID NO: 746848 - protein, 106 aa, Homo sapiens
STRILSHLSTISPYYPKLTGQALIPGSVIYHKQSQILLVYCKDGWIGVRSVMLKKSLTATDFYNGYLHPWYQKNSQAQPSQCRFQTLRLPTKKKQKKTVAMQQCIE

SEQ ID NO: 746849 - protein, 298 aa, Homo sapiens
AQGRPPAAEAMRVLVRRCWGPPLAHGARRGRPSPQWRALARLGWEDCRDSRVREKPPWRVLFFGTDQFAREALRALHAARENKEEELIDKLEVVTMPSPSPKGLPVKQYAVQSQLPVYEWPDVGSGEYDVGVVASFGRLLNEALILKFPYGILNVHPSCLPRWRGPAPVIHTVLHGDTVTGVTIMQIRPKRFDVGPILKQETVPVPPKSTAKELEAVLSRLGANMLISVLKNLPESLSNGRQQPMEGATYAPKISAGTSCIKWEEQTSEQIFRLYRAIGNIVSWEVRLQFYLVGFLCV

SEQ ID NO: 746850 - protein, 231 aa, Homo sapiens
AQGRPPAAEAMRVLVRRCWGPPLAHGARRGRPSPQWRALARLGWEDCRDSRVREKPPWRVLFFGTDQFAREALRALHAARENKEEELIDKLEVVTMPSPSPKGLPVKQYAVQSQLPVYEWPDVGSGEYDVGVVASFGRLLNEALILKFPYGILNVHPSCLPRWRGPAPVIHTVLHGDTVTGVTIMQIRPKRFDVGPILKQETVPVPPKSTAKELEAVLSRLGANMLISSPC

SEQ ID NO: 746851 - protein, 48 aa, Homo sapiens
MLIHSLIHCKASVHWKLDAIVSTKEKEAAESIEPRSQSSRVSQIDRVV

SEQ ID NO: 746852 - protein, 467 aa, Homo sapiens
MATQTCTPTFSTGSIKGLCGTAGGISRVSSIRSVGSCRVPSLAGAAGYISSARSGLSGLGSCLPGSYLSSECHTSGFVGSGGWFCEGSFNGSEKETMQFLNDRLANYLEKVRQLERENAELESRIQEWYEFQIPYICPDYQSYFKTIEDFQQKILLTKSENARLVLQIDNAKLAADDFRTKYETELSLRQLVEADINGLRRILDELTLCKADLEAQVESLKEELMCLKKNHEEEVSVLRCQLGDRLNVEVDAAPPVDLNKILEDMRCQYEALVENNRRDVEAWFNTQTEELNQQVVSSSEQLQCCQTEIIELRRTVNALEIELQAQHSMRNSLESTLAETEARYSSQLAQMQCLISNVEAQLSEIRCDLERQNQEYQVLLDVKARLEGEIATYRHLLEGEDCKLPPQPCATACKPVIRVPSVPPVPCVPSVPCTPAPQVGTQIRTITEEIRDGKVISSREHVQSRPL

SEQ ID NO: 746853 - protein, 417 aa, Homo sapiens
MLRSGLSGLGSCLPGSYLSSECHTSGFVGSGGWFCEGSFNGSEKETMQFLNDRLANYLEKVRQLERENAELESRIQEWYEFQIPYICPDYQSYFKTIEDFQQKILLTKSENARLVLQIDNAKLAADDFRTKYETELSLRQLVEADINGLRRILDELTLCKADLEAQVESLKEELMCLKKNHEEEVSVLRCQLGDRLNVEVDAAPPVDLNKILEDMRCQYEALVENNRRDVEAWFNTQTEELNQQVVSSSEQLQCCQTEIIELRRTVNALEIELQAQHSMRNSLESTLAETEARYSSQLAQMQCLISNVEAQLSEIRCDLERQNQEYQVLLDVKARLEGEIATYRHLLEGEDCKLPPQPCATACKPVIRVPSVPPVPCVPSVPCTPAPQVGTQIRTITEEIRDGKVISSREHVQSRPL

SEQ ID NO: 746854 - protein, 112 aa, Homo sapiens
MLRSGLSGLGSCLPGSYLSSECHTSGFVGSGGWFCEGSFNGSEKETMQFLNDRLANYLEKVRQLERENAELESRIQEWYEFQIPYICPDYQSYFKTIEDFQQKVRETWPLSS

SEQ ID NO: 746855 - protein, 126 aa, Homo sapiens
MPEPAKSAPAPKKGSKKAVTKAQKKDGRKRKRSRKESYSVYVYKVLKQVHPDTGISSKAMGIMNSFVNDIFERIAGEASRLPHYNKRSTITSREIQTAVRLLLPGELAKHAVSEGTKAVTKYTSAK

SEQ ID NO: 746856 - protein, 86 aa, Homo sapiens
MVRHPYSVQTQLSTEAKAIWRSMQQQETNLLANLTTNDARDNSKDFQNSKVGAAATSRDEGCNCPIIGEIVISCYWLFEIPPLISE

SEQ ID NO: 746857 - protein, 64 aa, Homo sapiens
MQQQETNLLANLTTNDARDNSKDFQNSKVGAAATSRDEGCNCPIIGEIVISCYWLFEIPPLISE

SEQ ID NO: 746858 - protein, 82 aa, Homo sapiens
MQCLYFILILKGYFHQQHHTLLITIALCFLQQQQETNLLANLTTNDARDNSKDFQNSKVGAAATSRDEGETQKCIQKPLHEK

SEQ ID NO: 746859 - protein, 616 aa, Homo sapiens
AHPFYTCSFAPNQEAIMSCRSYRVSSGHRVGNFSSCSAMTPQNLNRFRANSVSCWSGPGFRGLGSFGSRSVITFGSYSPRIAAVGSRPIHCGVRFGAGCGMGFGDGRGVGLGPRADSCVGLGFGAGSGIGYGFGGPGFGYRVGGVGVPAAPSITAVTVNKSLLTPLNLEIDPNAQRVKKDEKEQIKTLNNKFASFIDKVRFLEQQNKLLETKWSFLQEQKCIRSNLEPLFESYITNLRRQLEVLVSDQARLQAERNHLQDVLEGFKKKYEEEVVCRANAENEFVALKKDVDAAFMNKSDLEANVDTLTQEIDFLKTLYMEEIQLLQSHISETSVIVKMDNSRDLNLDGIIAEVKAQYEEVARRSRADAEAWYQTKYEEMQVTAGQHCDNLRNIRNEINELTRLIQRLKAEIEHAKAQRAKLEAAVAEAEQQGEATLSDAKCKLADLECALQQAKQDMARQLCEYQELMNAKLGLDIEIATYRRLLEGEESRLCEGVGPVNISVSSSRGGLVCGPEPLVAGSTLSRGGVTFSGSSSVCATSGVLASCGPSLGGARVAPATGDLLSTGTRSGSMLISEACVPSVPCPLPTQGGFSSCSGGRSSSVRFVSTTTSCRTKY

SEQ ID NO: 746860 - protein, 186 aa, Homo sapiens
MKAVNEQGKEVTEFGNKYWLMLNEKEAQQVYGGKEARTEEMKWRQWADDWLVHLISPNVYRTPTEALASFDYIVREGKFGAVEGAVAKYMGAAAMYLISKRLKSRHRLQDNVREDLYEAADKWVAAVGKDRPFMGGQKPNLADLAVYGVLRVMEGLDAFDDLMQHTHIQPWYLRVERAITEASPAH

SEQ ID NO: 746861 - protein, 186 aa, Homo sapiens; identical to SEQ ID NO: 746860

SEQ ID NO: 746862 - protein, 186 aa, Homo sapiens; identical to SEQ ID NO: 746860

SEQ ID NO: 746863 - protein, 186 aa, Homo sapiens; identical to SEQ ID NO: 746860

SEQ ID NO: 746864 - protein, 337 aa, Homo sapiens
MKAVNEQGKEVTEFGNKYWLMLNEKEAQQVYGGKEARTEEMKWRQWADDWLVHLISPNVYRTPTEALASFDYIVREGKFGAVEGAVAKYMGAAAMYLISKRLKSRQVCVHIRGLLSPSLRCHEQWCSHHTPQETSGRPRPRAGGKRIMDYGSLGQDGTWTQSSCSPPLGTAGLALKPEAWALTGASSVAFSLAWSLAFTTASPSGTDAPEASADVMLSPGVPSWLPHLPPLPRGDPLPCWAGSGGSPEGLFPSPPRHRLQDNVREDLYEAADKWVAAVGKDRPFMGGQKPNLADLAVYGVLRVMEGLDAFDDLMQHTHIQPWYLRVERAITEASPAH

SEQ ID NO: 746865 - protein, 144 aa, Homo sapiens
MKAVNEQGKEVTEFGNKYWLMLNEKEAQQVYGGKEARTEEMKWRQWADDWLVHLISPNVYRTPTEALASFDYIVREGKFGAVEGAVAKYMGAAAMYLISKRLKSSRPESGEAFSVTVAVEAGQGPTTPRVGAEGGQAPRGGRPP

SEQ ID NO: 746866 - protein, 360 aa, Homo sapiens
MPRCNSDRGQALDPRRAGLASRGRRAARAPWLQLVRGARGCWELRRWPWGDALGLYHTARWHLRAQDLHAERSAAQLSLSSRLQLTLYQYKTCPFCSKVRAFLDFHALPYQVVEVNPVRRAEIKFSSYRKVPILVAQEGESSQQLNDSSVIISALKTYLVSGQPLEEIITYYPAMKAVNEQGKEVTEFGNKYWLMLNEKEAQQVYGGKEARTEEMKWRQWADDWLVHLISPNVYRTPTEALASFDYIVREGKFGAVEGAVAKYMGAAAMYLISKRLKSRHRLQDNVREDLYEAADKWVAAVGKDRPFMGGQKPNLADLAVYGVLRVMEGLDAFDDLMQHTHIQPWYLRVERAITEASPAH

SEQ ID NO: 746867 - protein, 178 aa, Homo sapiens
MKAVNEQGKEVTEFGNKYWLMLNEKEAQQVEEMKWRQWADDWLVHLISPNVYRTPTEALASFDYIVREGKFGAVEGAVAKYMGAAAMYLISKRLKSRHRLQDNVREDLYEAADKWVAAVGKDRPFMGGQKPNLADLAVYGVLRVMEGLDAFDDLMQHTHIQPWYLRVERAITEASPAH

SEQ ID NO: 746868 - protein, 186 aa, Homo sapiens; identical to SEQ ID NO: 746860

SEQ ID NO: 746869 - protein, 321 aa, Homo sapiens
APARPGATAPCGTAPGSPQARWHLRAQDLHAERSAAQLSLSSRLQLTLYQYKTCPFCSKVRAFLDFHALPYQVVEVNPVRRAEIKFSSYRKVPILVAQEGESSQQLNDSSVIISALKTYLVSGQPLEEIITYYPAMKAVNEQGKEVTEFGNKYWLMLNEKEAQQVYGGKEARTEEMKWRQWADDWLVHLISPNVYRTPTEALASFDYIVREGKFGAVEGAVAKYMGAAAMYLISKRLKSRHRLQDNVREDLYEAADKWVAAVGKDRPFMGGQKPNLADLAVYGVLRVMEGLDAFDDLMQHTHIQPWYLRVERAITEASPAH

SEQ ID NO: 746870 - protein, 410 aa, Homo sapiens
SEHVTLAARVCAGALCAMDGVAALCHVDVLGVCLPPCLLATHCMMLCVLVASAVCVLCCVLCPDAPVCLHASVELVMPCWLSLWMLAVLLGPVWLMPWWLYHTVLLVGTLLLPMDLTAELLSACCMLSLSSRLQLTLYQYKTCPFCSKVRAFLDFHALPYQVVEVNPVRRAEIKFSSYRKVPILVAQEGESSQQLNDSSVIISALKTYLVSGQPLEEIITYYPAMKAVNEQGKEVTEFGNKYWLMLNEKEAQQVYGGKEARTEEMKWRQWADDWLVHLISPNVYRTPTEALASFDYIVREGKFGAVEGAVAKYMGAAAMYLISKRLKSRHRLQDNVREDLYEAADKWVAAVGKDRPFMGGQKPNLADLAVYGVLRVMEGLDAFDDLMQHTHIQPWYLRVERAITEASPAH

SEQ ID NO: 746871 - protein, 270 aa, Homo sapiens
CRRDRESCTHAFLDFHALPYQVVEVNPVRRAEIKFSSYRKVPILVAQEGESSQQLNDSSVIISALKTYLVSGQPLEEIITYYPAMKAVNEQGKEVTEFGNKYWLMLNEKEAQQVYGGKEARTEEMKWRQWADDWLVHLISPNVYRTPTEALASFDYIVREGKFGAVEGAVAKYMGAAAMYLISKRLKSRHRLQDNVREDLYEAADKWVAAVGKDRPFMGGQKPNLADLAVYGVLRVMEGLDAFDDLMQHTHIQPWYLRVERAITEASPAH

SEQ ID NO: 746872 - protein, 385 aa, Homo sapiens
AGTGLGSLGCPRRRLCGGGSGLQLGRGSPAEGPSSLAPHFAILSLEISGSAGRPLRVGEIRDTWFPRPLRLSLSSRLQLTLYQYKTCPFCSKVRAFLDFHALPYQVVEVNPVRRAEIKFSSYRKVPILVAQEGESSGRQIRNAWHSAWGLVCSFQNPPCPSTWEAKWQQLNDSSVIISALKTYLVSGQPLEEIITYYPAMKAVNEQGKEVTEFGNKYWLMLNEKEAQQVYGGKEARTEEMKWRQWADDWLVHLISPNVYRTPTEALASFDYIVREGKFGAVEGAVAKYMGAAAMYLISKRLKSRHRLQDNVREDLYEAADKWVAAVGKDRPFMGGQKPNLADLAVYGVLRVMEGLDAFDDLMQHTHIQPWYLRVERAITEASPAH

SEQ ID NO: 746873 - protein, 186 aa, Homo sapiens; identical to SEQ ID NO: 746860

SEQ ID NO: 746874 - protein, 387 aa, Homo sapiens
TITPYDKQKTKQRIDRARITLVTRVSGRCGLVGAPWPGGWEAAPSRCYPRRAGLASRGRRAARAPWLQLVRGARGCWELRRWPWGDALGLYHTARWHLRAQDLHAERSAAQLSLSSRLQLTLYQYKTCPFCSKVRAFLDFHALPYQVVEVNPVRRAEIKFSSYRKVPILVAQEGESSQQLNDSSVIISALKTYLVSGQPLEEIITYYPAMKAVNEQGKEVTEFGNKYWLMLNEKEAQQVEEMKWRQWADDWLVHLISPNVYRTPTEALASFDYIVREGKFGAVEGAVAKYMGAAAMYLISKRLKSRHRLQDNVREDLYEAADKWVAAVGKDRPFMGGQKPNLADLAVYGVLRVMEGLDAFDDLMQHTHIQPWYLRVERAITEASPAH

SEQ ID NO: 746875 - protein, 494 aa, Homo sapiens
MDPAARVVRALWPGGCALAWRLGGRPQPLLPTQSRAGFAGAAGGPSPVAAARKGSPRLLGAAALALGGCPGAVPHGAVAPARPGPPRRALSRAEVVEVNPVRRAEIKFSSYRKVPILVAQEGESSQQLNDSSVIISALKTYLVSGQPLEEIITYYPAMKAVNEQGKEVTEFGNKYWLMLNEKEAQQVYGGKEARTEEMKWRQWADDWLVHLISPNVYRTPTEALASFDYIVREGKFGAVEGAVAKYMGAAAMYLISKRLKSRQVCVHIRGLLSPSLRCHEQWCSHHTPQETSGRPRPRAGGKRIMDYGSLGQDGTWTQSSCSPPLGTAGLALKPEAWALTGASSVAFSLAWSLAFTTASPSGRMLPEASADVMLSPGVPSWLPHLPPLPRGDPLPCWAGSGGSPEGLFPSPPRHRLQDNVREDLYEAADKWVAAVGKDRPFMGGQKPNLADLAVYGVLRVMEGLDAFDDLMQHTHIQPWYLRVERAITEASPAH

SEQ ID NO: 746876 - protein, 148 aa, Homo sapiens
MDPAARVVRALWPGGCALAWRLGGRPQPLLPTQSRAGFAGAAGGPSPVAAARKGSPRLLGAAALALGGCPGAVPHGAVAPARPGPPRRALSRAALPVQPPAADPVPVQDVSLLQQGPSLPRLPCPALPRIFELNALFAVLKIRNSRSL

SEQ ID NO: 746877 - protein, 119 aa, Homo sapiens
GWYWSGEFGMSAETPMRWRLRASARAGEPSRRTEQPGTPLCHPLPGNLGVGGPAASRGRNQRHVVSKAPSGSGKFYGSGHSRKRTMRREGRENRNTAAHLVPGRVVSGAFSGRKSRRLY

SEQ ID NO: 746878 - protein, 149 aa, Homo sapiens
TRATRLRAHGLAWHLTRLFNGLECGAALPVARVVLLLGTGPERKWQKLGMGCWSLKECVGATGLNAARCSPVTLIKRLLFRAVFILPIHRSESTELPTLPPAPHSRQRHQPGAILYKLFQQNVPGKEMTAEGSAPWGQEVLRPMGSAGR

SEQ ID NO: 746879 - protein, 87 aa, Homo sapiens
GSDDDGEVVETPSQLGHPPVGRHVLSVASSGVLLKDYFLEQFSFYRYIDQRVRSFPHCLPHPIAGRGTSQAPSFTSCFSKMSLGLND

SEQ ID NO: 746880 - protein, 86 aa, Homo sapiens
GSDDDGEVVETPSQLGHPPVGRHVLSVASSGVLLKDYFLEQFSFYRYIDQRVRSFPHCLPHPIAGRGTSQAPSFTSCFSKMSLGRK

SEQ ID NO: 746881 - protein, 73 aa, Homo sapiens
VALTMMVRWWRRPHSWATLPSGDTFCQLLPLESLEGNDRRRECTVGAGGAAANGQCWEMKPTAAIAPERTWRC

SEQ ID NO: 746882 - protein, 149 aa, Homo sapiens
MKEALHQIVVRCSELVSSTSLPRLSVSRLQGPPDSQPLGTLGQGGWKLLGIVGSLAPETLGGLGTEFGPCTHPLPFDMVRERERDDELRQGWLLQCPQCARTLLCHCGPFLTPPSQTSSSGFQLCSLKPSGSLVTATEPLSNFAFSYFP

SEQ ID NO: 746883 - protein, 977 aa, Homo sapiens
ERQALQPRPRLGRPRLGRGVGSGCSSGLLSWLGNPRGRWLRLPGMTATPESLFPTGDELDSSQLQMESDEVDTLKEGEDPADRMHPFLAIYELQSLKVHPLVFAPGVPVTAQVVGTERYTSGSKVGTCTLYSVRLTHGDFSWTTKKKYRHFQELHRDLLRHKVLMSLLPLARFAVAYSPARDAGNREMPSLPRAGPEGSTRHAASKQKYLENYLNRLLTMSFYRNYHAMTEFLEVSQLSFIPDLGRKGLEGMIRKRSGGHRVPGLTCCGRDQVCYRWSKRWLVVKDSFLLYMCLETGAISFVQLFDPGFEVQVGKRSTEARHGVRIDTSHRSLILKCSSYRQARWWAQEITELAQGPGRDFLQLHRHDSYAPPRPGTLARWFVNGAGYFAAVADAILRAQEEIFITDWWLSPEVYLKRPAHSDDWRLDIMLKRKAEEGVRVSILLFKEVELALGINSGYSKRALMLLHPNIKVMRHPDQVTLWAHHEKLLVVDQVVAFLGGLDLAYGRWDDLHYRLTDLGDSSESAASQPPTPRPDSPATPDLSHNQFFWLGKDYSNLITKDWVQLDRPFEDFIDRETTPRMPWRDVGVVVHGLPARDLARHFIQRWNFTKTTKAKYKTPTYPYLLPKSTSTANQLPFTLPGGQCTTVQVLRSVDRWSAGTLENSILNAYLHTIRESQHFLYIENQFFISCSDGRTVLNKVGDEIVDRILKAHKQGWCYRVYVLLPLLPGFEGDISTGGGNSIQAILHFTYRTLCRGEYSILHRLKAAMGTAWRDYISICGLRTHGELGGHPVSELIYIHSKVLIADDRTVIIGSANINDRSLLGKRDSELAVLIEDTETEPSLMNGAEYQAGRFALSLRKHCFGVILGANTRPDLDLRDPICDDFFQLWQDMAESNANIYEQIFRCLPSNATRSLRTLREYVAVEPLATVSPPLARSELTQVQGHLVHFPLKFLEDESLLPPLGSKEGMIPLEVWT

SEQ ID NO: 746884 - protein, 933 aa, Homo sapiens
MTATPESLFPTGDELDSSQLQMESDEVDTLKEGEDPADRMHPFLAIYELQSLKVHPLVFAPGVPVTAQVVGTERYTSGSKVGTCTLYSVRLTHGDFSWTTKKKYRHFQELHRDLLRHKVLMSLLPLARFAVAYSPARDAGNREMPSLPRAGPEGSTRHAASKQKYLENYLNRLLTMSFYRNYHAMTEFLEVSQLSFIPDLGRKGLEGMIRKRSGGHRVPGLTCCGRDQVCYRWSKRWLVVKDSFLLYMCLETGAISFVQLFDPGFEVQVGKRSTEARHGVRIDTSHRSLILKCSSYRQARWWAQEITELAQGPGRDFLQLHRHDSYAPPRPGTLARWFVNGAGYFAAVADAILRAQEEIFITDWWLSPEVYLKRPAHSDDWRLDIMLKRKAEEGVRVSILLFKEVELALGINSGYSKRALMLLHPNIKVMRHPDQVTLWAHHEKLLVVDQVVAFLGGLDLAYGRWDDLHYRLTDLGDSSESAASQPPTPRPDSPATPDLSHNQFFWLGKDYSNLITKDWVQLDRPFEDFIDRETTPRMPWRDVGVVVHGLPARDLARHFIQRWNFTKTTKAKYKTPTYPYLLPKSTSTANQLPFTLPGGQCTTVQVLRSVDRWSAGTLENSILNAYLHTIRESQHFLYIENQFFISCSDGRTVLNKVGDEIVDRILKAHKQGWCYRVYVLLPLLPGFEGDISTGGGNSIQAILHFTYRTLCRGEYSILHRLKAAMGTAWRDYISICGLRTHGELGGHPVSELIYIHSKVLIADDRTVIIGSANINDRSLLGKRDSELAVLIEDTETEPSLMNGAEYQAGRFALSLRKHCFGVILGANTRPDLDLRDPICDDFFQLWQDMAESNANIYEQIFRCLPSNATRSLRTLREYVAVEPLATVSPPLARSELTQVQGHLVHFPLKFLEDESLLPPLGSKEGMIPLEVWT

SEQ ID NO: 746885 - protein, 922 aa, Homo sapiens
MTATPESLFPTGDELDSSQLQMESDEVDTLKEGEDPADRMHPFLAIYELQSLKVHPLVFAPGVPVTAQVVGTERYTSGSKVGTCTLYSVRLTHGDFSWTTKKKYRHFQELHRDLLRHKVLMSLLPLARFAVAYSPARDAGNREMPSLPRAGPEGSTRHAASKQKYLENYLNRLLTMSFYRNYHAMTEFLEVSQLSFIPDLGRKGLEGMIRKRSGGHRVPGLTCCGRDQVCYRWSKRWLVVKDSFLLYMCLETGAISFVQLFDPGFEVQVGKRSTEARHGVRIDTSHRSLILKCSSYRQARWWAQEITELAQGPGRDFLQLHRHDSYAPPRPGTLARWFVNGAGYFAAVADAILRAQEEIFITDWWLSPEVYLKRPAHSDDWRLDIMLKRKAEEGVRVSILLFKEVELALGINSGYSKRALMLLHPNIKVMRHPDQVTLWAHHEKLLVVDQVVAFLGGLDLAYGRWDDLHYRLTDLGDSSESAASQPPTPRPDSPATPDLSHNQFFWLGKDYSNLITKDWVQLDRPFEDFIDRETTPRMPWRDVGVVVHGLPARDLARHFIQRWNFTKTTKAKYKTPTYPYLLPKSTSTANQLPFTLPGGQCTTVQVLRSVDRWSAGTLENSILNAYLHTIRESQHFLYIENQFFISCSDGRTVLNKVGDEIVDRILKAHKQGWCYRVYVLLPLLPGFEGDISTGGGNSIQAILHFTYRTLCRGEYSILHRLKAAMGTAWRDYISICGLRTHGELGGHPVSELIYIHSKVLIADDRTVIIGSANINDRSLLGKRDSELAVLIEDTETEPSLMNGAEYQAGSVILGANTRPDLDLRDPICDDFFQLWQDMAESNANIYEQIFRCLPSNATRSLRTLREYVAVEPLATVSPPLARSELTQVQGHLVHFPLKFLEDESLLPPLGSKEGMIPLEVWT

SEQ ID NO: 746886 - protein, 103 aa, Homo sapiens
LEDSSESAASQPPTPRPDSPATPDLSHNQFFWLGKDYSNLITKDWVQLDRPFEDFIDRETTPRMPWRDVGVVVHGLPARDLARHFIQRWNFTKVFIPSDRGWR

SEQ ID NO: 746887 - protein, 977 aa, Homo sapiens; identical to SEQ ID NO: 746883

SEQ ID NO: 746888 - protein, 623 aa, Homo sapiens
TTVLRSSLSRAFWLLTPLTSLAWPPPRFVNGAGYFAAVADAILRAQEEIFITDWWLSPEVYLKRPAHSDDWRLDIMLKRKAEEGVRVSILLFKEVELALGINSGYSKRALMLLHPNIKVMRHPDQVTLWAHHEKLLVVDQVVAFLGGLDLAYGRWDDLHYRLTDLGDSSESAASQPPTPRPDSPATPDLSHNQFFWLGKDYSNLITKDWVQLDRPFEDFIDRETTPRMPWRDVGVVVHGLPARDLARHFIQRWNFTKTTKAKYKTPTYPYLLPKSTSTANQLPFTLPGGQCTTVQVLRSVDRWSAGTLENSILNAYLHTIRESQHFLYIENQFFISCSDGRTVLNKVGDEIVDRILKAHKQGWCYRVYVLLPLLPGFEGDISTGGGNSIQAILHFTYRTLCRGEYSILHRLKAAMGTAWRDYISICGLRTHGELGGHPVSELIYIHSKVLIADDRTVIIGSANINDRSLLGKRDSELAVLIEDTETEPSLMNGAEYQAGRFALSLRKHCFGVILGANTRPDLDLRDPICDDFFQLWQDMAESNANIYEQIFRCLPSNATRSLRTLREYVAVEPLATVSPPLARSELTQVQGHLVHFPLKFLEDESLLPPLGSKEGMIPLEVWT

SEQ ID NO: 746889 - protein, 299 aa, Homo sapiens
IYPCLANQFFISCSDGRTVLNKVGDEIVDRILKAHKQGWCYRVYVLLPLLPGFEGDISTGGGNSIQAILHFTYRTLCRGEYSILHRLKAAMGTAWRDYISICGLRTHGELGGHPVSELIYIHSKVLIADDRTVIIGSANINDRSLLGKRDSELAVLIEDTETEPSLMNGAEYQAGRFALSLRKHCFGVILGANTRPDLDLRDPICDDFFQLWQDMAESNANIYEQIFRCLPSNATRSLRTLREYVAVEPLATVSPPLARSELTQVQGHLVHFPLKFLEDESLLPPLGSKEGMIPLEVWT

SEQ ID NO: 746890 - protein, 303 aa, Homo sapiens
MSVSDILPQNNQFFISCSDGRTVLNKVGDEIVDRILKAHKQGWCYRVYVLLPLLPGFEGDISTGGGNSIQAILHFTYRTLCRGEYSILHRLKAAMGTAWRDYISICGLRTHGELGGHPVSELIYIHSKVLIADDRTVIIGSANINDRSLLGKRDSELAVLIEDTETEPSLMNGAEYQAGRFALSLRKHCFGVILGANTRPDLDLRDPICDDFFQLWQDMAESNANIYEQIFRCLPSNATRSLRTLREYVAVEPLATVSPPLARSELTQVQGHLVHFPLKFLEDESLLPPLGSKEGMIPLEVWT

SEQ ID NO: 746891 - protein, 163 aa, Homo sapiens
ASSSQSAGNTGVSHRTQPILNYLSRDNVTFLVLRFSKDLNLALLGPLFSYSVILGANTRPDLDLRDPICDDFFQLWQDMAESNANIYEQIFRCLPSNATRSLRTLREYVAVEPLATVSPPLARSELTQVQGHLVHFPLKFLEDESLLPPLGSKEGMIPLEVWT

SEQ ID NO: 746892 - protein, 427 aa, Homo sapiens
ERQALQPRPRLGRPRLGRGVGSGCSSGLLSWLGNPRGRWLRLPGMTATPESLFPTGDELDSSQLQMESDEVDTLKEGEDPADRMHPFLAIYELQSLKVHPLVFAPGVPVTAQVVGTERYTSGSKVGTCTLYSVRLTHGDFSWTTKKKYRHFQELHRDLLRHKVLMSLLPLARFAVAYSPARDAGNREMPSLPRAGPEGSTRHAASKQKYLENYLNRLLTMSFYRNYHAMTEFLEVSQLSFIPDLGRKGLEGMIRKRSGGHRVPGLTCCGRDQVCYRWSKRWLVVKDSFLLYMCLETGAISFVQLFDPGFEIWGGRHSPGLGRRRESQSSSPLLPSANHFSMLQRRSTAPARVSRVKPLIPGEGGSAPGPTTHCSLPLPALEPPPCPRALPAHCCQGGGKDKATSGFSPHQGKEGGHINSLHQPADRH

SEQ ID NO: 746893 - protein, 104 aa, Homo sapiens
GGWAGPREGAKGGLARVGRRGPTQGTSIQFLIPLGGNLHSVFCPLDSRRLFLDNQEEIPSFSGAASGPPETQSLDESAPSGSVRATGLLPVEGRCSPPSFLSVS

SEQ ID NO: 746894 - protein, 142 aa, Homo sapiens
PVQAVNVGQLLAVNAEEDAWLRAQVISTEENKIKVCYVDYGFSENVEKSKAYKLNPKFCSLSFQATKCKLAGLEVLSDDPDLVKVVESLTCGKIFAVEILDKADIPLVVLYDTSGEDDININATCLKAICDKSLEVHLQVPL

SEQ ID NO: 746895 - protein, 589 aa, Homo sapiens
PVQAVNVGQLLAVNAEEDAWLRAQVISTEENKIKVCYVDYGFSENVEKSKAYKLNPKFCSLSFQATKCKLAGLEVLSDDPDLVKVVESLTCGKIFAVEILDKADIPLVVLYDTSGEDDININATCLKAICDKSLEVHLQVDAMYTNVKVTNICSDGTLYCQVPCKGLNKLSDLLRKIEDYFHCKHMTSECFVSLPFCGKICLFHCKGKWLRVEITNVHSSRALDVQFLDSGTVTSVKVSELREIPPRFLQEMIAIPPQAIKCCLADLPQSIGMWTPDAVLWLRDSVLNCSDCSIKVTKVDETRGIAHVYLFTPKNFPDPHRSINRQITNADLWKHQKDVFLSAISSGADSPNSKNGNMPMSGNTGENFRKNLTDVIKKSMVDHTSAFSTEELPPPVHLSKPGEHMDVYVPVACHPGYFVIQPWQEIHKLEVLMEEMILYYSVSEERHIAVEKDQVYAAKVENKWHRVLLKGILTNGLVSVYELDYGKHELVNIRKVQPLVDMFRKLPFQAVTAQLAGVKCNQWSEEASMVFRNHVEKKPLVALVQTVIENANPWDRKVVVYLVDTSLPDTDTWIHDFMSEYLIELSKVN

SEQ ID NO: 746896 - protein, 589 aa, Homo sapiens; identical to SEQ ID NO: 746895

SEQ ID NO: 746897 - protein, 128 aa, Homo sapiens
MSGRGKQGGKARAKAKTRSSRAGLQFPVGRVHRLLRKGNYAERVGAGAPVYLAAVLEYLTAEILELAGNAARDNKKTRIIPRHLQLAIRNDEELNKLLGKVTIAQGGVLPNIQAVLLPKKTESHHKTK

SEQ ID NO: 746898 - protein, 204 aa, Homo sapiens
RQPSPSFVRWSPTSRPREAFLTFNPISRAPQSWSSPSSDTQRNGDQEPDAGFPSPCEDPVDQLHAHPVQPPDSVQWGREQTIVHPHSRLQLAEGRGRWGCRATNVDGDRAPGDSLCWGTYGGRIQTPQCLRATRPRQDLVSDDLEAGPEVQEGVPRDREGTGVTTVPPDSHLPAPVGGALFAYRVFAHVVGYNEDAGGGGLCPC

SEQ ID NO: 746899 - protein, 117 aa, Homo sapiens
MKLDSSSGCPRASFQPARPHRARHPHWREFDLMFHKALYLRRRGMGLSPSLCCRNPEFVAAKKTKEITIVIIMTLFMKTHLDVPPNQNNNSGNIQAMAKIIQAIKSSRPLFYKIPKV

SEQ ID NO: 746900 - protein, 706 aa, Homo sapiens
LMGQFGKRLLSWSRLKFAGRDGVGGGGTPVVQFDIEGAPTYSLGLRNLDVSKLKRRRRETRPQRTMATAKGIAIGIDLGTTYSCVGVFQHGKVEIIANDQGNRTTPSYVAFTDTERLIGDAAKNQVAMNPQNTVFDAKRLIGRKFNDPVVQADMKLWPFQVINEGGKPKVLVSYKGENKAFYPEEISSMVLTKLKETAEAFLGHPVTNAVITVPAYFNDSQRQATKDAGVIAGLNVLRIINEPTAAAIAYGLDKGGQGERHVLIFDLGGGTFDVSILTIDDGIFEVKATAGDTHLGGEDFDNRLVSHFVEEFKRKHKKDISQNKRAVRRLRTACERAKRTLSSSTQANLEIDSLYEGIDFYTSITRARFEELCADLFRGTLEPVEKALRDAKMDKAKIHDIVLVGGSTRIPKVQRLLQDYFNGRDLNKSINPDEAVAYGAAVQAAILMGDKSEKVQDLLLLDVAPLSLGLETAGGVMTALIKRNSTIPTKQTQIFTTYSDNQPGVLIQVYEGERAMTKDNNLLGRFDLTGIPPAPRGVPQIEVTFDIDANGILNVTAMDKSTGKVNKITITNDKGRLSKEEIERMVLDAEKYKAEDEVQREKIAAKNALESYAFNMKSVVSDEGLKGKISESDKNKILDKCNELLSWLEVNQLAEKDEFDHKRKELEQMCNPIITKLYQGGCTGPACGTGYVPGRPATGPTIEEVD

SEQ ID NO: 746901 - protein, 706 aa, Homo sapiens; identical to SEQ ID NO: 746900

SEQ ID NO: 746902 - protein, 366 aa, Homo sapiens
MDFLNSSDQNLTSEELLNRMPSKILVSLTLSGLALMTTTINSLVIAAIIVTRKLHHPANYLICSLAVTDFLVAVLVMPFSIVYIVRESWIMGQVVCDIWLSVDITCCTCSILHLSAIALDRYRAITDAVEYARKRTPKHAGIMITIVWIISVFISMPPLFWRHQGTSRDDECIIKHDHIVSTIYSTFGAFYIPLALILILYYKIYRAAKTLYHKRQASRIAKEEVNGQVLLESGEKSTKSVSTSYVLEKSLSDPSTDFDKIHSTVRSLRSEFKHEKSWRRQKISGTRERKAATTLGLILGAFVICWLPFFVKELVVNVCDKCKISEEMSNFLAWLGYLNSLINPLIYTIFNEDFKKAFQKLVRCRC

SEQ ID NO: 746903 - protein, 75 aa, Homo sapiens
MENPLALTGIPPPGPLPGLPMEVVPLLNPITVYPIAPFLSFHVNICKLFLPSKETNISLPSALCERVLDSLHLKT

SEQ ID NO: 746904 - protein, 1396 aa, Homo sapiens
MRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 746905 - protein, 1396 aa, Homo sapiens; identical to SEQ ID NO: 746904

SEQ ID NO: 746906 - protein, 1396 aa, Homo sapiens; identical to SEQ ID NO: 746904

SEQ ID NO: 746907 - protein, 1170 aa, Homo sapiens
MRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGLTSHGLRAHLQDLYHLELLLGQIA

SEQ ID NO: 746908 - protein, 1116 aa, Homo sapiens
MRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQDIH

SEQ ID NO: 746909 - protein, 1396 aa, Homo sapiens; identical to SEQ ID NO: 746904

SEQ ID NO: 746910 - protein, 1452 aa, Homo sapiens
MRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKLQKREKTCRAYLKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGMTGNYLLTNPLLRPHGTNNPYNTLLAETVVCNAPSAPVFNSPGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 746911 - protein, 1396 aa, Homo sapiens; identical to SEQ ID NO: 746904

SEQ ID NO: 746912 - protein, 789 aa, Homo sapiens
MNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 746913 - protein, 1156 aa, Homo sapiens
MRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGGINLNILLQD

SEQ ID NO: 746914 - protein, 1200 aa, Homo sapiens
MRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGMTGNYLLTNPLLRPHGTNNPYNTLLAETVVCNAPSAPVFNSPATLRPDSLSRQT

SEQ ID NO: 746915 - protein, 1414 aa, Homo sapiens
MRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGLTSHGLESPSSRFISFRGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 746916 - protein, 464 aa, Homo sapiens
MSIHGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 746917 - protein, 403 aa, Homo sapiens
MVSSGCRMRSLWFIIVISFLPNTEGFSRAALPFGLVRRELSCEGYSIDLRCPGSDVIMIESANYGRTDDKICDADPFQMENTDCYLPDAFKIMTQRLQLFTVGNAGKPGTFQVLAFKYNFVLNDIKKFCTKEIEFLWKGTEDSNDNSPSSVSGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 746918 - protein, 1156 aa, Homo sapiens; identical to SEQ ID NO: 746913

SEQ ID NO: 746919 - protein, 262 aa, Homo sapiens
SEPLQRKQMLARHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 746920 - protein, 624 aa, Homo sapiens
MRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKLQKREKTCRAYLKVSLLCCHPAFSLLQLPATLYHLAA

SEQ ID NO: 746921 - protein, 156 aa, Homo sapiens
IPQTFCRFCGYTHSSSQRMKFTTLLFLAAVAGALVYAEDASSDSTGADPAQEAGTSKPNEEISGPAEPASPPETTTTAQETSAAAVQGTAKVTSSRQELNPLKSIVEKSILLTEQALAKAGKGMHGGVPGGKQFIENGSEFAQKLLKKFSLLKPWA

SEQ ID NO: 746922 - protein, 349 aa, Homo sapiens
CCLSSQVAGVGRLERDSEKVPAEGGRRYGDSQGVADEDGGRRTSHHVWRINGLHGHSGAESRERVSDDGERKCEESDRRSRVAAGSLSADAGFSRSDLRRVSENLGHCRSVSRERVRGDSGHSHSCSWERVRGDSTFCSSDVNFSEVGGHQTTDSRGTAREDRGLRLSGPWEGVSDIRDPRTSDFGDRVSDDRSRRFSGSWEGGSVEGGHSVGSSWEEVSGDRGYAASDSSGVSGSEDASYRFSGFWERESEDEGFRCSFWERAREDLGPRPSDDGEEGRCRCSGSWVRASEDASYRFSGFWERESEDEGSAAASGREPERTLGPVLVTTEKRALPLQWLVGGSIWCKP

SEQ ID NO: 746923 - protein, 425 aa, Homo sapiens
CCLSSQVAGVGRLERDSEKVPAEGGRRYGDSQGVADEDGGRRTSHHVWRINGLHGHSGAESRERVSDDGERKCEESDRRSRVAAGSLSADAGFSRSDLRRVSENLGHCRSVSRERVRGDSGHSHSCSWERVRGDSTFCSSDVNFSEVGGHQTTDSRGTAREDRGLRLSGPWEGVSDIRDPRTSDFGDRVSDDRSRRFSGSWEGGSVEGGHSVGSSWEEVSGDRGYAASDSSGVSGSEDASYRFSGFWERESEDEGFRCSFWERAREDLGPRPSDDGEEGRCRCSGSWVRASEDRRSIRGLDSTPPQSRRCCAMPGVANSGPSTSSRETANPCSRKKVHFGSIHDAVRAGDVKQLSEIVVRGASINELDVLHKFTPLHWAAHSGSLECLHWLLWHGADITHVTTRGWTASHIAAIRGQDACVQVII

SEQ ID NO: 746924 - protein, 55 aa, Homo sapiens
MILAVGLSVCGFYCVEACSFYIQLSFYHEGMLNFTEYFFGIYRNGHMVMSFILLM

SEQ ID NO: 746925 - protein, 134 aa, Homo sapiens
GRLGPPGSLREEAGAGKEGSLGPAWGGRQEGPRAQCGPFFSLCATEPRARLLCEEDALTPSDLGSDGAEIAGPGLVARLVPHLGLCERPGAGSCLFPSFRQVCIQERGGQGQKDAGRLLISTEELISCETLTVI

SEQ ID NO: 746926 - protein, 103 aa, Homo sapiens
ALRVLSGPHPIIAQHTPFNMRGHPFIALRPERSHRPENTEQAAALTLLDTLEPEGVLAVFDHGQHVPDGEPRHGGLVHLQQQLLRHQFAAALIGHLAGLHLPQ

SEQ ID NO: 746927 - protein, 126 aa, Homo sapiens
ALRVLSGPHPIIAQHTPFNMRGHPFIALRPERSHRPENTEQAAALTLLDTLEPEGVLAVFDHGQHVPDGEPRHGGLVHLQQQLLRHQFAAALIGHLAGLHLPQQRKQWWWRRRRRRRQPERAVAEL

SEQ ID NO: 746928 - protein, 115 aa, Homo sapiens
GRLGPPGSLREEAGAGKEGSLGPAWGGRQEGPRAQCGPFFSLCATEPRARLLCEEDALTPSDLGSDGAEIAGPGLVARLVPHLGLCERPGAGSCRLHPREGRTGAKGCREAADFH

SEQ ID NO: 746929 - protein, 115 aa, Homo sapiens; identical to SEQ ID NO: 746928

SEQ ID NO: 746930 - protein, 126 aa, Homo sapiens; identical to SEQ ID NO: 746927

SEQ ID NO: 746931 - protein, 115 aa, Homo sapiens; identical to SEQ ID NO: 746928

SEQ ID NO: 746932 - protein, 115 aa, Homo sapiens [sequence omitted]

SEQ ID NO: 746933 - protein, 105 aa, Homo sapiens
MRGLGSSWLLRGLERHTSRSLAELVPQQDLVSLHCCRCISPPHVGAAVTSYWDPSPIQPHPGCGTTRCPVPLGRRRGGTCNAPSQPGKHSGFTLCKEGWYPLSGV

SEQ ID NO: 746934 - protein, 105 aa, Homo sapiens; identical to SEQ ID NO: 746933

SEQ ID NO: 746935 - protein, 842 aa, Homo sapiens
MKRGRLPSSSEDSDDNGSLSTTWSQNSRSQHRRSSCSRHEDRKPSEVFRTDLITAMKLHDSYQLNPDEYYVLADPWRQEWEKGVQVPVSPGTIPQPVARVVSEEKSLMFIRPKKYIVSSGSEPPELGYVDIRTLADSVCRYDLNDMDAAWLELTNEEFKEMGMPELDEYTMERVLEEFEQRCYDNMNHAIETEEGLGIEYDEDVVCDVCQSPDGEDGNEMVFCDKCNICVHQACYGILKVPEGSWLCRTCALGVQPKCLLCPKKGGAMKPTRSGTKWVHVSCALWIPEVSIGSPEKMEPITKVSHIPSSRWALVCSLCNEKFGASIQCSVKNCRTAFHVTCAFDRGLEMKTILAENDEVKFKSYCPKHSSHRKPEESLGKGAAQENGAPECSPRNPLEPFASLEQNREEAHRVSVRKQKLQQLEDEFYTFVNLLDVARALRLPEEVVDFLYQYWKLKRKVNFNKPLITPKKDEEDNLAKREQDVLFRRLQLFTHLRQDLERVRNLTYMVTRREKIKRSVCKVQEQIFNLYTKLLEQERVSGVPSSCSSSSLENMLLFNSPSVGPDAPKIEDLKWHSAFFRKQMGTSLVHSLKKPHKRDPLQNSPGSEGKTLLKQPDLCGRREGMVVPESFLGLEKTFAEARLISAQQKNGVVMPDHGKRRDNRFHCDLIKGDLKDKSFKQSHKPLRSTDVSQRHLDNTRAATSPGVGQSAPGTRKEIVPKCNGSLIKVNYNQTAVKVPTTPASPVKNWGGFRIPKKGERQQQGEAHDGACHQHSDYPYLGLGRVPAKERAKSKLKSDNENDGYVPDVEMSDSESEASEKKCIHTSSTISRRTDIIRRSILAS

SEQ ID NO: 746936 - protein, 907 aa, Homo sapiens
GWYGPEFLVTCASARCVRAGESRGPPGSPPAAARTHAAPSERAAPSPAPRPNPSAAGCLLFPGEIMKRGRLPSSSEDSDDNGSLSTTWSQNSRSQHRRSSCSRHEDRKPSEVFRTDLITAMKLHDSYQLNPDEYYVLADPWRQEWEKGVQVPVSPGTIPQPVARVVSEEKSLMFIRPKKYIVSSGSEPPELGYVDIRTLADSVCRYDLNDMDAAWLELTNEEFKEMGMPELDEYTMERVLEEFEQRCYDNMNHAIETEEGLGIEYDEDVVCDVCQSPDGEDGNEMVFCDKCNICVHQACYGILKVPEGSWLCRTCALGVQPKCLLCPKKGGAMKPTRSGTKWVHVSCALWIPEVSIGSPEKMEPITKVSHIPSSRWALVCSLCNEKFGASIQCSVKNCRTAFHVTCAFDRGLEMKTILAENDEVKFKSYCPKHSSHRKPEESLGKGAAQENGAPECSPRNPLEPFASLEQNREEAHRVSVRKQKLQQLEDEFYTFVNLLDVARALRLPEEVVDFLYQYWKLKRKVNFNKPLITPKKDEEDNLAKREQDVLFRRLQLFTHLRQDLERVRNLTYMVTRREKIKRSVCKVQEQIFNLYTKLLEQERVSGVPSSCSSSSLENMLLFNSPSVGPDAPKIEDLKWHSAFFRKQMGTSLVHSLKKPHKRDPLQNSPGSEGKTLLKQPDLCGRREGMVVPESFLGLEKTFAEARLISAQQKNGVVMPDHGKRRDNRFHCDLIKGDLKDKSFKQSHKPLRSTDVSQRHLDNTRAATSPGVGQSAPGTRKEIVPKCNGSLIKVNYNQTAVKVPTTPASPVKNWGGFRIPKKGERQQQGEAHDGACHQHSDYPYLGLGRVPAKERAKSKLKSDNENDGYVPDVEMSDSESEASEKKCIHTSSTISRRTDIIRRSILAS

SEQ ID NO: 746937 - protein, 842 aa, Homo sapiens; identical to SEQ ID NO: 746935

SEQ ID NO: 746938 - protein, 842 aa, Homo sapiens; identical to SEQ ID NO: 746935

SEQ ID NO: 746939 - protein, 509 aa, Homo sapiens
MKRGRLPSSSEDSDDNGSLSTTWSQNSRSQHRRSSCSRHEDRKPSEVFRTDLITAMKLHDSYQLNPDEYYVLADPWRQEWEKGVQVPVSPGTIPQPVARVVSEEKSLMFIRPKKYIVSSGSEPPELGYVDIRTLADSVCRYDLNDMDAAWLELTNEEFKEMGMPELDEYTMERVLEEFEQRCYDNMNHAIETEEGLGIEYDEDVVCDVCQSPDGEDGNEMVFCDKCNICVHQACYGILKVPEGSWLCRTCALGVQPKCLLCPKKGGAMKPTRSGTKWVHVSCALWIPEVSIGSPEKMEPITKVSHIPSSRWALVCSLCNEKFGASIQCSVKNCRTAFHVTCAFDRGLEMKTILAENDEVKFKSYCPKHSSHRKPEESLGKGAAQENGAPECSPRNPLEPFASLEQNREEAHRVSVRKQKLQQLEDEFYTFVNLLDVARALRLPEEVVDFLYQYWKLKRKVNFNKPLITPKKDEEDNLAKREQDVLFRRLQLFTHLRQDLERVMIDTDTL

SEQ ID NO: 746940 - protein, 876 aa, Homo sapiens
GTRQWGCLNFRGRLNSSLSPLPPVIGCLLFPGEIMKRGRLPSSSEDSDDNGSLSTTWSQNSRSQHRRSSCSRHEDRKPSEVFRTDLITAMKLHDSYQLNPDEYYVLADPWRQEWEKGVQVPVSPGTIPQPVARVVSEEKSLMFIRPKKYIVSSGSEPPELGYVDIRTLADSVCRYDLNDMDAAWLELTNEEFKEMGMPELDEYTMERVLEEFEQRCYDNMNHAIETEEGLGIEYDEDVVCDVCQSPDGEDGNEMVFCDKCNICVHQACYGILKVPEGSWLCRTCALGVQPKCLLCPKKGGAMKPTRSGTKWVHVSCALWIPEVSIGSPEKMEPITKVSHIPSSRWALVCSLCNEKFGASIQCSVKNCRTAFHVTCAFDRGLEMKTILAENDEVKFKSYCPKHSSHRKPEESLGKGAAQENGAPECSPRNPLEPFASLEQNREEAHRVSVRKQKLQQLEDEFYTFVNLLDVARALRLPEEVVDFLYQYWKLKRKVNFNKPLITPKKDEEDNLAKREQDVLFRRLQLFTHLRQDLERVRNLTYMVTRREKIKRSVCKVQEQIFNLYTKLLEQERVSGVPSSCSSSSLENMLLFNSPSVGPDAPKIEDLKWHSAFFRKQMGTSLVHSLKKPHKRDPLQNSPGSEGKTLLKQPDLCGRREGMVVPESFLGLEKTFAEARLISAQQKNGVVMPDHGKRRDNRFHCDLIKGDLKDKSFKQSHKPLRSTDVSQRHLDNTRAATSPGVGQSAPGTRKEIVPKCNGSLIKVNYNQTAVKVPTTPASPVKNWGGFRIPKKGERQQQGEAHDGACHQHSDYPYLGLGRVPAKERAKSKLKSDNENDGYVPDVEMSDSESEASEKKCIHTSSTISRRTDIIRRSILAS

SEQ ID NO: 746941 - protein, 842 aa, Homo sapiens; identical to SEQ ID NO: 746935

SEQ ID NO: 746942 - protein, 89 aa, Homo sapiens
ITAVLISFGHWGQWGESLLRSTNSSNPCWKRPQATIALDTELYAGLCCPRRLSCADEKGWGEARGRGGAELHKRAKPAVSNALVAVQGK

SEQ ID NO: 746943 - protein, 89 aa, Homo sapiens; identical to SEQ ID NO: 746942

SEQ ID NO: 746944 - protein, 357 aa, Homo sapiens
MNWVNKSVPQEFILLVFSDQPWLEIPPFVMFLFSYILTIFGNLTIILVSHVDFKLHTPMYFFLSNLSLLDLCYTTSTVPQMLVNICNTRKVISYGGCVAQLFIFLALGSTECLLLAVMCFDRFVAICRPLHYSIIMHQRLCFQLAAASWISGFSNSVLQSTWTLKMPLCGHKEVDHFFCEVPALLKLSCVDTTANEAELFFISVLFLLIPVTLILISYAFIVQAVLRIQSAEGQRKAFGTCGSHLIVVSLFYGTAISMYLQPPSPSSKDRGKMVSLFCGIIAPMLNPLIYTLRNKEVKEAFKRLVAKSLLNQEIRNMQMISFAKDTVLTYLTNFSASCPIFVITIENYCNLPQRKFP

SEQ ID NO: 746945 - protein, 107 aa, Homo sapiens [sequence omitted]

SEQ ID NO: 746946 - protein, 226 aa, Homo sapiens
LPSQLVILGPDVCHDFGKVLRFGASTSTVNSELAIWACEAFYFLFVVLLHEEQLLLEGLDLCLQLQPSDIGVINFLAKPMDVVLHRLAHGQLCLILDSKVISSKTGTVDLQNGAGIVHSICRDLSPQVLDGLEVMAPVSDLGSLLLQMLPDFALQLLVLSLQAPHSAQVGGQAVVQALHGLLLVLDASHSCQTPGHPRGQAPDPMPPWKLVEQDTEIQEPEPPAPA

SEQ ID NO: 746947 - protein, 407 aa, Homo sapiens
MNKSQGSVSFTDVTVDFTQEEWEQLDPSQRILYMDVMLENYSNLLSVEVWKADDQMERDHRNPDEQARQFLILKNQTPIEERGDLFGKALNLNTDFVSLRQVPYKYDLYEKTLKYNSDLLNSNRSYAGKQTDECNEFGKALLYLKQEKTHSGVEYSEYNKSGKALSHKAAIFKHQKIKNLVQPFICTYCDKAFSFKSLLISHKRIHTGEKPYECNVCKKTFSHKANLIKHQRIHTGEKPFECPECGKAFTHQSNLIVHQRAHMEKKPYECSECGKTFAQKFELTTHQRIHTGERPYECNECAKTFFKKSNLIIHQKIHTGEKRYECSECGKSFIQNSQLIIHMRTHTGEKPYECTECGKTFSQRSTLRLHLRIHTGEKPYECSECGKAFSRKSRLSVHQRVHIGEKP

SEQ ID NO: 746948 - protein, 219 aa, Homo sapiens
MDRSLRNVLVVSFGFLLLFTAYGGLQSLQSSLYSEEGLGVTALSTLYGGMLLSSMFLPPLLIERLGCKGTIILSMCGYVAFSVGNFFASWYTLIPTSILLGLGAAPLWSAQCTYLTITGNTHAEKAGKRGKDMVNQYFGIFFLIFQSSGVWGNLISSLVFGQTPSQETLPEEQLTSCGASDCLMATTTTNSTQRPSQQLVYTLLGIYTGTSSIGPGQGP

SEQ ID NO: 746949 - protein, 159 aa, Homo sapiens
MEGLSDVASFATKLKNTLIQYHSIEEDKWRVAKKTKDVTVWRKPSEEFNGYLYKAQGVIDDLVYSIIDHIRPGPCRLDWDSLMTSLDILENFEENCCVMRYTTAGQLWNIISPREFVDFSYTVGYKEGLLSCGNNLNMLCFFSVWFKYLCFLGWMSLSL

SEQ ID NO: 746950 - protein, 127 aa, Homo sapiens
RTLYSSYWFGENLRRINGYLYKAQGVIDDLVYSIIDHIRPGPCRLDWDSLMTSLDILENFEENCCVMRYTTAGQLWNIISPREFVDFSYTVGYKEGLLSCGNNLNMLCFFSVWFKYLCFLGWMSLSL

SEQ ID NO: 746951 - protein, 122 aa, Homo sapiens
PNPCDTNFLYNKPAHVSLSLKQKFFKKKKSNYFKMFYKALQWLIPAYFSTSYHVIFFPHTRHIPGTLATFQFLKPTLFLDLEAFNSMFLNSILPGSIPSVLFTGKTPLPSRDCCPLKCGFPQ

SEQ ID NO: 746952 - protein, 525 aa, Homo sapiens
VHIMDPGCLYYGVQPVGTPGAPDRRESRGVCQGRAEHRLSRQDLEAREDAGYASLELPGDSTLLSPTLETEETSDDLISPYASFSFTADRLTPLLSGWLDKLSPQGNYVFQRRFVQFNGRSLMYFGSDKDPFPKGVIPLTAIEMTRSSKDNKFQVITGQRVFVFRTESEAQRDMWCSTLQSCLKEQRLLGHPRPPQPPRPLRTGMLELRGHKAKVFAALSPGELALYKSEQAFSLGIGICFIELQGCSVRETKSRSFDLLTPHRCFSFTAESGGARQSWAAALQEAVTETLSDYEVAEKIWSNRANRQCADCGSSRPDWAAVNLGVVICKQCAGQHRALGSGISKVQSLKLDTSVWSNEIVQLFIVLGNDRANRFWAGTLPPGEGLHPDATPGPRGEFISRKYRLGLFRKPHPQYPDHSQLLQALCAAVARPNLLKNMTQLLCVEAFEGEEPWFPPAPDGSCPGLLPSDPSPGVYNEVVVRATYSGFLYCSPVSNKAGPSPPRRGRDAPPRLWCVLGAALEMFAS

SEQ ID NO: 746953 - protein, 123 aa, Homo sapiens
RSKVTNSVQVITHVKEKLHFMDMENACKKTQLAEIEAQAALGRDILTKTKQAREGLRTDNIRLNQKCGLLGKDSLLRDLEEKVDKTELLHRRLESLKRHHASLTLSCRGVRQKIREAKAFLPS

SEQ ID NO: 746954 - protein, 877 aa, Homo sapiens
MARPRRAREPLLVALLPLAWLAQAGLARAAGSVRLAGGLTLGGLFPVHARGAAGRACGPLKKEQGVHRLEAMLYALDRVNADPELLPGVRLGARLLDTCSRDTYALEQALSFVQALIRGRGDGDEVGVRCPGGVPPLRPAPPERVVAVVGASASSVSIMVANVLRLFAIPQISYASTAPELSDSTRYDFFSRVVPPDSYQAQAMVDIVRALGWNYVSTLASEGNYGESGVEAFVQISREAGGVCIAQSIKIPREPKPGEFSKVIRRLMETPNARGIIIFANEDDIRRVLEAARQANLTGHFLWVGSDSWGAKTSPILSLEDVAVGAITILPKRASIDGFDQYFMTRSLENNRRNIWFAEFWEENFNCKLTSSGTQSDDSTRKCTGEERIGRDSTYEQEGKVQFVIDAVYAIAHALHSMHQALCPGHTGLCPAMEPTDGRMLLQYIRAVRFNGSAGTPVMFNENGDAPGRYDIFQYQATNGSASSGGYQAVGQWAETLRLDVEALQWSGDPHEVPSSLCSLPCGPGERKKMVKGVPCCWHCEACDGYRFQVDEFTCEACPGDMRPTPNHTGCRPTPVVRLSWSSPWAAPPLLLAVLGIVATTTVVATFVRYNNTPIVRASGRELSYVLLTGIFLIYAITFLMVAEPGAAVCAARRLFLGLGTTLSYSALLTKTNRIYRIFEQGKRSVTPPPFISPTSQLVITFSLTSLQVVGMIAWLGARPPHSVIDYEEQRTVDPEQARGVLKCDMSDLSLIGCLGYSLLLMVTCTVYAIKARGVPETFNEAKPIGFTMYTTCIIWLAFVPIFFGTAQSAEKIYIQTTTLTVSLSLSASVSLGMLYVPKTYVILFHPEQNVQKRKRSLKATSTVAAPPKGEDAEAHK

SEQ ID NO: 746955 - protein, 247 aa, Homo sapiens
MAWAGSRRVPAGTRAAAERCCRLSLSPGAQPAPPPGPLPPPRPMRFLTSCSLLLPRAAQILAAEAGLPSSRSFMGFAAPFTNKRKAYSERRIMGYSMQEMYEVVSNVQEYREFVPWCKKSLVVSSRKGHLKAQLEVGFPPVMERYTSAVSMVKPHMVKAVCTDGKLFNHLETIWRFSPGIPAYPRTCTVDFSISFEFRSLLHSQLATMFFDEVVKQNVAAFERRAATKFGPETAIPRELMFHEVHQT

SEQ ID NO: 746956 - protein, 252 aa, Homo sapiens
GSLRTPGFRGGGVLYWDAGAAGTGSNHALGANVELWIMLLQVVREGKFSGFLTSCSLLLPRAAQILAAEAGLPSSRSFMGFAAPFTNKRKAYSERRIMGYSMQEMYEVVSNVQEYREFVPWCKKSLVVSSRKGHLKAQLEVGFPPVMERYTSAVSMVKPHMVKAVCTDGKLFNHLETIWRFSPGIPAYPRTCTVDFSISFEFRSLLHSQLATMFFDEVVKQNVAAFERRAATKFGPETAIPRELMFHEVHQT

SEQ ID NO: 746957 - protein, 247 aa, Homo sapiens; identical to SEQ ID NO: 746955

SEQ ID NO: 746958 - protein, 151 aa, Homo sapiens
MQEMYEVVSNVQEYREFVPWCKKSLVVSSRKGHLKAQLEVGFPPVMERYTSAVSMVKPHMVKAVCTDGKLFNHLETIWRFSPGIPAYPRTCTVDFSISFEFRSLLHSQLATMFFDEVVKQNVAAFERRAATKFGPETAIPRELMFHEVHQT

SEQ ID NO: 746959 - protein, 176 aa, Homo sapiens
MAWAGSRRVPAGTRAAAERCCRLSLSPGAQPAPPPGPLPPPRPMRFLTSCSLLLPRAAQILAAEAGLPSSRSFMGFAAPFTNKRKAYSERRIMGYSMQEMYEVVSNVQEYREFVPWCKKSLVVSSRKGHLKAQLEVGFPPVMERYTSAVSMVKPHMVKVRPVWEGLTRFFVFSSFI

SEQ ID NO: 746960 - protein, 114 aa, Homo sapiens
MAWAGSRRVPAGTRAAAERCCRLSLSPGAQPAPPPGPLPPPRPMRFLTSCSLLLPRAAQILAAEAGLPSSRSFMGFAAPFTNKRKAYSERRIMGYSMQEMYEVVSNVQEYRCLY

SEQ ID NO: 746961 - protein, 193 aa, Homo sapiens
MDGGTLPRSAPPAPPVPVGCAARRRPASPELLRCSRRRRPATAETGGGAAAVARRNERERNRVKLVNLGFQALRQHVPHGGASKKLSKVETLRSAVEYIRALQRLLAEHDAVRNALAGGLRPQAVRPSAPRGPPGTTPVAASPSRASSSPGRGGSSEPGSPRSAYSSDDSGCEGALSPAERELLDFSSWLGGY

SEQ ID NO: 746962 - protein, 736 aa, Homo sapiens
MAGIIKKQILKHLSRFTKNLSPDKINLSTLKGEGQLTNLELDEEVLQNVLELPTWLAITRVYCNRASIRIQWTKLKTHPICLCLDKVEVEMKTCEDPRPPNGQSPIALASGQSEYGFAEKVVEGMFIIVNSITIKIHSKAFHASFELWQLQGYSVNPNWQQSDLRLTRITDPCRGEVLTFKEITWQTLRIEADATDNGDQDPVTTPLRLITNQGRIQIALKRRTKDCNVISSKLMFLLDDLLWVLTDSQLKAMMKYAESLSEAMEKSAHQRKSLAPEPVQITPPAPSAQQSWAQAFGGSQGNSNSSSSRLSQYFEKFDVKESSYHLLISRLDLHICDDSQSREPGVSANRLMGGAMQLTFRKMAFDYYPFHWAGDSCKHWVRHCEAMETRGQWAQKLVMEFQSKMEKWHEETGLKPPWHLGVDSLFRRKADSLSSPRKNPLERSPSQGRQPAFQPPAWNRLRSSCMVVRVDDLDIHQVSTAGQPSKKPSTLLSCSRKLHNLPTQVSAIHIEFTEYYFPDNQELPVPCPNLYIQLNGLTFTMDPVSLLWGNLFCLDLYRSLEQFKAIYKLEDSSQKDEHLDIRLDAFWLKVSFPLEKRERAELHRPQALVFSASGMIATNTRHAPHCSCSDLQSLFRGFAAAEFFHSNYDHFPKVPGGFSLLHMLFLHHAFQMDSCLPPLTGFLPKWAIIEEFTKNNSLIIPTIIATITLLNLYFYLRLIYSTSITLLPISNNVKIK

SEQ ID NO: 746963 - protein, 126 aa, Homo sapiens
MPEPSKSAPAPKKGSKKAITKAQKKDGKKRKRSRKESYSIYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 746964 - protein, 184 aa, Homo sapiens
KKAGQAYWTFNRVEEKLLEVGSPYQEEAARHTYQALNSLLVAELPQFNQLVMQWLGQILCTFVTLQRDLAKQVLQRAEGSMAQLPHHHVPEPAFRKLVEDALGRTSNQLRSFQETFEKVQPPPTTQPLLPGSERQVQALLSRYGPGKLYQVTSNISGTGTLDLTLPRGQIVAILQNKDTKGNSG

SEQ ID NO: 746965 - protein, 70 aa, Homo sapiens
MLVPALTGLFKHLCLSVLLLSQPLLPGSERQVQALLSRYGPGKLYQVTSNISGTGTLDLTLPRGQIVAIL

SEQ ID NO: 746966 - protein, 150 aa, Homo sapiens
RPHACFAPTAWVHPHDPPLARKSGHLPTSQMRQLKTRDGERAATGSSEEMWWAPWENLASTRESEPRPRSPLALTHFHAVVRPATRVAFATTQLGSQTGAASSHCRRVTQGPHCPIPAQIAGHSGSAALWPRSGSGEPGCGWGAWRMRAK

SEQ ID NO: 746967 - protein, 240 aa, Homo sapiens
MSKPSDHIKRPMNAFMVWSRGQRRKMAQENPKMHNSEISKRLGAEWKLLSEAEKRPYIDEAKRLRAQHMKEHPDYKYRPRRKPKNLLKKDRYVFPLPYLGDTDPLKAAGLPVGASDGLLSAPEKARAFLPPASAPYSLLDPAQFSSSAIQKMGEVPHTLATGALPYASTLGYQNGAFGSLSCPSQHTHTHPSPTNPGYVVPCNCTAWSASTLQPPVAYILFPGMTKTGIDPYSSAHATAM

SEQ ID NO: 746968 - protein, 466 aa, Homo sapiens
MNNSTNSSNNSLALTSPYKTFEVVFIVLVAGSLSLVTIIGNILVMVSIKVNRHLQTVNNYFLFSLACADLIIGVFSMNLYTLYTVIGYWPLGPVVCDLWLALDYVVSNASVMNLLIISFDRYFCVTKPLTYPVKRTTKMAGMMIAAAWVLSFILWAPAILFWQFIVGVRTVEDGECYIQFFSNAAVTFGTAIAAFYLPVIIMTVLYWHISRASKSRIKKDKKEPVANQDPVSPSLVQGRIVKPNNNNMPSSDDGLEHNKIQNGKAPRDPVTENCVQGEEKESSNDSTSVSAVASNMRDDEITQDENTVSTSLGHSKDENSKQTCIRIGTKTPKSDSCTPTNTTVEVVGSSGQNGDEKQNIVARKIVKMTKQPAKKKPPPSREKKVTRTILAILLAFIITWAPYNVMVLINTFCAPCIPNTVWTIGYWLCYINSTINPACYALCNATFKKTFKHLLMCHYKNIGATR

SEQ ID NO: 746969 - protein, 456 aa, Homo sapiens
MNNSTNSSNNSLALTSPYKTFEVVFIVLVAGSLSLVTIIGNILVMVSIKVNRHLQTVNNYFLFSLACADLIIGVFSMNLYTLYTVIGYWPLGPVVCDLWLALDYVVSNASVMNLLIISFDRYFCVTKPLTYPVKRTTKMAGMMIAAAWVLSFILWAPAILFWQFIVGVRTVEDGECYIQFFSNAAVTFGTAIAAFYLPVIIMTVLYWHISRASKSRIKKDKKEPVANQDPVSPSLVQGRIVKPNNNNMPSSDDGLEHNKIQNGKAPRDPVTENCVQGEEKESSNDSTSVSAVASNMRDDEITQDENTVSTSLGHSKDENSKQTCIRIGTKTPKSDSCTPTNTTVEVVGSSGQNGDEKQNIVARKIVKMTKQPAKKKPPPSREKKVTRTILAILLAFIITWAPYNVMVLINTFCAPCIPNTVWTIGYWLCYINSTINPACYALCNATFKKTFKHLLM

SEQ ID NO: 746970 - protein, 149 aa, Homo sapiens
LEDSFDGVWKEVKKTAEMNEKLSKMGESSLRNFTMDTESSVYNFEGEDYREKQKIAFTEWIEPPKRERKANYAVDAYFREALRVSEPKAPKAPRPPKQPNVQDFQFFPPRLFELLEKEILFYRKTIGYKVPRNPELPNAAQNTVEGVPS

SEQ ID NO: 746971 - protein, 51 aa, Homo sapiens
VQTLIPKAPRPPKQPNVQDFQFFPPRLFELLEKEILFYRKTIGYKVIGNYL

SEQ ID NO: 746972 - protein, 491 aa, Homo sapiens
DAWVDPRVRADVVILYDSDWNPQVDLQAMDRAHRIGQTKTVRVFRFITDNTVEERIVERAEMKLRLDSIVIQQGRLVDQNLNKIGKDEMLQMIRHGATHVFASKESEITDEDIDGILERGAKKTAEMNEKLSKMGESSLRNFTMDTESSVYNFEGEDYREKQKIAFTEWIEPPKRERKANYAVDAYFREALRVSEPKAPKAPRPPKQPNVQDFQFFPPRLFELLEKEILFYRKTIGYKVPRNPELPNAAQAQKEEQLKIDEAESLNDEELEEKEKLLTQGFTNWNKRDFNQFIKANEKWGRDDIENIAREVEGKTPEEVIEYSAVFWERCNELQDIEKIMAQIERGEARIQRRISIKKALDTKIGRYKAPFHQLRISYGTNKGKNYTEEEDRFLICMLHKLGFDKENVYDELRQCIRNSPQFRFDWFLKSRTAMELQRRCNTLITLIERENMELEEKEKAEKKKRGPKPSTQKRKMDGAPDGRGRKKKLKL

SEQ ID NO: 746973 - protein, 1052 aa, Homo sapiens
MSSAAEPPPPPPPESAPSKPAASIASGGSNSSNKGGPEGVAAQAVASAASAGPADAEMEEIFDDASPGKQKEIQEPDPTYEEKMQTDRANRFEYLLKQTELFAHFIQPAAQKTPTSPLKMKPGRPRIKKDEKQNLLSVGDYRHRRTEQEEDEELLTESSKATNVCTRFEDSPSYVKWGKLRDYQVRGLNWLISLYENGINGILADEMGLGKTLQTISLLGYMKHYRNIPGPHMVLVPKSTLHNWMSEFKRWVPTLRSVCLIGDKEQRAAFVRDVLLPGEWDVCVTSYEMLIKEKSVFKKFNWRYLVIDEAHRIKNEKSKLSEIVREFKTTNRLLLTGTPLQNNLHELWSLLNFLLPDVFNSADDFDSWFDTNNCLGDQKLVERLHMVLRPFLLRRIKADVEKSLPPKKEVKIYVGLSKMQREWYTRILMKDIDILNSAGKMDKMRLLNILMQLRKCCNHPYLFDGAEPGPPYTTDMHLVTNSGKMVVLDKLLPKLKEQGSRVLIFSQMTRVLDILEDYCMWRNYEYCRLDGQTPHDERQDSINAYNEPNSTKFVFMLSTRAGGLGINLATADVVILYDSDWNPQVDLQAMDRAHRIGQTKTVRVFRFITDNTVEERIVERAEMKLRLDSIVIQQGRLVDQNLNKIGKDEMLQMIRHGATHVFASKESEITDEDIDGILERGAKKTAEMNEKLSKMGESSLRNFTMDTESSVYNFEGEDYREKQKIAFTEWIEPPKRERKANYAVDAYFREALRVSEPKAPKAPRPPKQPNVQDFQFFPPRLFELLEKEILFYRKTIGYKVPRNPELPNAAQAQKEEQLKIDEAESLNDEELEEKEKLLTQGFTNWNKRDFNQFIKANEKWGRDDIENIAREVEGKTPEEVIEYSAVFWERCNELQDIEKIMAQIERGEARIQRRISIKKALDTKIGRYKAPFHQLRISYGTNKGKNYTEEEDRFLICMLHKLGFDKENVYDELRQCIRNSPQFRFDWFLKSRTAMELQRRCNTLITLIERENMELEEKEKAEKKKRGPKPSTQKRKMDGAPDGRGRKKKLKL

SEQ ID NO: 746974 - protein, 769 aa, Homo sapiens
MSSAAEPPPPPPPESAPSKPAASIASGGSNSSNKGGPEGVAAQAVASAASAGPADAEMEEIFDDASPGKQKEIQEPDPTYEEKMQTDRANRFEYLLKQTELFAHFIQPAAQKTPTSPLKMKPGRPRIKKDEKQNLLSVGDYRHRRTEQEEDEELLTESSKATNVCTRFEDSPSYVKWGKLRDYQVRGLNWLISLYENGINGILADEMGLGKTLQTISLLGYMKHYRNIPGPHMVLVPKSTLHNWMSEFKRWVPTLRSVCLIGDKEQRAAFVRDVLLPGEWDVCVTSYEMLIKEKSVFKKFNWRYLVIDEAHRIKNEKSKLSEIVREFKTTNRLLLTGTPLQNNLHELWSLLNFLLPDVFNSADDFDSWFDTNNCLGDQKLVERLHMVLRPFLLRRIKADVEKSLPPKKEVKIYVGLSKMQREWYTRILMKDIDILNSAGKMDKMRLLNILMQLRKCCNHPYLFDGAEPGPPYTTDMHLVTNSGKMVVLDKLLPKLKEQGSRVLIFSQMTRVLDILEDYCMWRNYEYCRLDGQTPHDERQDSINAYNEPNSTKFVFMLSTRAGGLGINLATADVVILYDSDWNPQVDLQAMDRAHRIGQTKTVRVFRFITDNTVEERIVERAEMKLRLDSIVIQQGRLVDQNLNKIGKDEMLQMIRHGATHVFASKESEITDEDIDGILERGAKKTAEMNEKLSKMGESSLRNFTMDTESSVYNFEGEDYREKQKIAFTEWIEPPKRERKANYAVDAYFREALRVSEPKAPKVLYFKTKR

SEQ ID NO: 746975 - protein, 691 aa, Homo sapiens
MSSAAEPPPPPPPESAPSKPAASIASGGSNSSNKGGPEGVAAQAVASAASAGPADAEMEEIFDDASPGKQKEIQEPDPTYEEKMQTDRANRFEYLLKQTELFAHFIQPAAQKTPTSPLKMKPGRPRIKKDEKQNLLSVGDYRHRRTEQEEDEELLTESSKATNVCTRFEDSPSYVKWGKLRDYQVRGLNWLISLYENGINGILADEMGLGKTLQTISLLGYMKHYRNIPGPHMVLVPKSTLHNWMSEFKRWVPTLRSVCLIGDKEQRAAFVRDVLLPGEWDVCVTSYEMLIKEKSVFKKFNWRYLVIDEAHRIKNEKSKLSEIVREFKTTNRLLLTGTPLQNNLHELWSLLNFLLPDVFNSADDFDSWFDTNNCLGDQKLVERLHMVLRPFLLRRIKADVEKSLPPKKEVKIYVGLSKMQREWYTRILMKDIDILNSAGKMDKMRLLNILMQLRKCCNHPYLFDGAEPGPPYTTDMHLVTNSGKMVVLDKLLPKLKEQGSRVLIFSQMTRVLDILEDYCMWRNYEYCRLDGQTPHDERQDSINAYNEPNSTKFVFMLSTRAGGLGINLATADVVILYDSDWNPQVDLQAMDRAHRIGQTKTVRVFRFITDNTVEERIVERAEMKLRLDSIVIQQGRLVDQNLNKIGKDEMLQMIRHGATHVFASKESEITDEDIDGILERGAKKVRCRLNN

SEQ ID NO: 746976 - protein, 1052 aa, Homo sapiens; identical to SEQ ID NO: 746973

SEQ ID NO: 746977 - protein, 1052 aa, Homo sapiens; identical to SEQ ID NO: 746973

SEQ ID NO: 746978 - protein, 1052 aa, Homo sapiens; identical to SEQ ID NO: 746973

SEQ ID NO: 746979 - protein, 931 aa, Homo sapiens
MSSAAEPPPPPPPESAPSKPAASIASGGSNSSNKGGPEGVAAQAVASAASAGPADAEMEEIFDDASPGKQKEIQEPDPTYEEKMQTDRANRFEYLLKQTELFAHFIQPAAQKTPTSPLKMKPGRPRIKKDEKQNLLSVGDYRHRRTEQEEDEELLTESSKATNVCTRFEDSPSYVKWGKLRDYQVRGLNWLISLYENGINGILADEMGLGKTLQTISLLGYMKHYRNIPGPHMVLVPKSTLHNWMSEFKRWVPTLRSVCLIGDKEQRAAFVRDVLLPGEWDVCVTSYEMLIKEKSVFKKFNWRYLVIDEAHRIKNEKSKLSEIVREFKTTNRLLLTGTPLQNNLHELWSLLNFLLPDVFNSADDFDSWFDTNNCLGDQKLVERLHMVLRPFLLRRIKADVEKSLPPKKEVKIYVGLSKMQREWYTRILMKDIDILNSAGKMDKMRLLNILMQLRKCCNHPYLFDGAEPGPPYTTDMHLVTNSGKMVVLDKLLPKLKEQGSRVLIFSQMTRVLDILEDYCMWRNYEYCRLDGQTPHDERQDSINAYNEPNSTKFVFMLSTRAGGLGINLATADVVILYDSDWNPQVDLQAMDRAHRIGQTKTVRVFRFITDNTVEERIVERAEMKLRLDSIVIQQGRLVDQNLNKIGKDEMLQMIRHGATHVFASKESEITDEDIDGILERGAKKTAEMNEKLSKMGESSLRNFTMDTESSVYNFEGEDYREKQKIAFTEWIEPPKRERKANYAVDAYFREALRVSEPKAPKAPRPPKQPNVQDFQFFPPRLFELLEKEILFYRKTIGYKVPRNPELPNAAQAQKEEQLKIDEAESLNDEELEEKEKLLTQGFTNWNKRDFNQFIKANEKWGRDDIENIAREVEGKTPEEVIEYSAVFWERCNELQDIEKIMAQIERGEARRGGRRGRGGRRGRGGRRGRVP

SEQ ID NO: 746980 - protein, 726 aa, Homo sapiens
MSSAAEPPPPPPPESAPSKPAASIASGGSNSSNKGGPEGVAAQAVASAASAGPADAEMEEIFDDASPGKQKEIQEPDPTYEEKMQTDRANRFEYLLKQTELFAHFIQPAAQKTPTSPLKMKPGRPRIKKDEKQNLLSVGDYRHRRTEQEEDEELLTESSKATNVCTRFEDSPSYVKWGKLRDYQVRGLNWLISLYENGINGILADEMGLGKTLQTISLLGYMKHYRNIPGPHMVLVPKSTLHNWMSEFKRWVPTLRSVCLIGDKEQRAAFVRDVLLPGEWDVCVTSYEMLIKEKSVFKKFNWRYLVIDEAHRIKNEKSKLSEIVREFKTTNRLLLTGTPLQNNLHELWSLLNFLLPDVFNSADDFDSWFDTNNCLGDQKLVERLHMVLRPFLLRRIKADVEKSLPPKKEVKIYVGLSKMQREWYTRILMKDIDILNSAGKMDKMRLLNILMQLRKCCNHPYLFDGAEPGPPYTTDMHLVTNSGKMVVLDKLLPKLKEQGSRVLIFSQMTRVLDILEDYCMWRNYEYCRLDGQTPHDERQDSINAYNEPNSTKFVFMLSTRAGGLGINLATADVVILYDSDWNPQVDLQAMDRAHRIGQTKTVRVFRFITDNTVEERIVERAEMKLRLDSIVIQQGRLVDQNLNKIGKDEMLQMIRHGATHVFASKESEITDEDIDGILERGAKKTAEMNEKLSKMGESSLRNFTMDTESSVYNFEGEDYREKQKVI

SEQ ID NO: 746981 - protein, 548 aa, Homo sapiens
GGASGHRSGQEQRPRRRRDQRAQARSGVLAAGTSPPGPGRPPAAGKMPEQSNDYRVVVFGAGGVGKSSLVLRFVKGTFRDTYIPTIEDTYRQVISCDKSVCTLQITDTTGSHQFPAMQRLSISKGHAFILVFSVTSKQSLEELGPIYKLIVQIKGSVEDIPVMLVGNKCDETQREVDTREAQAVAQEWKCAFMETSAKMNYNVKELFQELLTLETRRNMSLNIDGKRSGKQKRTDRVKGKCTLMGARNARRRGGERKVGEMTRWTRRHEEEPEGYERMTGDEVSRKTEQNDTQRQPKRKKNRTRRPAQKSRRETKKDNKKQKRQQNHPETQDQPQNTPTKRCAGDPAKHKTPKTSKEAPKEEKNDIENRKREEANDRTTNDQTKGDQKDKKRDREKPTAHTKNDTTGKDIKPEDSNTQQKSEHKNQRKTKGAHEPKSKERAGEGKTNRRKGPEARNESTRQKHTKQTRRERKRNRSEQNQTSNKTPTTRANNQEREGSTTEQRPPRQRTEKDANEKGKQPQQNRQAKKHRATRPNTAAPTNKQTTKTK

SEQ ID NO: 746982 - protein, 950 aa, Homo sapiens [sequence omitted]

SEQ ID NO: 746983 - protein, 848 aa, Homo sapiens
MGDTPLHRAAFTGRKELVMLLLEYNADTTIVNGSGQTAKEVTHAEEIRSMLEAVERTQQRKLEELLLAAAREGKTTELTALLNRPNPPDVNCSDQLGNTPLHCAAYRAHKQCALKLLRSGADPNLKNKNDQKPLDLAQGAEMKHILVGNKVIYKALKRYEGPLWKSSRFFGWRLFWVVLEHGVLSWYRKQPDAVHNIYRQGCKHLTQAVCTVKSTDSCLFFIKCFDDTIHGFRVPKNSLQQSREDWLEAIEEHSAYSTHYCSQDQLTDEEEEDTVSAADLKKSLEKAQSCQQRLDREISNFLKMIKECDMAKEMLPSFLQKVEVVSEASRETCVALTDCLNLFTKQEGVRNFKLEQEQEKNKILSEALETLATEHHELEQSLVKGSPPASILSEDEFYDALSDSESERSLSRLEAVTARSFEEEGEHLGSRKHRMSEEKDCGGGDALSNGIKKHRTSLPSPMFSRNDFSIWSILRKCIGMELSKITMPVIFNEPLSFLQRLTEYMEHTYLIHKASSLSDPVERMQCVAAFAVSAVASQWERTGKPLVSHHPPISAFHAEGLNNDFIFHGSIYPKLKFWGKSVEAEPKGTITLELLEHNEAYTWTNPTCCVHNIIVGKLWIEQYGNVEIINHKTGDKCVLNFKPCGLFGKELHKVEGYIQDKSKKKLCALYGKWTECLYSVDPATFDAYKKNDKKNTEEKKNSKQMSTPEELDEMPVPDSESVFIIPGSVLLWRIAPRPPNSAQMYNFTSFAMVLNEVDKDMESVIPKTDCRLRPDIRAMENGEIDQASEEKKRLEEKQRAARKNRSKSEEDWKTRWFHQGPNPYNGAQDWIYSGSYWDRNYFNLPDIY

SEQ ID NO: 746984 - protein, 927 aa, Homo sapiens
MNTEAEQQLLHHARNGNAEEVRQLLETMARNEVIADINCKGRSKSNLGWTPLHLACYFGHRQVVQDLLKAGAEVNVLNDMGDTPLHRAAFTGRKELVMLLLEYNADTTIVNGSGQTAKEVTHAEEIRSMLEAVERTQQRKLEELLLAAAREGKTTELTALLNRPNPPDVNCSDQLGNTPLHCAAYRAHKQCALKLLRSGADPNLKNKNDQKPLDLAQGAEMKHILVGNKVIYKALKRYEGPLWKSSRFFGWRLFWVVLEHGVLSWYRKQPDAVHNIYRQGCKHLTQAVCTVKSTDSCLFFIKCFDDTIHGFRVPKNSLQQSREDWLEAIEEHSAYSTHYCSQDQLTDEEEEDTVSAADLKKSLEKAQSCQQRLDREISNFLKMIKECDMAKEMLPSFLQKVEVVSEASRETCVALTDCLNLFTKQEGVRNFKLEQEQEKNKILSEALETLATEHHELEQSLVKGSPPASILSEDEFYDALSDSESERSLSRLEAVTARSFEEEGEHLGSRKHRMSEEKDCGGGDALSNGIKKHRTSLPSPMFSRNDFSIWSILRKCIGMELSKITMPVIFNEPLSFLQRLTEYMEHTYLIHKASSLSDPVERMQCVAAFAVSAVASQWERTGKPLVSHHPPISAFHAEGLNNDFIFHGSIYPKLKFWGKSVEAEPKGTITLELLEHNEAYTWTNPTCCVHNIIVGKLWIEQYGNVEIINHKTGDKCVLNFKPCGLFGKELHKVEGYIQDKSKKKLCALYGKWTECLYSVDPATFDAYKKNDKKNTEEKKNSKQMSTPEELDEMPVPDSESVFIIPGSVLLWRIAPRPPNSAQMYNFTSFAMVLNEVDKDMESVIPKTDCRLRPDIRAMENGEIDQASEEKKRLEEKQRAARKNRSKSEEDWKTRWFHQGPNPYNGAQDWIYSGSYWDRNYFNLPDIY

SEQ ID NO: 746985 - protein, 112 aa, Homo sapiens
KYLLYQNLLNDWSRGSQLGTVLAPQGKSGHVWRHFWLSQLGHCYWHLVGRGQGCYEMSYNTQASLLQQRITARGSPVLRSRVQDGSHSSQQDQPWRIVLFCFFSAPGVLPMF

SEQ ID NO: 746986 - protein, 1095 aa, Homo sapiens
TVPATTVKIVSLGGGCNMIQPVNAAVAQSPQTIPITTLLVNPTSFPCPLNQSLVASSVSPLIVSGNSVNLPIPSTPEDKAHVNVDIACAVADGENAFQGLEPKLEPQELSPLSATVFPKVEHSPGPPLADAECQEGLSENSACRWTVVKTEEGRQALEPLPQGIQESLNNPTPGDLEEIVKMEPEEAREEISGSPERDICDDIKVEHAVELDTGAPSEELSSAGEVTKQTVLQKEEERSQPTKTPSSSQEPPDEGTSGTDVNKGSSKNALSSMDPEVRLSSPPGKPEDSSSVDGQSVGTPVGPETGGEKNGPEEEEEEDFDDLTQDEEDEMSSASEESVLSVPELQETMEKLTWLASERRMSQEGESEEENSQEENSEPEEEEEEEAEGMESLQKEDEMTDEAVGDSAEKPPTFASPETAPEVETSRTPPGESIKAAGKGRNNHRARNKRGSRARASKDTSKLLLLYDEDILERDPLREQKDLAFAQAYLTRVREALQHIPGKYEDFLQVIYEFESSTQRRTAVDLYKSLQILLQDWPQLLKDFAAFLLPEQALACGLFEEQQAFEKSRKFLRQLEICFAENPSHHQKIIKVLQGCADCLPQEITELKTQMWQLLKGHDHLQDEFSIFFDHLRPAASRMGDFEEINWTEEKEYEFDGFEEVALPDVEEEEEPPKIPTASKNKRKKEIGVQNHDKETEWPDGAKDCACSCHEGGPDSKLKKSKRRSCSHCSSKVCDSKSYKSKEPHELVGSSPHREASPMPGAKEAGQGKDMMEEEAPEERESTEATQSRTVRTTRKGEMPVSGLAVGSTLPSPREVTVTERLLLDGPPPHSPETPQFPPTTGAVLYTVKRNQVGPEVRSCPKASPRLQKEREGQKAVSESEALMLVWDASETEKLPGTVEPPASFLSPVSSKTRDAGRRHVSGKPDTQERWLPSSRARVKTRDRTCPVHESPSGIDTSETSPKAPRGGLAKDSGTQAKGPEGEQQPKAAEATVCANNSKVSSTGEKVVLWTREADRVILTMCQEQGAQPQTFNIISQQLGNKTPAEVSHRFRELMQLFHTACEASSEDEDDATSTSNADQLSDHGDLLSEEELDE

SEQ ID NO: 746987 - protein, 147 aa, Homo sapiens
MWQLLKGHDHLQDEFSIFFDHLRPAASRMGDFEEINWTEEKEYEFDGFEEVALPDVEEEEEPPKIPTASKNKRKKEIGVQNHDKETEWPDGAKDCACSCHEGGPDSKLKKSKRRSCSHCSSKVRKVSRVPRVSELLGDCLLPRIVPY

SEQ ID NO: 746988 - protein, 1073 aa, Homo sapiens
TVPATTVKIVSLGGGCNMIQPVNAAVAQSPQTIPITTLLVNPTSFPCPLNQSLVASSVSPLIVSGNSVNLPIPSTPEDKAHVNVDIACAVADGENAFQGLEPKLEPQELSPLSATVFPKVEHSPGPPLADAECQEGLSENSACRWTVVKTEEGRQALEPLPQGIQESLNNPTPGDLEEIVKMEPEEAREEISGSPERDICDDIKVEHAVELDTGAPSEELSSAGEVTKQTVLQKEEERSQPTKTPSSSQEPPDEGTSGTDVNKGSSKNALSSMDPEVRLSSPPGKPEDSSSVDGQSVGTPVGPETGGEKNGPEEEEEEDFDDLTQDEEDEMSSASEESVLSVPELQETMEKLTWLASERRMSQEGESEEENSQEENSEPEEEEEEEAEGMESLQKEDEMTDEAVGDSAEKPPTFASPETAPEVETSRTPPGESIKAAGKGRNNHRARNKRGSRARASKDTSKLLLLYDEDILERDPLREQKDLAFAQAYLTRVREALQHIPGKYEDFLQVIYEFESSTQRRTAVDLYKSLQILLQDWPQLLKDFAAFLLPGASSGLWIKNPSHHQKIIKVLQGCADCLPQEITELKTQMWQLLKGHDHLQDEFSIFFDHLRPAASRMGDFEEINWTEEKEYEFDGFEEVALPDVEEEEEPPKIPTASKNKRKKEIGVQNHDKETEWPDGAKDCACSCHEGGPDSKLKKSKRRSCSHCSSKVCDSKSYKSKEPHELVGSSPHREASPMPGAKEAGQGKDMMEEEAPEERESTEATQSRTVRTTRKGEMPVSGLAVGSTLPSPREVTVTERLLLDGPPPHSPETPQFPPTTGAVLYTVKRNQVGPEVRSCPKASPRLQKEREGQKAVSESEALMLVWDASETEKLPGTVEPPASFLSPVSSKTRDAGRRHVSGKPDTQERWLPSSRARVKTRDRTCPVHESPSGIDTSETSPKAPRGGLAKDSGTQAKGPEGEQQPKAAEATVCANNSKVSSTGEKVVLWTREADRVILTMCQEQGAQPQTFNIISQQLGNKTPAEVSHRFRELMQLFHTACEASSEDEDDATSTSNADQLSDHGDLLSEEELDE

SEQ ID NO: 746989 - protein, 1012 aa, Homo sapiens
TVPATTVKIVSLGGGCNMIQPVNAAVAQSPQTIPITTLLVNPTSFPCPLNQSLVASSVSPLIVSGNSVNLPIPSTPEDKAHVNVDIACAVADGENAFQGLEPKLEPQELSPLSATVFPKVEHSPGPPLADAECQEGLSENSACRWTVVKTEEGRQALEPLPQGIQESLNNPTPGDLEEIVKMEPEEAREEISGSPERDICDDIKVEHAVELDTGAPSEELSSAGEVTKQTVLQKEEERSQPTKTPSSSQEPPDEGTSGTDVNKGSSKNALSSMDPEVRLSSPPGKPEDSSSVDGQSVGTPVGPETGGEKNGPEEEEEEDFDDLTQDEEDEMSSASEESVLSVPELQETMEKLTWLASERRMSQEGESEEENSQEENSEPEEEEEEEAEGMESLQKEDEMTDEAVGDSAEKPPTFASPETAPEVETSRTPPGESIKAAGKGRNNHRARNKRGSRARASKDTSKLLLLYDEDILERDPLREQKDLAFAQAYLTRVREALQHIPGKYEDFLQVIYEFESSTQRRTAVDLYKSLQILLQDWPQLLKDFAAFLLPEQALACGLFEEQQAFEKSRKFLRQLEICFAENPSHHQKIIKVLQGCADCLPQEITELKTQMWQLLKGHDHLQDEFSIFFDHLRPAASRMGDFEEINWTEEKEYEFDGFEEVALPDVEEEEEPPKIPTASKNKRKKEIGVQNHDKETEWPDGAKDCACSCHEGGPDSKLKKSKRRSCSHCSSKVCDSKSYKSKEPHELVGSSPHREASPMPGAKEAGQGKDMMEEEAPEERESTEATQSRTVRTTRKGEMPVSGLAVGSTLPSPREVTVTERLLLDGPPPHSPETPQFPPTTGAVLYTVKRNQVGPEVRSCPKASPRLQKEREGQKAVSESEALMLVWDASETEKLPGTVEPPASFLSPVSSKTRDAGRRHVSGKPDTQERWLPSSRARVKTRDRTCPVHESPSGIDTSETSPKAPRGGLAKDSGTQAKGPEGEQQPKAAEATVCANNSKVSSTGEKVVLWTR

SEQ ID NO: 746990 - protein, 212 aa, Homo sapiens [sequence omitted]

SEQ ID NO: 746991 - protein, 804 aa, Homo sapiens
TVPATTVKIVSLGGGCNMIQPVNAAVAQSPQTIPITTLLVNPTSFPCPLNQSLVASSVSPLIVSGNSVNLPIPSTPEDKAHVNVDIACAVADGENAFQGLEPKLEPQELSPLSATVFPKVEHSPGPPLADAECQEGLSENSACRWTVVKTEEGRQALEPLPQGIQESLNNPTPGDLEEIVKMEPEEAREEISGSPERDICDDIKVEHAVELDTGAPSEELSSAGEVTKQTVLQKEEERSQPTKTPSSSQEPPDEGTSGTDVNKGSSKNALSSMDPEVRLSSPPGKPEDSSSVDGQSVGTPVGPETGGEKNGPEEEEEEDFDDLTQDEEDEMSSASEESVLSVPELQETMEKLTWLASERRMSQEGESEEENSQEENSEPEEEEEEEAEGMESLQKEDEMTDEAVGDSAEKPPTFASPETAPEVETSRTPPGESIKAAGKGRNNHRARNKRGSRARASKDTSKLLLLYDEDILERDPLREQKDLAFAQAYLTRVREALQHIPGKYEDFLQVIYEFESSTQRRTAVDLYKSLQILLQDWPQLLKDFAAFLLPEQALACGLFEEQQAFEKSRKFLRQLEICFAENPSHHQKIIKVLQGCADCLPQEITELKTQMWQLLKGHDHLQDEFSIFFDHLRPAASRMGDFEEINWTEEKEYEFDGFEEVALPDVEEEEEPPKIPTASKNKRKKEIGVQNHDKETEWPDGAKDCACSCHEGGPDSKLKKSKRRSCSHCSSKVCDSKSYKSKEPHELVGSSPHREASPMPGAKEAGQGKDMMEEEAPEERESTEATQSRTVRTTRKGEMPVSGE

SEQ ID NO: 746992 - protein, 1095 aa, Homo sapiens; identical to SEQ ID NO: 746986

SEQ ID NO: 746993 - protein, 485 aa, Homo sapiens [sequence omitted]

SEQ ID NO: 746994 - protein, 354 aa, Homo sapiens
MLVWDASETEKLPGTVEPPASFLSPVSSKPEMQGEDMCPGNQTLKQGRTVRTTRKGEMPVSGLAVGSTLPSPREVTVTERLLLDGPPPHSPETPQFPPTTGAVLYTVKRNQVGPEVRSCPKASPRLQKEREGQKAVSESEALMLVWDASETEKLPGTVEPPASFLSPVSSKTRDAGRRHVSGKPDTQERWLPSSRARVKTRDRTCPVHESPSGIDTSETSPKAPRGGLAKDSGTQAKGPEGEQQPKAAEATVCANNSKVSSTGEKVVLWTREADRVILTMCQEQGAQPQTFNIISQQLGNKTPAEVSHRFRELMQLFHTACEASSEDEDDATSTSNADQLSDHGDLLSEEELDE

SEQ ID NO: 746995 - protein, 655 aa, Homo sapiens
TVPATTVKIVSLGGGCNMIQPVNAAVAQSPQTIPITTLLVNPTSFPCPLNQSLVASSVSPLIVSGNSVNLPIPSTPEDKAHVNVDIACAVADGENAFQGLEPKLEPQELSPLSATVFPKVEHSPGPPLADAECQEGLSENSACRWTVVKTEEGRQALEPLPQGIQESLNNPTPGDLEEIVKMEPEEAREEISGSPERDICDDIKVEHAVELDTGAPSEELSSAGEVTKQTVLQKEEERSQPTKTPSSSQEPPDEGTSGTDVNKGSSKNALSSMDPEVRLSSPPGKPEDSSSVDGQSVGTPVGPETGGEKNGPEEEEEEDFDDLTQDEEDEMSSASEESVLSVPELQETMEKLTWLASERRMSQEGESEEENSQEENSEPEEEEEEEAEGMESLQKEDEMTDEAVGDSAEKPPTFASPETAPEVETSRTPPGESIKAAGKGRNNHRARNKRGSRARASKDTSKLLLLYDEDILERDPLREQKDLAFAQAYLTRVREALQHIPGKYEDFLQVIYEFESSTQRRTAVDLYKSLQILLQDWPQLLKDFAAFLLPEQALACGLFEEQQAFEKSRKFLRQLEICFAENPSHHQKIIKVLQGCADCLPQEITELKTQMWQLLKGHDHLQDEFSIFFDHLRPAASRMGDFEEINWTEEKEYEV

SEQ ID NO: 746996 - protein, 284 aa, Homo sapiens
MYGSCLLEKEAGMYPGTLMSPGGDGTAGTGGTGGGGSPMPASNFAAAPAFSHYMGYPHMPSMDPHWPSLGVWGSPYSPPREDWSVYPGPSSTMGTVPVNDVTSSPAAFCSTDYSNLGPVGGGTSGSSLPGQAGGSLVPTDAGAAKASSPSRSRHSPYAWMRKTVQVTGKTRTKEKYRVVYTDHQRLELEKEFHCNRYITIQRKSELAVNLGLSERQVKIWFQNRRAKERKMIKKKISQFENSGGSVQSDSDSISPGELPNTFFTTPSAVRGFQPIEIQQVIVSE

SEQ ID NO: 746997 - protein, 79 aa, Homo sapiens
VLEVAAESHLSHVTISSHCRLTWHSGQAGRGHQCIAHAEDSDRNLFPCSQRMRLRMRTLKMIQSTEDGSCLQKLPFHPS

SEQ ID NO: 746998 - protein, 107 aa, Homo sapiens
EPVLIVSGLGFRLGPFRSGSESLYPSLSPEARLLGPAQKLANYAGGPEAPLGSRLPQVLSSGAASYPLPGSRCPVAPAGPSFPALSSLLLRPPTPPSHPFPWLSHCL

SEQ ID NO: 746999 - protein, 384 aa, Homo sapiens
MTSFHPRGLQAARAQKFKSKRPRSNSDCFQEEDLRQGFQWRKSLPFGAASSYLNLEKLGEGSYATVYKGISRINGQLVALKVISMNAEEGVPFTAIREASLLKGLKHANIVLLHDIIHTKETLTFVFEYMHTDLAQYMSQHPGGLHPHNVRLFMFQLLRGLAYIHHQHVLHRDLKPQNLLISHLGELKLADFGLARAKSIPSQTYSSEVVTLWYRPPDALLGATEYSSELDIWGAGCIFIEMFQGQPLFPGVSNILEQLEKIWEVLGVPTEDTWPGVSKLPNYNPEWFPLPTPRSLHVVWNRLGRVPEAEDLASQMLKGFPRDRVSAQEALVHDYFSALPSQLYQLPDEESLFTVSGVRLKPEMCDLLASYQKGHHPAQFSKCW

SEQ ID NO: 747000 - protein, 252 aa, Homo sapiens
MGQELCAKTVQPGCSCYHCSEGGEAHSCRRSQPETTEAAFKLTDLKEASCSMTSFHPRGLQAARAQKFKSKRPRSNSDCFQEEDLRQGFQWRKSLPFGAASSYLNLEKLGEGSYATVYKGISRINGQLVALKVISMNAEEGVPFTAIREASLLKGLKHANIVLLHDIIHTKETLTFVFEYMHTDLAQYMSQHPGGLHPHNVRLFMFQLLRGLAYIHHQHVLHRDLKPQNLLISHLGELKLADFGKSPLGSHS

SEQ ID NO: 747001 - protein, 255 aa, Homo sapiens
MHTDLAQYMSQHPGGLHPHNVRLFMFQLLRGLAYIHHQHVLHRDLKPQNLLISHLGELKLADFGLARAKSIPSQTYSSEVVTLWYRPPDALLGATEYSSELDIWGAGCIFIEMFQGQPLFPGVSNILEQLEKIWEVLGVPTEDTWPGVSKLPNYNPEWFPLPTPRSLHVVWNRLGRVPEAEDLASQMLKGFPRDRVSAQEALVHDYFSALPSQLYQLPDEESLFTVSGVRLKPEMCDLLASYQKGHHPAQFSKCW

SEQ ID NO: 747002 - protein, 121 aa, Homo sapiens
MYQPIQTYPWMNLSRRREFRCLSCSECLLVTCLGLSTVILGLIVVLQDPSDSVVFSTGLTMIAIGAFFVVLTGVTALCTVTVDENLQKTTRLRLGVIRKSGSLQGTTEPSMTHSIIASTSL

SEQ ID NO: 747003 - protein, 121 aa, Homo sapiens; identical to SEQ ID NO: 747002

SEQ ID NO: 747004 - protein, 121 aa, Homo sapiens; identical to SEQ ID NO: 747002

SEQ ID NO: 747005 - protein, 121 aa, Homo sapiens; identical to SEQ ID NO: 747002

SEQ ID NO: 747006 - protein, 121 aa, Homo sapiens; identical to SEQ ID NO: 747002

SEQ ID NO: 747007 - protein, 121 aa, Homo sapiens; identical to SEQ ID NO: 747002

SEQ ID NO: 747008 - protein, 121 aa, Homo sapiens; identical to SEQ ID NO: 747002

SEQ ID NO: 747009 - protein, 167 aa, Homo sapiens
AAASSALTALRAPTALTAMARSNLPLALGLALVAFCLLALPRDARARPQERMVGELRDLSPDDPQVQKAAQAAVASYNMGSNSIYYFRDTHIIKAQSQLVAGIKYFLTMEMGSTDCRKTRVTGDHVDLTTCPLAAGAQQEKLRCDFEVLVVPWQNSSQLLKHNCVQM

SEQ ID NO: 747010 - protein, 167 aa, Homo sapiens; identical to SEQ ID NO: 747009

SEQ ID NO: 747011 - protein, 529 aa, Homo sapiens
MRRNSSLSFQMERPLEEQVQSKWSSSQGRTGTGGSDVLQMQNSEHHGQSIKTQTDSISLEDVAVNFTLEEWALLDPGQRNIYRDVMRATFKNLACIGEKWKDQDIEDEHKNQGRNLRSPMVEALCENKEDCPCGKSTSQIPDLNTNLETPTGLKPCDCSVCGEVFMHQVSLNRHMRSHTEQKPNECHEYGEKPHKCKECGKTFTRSSSIRTHERIHTGEKPYECKECGKAFAFLFSFRNHIRIHTGETPYECKECGKAFRYLTALRRHEKNHTGEKPYKCKQCGKAFIYYQPFLTHERTHTGEKPYECKQCGKAFSCPTYLRSHEKTHTGEKPFVCRECGRAFFSHSSLRKHVKTHTGVQPYTCKKCGEAFKSSSSCEVHERTHFGEKPYECKQCGKAFNSSSYLQLHERVHTGEKTYECKECGKAFLYSTHFRIHERTHTREKPYECKQCGRVFIYFSHLRRHERSHTGVKPCECKQCGKAFTCLNSLKVHKRIHTGERPFQCRQCGKAFSYSKSLHVHERTHSRQKP

SEQ ID NO: 747012 - protein, 529 aa, Homo sapiens; identical to SEQ ID NO: 747011

SEQ ID NO: 747013 - protein, 529 aa, Homo sapiens; identical to SEQ ID NO: 747011

SEQ ID NO: 747014 - protein, 309 aa, Homo sapiens
MKKENQSFNLDFILLGVTSQQEQNNVFFVIFLCIYPITLTGNLLIILAICADIRLHNPMYFLLANLSLVDIIFSSVTIPKVLANHLLGSKFISFGGCLMQMYFMIALAKADSYTLAAMAYDRAVAISCPLHYTTIMSPRSCILLIAGSWVIGNTSALPHTLLTASLSFCGNQEVANFYCDIMPLLKLSCSDVHFNVKMMYLGVGVFSLPLLCIIVSYVQVFSTVFQVPSTKSLFKAFCTCGSHLTVVFLYYGTTMGMYFRPLTSYSPKDAVITVMYVAVTPALNPFIYSLRNWDMKAALQKLFSKRISS

SEQ ID NO: 747015 - protein, 123 aa, Homo sapiens
MVDPVGELAAKRSGLTVEDVRANVPEELSIWIDPFGVSYQIGEKGAVKVLYLDDSDGCGAPELDMKIKSSFTPDDQMLFLLGSQDSSLSNSPSLCFAHHPAPPSSSASPSPSPSPWTPLLPPN

SEQ ID NO: 747016 - protein, 63 aa, Homo sapiens
MPPPGKVPRKENLWLQCEWGSCSFVCSTMEKFFEHVTQHLQQHLHGSGEEEEEEEEDDPLGKR

SEQ ID NO: 747017 - protein, 302 aa, Homo sapiens
MVTEQEVDAIGQTLVDPKQPLQARFRALFTLRGLGGPGAIAWISQAFDDDSALLKHELAYCLGQMQDARAIPMLVDVLQDTRQEPMVRHEAGEALGAIGDPEVLEILKQYSSDPVIEVAETCQLAVRRLEWLQQHGGEPAAGPYLSVDPAPPAEERDVGRLREALLDESRPLFERYRAMFALRNAGGEEAALALAEGLHCGSALFRHEVGYVLGQLQHEAAVPQLAAALARCTENPMVRHECAEALGAIARPACLAALQAHADDPERVVRESCEVALDMYEHETGRAFQYADGLEQLRGAPS

SEQ ID NO: 747018 - protein, 302 aa, Homo sapiens; identical to SEQ ID NO: 747017

SEQ ID NO: 747019 - protein, 302 aa, Homo sapiens; identical to SEQ ID NO: 747017

SEQ ID NO: 747020 - protein, 232 aa, Homo sapiens
RRRAFSTHPPHQHELSGCFFPGEALGAIGDPEVLEILKQYSSDPVIEVAETCQLAVRRLEWLQQHGGEPAAGPYLSVDPAPPAEERDVGRLREALLDESRPLFERYRAMFALRNAGGEEAALALAEGLHCGSALFRHEVGYVLGQLQHEAAVPQLAAALARCTENPMVRHECAEALGAIARPACLAALQAHADDPERVVRESCEVALDMYEHETGRAFQYADGLEQLRGAPS

SEQ ID NO: 747021 - protein, 302 aa, Homo sapiens; identical to SEQ ID NO: 747017

SEQ ID NO: 747022 - protein, 232 aa, Homo sapiens; identical to SEQ ID NO: 747020

SEQ ID NO: 747023 - protein, 300 aa, Homo sapiens
VSAHPRTRASAGEGQLASGGRTPFPPTLSAQTRGAESRGGGGSVDSWNAYTEERGMRHQQTERQDPSQPLSRQHENFEGTYRQIFHPEQLITGKEDAANNYAWGHYTIGKEFIDLLLDRIRKLADQCTGLQGFLVFHSLGRGTGSDVTSFLMEWLSVNYGKKSKLGFSIYPAPQVSTAMVQPYNSILTTHTTLEHSDCAFMVDNKAIYDICHRNLDIERPTYTNLNRLISQIVSSITASLRFDGALNVDLTEFQTNLVSYLTSTSPWPPMHQSSLQKKYTTSSCRWQRLPMPALSLPTRW

SEQ ID NO: 747024 - protein, 227 aa, Homo sapiens
MMNFEGTYRQIFHPEQLITGKEDAANNYAWGHYTIGKEFIDLLLDRIRKLADQCTGLQGFLVFHSLGRGTGSDVTSFLMEWLSVNYGKKSKLGFSIYPAPQVSTAMVQPYNSILTTHTTLEHSDCAFMVDNKAIYDICHRNLDIERPTYTNLNRLISQIVSSITASLRFDGALNVDLTEFQTNLVSYLTSTSPWPPMHQSSLQKKYTTSSCRWQRLPMPALSLPTRW

SEQ ID NO: 747025 - protein, 120 aa, Homo sapiens
SLSGAGGGKLNPPPAPPARSPTTELSSKSQQATAWTPTQQPGGQLRNGSLHIIDDFESKFTFHSVEDFPPPDEYKPCQKIYPSKIPRSRTPGPWLQAEAVGQSSDDIKGRNSQLSLKTLR

SEQ ID NO: 747026 - protein, 130 aa, Homo sapiens
ATGNSPYLQNEEERSYHFNRYRKSICKCQNPFITSTLSKLGEEGKSLNLMRESLKSYQMTSCSMGSCWAFSSCDQEGAPALTTATQSHSTQSLSPVRNRDVGYTWRLGVAQAGRGASGNLAMFPFSLGAT

SEQ ID NO: 747027 - protein, 179 aa, Homo sapiens
RPQSVCIQVLIKTVCCSTPPRVVCWRALRVPTNARALGLALKPARGFRPRPQWTYHPSIWESRPQQPDKGSSSASSRLSVHAHRSLISPTGTDVFIGQTDPHKKLPPKWTGPYTVILSTPTAVRVRGLPNWIHRTRVKLTPKAASSSKTLTAKCLSGPISPTKFKLTNIFFLKPKHKED

SEQ ID NO: 747028 - protein, 320 aa, Homo sapiens
MLLCFRFGNQSMKRENFTLITDFVFQGFSSFHEQQITLFGVFLALYILTLAGNIIIVTIIRIDLHLHTPMYFFLSMLSTSETVYTLVILPRMLSSLVGMSQPMSLAGCATQMFFFVTFGITNCFLLTAMGYDRYVAICNPLRYMVIMNKRLRIQLVLGACSIGLIVAITQVTSVFRLPFCARKVPHFFCDIRPVMKLSCIDTTVNEILTLIISVLVLVVPMGLVFISYVLIISTILKIASVEGRKKAFATCASHLTVVIVHYSCASIAYLKPKSENTREHDQLISVTYTVITPLLNPVVYTLRNKEVKDALCRAVGGKFS

SEQ ID NO: 747029 - protein, 105 aa, Homo sapiens
GVPDMTWGQRVTAVVTLREGHSLSHRELKEWARLKEHPTKRRENSILNIGRKRNLASGMRALTGRMAARRAAVSSEVSSSDETDNSLKRHKLPRLTQTLKQTEQF

SEQ ID NO: 747030 - protein, 140 aa, Homo sapiens
MRSQPRTPPVLQEPWSQALAVQATCCTWPTATSPAALSPACCARLRLRLQCLSIHHERKKNRKGGRRKLKEHPTKRRENSILNIGRKRNLASGMRALTGRMAARRAAVSSEVSSSDETDNSLKRHKLPRLTQTLKQTEQF

SEQ ID NO: 747031 - protein, 103 aa, Homo sapiens
PPCLDNFFLFLVETGFHHVGHAGFELLTTCGPPTLASIMCILVYLLVFQHLVSLKNLKGQNASFYFSPFGQHLSGFVKCSIWCCGSLSGLEGHFLPPHSPPLH

SEQ ID NO: 747032 - protein, 96 aa, Homo sapiens
SRLHPQEPCLKDGKALFPTKTTESPLAKVNRDQCFTSEVVSKALKQEVANPVKITYRCSYGGLDMMQAPGPSKEEIIYKIMRLLWATSYCGPQPCG

SEQ ID NO: 747033 - protein, 119 aa, Homo sapiens
FLRQSLAVLPRVECSGVILAHCNLRLPGSSNPPVSASQVPGIIGTCYHTWQIFVFLVETGFHHVDQAGLKLLRLKSSACLCLPKCWDYRTEPLCPDVFYSLRITTSESAKYKQKTPEKL

SEQ ID NO: 747034 - protein, 113 aa, Homo sapiens
MAGPAAAFRRLGALSGAAALGFASYGAHGAQFPDAYGKELFDKANKHHFLHSLALLGVPHCRKPLWAGLLLASGTTLFCTSFYYQALSGDPSIQTLAPAGGTLLLLGWLALAL

SEQ ID NO: 747035 - protein, 123 aa, Homo sapiens
MAGPAAAFRRLGALSGAAALGFASYGAHGAQFPDAYGKELFDKANKHHFLHSLALLGVPHCRKPLWAGLLLASGTTLFCTSFYYQALSGDPSIQTLALEYSGATSAHCNLCLPGSSDSPASAS

SEQ ID NO: 747036 - protein, 46 aa, Homo sapiens
MAGPAAAFRRLGALSGAAALGFASYGAAGRGGDEDGTVLGASSGVC

SEQ ID NO: 747037 - protein, 113 aa, Homo sapiens; identical to SEQ ID NO: 747034

SEQ ID NO: 747038 - protein, 103 aa, Homo sapiens
GGRNFGPLCHQGISVPVAYDIPSFLFFLQLFDKANKHHFLHSLALLGVPHCRKPLWAGLLLASGTTLFCTSFYYQALSGDPSIQTLAPAGGTLLLLGWLALAL

SEQ ID NO: 747039 - protein, 764 aa, Homo sapiens
MAGTSAPGSKRRSEPPAPRPGPPPGTGHPPSKRARGFSAAAAPDPDDPFGAHGDFTADDLEELDTLASQALSQCPAAARDVSSDHKVHRLLDGMSKNPSGKNRETVPIKDNFELEVLQAQYKELKEKMKVMEEEVLIKNGEIKILRDSLHQTESVLEEQRRSHFLLEQEKTQALSDKEKEFSKKLQSLQSELQFKDAEMNELRTKLQTSERANKLAAPSVSHVSPRKNPSVVIKPEACSPQFGKTSFPTKESFSANMSLPHPCQTESGYKPLVGREDSKPHSLRGDSIKQEEAQKSFVDSWRQRSNTQGSILINLLLKQPLIPGSSLSLCHLLSSSSESPAGTPLQPPGFGSTLAGMSGLRTTGSYDGSFSLSALREAQNLAFTGLNLVARNECSRDGDPAEGGRRAFPLCQLPGAVHFLPLVQFFIGLHCQALQDLAAAKRSGAPGDSPTHSSCVSSGVETNPEDSVCILEGFSVTALSILQHLVCHSGAVVSLLLSGVGADSAAGEGNRSLVHRLSDGDMTSALRGVADDQGQHPLLKMLLHLLAFSSAATGHLQASVLTQCLKVLVKLAENTSCDFLPRFQCVFQVLPKCLSPETPLPSVLLAVELLSLLADHDQLAPQLCSHSEGCLLLLLYMYITSRPDRVALETQWLQLEQEVVRALTVMLHRQWLTVRRAGGPPRTDQQRRTVRCLRDTVLLLHGLSQKDKLFMMHCVEVLHQFDQVMPGVSMLIRGLPDVTDCEEAALDDLCAAETDVEDPEVECG

SEQ ID NO: 747040 - protein, 764 aa, Homo sapiens; identical to SEQ ID NO: 747039

SEQ ID NO: 747041 - protein, 908 aa, Homo sapiens
MAGTSAPGSKRRSEPPAPRPGPPPGTGHPPSKRARGFSAAAAPDPDDPFGAHGDFTADDLEELDTLASQALSQCPAAARDVSSECSSRPFARRELSTAPDPLDGCGFGTSRPALPFRLFKIWEHPDLSSGCLPEGPLILGGNALARSNSRFETQKAKLTFYVIFYSLGHLVLGSKQRSLEHTYHHHQNHHYPCMGTHSCDKFELALDLMKPTVSLGQCEHEEEPDTGDHKVHRLLDGMSKNPSGKNRETVPIKDNFELEVLQAQYKELKEKMKVMEEEVLIKNGEIKILRDSLHQTESVLEEQRRSHFLLEQEKTQALSDKEKEFSKKLQSLQSELQFKDAEMNELRTKLQTSERANKLAAPSVSHVSPRKNPSVVIKPEACSPQFGKTSFPTKESFSANMSLPHPCQTESGYKPLVGREDSKPHSLRGDSIKQEEAQKSFVDSWRQRSNTQGSILINLLLKQPLIPGSSLSLCHLLSSSSESPAGTPLQPPGFGSTLAGMSGLRTTGSYDGSFSLSALREAQNLAFTGLNLVARNECSRDGDPAEGGRRAFPLCQLPGAVHFLPLVQFFIGLHCQALQDLAAAKRSGAPGDSPTHSSCVSSGVETNPEDSVCILEGFSVTALSILQHLVCHSGAVVSLLLSGVGADSAAGEGNRSLVHRLSDGDMTSALRGVADDQGQHPLLKMLLHLLAFSSAATGHLQASVLTQCLKVLVKLAENTSCDFLPRFQCVFQVLPKCLSPETPLPSVLLAVELLSLLADHDQLAPQLCSHSEGCLLLLLYMYITSRPDRVALETQWLQLEQEVVRALTVMLHRQWLTVRRAGGPPRTDQQRRTVRCLRDTVLLLHGLSQKDKLFMMHCVEVLHQFDQVMPGVSMLIRGLPDVTDCEEAALDDLCAAETDVEDPEVECG

SEQ ID NO: 747042 - protein, 703 aa, Homo sapiens
HSRRRQAAARGRLVQFSGLAAGDHKVHRLLDGMSKNPSGKNRETVPIKDNFELEVLQAQYKELKEKMKVMEEEVLIKNGEIKILRDSLHQTESVLEEQRRSHFLLEQEKTQALSDKEKEFSKKLQSLQSELQFKDAEMNELRTKLQTSERANKLAAPSVSHVSPRKNPSVVIKPEACSPQFGKTSFPTKESFSANMSLPHPCQTESGYKPLVGREDSKPHSLRGDSIKQEEAQKSFVDSWRQRSNTQGSILINLLLKQPLIPGSSLSLCHLLSSSSESPAGTPLQPPGFGSTLAGMSGLRTTGSYDGSFSLSALREAQNLAFTGLNLVARNECSRDGDPAEGGRRAFPLCQLPGAVHFLPLVQFFIGLHCQALQDLAAAKRSGAPGDSPTHSSCVSSGVETNPEDSVCILEGFSVTALSILQHLVCHSGAVVSLLLSGVGADSAAGEGNRSLVHRLSDGDMTSALRGVADDQGQHPLLKMLLHLLAFSSAATGHLQASVLTQCLKVLVKLAENTSCDFLPRFQCVFQVLPKCLSPETPLPSVLLAVELLSLLADHDQLAPQLCSHSEGCLLLLLYMYITSRPDRVALETQWLQLEQEVVRALTVMLHRQWLTVRRAGGPPRTDQQRRTVRCLRDTVLLLHGLSQKDKLFMMHCVEVLHQFDQVMPGVSMLIRGLPDVTDCEEAALDDLCAAETDVEDPEVECG

SEQ ID NO: 747043 - protein, 764 aa, Homo sapiens; identical to SEQ ID NO: 747039

SEQ ID NO: 747044 - protein, 791 aa, Homo sapiens
MAGTSAPGSKRRSEPPAPRPGPPPGTGHPPSKRARGFSAAAAPDPDDPFGAHGDFTADDLEELDTLASQALSQCPAAARDVSSDHKVHRLLDGMSKNPSGKNRETVPIKDNFELEVLQAQYKELKEKMKVMEEEVLIKNGEIKILRDSLHQTESVLEEQRRSHFLLEQEKTQALSDKEKEFSKKLQSLQSELQFKDAEMNELRTKLQTSERANKLAAPSVSHVSPRKNPSVVIKPEACSPQFGKTSFPTKESFSANMSLPHPCQTESGYKPLVGREDSKPHSLRGDSIKQEEAQKSFVDSWRQRSNTQGSILINLLLKQPLIPGSSLSLCHLLSSSSESPAGTPLQPPGFGSTLAGMSGLRTTGSYDGSFSLSALREAQNLAFTGLNLVARNECSRDGDPAEGGRRAFPLCQLPGAVHFLPLVQFFIGLHCQALQDLAAAKRSGAPGDSPTHSSCVSSGVETNPEDSVCILEGFSVTALSILQHLVCHSGAVVSLLLSGVGADSAAGEGNRSLVHRLSDGDMTSALRGVADDQGQHPLLKMLLHLLAFSSAATGHLQASVLTQCLKVLVKLAENTSCDFLPRFQCVFQVLPKCLSPETPLPSVLLAVELLSLLADHDQLAPQLCSHSEGCLLLLLYMYITSRPDRVALETQWLQLEQEVVWLLAKLGVQSPLPPVTGSNCQCNVEVVRALTVMLHRQWLTVRRAGGPPRTDQQRRTVRCLRDTVLLLHGLSQKDKLFMMHCVEVLHQFDQVMPGVSMLIRGLPDVTDCEEAALDDLCAAETDVEDPEVECG

SEQ ID NO: 747045 - protein, 464 aa, Homo sapiens
MAGTSAPGSKRRSEPPAPRPGPPPGTGHPPSKRARGFSAAAAPDPDDPFGAHGDFTADDLEELDTLASQALSQCPAAARDVSSDHKVHRLLDGMSKNPSGKNRETVPIKDNFELEVLQAQYKELKEKMKVMEEEVLIKNGEIKILRDSLHQTESVLEEQRRSHFLLEQEKTQALSDKEKEFSKKLQSLQSELQFKDAEMNELRTKLQTSERANKLAAPSVSHVSPRKNPSVVIKPEACSPQFGKTSFPTKESFSANMSLPHPCQTESGYKPLVGREDSKPHSLRGDSIKQEEAQKSFVDSWRQRSNTQGSILINLLLKQPLIPGSSLSLCHLLSSSSESPAGTPLQPPGFGSTLAGMSGLRTTGSYDGSFSLSALREAQNLAFTGLNLVARNECSRDGDPAEGGRRAFPLCQLPGAVHFLPLVQFFIGLHCQALQDLAAAKRSGAPGDSPTHSSCQQVTFKPVS

SEQ ID NO: 747046 - protein, 583 aa, Homo sapiens [sequence omitted]

SEQ ID NO: 747047 - protein, 764 aa, Homo sapiens; identical to SEQ ID NO: 747039

SEQ ID NO: 747048 - protein, 764 aa, Homo sapiens; identical to SEQ ID NO: 747039

SEQ ID NO: 747049 - protein, 764 aa, Homo sapiens; identical to SEQ ID NO: 747039

SEQ ID NO: 747050 - protein, 369 aa, Homo sapiens
MGPGARRQGRIVQGRPEMCFCPPPTPLPPLRILTLGTHTPTPCSSPGSAAGTYPTMGSQALPPGPMQTLIFFDMEATGLPFSQPKVTELCLLAVHRCALESPPTSQGPPPTVPPPPRVVDKLSLCVAPGKACSPAASEITGLSTAVLAAHGRQCFDDNLANLLLAFLRRQPQPWCLVAHNGDRYDFPLLQAELAMLGLTSALDGAFCVDSITALKALERASSPSEHGPRKSYSLGSIYTRLYGQSPPDSHTAEGDVLALLSICQWRPQALLRWVDAHARPFGTIRPMYGVTASARTKPRPSAVTTTAHLATTRNTSPSLGESRGTKDLPPVKDPGALSREGLLAPLGLLAILTLAVATLYGLSLATPGE

SEQ ID NO: 747051 - protein, 369 aa, Homo sapiens; identical to SEQ ID NO: 747050

SEQ ID NO: 747052 - protein, 369 aa, Homo sapiens; identical to SEQ ID NO: 747050

SEQ ID NO: 747053 - protein, 764 aa, Homo sapiens; identical to SEQ ID NO: 747039

SEQ ID NO: 747054 - protein, 834 aa, Homo sapiens [sequence omitted]

SEQ ID NO: 747055 - protein, 369 aa, Homo sapiens; identical to SEQ ID NO: 747050

SEQ ID NO: 747056 - protein, 764 aa, Homo sapiens; identical to SEQ ID NO: 747039

SEQ ID NO: 747057 - protein, 764 aa, Homo sapiens; identical to SEQ ID NO: 747039

SEQ ID NO: 747058 - protein, 764 aa, Homo sapiens; identical to SEQ ID NO: 747039

SEQ ID NO: 747059 - protein, 764 aa, Homo sapiens; identical to SEQ ID NO: 747039

SEQ ID NO: 747060 - protein, 369 aa, Homo sapiens; identical to SEQ ID NO: 747050

SEQ ID NO: 747061 - protein, 791 aa, Homo sapiens; identical to SEQ ID NO: 747044

SEQ ID NO: 747062 - protein, 583 aa, Homo sapiens [sequence omitted]

SEQ ID NO: 747063 - protein, 583 aa, Homo sapiens [sequence omitted]

SEQ ID NO: 747064 - protein, 224 aa, Homo sapiens
MAFYPLQIAGLVLGFLGMVGTLATTLLPQWRVSAFVGSNIIVFERLWEGLWMNCIRQARVRLQCKFYSSLLALPPALETARALMCVAVALSLIALLIGICGMKQVQCTGSNERAKAYLLGTSGVLFILTGIFVLIPVSWTANIIIRDFYNPAIHIGQKRELGAALFLGWASAAVLFIGGGLLCGFCCCNRKKQGYRYPVPGYRVPHTDKRRNTTMLSKTSTSYV

SEQ ID NO: 747065 - protein, 90 aa, Homo sapiens
MDGSLSRSGQLGVPSLEGQHTRLQVARVSKVPGDVSHTQPTPVQSRTDTLGFRANLLPRGVTTWSHRHPARTRSPHTPGTPDTVTCTRAR

SEQ ID NO: 747066 - protein, 126 aa, Homo sapiens
MPEPVKSAPVPKKGSKKAINKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 747067 - protein, 388 aa, Homo sapiens
MSAPSTLPPGGEEGLGTAWPSAANASSAPAEAEEAVAGPGDARAAGMVAIQCIYALVCLVGLVGNALVIFVILRYAKMKTATNIYLLNLAVADELFMLSVPFVASSAALRHWPFGSVLCRAVLSVDGLNMFTSVFCLTVLSVDRYVAVVHPLRAATYRRPSVAKLINLGVWLASLLVTLPIAIFADTRPARGGQAVACNLQWPHPAWSAVFVVYTFLLGFLLPVLAIGLCYLLIVGKMRAVALRAGWQQRRRSEKKITRLVLMVVVVFVLCWMPFYVVQLLNLFVTSLDATVNHVSLILSYANSCANPILYGFLSDNFRRFFQRVLCLRCCLLEGAGGAEEEPLDYYATALKSKGGAGCMCPPLPCQQEALQPEPGRKRIPLTRTTTF

SEQ ID NO: 747068 - protein, 478 aa, Homo sapiens
MNPPSGPRVLPSPTQEPSCMATPAPPSWWDSSQSSISSLGRLPSISPTAPGTWAAAWVPLPTVDVPDHAHYTLGTVILLVGLTGMLGNLTVIYTFCRSRSLRTPANMFIINLAVSDFLMSFTQAPVFFTSSLYKQWLFGETGCEFYAFCGALFGISSMITLTAIALDRYLVITRPLATFGVASKRRAAFVLLGVWLYALAWSLPPFFGWSAYVPEGLLTSCSWDYMSFTPAVRAYTMLLCCFVFFLPLLIIIYCYIFIFRAIRETGRALQTFGACKGNGESLWQRQRLQSECKMAKIMLLVILLFVLSWAPYSAVALVAFAGYAHVLTPYMSSVPAVIAKASAIHNPIIYAITHPKYRVAIAQHLPCLGVLLGVSRRHSRPYPSYRSTHRSTLISHTSNLSWISIRRRQESLGSESEVGWTHMEAAAVWGAAQQANGRSLYGQGLEDLEAKAPPRPQGHEAETPGKTKGLIPSQDPRM

SEQ ID NO: 747069 - protein, 489 aa, Homo sapiens
MNPPSGPRVLPSPTQEPSCMATPAPPSWWDSSQSSISSLGRLPSISPTAPGTWAAAWVPLPTVDVPDHAHYTLGTVILLVGLTGMLGNLTVIYTFCRAVLRGVTVMMQSRSLRTPANMFIINLAVSDFLMSFTQAPVFFTSSLYKQWLFGETGCEFYAFCGALFGISSMITLTAIALDRYLVITRPLATFGVASKRRAAFVLLGVWLYALAWSLPPFFGWSAYVPEGLLTSCSWDYMSFTPAVRAYTMLLCCFVFFLPLLIIIYCYIFIFRAIRETGRALQTFGACKGNGESLWQRQRLQSECKMAKIMLLVILLFVLSWAPYSAVALVAFAGYAHVLTPYMSSVPAVIAKASAIHNPIIYAITHPKYRVAIAQHLPCLGVLLGVSRRHSRPYPSYRSTHRSTLISHTSNLSWISIRRRQESLGSESEVGWTHMEAAAVWGAAQQANGRSLYGQGLEDLEAKAPPRPQGHEAETPGKTKGLIPSQDPRM

SEQ ID NO: 747070 - protein, 202 aa, Homo sapiens
MDHFFIKRKRNSEVKYTEACSSSSVESGIVNSDNIEKNTDSNLQTSTSFEPHFKKKKVSARRYNEDYLKYGFIKCEKPFENDRPQCVICNNILANESLKPSKLKRHLETQHAELIDKPLEYFQRKKKDIKLSTQFLSCSTAVSEKALLSSYLVAYRVAKEKIANTAAEKIILPACLDMVRTIFDDKSADKLKTIPNDNTVSL

SEQ ID NO: 747071 - protein, 330 aa, Homo sapiens
IHREGLASREIPQNLMEVLKNAVKVVNFIKGSSLNSRLLETFCSEIGTNHTHLLYHTKIRWLSQGKILSRVYELRNEIHFFLIEKKSHLASIFEDDTWVTKLAYLTDIFSILNELSLKLQGKNSDVFQHVERIQGFRKTLLLWQVRLKSNRPSYYMFPRFLQHIEENIINENILKEIKLEILLHLTSLSQTFNHFFPEEKFETLRENSWVKDPFAFRNPESIIELNLVPEEENELLQLSSSYTLKNDYETLSLSAFWMKVKEDFPLLSRKSVLLLLPFTTTSLCELGFSILTQLKTKERNGLNCAAVMRVALSSCVPDWNELMNRQAHPS

SEQ ID NO: 747072 - protein, 236 aa, Homo sapiens
IHREGLASREIPQNLMEVLKNAVKVVNFIKGSSLNSRLLETFCSEIGTNHTHLLYHTKIRWLSQGKILSRVYELRNEIHFFLIEKKSHLASIFEDDTWVTKLAYLTDIFSILNELSLKLQGKNSDVFQHVERIQGFRKTLLLWQVRLKSNRPSYYMFPRFLQHIEENIINENILKEIKLEILLHLTSLSQTFNHFFPEEKFETLRENSWVKDPFAFRNPESIIELNLVPEEENELK

SEQ ID NO: 747073 - protein, 878 aa, Homo sapiens
MNLRPLGTPRGVSAVAGPHDIGASPGDKKSKNRSTRGKKKSIFETYMSKEDVSEGLKRGTLIQGVLRINPKKFHEAFIPSPDGDRDIFIDGVVARNRALNGDLVVVKLLPEEHWKVVKPESNDKETEAAYESDIPEELCGHHLPQQSLKSYNDSPDVIVEAQFDGSDSEDGHGITQNVLVDGVKKLSVCVSEKGREDGDAPVTKDETTCISQDTRALSEKSLQRSAKVVYILEKKHSRAATGFLKLLADKNSELFRKYALFSPSDHRVPRIYVPLKDCPQDFVARPKDYANTLFICRIVDWKEDCNFALGQLAKSLGQAGEIEPETEGILTEYGVDFSDFSSEVLECLPQGLPWTIPPEEFSKRRDLRKDCIFTIDPSTARDLDDALSCKPLADGNFKVGVHIADVSYFVPEGSDLDKVAAERATSVYLVQKVVPMLPRLLCEELCSLNPMSDKLTFSVIWTLTPEGKILDEWFGRTIIRSCTKLSYEHAQSMIESPTEKIPAKELPPISPEHSSEEVHQAVLNLHGIAKQLRQQRFVDGALRLDQLKLAFTLDHETGLPQGCHIYEYRESNKLVEEFMLLANMAVAHKIHRAFPEQALLRRHPPPQTRMLSDLVEFCDQMGLPVDFSSAGALNKSLTQTFGDDKYSLARKEVLTNMCSRPMQMALYFCSGLLQDPAQFRHYALNVPLYTHFTSPIRRFADVLVHRLLAAALGYRERLDMAPDTLQKQADHCNDRRMASKRVQELSTSLFFAVLVKESGPLESEAMVMGILKQAFDVLVLRYGVQKRIYCNALALRSHHFQKVGKKPELTLVWEPEDMEQEPAQQVITIFSLVEVVLQAESTALKYSAILKRPGTQGHLGPEKEEEESDGEPEDSSTS

SEQ ID NO: 747074 - protein, 995 aa, Homo sapiens
MSHPDYRMNLRPLGTPRGVSAVAGPHDIGASPGDKKSKNRSTRGKKKSIFETYMSKEDVSEGLKRGTLIQGVLRINPKKFHEAFIPSPDGDRDIFIDGVVARNRALNGDLVVVKLLPEEHWKVVKPESNDKETEAAYESDIPEELCGHHLPQQSLKSYNDSPDVIVEAQFDGSDSEDGHGITQNVLVDGVKKLSVCVSEKGREDGDAPVTKDETTCISQDTRALSEKSLQRSAKVVYILEKKHSRAATGFLKLLADKNSELFRKYALFSPSDHRVPRIYVPLKDCPQDFVARPKDYANTLFICRIVDWKEDCNFALGQLAKSLGQAGEIEPETEGILTEYGVDFSDFSSEVLECLPQGLPWTIPPEEFSKRRDLRKDCIFTIDPSTARDLDDALSCKPLADGNFKVGVHIADVSYFVPEGSDLDKVAAERATSVYLVQKVVPMLPRLLCEELCSLNPMSDKLTFSVIWTLTPEGKILDEWFGRTIIRSCTKLSYEHAQSMIESPTEKIPAKELPPISPEHSSEEVHQAVLNLHGIAKQLRQQRFVDGALRLDQLKLAFTLDHETGLPQGCHIYEYRESNKLVEEFMLLANMAVAHKIHRAFPEQALLRRHPPPQTRMLSDLVEFCDQMGLPVDFSSAGALNKSLTQTFGDDKYSLARKEVLTNMCSRPMQMALYFCSGLLQDPAQFRHYALNVPLYTHFTSPIRRFADVLVHRLLAAALGYRERLDMAPDTLQKQADHCNDRRMASKRVQELSTSLFFAVLVKESGPLESEAMVMGILKQAFDVLVLRYGVQKRIYCNALALRSHHFQKVGKKPELTLVWEPEDMEQEPAQQGPLENLMKAMSLHPRNCLEPFSPTVCPERRTQALRLCFISLGSAQDASDFPNSALTQGILPGGGPHYRQASRGFQRPKEGPGVLLQGWRQSCASTSGPAILVPSRLGSAQVITIFSLVEVVLQAESTALKYSAILKRPGTQGHLGPEKEEEESDGEPEDSSTS

SEQ ID NO: 747075 - protein, 709 aa, Homo sapiens
MLVRGLVLILAEGVTKLSVCVSEKGREDGDAPVTKDETTCISQDTRALSEKSLQRSAKVVYILEKKHSRAATGFLKLLADKNSELFRKYALFSPSDHRVPRIYVPLKDCPQDFVARPKDYANTLFICRIVDWKEDCNFALGQLAKSLGQAGEIEPETEGILTEYGVDFSDFSSEVLECLPQGLPWTIPPEEFSKRRDLRKDCIFTIDPSTARDLDDALSCKPLADGNFKVGVHIADVSYFVPEGSDLDKVAAERATSVYLVQKVVPMLPRLLCEELCSLNPMSDKLTFSVIWTLTPEGKILDEWFGRTIIRSCTKLSYEHAQSMIESPTEKIPAKELPPISPEHSSEEVHQAVLNLHGIAKQLRQQRFVDGALRLDQLKLAFTLDHETGLPQGCHIYEYRESNKLVEEFMLLANMAVAHKIHRAFPEQALLRRHPPPQTRMLSDLVEFCDQMGLPVDFSSAGALNKSLTQTFGDDKYSLARKEVLTNMCSRPMQMALYFCSGLLQDPAQFRHYALNVPLYTHFTSPIRRFADVLVHRLLAAALGYRERLDMAPDTLQKQADHCNDRRMASKRVQELSTSLFFAVLVKESGPLESEAMVMGILKQAFDVLVLRYGVQKRIYCNALALRSHHFQKVGKKPELTLVWEPEDMEQEPAQQVITIFSLVEVVLQAESTALKYSAILKRPGTQGHLGPEKEEEESDGEPEDSSTS

SEQ ID NO: 747076 - protein, 242 aa, Homo sapiens
MNLRPLGTPRGVSAVAGPHDIGASPGDKKSKNRSTRGKKKSIFETYMSKEDVSEGLKRGTLIQGVLRINPKKFHEAFIPSPDGDRDIFIDGVVARNRALNGDLVVVKLLPEEHWKVVKPESNDKETEAAYESDIPEELCGHHLPQQSLKSYNDSPDVIVEAQFDGSDSEDGHGITQNVLVDGVKKLSVCVSEKGREDGDAPVTKDETTCISQDTRALSEKSLQRSAKVIAYRFSPRVQMAFT

SEQ ID NO: 747077 - protein, 196 aa, Homo sapiens
MNLRPLGTPRGVSAVAGPHDIGASPGDKKSKNRSTRGKKKSIFETYMSKEDVSEGLKRGTLIQGVLRINPKKFHEAFIPSPDGDRDIFIDGVVARNRALNGDLVVVKLLPEEHWKVVKPESNDKETEAAYESDIPEELCGHHLPQQSLKSYNDSPDVIVEAQFDGSDSEDGHGITQNVLVDGVKKLSVCVSEKGEY

SEQ ID NO: 747078 - protein, 138 aa, Homo sapiens
LDMAPDTLQKQADHCNDRRMASKRVQELSTSLFFAVLVKVSPPAWCPSPPSGSRPSWAPAHQEAIEEPRAVPGGAMAAALSLQESGPLESEAMVMGILKQAFDVLVLRYGVQKRIYCNVSALGEPGGGQGSPSHPALE

SEQ ID NO: 747079 - protein, 124 aa, Homo sapiens
SLSAPFGPPGGVSAVAGPHDIGASPGDKKSKNRSTRGKKKSIFETYMSKEDVSEGLKRGTLIQGVLRINPKKFHEAFIPSPDGDRDIFIDGVVARNRALNGDLVVVKLLPEEHWKVVKPGKHLS

SEQ ID NO: 747080 - protein, 878 aa, Homo sapiens; identical to SEQ ID NO: 747073

SEQ ID NO: 747081 - protein, 782 aa, Homo sapiens
MSHPDYRMNLRPLGTPRGVSAVAGPHDIGASPGDKKSKNRSTRGKKKSIFETYMSKEDVSEGLKRGTLIQGVLRINPKKFHEAFIPSPDGDRDIFIDGVVARNRALNGDLVVVKLLPEEHWKVVKPESNDKETEAAYESDIPEELCGHHLPQQSLKSYNDSPDVIVEAQFDGSDSEDGHGITQNVLVDGVKKLSVCVSEKGREDGDAPVTKDETTCISQDTRALSEKSLQRSAKVVYILEKKHSRAATGFLKLLADKNSELFRKYALFSPSDHRVPRIYVPLKDCPQDFVARPKDYANTLFICRIVDWKEDCNFALGQLAKSLGQAGEIEPETEGILTEYGVDFSDFSSEVLECLPQGLPWTIPPEEFSKRRDLRKDCIFTIDPSTARDLDDALSCKPLADGNFKVGVHIADVSYFVPEGSDLDKVAAERATSVYLVQKVVPMLPRLLCEELCSLNPMSDKLTFSVIWTLTPEGKILDEWFGRTIIRSCTKLSYEHAQSMIESPTEKIPAKELPPISPEHSSEEVHQAVLNLHGIAKQLRQQRFVDGALRLDQLKLAFTLDHETGLPQGCHIYEYRESNKLVEEFMLLANMAVAHKIHRAFPEQALLRRHPPPQTRMLSDLVEFCDQMGLPVDFSSAGALNKSLTQTFGDDKYSLARKEVLTNMCSRPMQMALYFCSGLLQDPAQFRHYALNVPLYTHFTSPIRRFADVLVHRLLAAALGYRERLDMAPDTLQKQADHCNDRRMASKRVQELSTSLFFAVLVKVSPPAWCPSPPSGSRPSWA

SEQ ID NO: 747082 - protein, 209 aa, Homo sapiens
MFEPGHGLVQFETRSDTISEASSGARRCEQGVLRINPKKFHEAFIPSPDGDRDIFIDGVVARNRALNGDLVVVKLLPEEHWKVVKPESNDKETEAAYESDIPEELCGHHLPQQSLKSYNDSPDVIVEAQFDGSDSEDGHGITQNVLVDGVKKLSVCVSEKGREDGDAPVTKDETTCISQDTRALSEKSLQRSAKVIAYRFSPRVQMAFT

SEQ ID NO: 747083 - protein, 121 aa, Homo sapiens
PGLDTTSVPDDEAHSSSCRIGHQRHELKSYNDSPDVIVEAQFDGSDSEDGHGITQNVLVDGVKKLSVCVSEKGREDGDAPVTKDETTCISQDTRALSEKSLQRSAKVIAYRFSPRVQMAFT

SEQ ID NO: 747084 - protein, 204 aa, Homo sapiens
MSGAGVAAGTRPPSSPTPGSRRRRQRPSVGVQSLRPQSPQLRQSDPQKRNLDLEKSLQFLQQQHSEMLAKLHEEIEHLKRENKGEPARGPRPALPPQAHSTLPLPQHRNTAINSSTRLGSGGTQDDLHYKLIMNQTSQKKDSLSMSSFQSVKSISNSGKARPQPGSFNKQDSKADVSQKADLEEEPLLHNSKLDKVPGVQGQAR

SEQ ID NO: 747085 - protein, 378 aa, Homo sapiens
MSGAGVAAGTRPPSSPTPGSRRRRQRPSVGVQSLRPQSPQLRQSDPQKRNLDLEKSLQFLQQQHSEMLAKLHEEIEHLKRENKDLHYKLIMNQTSQKKDGPSGNHLSRASAPLGARWVCINGVWVEPGGPSPARLKEGSSRTHRPGGKRGRLAGGSADTVRSPADSLSMSSFQSVKSISNSGKARPQPGSFNKQDSKADVSQKADLEEEPLLHNSKLDKVPGVQGQARKEKAEASNAGAACMGNSQHQGRQMGAGAHPPMILPLPLRKPTTLRQCEVLIRELWNTNLLQTQELRHLKSLLEGSQRPQAAPEEASFPRDQEATHFPKVSTKSLSKKCLSPPVAERAILPALKQTPKNNFAERQKRLQAMQKRRLHRSVL

SEQ ID NO: 747086 - protein, 288 aa, Homo sapiens
MNQTSQKKDGPSGNHLSRASAPLGARWVCINGVWVEPGGPSPARLKEGSSRTHRPGGKRGRLAGGSADTVRSPADSLSMSSFQSVKSISNSGKARPQPGSFNKQDSKADVSQKADLEEEPLLHNSKLDKVPGVQGQARKEKAEASNAGAACMGNSQHQGRQMGAGAHPPMILPLPLRKPTTLRQCEVLIRELWNTNLLQTQELRHLKSLLEGSQRPQAAPEEASFPRDQEATHFPKVSTKSLSKKCLSPPVAERAILPALKQTPKNNFAERQKRLQAMQKRRLHRSVL

SEQ ID NO: 747087 - protein, 222 aa, Homo sapiens
RPPTTTKLSAARRDRPQSQRPPPGAQSTLLSGRGEPGPLPHIGLGAAWGGMLGGWLDAPGQVTSGCCNDCFRKEKAEASNAGAACMGNSQHQGRQMGAGAHPPMILPLPLRKPTTLRQCEVLIRELWNTNLLQTQELRHLKSLLEGSQRPQAAPEEASFPRDQEATHFPKVSTKSLSKKCLSPPVAERAILPALKQTPKNNFAERQKRLQAMQKRRLHRSVL

SEQ ID NO: 747088 - protein, 135 aa, Homo sapiens
MSGAGVAAGTRPPSSPTPGSRRRRQRPSVGVQSLRPQSPQLRQSDPQKRNLDLEKSLQFLQQQHSEMLAKLHEEIEHLKRENKGEPARGPRPALPPQAHSTLPLPQHRNTAINSSTRLGSGGTQDGSDTPLLKTL

SEQ ID NO: 747089 - protein, 312 aa, Homo sapiens
MSGAGVAAGTRPPSSPTPGSRRRRQRPSVGVQSLRPQSPQLRQSDPQKRNLDLEKSLQFLQQQHSEMLAKLHEEIEHLKRENKDLHYKLIMNQTSQKKDSLSMSSFQSVKSISNSGKARPQPGSFNKQDSKADVSQKADLEEEPLLHNSKLDKVPGVQGQARKEKAEASNAGAACMGNSQHQGRQMGAGAHPPMILPLPLRKPTTLRQCEVLIRELWNTNLLQTQELRHLKSLLEGSQRPQAAPEEASFPRDQEATHFPKVSTKSLSKKCLSPPVAERAILPALKQTPKNNFAERQKRLQAMQKRRLHRSVL

SEQ ID NO: 747090 - protein, 288 aa, Homo sapiens; identical to SEQ ID NO: 747086

SEQ ID NO: 747091 - protein, 230 aa, Homo sapiens
MSGAGVAAGTRPPSSPTPGSRRRRQRPSVGVQSLRPQSPQLRQSDPQKRNLDLEKSLQFLQQQHSEMLAKLHEEIEHLKRENKDLHYKLIMNQTSQKKDSLSMSSFQSVKSISNSGKARPQPGSFNKQDSKADVSQKADLEEEPLLHNSKLDKVPGVQGQASPPHLGSAKCSSASCGIPTSCRPKSCGTSSPSWKGARGPRQPRRKLAFPGTKKPRISPRSPPRASPRNA

SEQ ID NO: 747092 - protein, 137 aa, Homo sapiens
WGGMLGGWLDAPGQVTSGCCNDCFRKEKAEASNAGAACMGNSQHQGRQMGAGAHPPMILPLPLRKPTTLRQCEVLIRELWNTNLLQTQEVRPWVVGVALGSLAPPQAPPCPCPCLSAAAPQVPPGREPEAPGSPGGS

SEQ ID NO: 747093 - protein, 307 aa, Homo sapiens
MGGFQRGKYGTMAEGRSEDNLSATPPALRIILVGKTGCGKSATGNSILGQPVFESKLRAQSVTRTCQVKTGTWNGRKVLVVDTPSIFESQADTQELYKNIGDCYLLSAPGPHVLLLVIQLGRFTAQDTVAIRKVKEVFGTGAMRHVVILFTHKEDLGGQALDDYVANTDNCSLKDLVRECERRYCAFNNWGSVEEQRQQQAELLAVIERLGREREGSFHSNDLFLDAQLLQRTGAGACQEDYRQYQAKVEWQVEKHKQELRENESNWAYKALLRVKHLMLLHYEIFVFLLLCSILFFIIFLFIFHYI

SEQ ID NO: 747094 - protein, 333 aa, Homo sapiens
LHSQPKGKQQVGASCGQLQSLSPGKVSMGGRKMATDEENVYGLEENAQSRQESTRRLILVGRTGAGKSATGNSILGQRRFFSRLGATSVTRACTTGSRRWDKCHVEVVDTPDIFSSQVSKTDPGCEERGHCYLLSAPGPHALLLVTQLGRFTAQDQQAVRQVRDMFGEDVLKWMVIVFTRKEDLAGGSLHDYVSNTENRALRELVAECGGRVCAFDNRATGREQEAQVEQLLGMVEGLVLEHKGAHYSNEVYELAQVLRWAGPEERLRRVAERVAARVQRRPWGAWLSARLWKWLKSPRSWRLGLALLLGGALLFWVLLHRRWSEAVAEVGPD

SEQ ID NO: 747095 - protein, 307 aa, Homo sapiens; identical to SEQ ID NO: 747093

SEQ ID NO: 747096 - protein, 466 aa, Homo sapiens
MKKMSIRFFSRLGATSVTRACTTGSRRWDKCHVEVVDTPDIFSSQVSKTDPGCEERGHCYLLSAPGPHALLLVTQLGRFTAQDQQAVRQLSHGAFSPSTWLLLNCVCSTSLSPVNSIPAHRRRAGLSLLPLHLPERGPAARASVTATLEDRAQQPFLERMGGFQRGKYGTMAEGRSEDNLSATPPALRIILVGKTGCGKSATGNSILGQPVFESKLRAQSVTRTCQVKTGTWNGRKVLVVDTPSIFESQADTQELYKNIGDCYLLSAPGPHVLLLVIQLGRFTAQDTVAIRKVKEVFGTGAMRHVVILFTHKEDLGGQALDDYVANTDNCSLKDLVRECERRYCAFNNWGSVEEQRQQQAELLAVIERLGREREGSFHSNDLFLDAQLLQRTGAGACQEDYRQYQAKVEWQVEKHKQELRENESNWAYKALLRVKHLMLLHYEIFVFLLLCSILFFIIFLFIFHYI

SEQ ID NO: 747097 - protein, 307 aa, Homo sapiens; identical to SEQ ID NO: 747093

SEQ ID NO: 747098 - protein, 386 aa, Homo sapiens
PSGWESGHTGPPIPFPLTSVLRVPDPHFHPPTGQYLVISSPPLECPFDTKTFWDWKFPLLQINQSYLQQGNFFFSILERMGGFQRGKYGTMAEGRSEDNLSATPPALRIILVGKTGCGKSATGNSILGQPVFESKLRAQSVTRTCQVKTGTWNGRKVLVVDTPSIFESQADTQELYKNIGDCYLLSAPGPHVLLLVIQLGRFTAQDTVAIRKVKEVFGTGAMRHVVILFTHKEDLGGQALDDYVANTDNCSLKDLVRECERRYCAFNNWGSVEEQRQQQAELLAVIERLGREREGSFHSNDLFLDAQLLQRTGAGACQEDYRQYQAKVEWQVEKHKQELRENESNWAYKALLRVKHLMLLHYEIFVFLLLCSILFFIIFLFIFHYI

SEQ ID NO: 747099 - protein, 170 aa, Homo sapiens
MGGFQRGKYGTMAEGRSEDNLSATPPALRIILVGKTGCGKSATGNSILGQPVFESKLRAQSVTRTCQVKTGTWNGRKVLVVDTPSIFESQADTQELYKNIGDCYLLSAPGPHVLLLVIQLGRFTAQDTVAIRKVKEVFGTGAMRHVVILFTLSHQPCSLPYLRISSCISQ

SEQ ID NO: 747100 - protein, 307 aa, Homo sapiens; identical to SEQ ID NO: 747093

SEQ ID NO: 747101 - protein, 204 aa, Homo sapiens
LHSQPKGKQQVGASCGQLQSLSPGKVSMGGRKMATDEENVYGLEENAQSRQESTRRLILVGRTGAGKSATGNSILGQRRFFSRLGATSVTRACTTGSRRWDKCHVEVVDTPDIFSSQVSKTDPGCEERGHCYLLSAPGPHALLLVTQLGRFTAQDQQAVRQVRDMFGEDVLKWMVIVFTRKEDLAGGSLHDYVSNTENRVPRAA

SEQ ID NO: 747102 - protein, 479 aa, Homo sapiens
MKKMSIGKSATGNSILGQRRFFSRLGATSVTRACTTGSRRWDKCHVEVVDTPDIFSSQVSKTDPGCEERGHCYLLSAPGPHALLLVTQLGRFTAQDQQAVRQLSHGAFSPSTWLLLNCVCSTSLSPVNSIPAHRRRAGLSLLPLHLPERGPAARASVTATLEDRAQQPFLERMGGFQRGKYGTMAEGRSEDNLSATPPALRIILVGKTGCGKSATGNSILGQPVFESKLRAQSVTRTCQVKTGTWNGRKVLVVDTPSIFESQADTQELYKNIGDCYLLSAPGPHVLLLVIQLGRFTAQDTVAIRKVKEVFGTGAMRHVVILFTHKEDLGGQALDDYVANTDNCSLKDLVRECERRYCAFNNWGSVEEQRQQQAELLAVIERLGREREGSFHSNDLFLDAQLLQRTGAGACQEDYRQYQAKVEWQVEKHKQELRENESNWAYKALLRVKHLMLLHYEIFVFLLLCSILFFIIFLFIFHYI

SEQ ID NO: 747103 - protein, 289 aa, Homo sapiens
MGGFQRGKYGTMAEGRSEDNLSATPPALRIILVGKTGCGKSATGNSILGQPVFESKLRAQSVTRTCQVFESQADTQELYKNIGDCYLLSAPGPHVLLLVIQLGRFTAQDTVAIRKVKEVFGTGAMRHVVILFTHKEDLGGQALDDYVANTDNCSLKDLVRECERRYCAFNNWGSVEEQRQQQAELLAVIERLGREREGSFHSNDLFLDAQLLQRTGAGACQEDYRQYQAKVEWQVEKHKQELRENESNWAYKALLRVKHLMLLHYEIFVFLLLCSILFFIIFLFIFHYI

SEQ ID NO: 747104 - protein, 117 aa, Homo sapiens [sequence omitted]

SEQ ID NO: 747105 - protein, 178 aa, Homo sapiens
MGGFQRGKYGTMAEGRSEDNLSATPPALRIILVGKTGCGKSATGNSILGQPVFESKLRAQSVTRTCQVKTGTWNGRKVLVVDTPSIFESQADTQELYKNIGDCYLLSAPGPHVLLLVIQLGRFTAQDTVAIRKVKEVFGTGAMRHVVILFTHKEDLGGQALDDYVANTDNCSSFVLPT

SEQ ID NO: 747106 - protein, 109 aa, Homo sapiens
MDSSPAGSRSSWGEWSEPLWCRGGAYLVAFSLRVEAPTTLGDNTAANNVRFRCSDGEELQGPGLSWGDFGDWSDHCPKGACGLQTKIQGPRGLGDDTALNDARLFCCRS

SEQ ID NO: 747107 - protein, 152 aa, Homo sapiens
GRPFRNRSPHRGQTDINLLRRPDVTDATGWSGAQEPSCCRCCCFCGRLVSHVHSWGEWSEPLWCRGGAYLVAFSLRVEAPTTLGDNTAANNVRFRCSDGEELQGPGLSWGDFGDWSDHCPKGACGLQTKIQGPRGLGDDTALNDARLFCCRS

SEQ ID NO: 747108 - protein, 237 aa, Homo sapiens
MERGAGAKLLPLLLLLRATGFTCAQADGRNGYTAVIEVTSGGPWGDWAWPEMCPDGFFASGFSLKVGAQAVGPGEGGDAWDHRAKDDNSVTRPAPLLDTQVEPPQGIPGDDTALNGIRLHCARGNVLGNTHVVESQSGSWGEWSEPLWCRGGAYLVAFSLRVEAPTTLGDNTAANNVRFRCSDGEELQGPGLSWGDFGDWSDHCPKGACGLQTKIQGPRGLGDDTALNDARLFCCRS

SEQ ID NO: 747109 - protein, 202 aa, Homo sapiens [sequence omitted]

SEQ ID NO: 747110 - protein, 121 aa, Homo sapiens
LESLKGLVNGGPAEATHLPLPCSWGEWSEPLWCRGGAYLVAFSLRVEAPTTLGDNTAANNVRFRCSDGEELQGPGLSWGDFGDWSDHCPKGACGLQTKIQGPRGLGDDTALNDARLFCCRS

SEQ ID NO: 747111 - protein, 102 aa, Homo sapiens
MERGAGAKLLPLLLLLRATGFTCAQADGRNGYTAVIEVTSGGPWGDWAWPEMCPDGFFASGFSLKVEPPQGIPGDDTALNGIRLHCARGNVLGNTHVLGRME

SEQ ID NO: 747112 - protein, 312 aa, Homo sapiens
MDGVNDSSLQGFVLMSISDHPQLEMIFFIAILFSYLLTLLGNSTIILLSRLEARLHTPMYFFLSNLSSLDLAFATSSVPQMLINLWGPGKTISYGGCITQLYVFLWLGATECILLVVMAFDRYVAVCRPLRYTAIMNPQLCWLLAVIAWLGGLGNSVIQSTFTLQLPLCGHRRVEGFLCEVPAMIKLACGDTSLNQAVLNGVCTFFTAVPLSIIVISYCLIAQAVLKIHSAEGRRKAFNTCLSHLLVVFLFYGSASYGYLLPAKNSKQDQGKFISLFYSLVTPMVNPLIYTLRNMEVKGALRRLLGKGREVG

SEQ ID NO: 747113 - protein, 67 aa, Homo sapiens
MQRGATTSGLQESQELRRPSSCDFMLPSAALTCWAWAERQPRKSIKASQDDLCSVTQRFPNKSCFQG

SEQ ID NO: 747114 - protein, 557 aa, Homo sapiens
MRHRFHSGERRRTQTQYTVGRGTSMSAAREPFQNLTQKMASILRKSTYAYDVQTAEGVLSTIVKGVSRWPQAAQMKRPVWAAERSLEVGSKGHEPVWAAGGGPGKEGSRGSTCGGLLPDPRELEASLPPGPPSQAEPAARGTEQCPPCAQCGQSFGQKELSAPHQRVHRGPRPFAGAQCPKSFTQRTTPASHRRAHVAECTYTRAQCGKTFLQQIDAHTHYCAHIREKPYECAKLFGRLSTLLEHRHMHTGERPFQCTQCGCCFSRLSTLLEHRHTHISEKPFQCAQCDKRFTRLANLTVHQRVHLGERSFQCAQYSRRFMQKPGFLRHLCGHSQEKHYPCSPCGESFTCPSWLVRHQDSHASQASPSCLVCERDSSTDEPPTGLRGAVWGSTPSNPSAALRFEGTGTELGLRRCPGDRQRGSGDQEGLGWGSLAQFSFSREDGEMWVAPRELPKGALRAQGQLVPLKSEQPLLGATSWPGQSILAMVLASRGRAVLPGTEIAHGPSRCREAAGIEASPKHLSLTEGKAWAWRWGAQEWLALPCSIRRVIFRDKGPS

SEQ ID NO: 747115 - protein, 557 aa, Homo sapiens; identical to SEQ ID NO: 747114

SEQ ID NO: 747116 - protein, 350 aa, Homo sapiens
MRHRFHSGERRRTQTQYTVGRGTSMSAAREPFQNLTQKMASILRKSTYAYDVQTAEGVLSTIVKGVSRWPQAAQMKRPVWAAERSLEVGSKGHEPVWAAGGGPGKEGSRGSTCGGLLPDPRELEASLPPGPPSQAEPAARGTEQCPPCAQCGQSFGQKELSAPHQRVHRGPRPFAGAQCPKSFTQRTTPASHRRAHVAECTYTRAQCGKTFLQQIDAHTHYCAHIREKPYECAKLFGRLSTLLEHRHMHTGERPFQCTQCGCCFSRLSTLLEHRHTHISEKPFQCAQCDKRFTRLANLTVHQRVHLGERSFQCAQYSRRFMQKPGFLRHLCGHSQEKHYPCSPCGSHDQW

SEQ ID NO: 747117 - protein, 102 aa, Homo sapiens
PKKLWKKCTQYAHLCPFSVSLQTECCLTKLKSCGREREVVQDTWLLTVRKTASLRQAQWLTPVIPTIWEAEAGGSPEVRSSRPAWPTRRNPISAKNTKISRA

SEQ ID NO: 747118 - protein, 112 aa, Homo sapiens
MVRISDVIAHANLATSLKKNTCNCQADLLSWRSWVNGISCHCPNLRPLSKSIFRDSTSLCSLSQQRLCPLHSKPEACWGLFVSVHAHFRVQSGGRGNRVGKKTRVSRNDETL

SEQ ID NO: 747119 - protein, 685 aa, Homo sapiens
MGVANPEVAGGRAPFPECTAAAAFRNRFSFGPGRPGGEDWCGLAMDGLQASAGPLRRGRPRRRRKPQPHSGSVLALPLRSRKIRKQLRSVVSRMAALRTQTLPSENSEESRVESTADDLGDALPGGAAVAAVPDAARREPYGHLGPAELLEASPAARSLQTPSARLVPASAPPARLVEVPAAPVRVVETSALLCTAQHLAAVQSSGAPATASGPQVDNTGGEPAWDSPLRRVLAELNRIPSSRRRAARLFEWLIAPMPPDHFYRRLWEREAVLVRRQDHTYYQGLFSTADLDSMLRNEEVQFGQHLDAARYINGRRETLNPPGRALPAAAWSLYQAGCSLRLLCPQAFSTTVWQFLAVLQEQFGSMAGSNVYLTPPNSQGFAPHYDDIEAFVLQLEGRKLWRVYRPRAPTEELALTSSPNFSQDDLGEPVLQTVLEPGDLLYFPRGFIHQAECQDGVHSLHLTLSTYQRNTWGDFLEAILPLAVQAAMEENVEFRRGLPRDFMDYMGAQHSDSKDPRRTAFMEKVRVLVARLGHFAPVDAVADQRAKDFIHDSLPPVLTDRERALSVYGLPIRWEAGEPVNVGAQLTTETEVHMLQDGIARLVGEGGHLFLYYTVENSRVYHLEEPKCLEIYPQQADAMELLLGSYPEFVRVGDLPCDSVEDQLSLATTLYDKGLLLTKMPLALN

SEQ ID NO: 747120 - protein, 80 aa, Homo sapiens
YGTFPTFPETSPILTEKQAKQLLRSRRQDRPSKPGFPDEPMREYMHHLLALEHRAEEQFLEHWLNPHCKPHCDRNRIHPV

SEQ ID NO: 747121 - protein, 313 aa, Homo sapiens
MGQNQTSISDFLLLGLPIQPEQQNLCYALFLAMYLTTLLGNLLIIVLIRLDSHLHTPMYLFLSNLSFSDLCFSSVTIPKLLQNMQNQDPSIPYADCLTQMYFFLLFGDLESFLLVAMAYDRYVAICFPLHYTAIMSPMLCLTLVALSWVLTTFHAMLHTLLMARLCFCADNVIPHFFCDMSALLKLAFSDTRVNEWVIFIMGGLILVIPFLLILGSYARIVSSILKVPSSKGICKAFSTCGSHLSVVSLFYGTVIGLYLCSSANSSTLKDTVMAMMYTVVTPMLNPFIYSLRNRDMKGALSRVIHQKKTFFSL

SEQ ID NO: 747122 - protein, 223 aa, Homo sapiens [sequence omitted]

SEQ ID NO: 747123 - protein, 223 aa, Homo sapiens [sequence omitted]

SEQ ID NO: 747124 - protein, 209 aa, Homo sapiens
MSDEEARQSGGSSQAGAVTVSDVQELMRRKEEIEAQIKANYDVLESQKGIGMNEPLVDCEGYPRSDVDLYQVRTARHNIICLQNDHKAVMKQVEEALHQLHARDKEKQARDMAEAHKEAMSRKLGQSESQGPPRAFAKVNSISPGSPASIAGLQVDDEIVEFGSVNTQNFQSLHNIGSVVQHSEGALAPTILLSVSMNLTTPGTSSRSP

SEQ ID NO: 747125 - protein, 234 aa, Homo sapiens
MSDEEARQSGGSSQAGAVTVSDVQELMRRKEEIEAQIKANYDVLESQKGIGMNEPLVDCEGYPRSDVDLYQVRTARHNIICLQNDHKAVMKQVEEALHQLHARDKEKQARDMAEAHKEAMSRKLGQSESQGPPRAFAKVNSISPGSPASIAGLQVDDEIVEFGSVNTQNFQSLHNIGSVVQHSEGKPLNVTVIRRGEKHQLRLVPTRWAGKGLLGEYSLKMCPGTVRRHLCLIG

SEQ ID NO: 747126 - protein, 223 aa, Homo sapiens [sequence omitted]

SEQ ID NO: 747127 - protein, 82 aa, Homo sapiens
LFSRSRTAVVFWRMGGAVVTVDWGVVPSPGAGSLESRPGVHDVRRGSEAERRLLAGRRRDCQRRPGADAAQGGDRSADQGQL

SEQ ID NO: 747128 - protein, 100 aa, Homo sapiens
HAVGFGEGPPRAFAKVNSISPGSPASIAGLQVDDEIVEFGSVNTQNFQSLHNIGSVVQHSEGKPLNVTVIRRGEKHQLRLVPTRWAGKGLLGCNIIPLQR

SEQ ID NO: 747129 - protein, 169 aa, Homo sapiens
MSDEEARQSGGSSQAGAVTVSDVQELMRRKEEIEAQIKANYDVLESQKGIGMNEPLVDCEGYPRSDVDLYQVRTARHNIICLQNDHKAVMKQVEEALHQLHARDKEKQARDMAEAHKEAMSRKLGQSESQGPPRAFAKVNSISPGSPASIAVIQGLATQVHAQGTRWVR

SEQ ID NO: 747130 - protein, 683 aa, Homo sapiens
AISAIFWATKYSQDNKEESLFLLLQYLPPGVIALVNFLGPLLFTFLVQLENYPPNTEVNLTLIWCVVLKLASLGMFSVSLGQTILCIGRDKSSCESYGYNVCDYQVAGSPAGPVPPFLLPKKLTSNCAEPCSCPFVTFERSCEQGCLHRRTPPGGATAATWCSVAALAVGLPALIPSSRPGFQPNDSIRHQARHLHHRNPHRRLREGRAGVAVSGDGSPSPAPQCWENSVGEELYKLSIFNFLLTVAFAFLVTLPRRLLVDRFSGRFWAWLEREEFLVPKNVLDIVAGQTVTWMGLFYCPLLPLLNSVFLFLTFYIKKYTLLKNSRASSRPFRASSSTFFFQLVLLLGLLLAAVPLGYVVSSPTWPSLASIHSSWDCGLFTNYSAPWQVVPELVALGLPPIGQRALHYLGSHAFSFPLLIMLRFSGQRGHGRGHLEGEVLPSMGVVSLCTPNQEPDAESQGKQGPLKSRNLLGPPSGLPWGLQDHWGSTVSGWLQLLSYWYCCARGEGMRGSARKERRVPSSDTAVCSEKTPVPRIVEIEVGREEVRERRLWPQGQLTTNPLPTQSLVLTVCVSQTQANARAIHRLRKQLVWVQEKWHLVEDLSRLLPEPGPSDSPGPKYPASQASRPQSFCPGCPCPGSPGHQAPRPGPSVVDAAGLRSPCPGQHGAPASARRFRFPSGAEL

SEQ ID NO: 747131 - protein, 540 aa, Homo sapiens
AISAIFWATKYSQDNKEESLFLLLQYLPPGVIALVNFLGPLLFTFLVQLENYPPNTEVNLTLIWCVVLKLASLGMFSVSLGQTILCIGRDKSSCESYGYNVCDYQVAGSPAGPVPPFLLPKKLTSNCAEPCSCPFVTFERSCEQGCLHRRTPPGGATAATWCSVAALAVGLPALIPSSRPGFQPNDSIRHQARHLHHRNPHRRLREGRAGVAVSGDGSPSPAPQCWENSVGEELYKLSIFNFLLTVAFAFLVTLPRRLLVDRFSGRFWAWLEREEFLVPKNVLDIVAGQTVTWMGLFYCPLLPLLNSVFLFLTFYIKKYTLLKNSRASSRPFRASSSTFFFQLVLLLGLLLAAVPLGYVVSSPTWPSLASIHSSWDCGLFTNYSAPWQVVPELVALGLPPIGQRALHYLGSHAFSFPLLIMLSLVLTVCVSQTQANARAIHRLRKQLVWVQEKWHLVEDLSRLLPEPGPSDSPGPKYPASQASRPQSFCPGCPCPGSPGHQAPRPGPSVVDAAGLRSPCPGQHGAPASARRFRFPSGAEL

SEQ ID NO: 747132 - protein, 515 aa, Homo sapiens
AISAIFWATKYSQDNKEESLFLLLQYLPPGVIALVNFLGPLLFTFLVQLENYPPNTEVNLISDLCWENSVGEELYKLSIFNFLLTVAFAFLVTLPRRLLVDRFSGRFWAWLEREEFLVPKNVLDIVAGQTVTWMGLFYCPLLPLLNSVFLFLTFYIKKYTLLKNSRASSRPFRASSSTFFFQLVLLLGLLLAAVPLGYVVSSIHSSWDCGLFTNYSAPWQVVPELVALGLPPIGQRALHYLGSHAFSFPLLIMLRFSGQQGPWEGTPGGGGPSFHGGGEPVHPQPGARRRKQGKQGPLKSRNLLGPPSGLPWGLQDHWGSTVSGWLQLLSYWYCCARGEGMRGSARKERRVPSSDTAVCSEKTPVPRIVEIEVGREEVRERRLWPQGQLTTNPLPTQSLVLTVCVSQTQANARAIHRLRKQLVWVQEKWHLVEDLSRLLPEPGPSDSPGPKYPASQASRPQSFCPGCPCPGSPGHQAPRPGPSVVDAAGLRSPCPGQHGAPASARRFRFPSGAEL

SEQ ID NO: 747133 - protein, 564 aa, Homo sapiens
AISAIFWATKYSQDNKEESLFLLLQYLPPGVIALVNFLGPLLFTFLVQLENYPPNTEVNLTLIWCVVLKLASLGMFSVSLGQTILCIGRDKSSCESYGYNVCDYQCWENSVGEELYKLSIFNFLLTVAFAFLVTLPRRLLVDRFSGRFWAWLEREEFLVPKNVLDIVAGQTVTWMGLFYCPLLPLLNSVFLFLTFYIKKYTLLKNSRASSRPFRASSSTFFFQLVLLLGLLLAAVPLGYVVSSPTWPSLASIHSSWDCGLFTNYSAPWQVVPELVALGLPPIGQRALHYLGSHAFSFPLLIMLRFSGQRGHGRGHLEGEVLPSMGVVSLCTPNQEPDAESQGKQGPLKSRNLLGPPSGLPWGLQDHWGSTVSGWLQLLSYWYCCARGEGMRGSARKERRVPSSDTAVCSEKTPVPRIVEIEVGREEVRERRLWPQGQLTTNPLPTQSLVLTVCVSQTQANARAIHRLRKQLVWVQEKWHLVEDLSRLLPEPGPSDSPGPKYPASQASRPQSFCPGCPCPGSPGHQAPRPGPSVVDAAGLRSPCPGQHGAPASARRFRFPSGAEL

SEQ ID NO: 747134 - protein, 123 aa, Homo sapiens [sequence omitted]

SEQ ID NO: 747135 - protein, 123 aa, Homo sapiens [sequence omitted]

SEQ ID NO: 747136 - protein, 683 aa, Homo sapiens; identical to SEQ ID NO: 747130

SEQ ID NO: 747137 - protein, 528 aa, Homo sapiens
AISAIFWATKYSQDNKEESLFLLLQYLPPGVIALVNFLGPLLFTFLVQLENYPPNTEVNLTLIWCVVLKLASLGMFSVSLGQTILCIGRDKSSCESYGYNVCDYQVAGSPAGPVPPFLLPKKLTSNCAEPCSCPFVTFERSCEQGCLHRRTPPGGATAATWCSVAALAVGLPALIPSSRPGFQPNDSIRHQARHLHHRNPHRRLREGRAGVAVSGDGSPSPAPQCWENSVGEELYKLSIFNFLLTVAFAFLVTLPRRLLVDRFSGRFWAWLEREEFLVPKNVLDIVAGQTVTWMGLFYCPLLPLLNSVFLFLTFYIKKYTLLKNSRASSRPFRASSSTFFFQLVLLLGLLLAAVPLGYVVSSPTWPSLASIHSSWDCGLFTNYSAPWQVVPELVALGLPPIGQRALHYLGSHAFSFPLLIMLRFSGQQGPWEGTPGGGGPSFHGGGEPVHPQPGARRRKPREAGASEKQEPPGPTLWAAMGIAGSLGKHRVWVAAAAELLVLLCQRGGDEGLCEEGEEGPILRYSSVQ

SEQ ID NO: 747138 - protein, 114 aa, Homo sapiens
MLLPRSVSSERAPGVPEPEELWEAEMERLRGSGTPVRGLPYAMMDKRLIWQLREPAGVQTLRWQRWQRRRQTVERRLREAAQAAGPGALGSGRGRSTRSGASSAQEFGPTSPSS

SEQ ID NO: 747139 - protein, 121 aa, Homo sapiens
PDIVGTTSNLLKGIILSLSPRAKFGTRLLISGLGPKVAPGPVASASPGKRLEMNIPRPHLSLLNQSIPLANHTEKQPRASPSAVKKASFETLKESSNSGPRCAHPGRDKDAMLLQVASKIK

SEQ ID NO: 747140 - protein, 256 aa, Homo sapiens
AISAIFWATKYSQDNKEESLFLLLQYLPPGVIALVNFLGPLLFTFLVQLENYPPNTEVNLTLIWCVVLKLASLGMFSVSLGQTILCIGRDKSSCESYGYNVCDYQCWENSVGEELYKLSIFNFLLTVAFAFLVTLPRRLLVDRFSGRFGEGQEETRAWWDWLQAHRRRARGLDTKPPSYLGSSFFSFAFFCFCCMISESLCLRAAAESPSSRRFPLTESLCFFIFFWRASSRWYRRSWRRQRLQPASSCPSQGSSS

SEQ ID NO: 747141 - protein, 155 aa, Homo sapiens
LHRSGSNASDRISCPSFSFPPRYYRGAVGALLVFDLTKHQTYAVVERWLKELYDHAEATIVVMLVGNKSDLSQAREVPTEEARMFAENNGLLFLETSALDSTNVELAFETVLKEIFAKVSKQRQNSIRTNAITLGSAQAGQEPGPGEKRACCISL

SEQ ID NO: 747142 - protein, 213 aa, Homo sapiens
MGNGTEEDYNFVFKVVLIGESGVGKTNLLSRFTRNEFSHDSRTTIGVEFSTRTVMLGTAAVKAQIWDTAGLERYRAITSAYYRGAVGALLVFDLTKHQTYAVVERWLKELYDHAEATIVVMLVGNKSDLSQAREVPTEEARMFAENNGLLFLETSALDSTNVELAFETVLKEIFAKVSKQRQNSIRTNAITLGSAQAGQEPGPGEKRACCISL

SEQ ID NO: 747143 - protein, 184 aa, Homo sapiens
MGNGTEEDYNFVFKVVLIGESGVGKTNLLSRFTRNEFSHDSRTTIGVEFSTRTVMLGTAAVKAQIWDTAGLERYRAITSAYYRGAVGALLVFDLTKHQTYAVVERWLKELYDHAEATIVVMLVGNKSDLSQAREVPTEEARMFAENNGLLFLETSALDSTQLVLPASGLPGLLDASFNAHTAMR

SEQ ID NO: 747144 - protein, 86 aa, Homo sapiens
KHRRAPTVTTEEARMFAENNGLLFLETSALDSTNVELAFETVLKEIFAKVSKQRQNSIRTNAITLGSAQAGQEPGPGEKRACCISL

SEQ ID NO: 747145 - protein, 173 aa, Homo sapiens
MIIFQDLISHNEMFSDIYKIWEITNGLCLEVEQKMLSKTTGNTDDSLIGRNSSSESTEDEVTESTIITSVDIVTNHHLQESIFTKEAYKKYIKDYMKSINEKLEEQRPERVKLFITGNEEQIKHIFANFQNYQFFIGENLNPPGMVALLNYRKDGQYDPIYDFLRNGLEIKRC

SEQ ID NO: 747146 - protein, 285 aa, Homo sapiens
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILSDVQLIKTGDKVGASEATLLNMLNISPFSFGLVIQQVFDNGSIYNPEVLDITEETLHSRFLEGVRNVASVCLADWYPTVASVPHSIINGYKRVLACLWRRITPSHLLKRSRLSWLIHLPLWLLPLWLLPP

SEQ ID NO: 747147 - protein, 158 aa, Homo sapiens
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILCAS

SEQ ID NO: 747148 - protein, 285 aa, Homo sapiens; identical to SEQ ID NO: 747146

SEQ ID NO: 747149 - protein, 285 aa, Homo sapiens; identical to SEQ ID NO: 747146

SEQ ID NO: 747150 - protein, 223 aa, Homo sapiens
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILGVRNVASVCLADWYPTVASVPHSIINGYKRVLACLWRRITPSHLLKRSRLSWLIHLPLWLLPLWLLPP

SEQ ID NO: 747151 - protein, 178 aa, Homo sapiens
MPREDRATWKSNYFLKIIQLLDDYPEYVSLDGEAETNVGSNVKDASNESGHVLISSVDMGLLGIDDLQFGGQHESTSMYAAMARSRGAPAKYQHQSLGGELLPHIRGNVGFVFTKEDLTEIRDMLLANKVPAAARAGAIAPCEVTVPAQNTGLGPEKTSFFQALGITTKISRGTIEIL

SEQ ID NO: 747152 - protein, 385 aa, Homo sapiens
MKDEPRSTNLFMKLDSVFIWKEPFGLVLIIAPWNYPLNLTLVLLVGALAAGSCVVLKPSEISQGTEKVLAEVLPQYLDQSCFAVVLGGPQETGQLLEHKLDYIFFTGSPRVGKIVMTAATKHLTPVTLELGGKNPCYVDDNCDPQTVANRVAWFCYFNAGQTCVAPDYVLCSPEMQERLLPALQSTITRFYGDDPQSSPNLGRIINQKQFQRLRALLGCGRVAIGGQSNESDRYIAPTVLVDVQETEPVMQEEIFGPILPIVNVQSVDEAIKFINRQEKPLALYAFSNSSQVVNQMLERTSSGSFGGNEGFTYISLLSVPFGGVGHSGMGRYHGKFTFDTFSHHRTCLLAPSGLEKLKEIRYPPYTDWNQQLLRWGMGSQSCTLL

SEQ ID NO: 747153 - protein, 385 aa, Homo sapiens; identical to SEQ ID NO: 747152

SEQ ID NO: 747154 - protein, 141 aa, Homo sapiens
IARRGHGSWFGSCQSPGRIAVSRAGLRPGGRSRACASGGSMSKKGSGGAAKDPGAEPTLGWTPSRTRCGGCVRPSTEGARGRPSSGLRSSRAWATSFKKTSSFCATCWPRTCISQLSRQTYLSSSFARTRLTTLSRTCRPG

SEQ ID NO: 747155 - protein, 357 aa, Homo sapiens
MKDEPRSTNLFMKLDSVFIWKEPFGLVLIIAPWNYPLNLTLVLLVGALAAGSCVVLKPSEISQGTEKVLAEVLPQYLDQSCFAVVLGGPQETGQLLEHKLDYIFFTGSPRVGKIVMTAATKHLTPVTLELGGKNPCYVDDNCDPQTVANRVAWFCYFNAGQTCVAPDYVLCSPEMQERLLPALQSTITRFYGDDPQSSPNLGRIINQKQFQRLRALLGCGRVAIGGQSNESDRYIAPTVLVDVQETEPVMQEEIFGPILPIVNVQSVDEAIKFINRQEKPLALPQWDGPVPRQVHLRHLLPPPHLPARPLRPGEIKGDPLPTLYRLEPAAVTLGHGLPELHPPVSVPPASNGSHRET

SEQ ID NO: 747156 - protein, 385 aa, Homo sapiens; identical to SEQ ID NO: 747152

SEQ ID NO: 747157 - protein, 385 aa, Homo sapiens; identical to SEQ ID NO: 747152

SEQ ID NO: 747158 - protein, 385 aa, Homo sapiens; identical to SEQ ID NO: 747152

SEQ ID NO: 747159 - protein, 223 aa, Homo sapiens
MKDEPRSTNLFMKLDSVFIWKEPFGLVLIIAPWNYPLNLTLVLLVGALAAGSCVVLKPSEISQGTEKVLAEVLPQYLDQSCFAVVLGGPQETGQLLEHKLDYIFFTGSPRVGKIVMTAATKHLTPVTLELGGKNPCYVDDNCDPQTVANRVAWFCYFNAGQTCVAPDYVLCSPEMQERLLPALQSTITLYRLEPAAVTLGHGLPELHPPVSVPPASNGSHRET

SEQ ID NO: 747160 - protein, 107 aa, Homo sapiens
MTRAQTHLLTPWQVVNQMLERTSSGSFGGNEGFTYISLLSVPFGGVGHSGMGRYHGKFTFDTFSHHRTCLLAPSGLEKLKEIRYPPYTDWNQQLLRWGMGSQSCTLL

SEQ ID NO: 747161 - protein, 385 aa, Homo sapiens; identical to SEQ ID NO: 747152

SEQ ID NO: 747162 - protein, 268 aa, Homo sapiens
MKDEPRSTNLFMKLDSVFIWKEPFGLVLIIAPWNYPLNLTLVLLVGALAAGSCVVLKPSEISQGTEKVLAEVLPQYLDQSCFAVVLGGPQETGQLLEHKLDYIFFTGSPRVGKIVMTAATKHLTPVTLELGGKNPCYVDDNCDPQTVANRVAWFCYFNAGQTCVAPDYVLCSPEMQERLLPALQSTITRFYGDDPQSSPNLGRIINQKQFQVNLSEKGRQVDAEEYLGFILDGLHEEMLTLKKLLSPSNERLTISNRPKNHSVNEEEQ

SEQ ID NO: 747163 - protein, 264 aa, Homo sapiens
MSKKGSGGAAKDPGAEPTLGSPRVGKIVMTAATKHLTPVTLELGGKNPCYVDDNCDPQTVANRVAWFCYFNAGQTCVAPDYVLCSPEMQERLLPALQSTITRFYGDDPQSSPNLGRIINQKQFQRLRALLGCGRVAIGGQSNESDRYIAPTVLVDVQETEPVMQEEIFGPILPIVNVQSVDEAIKFINRQEKPLALYAFSNSSQVVNQMLERTSSGSFGGNEGFTYISLLSVPFGGVESASGWPYTTHTLHTTAVASAENKEST

SEQ ID NO: 747164 - protein, 82 aa, Homo sapiens
LTPWQVVNQMLERTSSGSFGGNEGFTYISLLSVPFGGVAVGPCPFPPLGKLGFGTPDPGSPFTHCSTLIHTLGLSRPQFPYL

SEQ ID NO: 747165 - protein, 104 aa, Homo sapiens
SLNFPFSLLILGVQDIFLSHQSALPQQAPGPLPCSRWARQESTLHERQGLGPAPAPICFLIRQADAAGSVIISPSTRCAHVRTGDDCPERAGVPLPHLPHLGKL

SEQ ID NO: 747166 - protein, 161 aa, Homo sapiens
GEVILQIANEPVLPFNALDIALEVQNNLKGDQPNTHQLLAMASRLRESAELFQSDEMRPANDPKERAPIRIRMLNDILQDMEKSFLVKQAPPGFYRNILYHLDEKTSRFSILIEAWEHCKPLASNETLQEALSEVLNSINSAQVYFKAGLDVFKSVLDGKN

SEQ ID NO: 747167 - protein, 161 aa, Homo sapiens; identical to SEQ ID NO: 747166

SEQ ID NO: 747168 - protein, 236 aa, Homo sapiens
MTGYEARLITFGTWMYSVNKEQLARAGFYAIGQEDKVQCFHCGGGLANWKPKEDPWEQHAKWYPGCKYLLEEKGHEYINNIHLTRSLEGALVQTTKKTPSLTKRISDTIFPNPMLQEAIRMGFDFKDVKKIMEERIQTSGSNYKTLEVLVADLVSAQKDTTENELNQTSLQREISPEEPLRRLQEEKLCKICMDRHIAVVFIPCGHLVTCKQCAEAVDRCPMCSAVIDFKQRVFMS

SEQ ID NO: 747169 - protein, 706 aa, Homo sapiens
SHSSLVGDWRCSLMWPQPYLPPHPMMLEESRQNKLAAAKKKLKEYQQRKSPGIPAGAKTKKKKTDSSPETTTSGGCHSPGDSQYQELAVALESSSVTINQLNENIESLKQQKKQVEHQLEEAKKTNNEIHKAQMEQLETINILTLEKADLKTTLYHTKRAARHFEEESKDLAGRLQYSLQRIQELERALCAVSTQQQEEDRSSSCREAVLQRRLQQTIKERALLNAHVTQVTESLKQVQLERDEYAKHIKGERARWQERMWKMSVEARTLKEEKKRDIHRIQELERSLSELKNQMAEPPSLAPPAVTSVVEQLQDEAKHLRQEVEGLEGKLQSQVENNQALSLLSKEQKQRLQEQEEMLREQEAQRVREQERLCEQNERLREQQKTLQEQGERLRKQEQRLRKQEERLRKEEERLQKQEKRLWDQEERLWKKEERLQKQEERLALSQNHKLDKQLAEPQCSFEDLNNEKKSALQLEQQVKELQEKLDEEHLEAASHQNQQLETQLSLVALPGEGDGGQHLDSEEEEAPRPTPNIPEDLESREATSSFMDLPKEKADGTEQVERRELGFVQPSGVTDGMRESFTVYESQGAVPNTRHQEMEDVIRLAQKEEEMKVKLLELQELVLPLVGNHEGHGKFLIAAQNPADEPTPGAPAPQELGAAGEQDVFYEVSLDNNVEPAPGAAREGSPHDNPTVQQIVQLSPVMQDT

SEQ ID NO: 747170 - protein, 833 aa, Homo sapiens
RVARGWGGCGACGGSGIVGQGKGEPSRRRGRAAGRPQSMERGKMAEAESLETAAEHERILREIESTDTACIGPTLRSVYDGEEHGRFMEKLETRIRNHDREIEKMCNFHYQGFVDSITELLKVRGEAQKLKLVIAMEELKQCRLQQRNISATVDKLMLCLPVLEMYSKLRDQMKTKRHYPALKTLEHLEHTYLPQVSHYRFCKVMVDNIPKLREEIKDVSMSDLKDFLESIRKHSDKIGETAMKQAQQQRNLDNIVLQQPRIGSKRKSKKDAYIIFDTEIESTSPKSEQDSGILDVEDEEDDEEVPGAQDLVDFSPVYRCLHIYSVLGARETFENYYRKQRRKQARLVLQPPSNMHETLDGYRKYFNQIVGFFVVEDHILHTTQGLVNRAYIDELWEMALSKTIAALRTHSSYCSDPNLVLDLKNLIVLFADTLQVYGFPVNQLFDMLLEIRDQYSETLLKKWAGIFRNILDSDNYSPIPVTSEEMYKKVVGQFPFQDIELEKQPFPKKFPFSEFVPKVYNQIKEFIYACLKFSEDLHLSSTEVDDMIRKSTNLLLTRTLSNSLQNVIKRKNIGLTELVQIIINTTHLEKSCKYLEEFITNITNVLPETVHTTKLYGTTTFKDARHAAEEEIYTNLNQKIDQFLQLADYDWMTGDLGNKASDYLVDLIAFLRSTFAVFTHLPGKVAQTACMSACKHLATSLMQLLLEAEVRQLTLGALQQFNLDVRECEQFARSGPVPGFQEDTLQLAFIDLRQLLDLFIQWDWSTYLADYGQPNCKYLRVNPVTALTLLEKMKDTSRKNNMFAQFRKNERDKQKLIDTVAKQLRGLISSHHS

SEQ ID NO: 747171 - protein, 789 aa, Homo sapiens
LASTLSAGDRVWAHAQSVYDGEEHGRFMEKLETRIRNHDREIEKMCNFHYQGFVDSITELLKVRGEAQKLKNQVTDTNRKLQHEGKELVIAMEELKQCRLQQRNISATVDKLMLCLPVLEMYSKLRDQMKTKRHYPALKTLEHLEHTYLPQVSHYRFCKVMVDNIPKLREEIKDVSMSDLKDFLESIRKHSDKIGETAMKQAQQQRNLDNIVLQQPRIGSKRKSKKDAYIIFDTEIESTSPKSEQDSGILDVEDEEDDEEVPGAQDLVDFSPVYRCLHIYSVLGARETFENYYRKQRRKQARLVLQPPSNMHETLDGYRKYFNQIVGFFVVEDHILHTTQGLVNRAYIDELWEMALSKTIAALRTHSSYCSDPNLVLDLKNLIVLFADTLQVYGFPVNQLFDMLLEIRDQYSETLLKKWAGIFRNILDSDNYSPIPVTSEEMYKKVVGQFPFQDIELEKQPFPKKFPFSEFVPKVYNQIKEFIYACLKFSEDLHLSSTEVDDMIRKSTNLLLTRTLSNSLQNVIKRKNIGLTELVQIIINTTHLEKSCKYLEEFITNITNVLPETVHTTKLYGTTTFKDARHAAEEEIYTNLNQKIDQFLQLADYDWMTGDLGNKASDYLVDLIAFLRSTFAVFTHLPGKVAQTACMSACKHLATSLMQLLLEAEVRQLTLGALQQFNLDVRECEQFARSGPVPGFQEDTLQLAFIDLRQLLDLFIQWDWSTYLADYGQPNCKYLRVNPVTALTLLEKMKDTSRKNNMFAQFRKNERDKQKLIDTVAKQLRGLISSHHS

SEQ ID NO: 747172 - protein, 833 aa, Homo sapiens; identical to SEQ ID NO: 747170

SEQ ID NO: 747173 - protein, 833 aa, Homo sapiens; identical to SEQ ID NO: 747170

SEQ ID NO: 747174 - protein, 734 aa, Homo sapiens
RVARGWGGCGACGGSGIVGQGKGEPSRRRGRAAGRPQSMERGKMAEAESLETAAEHERILREIESTDTACIGPTLRSVYDGEEHGRFMEKLETRIRNHDREIEKMCNFHYQGFVDSITELLKVRGEAQKLKLVIAMEELKQCRLQQRNISATVDKLMLCLPVLEMYSKLRDQMKTKRHYPALKTLEHLEHTYLPQVSHYRFCKVMVDNIPKLREEIKDVSMSDLKDFLESIRKHSDKIGETAMKQAQQQRNLDNIVLQQPRIGSKRKSKKDAYIIFDTEIESTSPKSEQDSGILDVEDEEDDEEVPGAQDLVDFSPVYRCLHIYSVLGARETFENYYRKQRRKQARLVLQPPSNMHETLDGYRKYFNQIVGFFVVEDHILHTTQGLVNRAYIDELWEMALSKTIAALRTHSSYCSDPNLVLDLKNLIVLFADTLQVYGFPVNQLFDMLLEIRDQYSETLLKKWAGIFRNILDSDNYSPIPVTSEEMYKKVVGQFPFQDIELEKQPFPKKFPFSEFVPKVYNQIKEFIYACLKFSEDLHLSSTEVDDMIRKSTNLLLTRTLSNSLQNVIKRKNIGLTELVQIIINTTHLEKSCKYLEEFITNITNVLPETVHTTKLYGTTTFKDARHAAEEEIYTNLNQKIDQFLQLADYDWMTGDLGNKASDYLVDLIAFLRSTFAVFTHLPTSYSKTLKQDPEVLMKKECIKSELKFKMLNFMLHLFYHNNEGDFKKSKEKKT

SEQ ID NO: 747175 - protein, 710 aa, Homo sapiens
RVARGWGGCGACGGSGIVGQGKGEPSRRRGRAAGRPQSMERGKMAEAESLETAAEHERILREIESTDTACIGPTLRSVYDGEEHGRFMEKLETRIRNHDREIEKMCNFHYQGFVDSITELLKVRGEAQKLKNQVTDTNRKLQHEGKELVIAMEELKQCRLQQRNISATVDKLMLCLPVLEMYSKLRDQMKTKRHYPALKTLEHLEHTYLPQVSHYRFCKVMVDNIPKLREEIKDVSMSDLKDFLESIRKHSDKIGETAMKQAQQQRNLDNIVLQQPRIGSKRKSKKDAYIIFDTEIESTSPKSEQDSGILDVEDEEDDEEVPGAQDLVDFSPVYRCLHIYSVLGARETFENYYRKQRRKQARLVLQPPSNMHETLDGYRKYFNQIVGFFVVEDHILHTTQGLVNRAYIDELWEMALSKTIAALRTHSSYCSDPNLVLDLKNLIVLFADTLQVYGFPVNQLFDMLLEIRDQYSETLLKKWAGIFRNILDSDNYSPIPVTSEEMYKKVVGQFPFQDIELEKQPFPKKFPFSEFVPKVYNQIKEFIYACLKFSEDLHLSSTEVDDMIRKSTNLLLTRTLSNSLQNVIKRKNIGLTELVQIIINTTHLEKSCKYLEEFITNITNVLPETVHTTKLYGTTTFKDARHAAEEEIYTNLNQKIDQFLQLADYDWMTGDLGNKASDYLVDLIAFLRSTFAVFTHLPVSGSCSYFVLYI

SEQ ID NO: 747176 - protein, 282 aa, Homo sapiens
CDLIQGKKYHLLRKVIPGQTIGAYIELVQIIINTTHLEKSCKYLEEFITNITNVLPETVHTTKLYGTTTFKDARHAAEEEIYTNLNQKIDQFLQLADYDWMTGDLGNKASDYLVDLIAFLRSTFAVFTHLPGKVAQTACMSACKHLATSLMQLLLEAEVRQLTLGALQQFNLDVRECEQFARSGPVPGFQEDTLQLAFIDLRQLLDLFIQWDWSTYLADYGQPNCKYLRVNPVTALTLLEKMKDTSRKNNMFAQFRKNERDKQKLIDTVAKQLRGLISSHHS

SEQ ID NO: 747177 - protein, 770 aa, Homo sapiens
RVARGWGGCGACGGSGIVGQGKGEPSRRRGRAAGRPQSMERGKMAEAESLETAAEHERILREIESTDTACIGPTLRSVYDGEEHGRFMEKLETRIRNHDREIEKMCNFHYQGFVDSITELLKVRGEAQKLKLVIAMEELKQCRLQQRNISATVDKLMLCLPVLEMYSKLRDQMKTKRHYPALKTLEHLEHTYLPQVSHYRFCKVMVDNIPKLREEIKDVSMSDLKDFLESIRKHSDKIGETAMKQAQQQRNLDNIVLQQPRIGSKRKSKKDAYIIFDTEIESTSPKSEQDSGILDVEDEEDDEEVPGAQDLVDFSPVYRCLHIYSVLGARETFENYYRKQRRKQARLVLQPPSNMHETLDGYRKYFNQIVGFFVVEDHILHTTQGLVNRAYIDELWEMALSKTIAALRTHSSYCSDPNLVLDLKNLIVLFADTLQVYGFPVNQLFDMLLEIRDQYSETLLKKWAGIFRNILDSDNYSPIPVTSEEMYKKVVGQFPFQDIELEKQPFPKKFPFSEFVPKVYNQIKEFIYACLKFSEDLHLSSTEVDDMIRKSTNLLLTRTLSNSLQNVIKRKNIGLTELVQIIINTTHLEKSCKYLEEFITNITNVLPETVHTTKLYGTTTFKDARHAAEEEIYTNLNQKIDQFLQLADYDWMTGDLGNKASDYLVDLIAFLRSTFAVFTHLPGKVAQTACMSACKHLATSLMQLLLEAEVRQLTLGALQQFNLDVRECEQFARSGPVPGFQEDTLQLAFIDLRQVSLCVFVFCFSFKMCD

SEQ ID NO: 747178 - protein, 100 aa, Homo sapiens
CGAGRKLSWTGHRVARTIGRRGTGWGDLPEAVPPFPSRACAPDLVPLDMQSLGATCRNHVGCAPALGWVWTWSPWGYWKGLWEIFRAQPGHLYHALANIQ

SEQ ID NO: 747179 - protein, 455 aa, Homo sapiens
MVDFPGYNLSGAVASFLFILLTMKQSEDFRVIGPAHPILAGVGEDALLTCQLLPKRTTMHVEVRWYRSEPSTPVFVHRDGVEVTEMQMEEYRGWVEWIENGIAKGNVALKIHNIQPSDNGQYWCHFQDGNYCGETSLLLKVAGLGSAPSIHMEGPGESGVQLVCTARGWFPEPQVYWEDIRGEKLLAVSEHRIQDKDGLFYAEATLVVRNASAESVSCLVHNPVLTEEKGSVISLPEKLQTELASLKVNGPSQPILVRVGEDIQLTCYLSPKANAQSMEVRWDRSHRYPAVHVYMDGDHVAGEQMAEYRGRTVLVSDAIDEGRLTLQILSARPSDDGQYRCLFEKDDVYQEASLDLKVVSLGSSPLITVEGQEDGEMQPMCSSDGWFPQPHVPWRDMEGKTIPSSSQALTQGSHGLFHVQTLLRVTNISAVDVTCSISIPFLGEEKIATFSLSGW

SEQ ID NO: 747180 - protein, 208 aa, Homo sapiens
MAGTARHDREMAIQAKKKLTTATDPIERLRLQCLARGSAGIKGLGRVFRIMDDDNNRTLDFKEFMKGLNDYAVVMEKEEVEELFRRFDKDGNGTIDFNEFLLTLRPPMSRARKEVIMQAFRKLDKTGDGVITIEDLREVYNAKHHPKYQNGEWSEEQVFRKFLDNFDSPYDKDGLVTPEEFMNYYAGVSASIDTDVYFIIMMRTAWKL

SEQ ID NO: 747181 - protein, 208 aa, Homo sapiens; identical to SEQ ID NO: 747180

SEQ ID NO: 747182 - protein, 208 aa, Homo sapiens; identical to SEQ ID NO: 747180

SEQ ID NO: 747183 - protein, 180 aa, Homo sapiens
MAGTARHDREMAIQAKKKLTTATDPIERLRLQCLARGSAGIKGLGRVFRIMDDDNNRTLDFKEFMKGLNDYAVVMEKEEVEELFRRFDKDGNGTIDFNEFLLTLRPPMSRARKEVIMQAFRKLDKTGDGVITIEDLREVYNAKHHPKYQNGEWSEEQVFRKFLDNFDSPYDKDGLVSKRA

SEQ ID NO: 747184 - protein, 208 aa, Homo sapiens; identical to SEQ ID NO: 747180

SEQ ID NO: 747185 - protein, 78 aa, Homo sapiens
KQVQEIPCGCLLPGFPAMIPESHSSNMIAKDSLLIFPQHAQRCPVSVATRQSRIYSRTQSTHLLILPREECLKPIAGN

SEQ ID NO: 747186 - protein, 359 aa, Homo sapiens
MAPMGIRLSPLGVAVFCLLGLGVLYHLYSGFLAGRFSLFGLGGEPGGGAAGPAAAADGGTVDLREMLAVSVLAAVRGGDEVRRVRESNVLHEKSKGKTREGAEDKMTSGDVLSNRKMFYLLKTAFPSVQINTEEHVDAADQEVILWDHKIPEDILKEVTTPKEVPAESVTVWIDPLDATQEYTEDLRKYVTTMVCVAVNGKPMLGVIHKPFSEYTAWAMVDGGSNVKARSSYNEKTPRIVVSRSHSGMVKQVALQTFGNQTTIIPAGGAGYKVLALLDVPDKSQEKADLYIHVTYIKKWDICAGNAILKALGGHMTTLSGEEISYTGSDGIEGGLLASIRMNHQALVRKLPDLEKTGHK

SEQ ID NO: 747187 - protein, 359 aa, Homo sapiens; identical to SEQ ID NO: 747186

SEQ ID NO: 747188 - protein, 284 aa, Homo sapiens
MAPMGIRLSPLGVAVFCLLGLGVLYHLYSGFLAGRFSLFGLGGEPGGGAAGPAAAADGGTVDLREMLAVSVLAAVRGGDEVRRVRESNVLHEKSKGKTREGAEDKMTSGDVLSNRKMFYLLKTAFPSVQINTEEHVDAADQEVILWDHKIPEDILKEVTTPKEVPAESVTVWIDPLDATQEYTEDLRKYVTTMVCVAVNGKPMLGVIHKPFSEYTAWAMVDGGSNVKARSSYNEKTPRIVVSRSHSGMVKQVALQTFGNQTTIIPAGGAGYKVFALLTAIVRGS

SEQ ID NO: 747189 - protein, 110 aa, Homo sapiens
AAAADGGTVDLREMLAVSVLAAVRGGDEVRRVRESNVLHEKSKGKTREGAEDKMTSGDVLSNRKMFYLLKTAFPSVQVGAHGRSAHSSRVARLGPSTLNSMGCGASGSIL

SEQ ID NO: 747190 - protein, 124 aa, Homo sapiens [sequence omitted]

SEQ ID NO: 747191 - protein, 51 aa, Homo sapiens
MAEGSQSAPEAGNDMGNDDAIGGNVSKYIVLPTGYCGQPKKGHLIFDACFE

SEQ ID NO: 747192 - protein, 42 aa, Homo sapiens
MGIMRTQETRLLDYSQEEVRSKAYAVADTCNPSTLGGQGESI

SEQ ID NO: 747193 - protein, 737 aa, Homo sapiens
MCESYSRSLLRVSVAQICQALGWDSVQLSACHLLTDVLQRYLQQLGRGCHRYSELYGRTDPILDDVGEAFQLMGVSLHELEDYIHNIEPVTFPHQIPSFPVSKNNVLQFPQPGSKDAEERKEYIPDYLPPIVSSQEEEEEEQVPTDGGTSAEAMQVPLEEDDELEEEEIINDENFLGKRPLDSPEAEELPAMKRPRLLSTKGDTLDVVLLEAREPLSSINTQKIPPMLSPVHVQDSTDLAPPSPEPPMLAPVAKSQMPTAKPLETKSFTPKTKTKTSSPGQKTKSPKTAQSPAMVGSPIRSPKTVSKEKKSPGRSKSPKSPKSPKVTTHIPQTPVRPETPNRTPSATLSEKISKETIQVKQIQTPPDAGKLNSENQPKKAVVADKTIEASIDAVIARACAEREPDPFEFSSGSESEGDIFTSPKRISGPECTTPKASTSANNFTKSGSTPLPLSGGTSSSDNSWTMDASIDEVVRKAKLGTPSNMPPNFPYISSPSVSPPTPEPLHKVYEEKTKLPSSVEVKKKLKKELKTKMKKKEKQRDREREKDKNKDKSKEKDKVKEKEKDKETGRETKYPWKEFLKEEEADPYKFKIKEFEDVDPKVKLKDGLVRKEKEKHKDKKKDREKGKKDKDKREKEKVKDKGREDKMKAPAPPLVLPPKELALPLFSPATASRVPAMLPSLLPVLPEKLFEEKEKVKEKEKKKDKKEKKKKKEKEKEKKEKEREKEKREREKREKEK

SEQ ID NO: 747194 - protein, 551 aa, Homo sapiens
MCESYSRSLLRVSVAQICQALGWDSVQLSACHLLTDVLQRYLQQLGRGCHRYSELYGRTDPILDDVGEAFQLMGVSLHELEDYIHNIEPVTFPHQIPSFPVSKNNVLQFPQPGSKDAEERKEYIPDYLPPIVSSQEEEEEEQVPTDGGTSAEAMQVPLEEDDELEEEEIINDENFLGKRPLDSPEAEELPAMKRPRLLSTKGDTLDVVLLEAREPLSSINTQKIPPMLSPVHVQDSTDLAPPSPEPPMLAPVAKSQMPTAKPLETKSFTPKTKTKTSSPGQKTKSPKTAQSPAMVGSPIRSPKTVSKEKKSPGRSKSPKSPKSPKVTTHIPQTPVRPETPNRTPSATLSEKISKETIQVKQIQTPPDAGKLNSENQPKKAVVADKTIEASIDAVIARACAEREPDPFEFSSGSESEGDIFTSPKRISGPECTTPKASTSANNFTKSGSTPLPLSGGTSSSDNSWTMDASIDEVVRKAKLGTPSNMPPNFPYISSPSVSPPTPEPLQHRLYRIRPLSTHPSLILEEKTHRHDPSLSNTHSQTHTPRYLNHQK

SEQ ID NO: 747195 - protein, 103 aa, Homo sapiens
MHVSCPGDVVCRSHRTLKYSGVCSMCLAPRNPCIFLSGKLQGGLQLYKKEWCIKKAMQCWDYRPKALHLAQIFFNGGTIQPITASVCVCICAYVSENYGDACS

SEQ ID NO: 747196 - protein, 106 aa, Homo sapiens
MNQKLTKRQAEVHTGRKGTAHRKKVVHTTAEDKKFQFSLKKLGVNNIPGIEEVNMFTHQGTVIHFNNPEVQASLAANTFTMTGHAETKQLTEMLLSIDHKPVLQMV

SEQ ID NO: 747197 - protein, 476 aa, Homo sapiens
MANSAKAEEYEKMSLEQAKASVNSETESSFNINENTTASGTGLSEKTSVCRQVDIARKRKEFEDDLVKESSSCGKDTPSKKRKLDPEIVPEEKDCGDAEGNSKKRKRETEDVPKDKSSTGDGTQNKRKIALEDVPEKQKNLEEGHSSTVAAHYNELQEVGLEKRSQSRIFYLRNFNNWMKSVLIGEFLEKVRQKKKRDITVLDLGCGKGGDLLKWKKGRINKLVCTDIADVSVKQCQQRYEDMKNRRDSEYIFSAEFITADSSKELLIDKFRDPQMCFDICSCQFVCHYSFESYEQADMMLRNACERLSPGGYFIGTTPNSFELIRRLEASETESFGNEIYTVKFQKKGDYPLFGCKYDFNLEGVVDVPEFLVYFPLLNEMAKKYNMKLVYKKTFLEFYEEKIKNNENKMLLKRMQALEPYPANESSKLVSEKVDDYEHAAKYMKNSQVRLPLGTLSKSEWEATSIYLVFAFEKQQ

SEQ ID NO: 747198 - protein, 504 aa, Homo sapiens
MANSAKAEEYEKMSLEQAKASVNSETESSFNINENTTASGTGLSEKTSVCRQVDIARKRKEFEDDLVKESSSCGKDTPSKKRKLDPEIVPEEKDCGDAEGNSKKRKRETEDVPKDKSSTGDGTQNKRKIALEDVPEKQKNLEEGHSSTVAAHYNELQEVGLEKRSQSRIFYLRNFNNWMKSVLIGEFLEKVRQKKKRDITVLDLGCGKGGDLLKWKKGRINKLVCTDIADVSVKQCQQRYEDMKNRRDSEYIFSAEFITADSSKELLIDKFRDPQMCFDICSCQFVCHYSFESYEQADMMLRNACERLSPGGYFIGTTPNSFELIRRLEASETESFGNEIYTVKFQKKGDYPLFGCKYDFNLEGVVDVPEFLVYFPLLNEMAKKYNMKLVYKKTFLEFYEEKIKNNENKMLLKRMQALEPYPANESSKLVSEKVDDYEHAAKYMKNSQVRLPLGTLSKSEWEATRLTVTIMREAWLSTVGPGRAPVAASSVKWGTPRPAMQFIL

SEQ ID NO: 747199 - protein, 476 aa, Homo sapiens; identical to SEQ ID NO: 747197

SEQ ID NO: 747200 - protein, 476 aa, Homo sapiens; identical to SEQ ID NO: 747197

SEQ ID NO: 747201 - protein, 356 aa, Homo sapiens
RHAWRGPPFPQTESRLAVLNLEEGHSSTVAAHYNELQEVGLEKRSQSRIFYLRNFNNWMKSVLIGEFLEKVRQKKKRDITVLDLGCGKGGDLLKWKKGRINKLVCTDIADVSVKQCQQRYEDMKNRRDSEYIFSAEFITADSSKELLIDKFRDPQMCFDICSCQFVCHYSFESYEQADMMLRNACERLSPGGYFIGTTPNSFELIRRLEASETESFGNEIYTVKFQKKGDYPLFGCKYDFNLEGVVDVPEFLVYFPLLNEMAKKYNMKLVYKKTFLEFYEEKIKNNENKMLLKRMQALEPYPANESSKLVSEKVDDYEHAAKYMKNSQVRLPLGTLSKSEWEATSIYLVFAFEKQQ

SEQ ID NO: 747202 - protein, 476 aa, Homo sapiens; identical to SEQ ID NO: 747197

SEQ ID NO: 747203 - protein, 476 aa, Homo sapiens; identical to SEQ ID NO: 747197

SEQ ID NO: 747204 - protein, 504 aa, Homo sapiens; identical to SEQ ID NO: 747198

SEQ ID NO: 747205 - protein, 476 aa, Homo sapiens; identical to SEQ ID NO: 747197

SEQ ID NO: 747206 - protein, 476 aa, Homo sapiens; identical to SEQ ID NO: 747197

SEQ ID NO: 747207 - protein, 111 aa, Homo sapiens
NRARYLWRLQCKGYYTCVMIFSRCIQDWIPGHCQFFPPSRAAQFVLCSHVGLKSPHSLVPAPHHDIEEAQDIQGYSPVWLWRLEQALKSPAPWTSPGLCFFGGNIPWTKLS

SEQ ID NO: 747208 - protein, 476 aa, Homo sapiens; identical to SEQ ID NO: 747197

SEQ ID NO: 747209 - protein, 174 aa, Homo sapiens
LGVNEESISSLFDFTPECRTTDQDQKIKKANECASRLMYGMELDDMDEVEFLRIKYWDRRRRAAPHSYSAQRGRIRYGPWYFEPKLGKKLRSDEPLIDPKPVLEKPDEPDILDGLYGPIAFKDFILSKGYRMPGVIEKLFAKKGWTYDSVKTPIQRAVQVYKYKEDVTDASKED

SEQ ID NO: 747210 - protein, 75 aa, Homo sapiens
FSLLKTQHQTEMPSAHPRPQTLRLDPNSEPGVERGRWGQCSGPSPVGTDSFQCPRSISTSSPGTSGPSLGVIPTQ

SEQ ID NO: 747211 - protein, 481 aa, Homo sapiens
MARLTESEARRQQQQLLQPRPSPVGSSGPEPPGGQPDGMKDLDAIKLFVGQIPRHLDEKDLKPLFEQFGRIYELTVLKDPYTGMHKGCAFLTYCARDSAIKAQTALHEQKTLPGMARPIQVKPADSESRGGRDRKLFVGMLNKQQSEEDVLRLFQPFGVIDECTVLRGPDGSSKGCAFVKFSSHTEAQAAIHALHGSQTMPGASSSLVVKFADTDKERTLRRMQQMVGQLGILTPSLTLPFSPYSAYAQALMQQQTTVLSTSGSYLSPGVAFSPCHIQQIGAVSLNGLPATPIAPASGLHSPPLLGTTAVPGLVAPITNGFAGVVPFPGGHPALETVYANGLVPYPAQSPTVAETLHPAFSGVQQYTAMYPTAAITPIAHSVPQPPPLLQQQQREGPEGCNLFIYHLPQEFGDTELTQMFLPFGNIISSKVFMDRATNQSKCFGFVSFDNPASAQAAIQAMNGFQIGMKRLKVQLKRPKDP

SEQ ID NO: 747212 - protein, 387 aa, Homo sapiens
GGGTWMPAWRASPGRWMARPIQVKPADSESRGGRDRKLFVGMLNKQQSEEDVLRLFQPFGVIDECTVLRGPDGSSKGCAFVKFSSHTEAQAAIHALHGSQTMPGASSSLVVKFADTDKERTLRRMQQMVGQLGILTPSLTLPFSPYSAYAQALMQQQTTVLSTSGSYLSPGVAFSPCHIQQIGAVSLNGLPATPIAPASGLHSPPLLGTTAVPGLVAPITNGFAGVVPFPGGHPALETVYANGLVPYPAQSPTVAETLHPAFSGVQQYTAMYPTAAITPIAHSVPQPPPLLQQQQREGPEGCNLFIYHLPQEFGDTELTQMFLPFGNIISSKVFMDRATNQSKCFGFVSFDNPASAQAAIQAMNGFQIGMKRLKVQLKRPKDPGHPY

SEQ ID NO: 747213 - protein, 171 aa, Homo sapiens
PGPTEGLAQRRSWAGCLLLSLRLLRIGGGWKTSAAPAPLSPSVCPQLRARLWPRHCILPSPESSSTQPCTPPRPSRPSRTASPSRRPSCSSSSEKEFGDTELTQMFLPFGNIISSKVFMDRATNQSKCFGFVSFDNPASAQAAIQAMNGFQIGMKRLKVQLKRPKDPGHPY

SEQ ID NO: 747214 - protein, 85 aa, Homo sapiens
GLNCKDGYQLLGPPHTEGYPLHVPSHCQELFCCSITFFSAFLTLWCPRTSLFLVTGQKPRTRQTVGTKNGCNTHLAGSWSCGQWA

SEQ ID NO: 747215 - protein, 319 aa, Homo sapiens
MERGNQTEVGNFLLLGFAEDSDMQLLLHGLFLSMYLVTIIGNLLIILTISSDSHLHTPMYFFLSNLSFADICFTSTTVPKMLVNIQTQSKMITFAGCLTQIFFFIAFGCLDNLLLTMTAYDRFVAICYPLHYTVIMNPRLCGLLVLGSWCISVMGSLLETLTILRLSFCTNMEIPHFFCDPSEVLKLACSDTFINNIVMYFVTIVLGVFPLCGILFSYSQIFSSVLRVSARGQHKAFSTCGSHLSVVSLFYGTGLGVYLSSAVTPPSRTSLAASVMYTMVTPMLNPFIYSLRNKDMKGSLGRLLLRATSLKEGTIAKLS

SEQ ID NO: 747216 - protein, 258 aa, Homo sapiens
MDGIIEQKSMLVHSKISDAGKRNGLINTRNLMAESRDGLVSVYPAPQYQSHRVGASTVPASLDSSRSEPMQQLLDPNTLQQSVESRYRPNIILYSEGVLRSWGDGVAADCCETTFIEDRSPTKDSLEYPDGKFIDLSADDIKIHTLSYDVEEEEEFQELESDYSSDTESEDNFLMMPPRDHLGLSVFSMLCCFWPLGIAAFYLSHETNKAVAKGDLHQASTSSRRALFLAVLSITIGTGVYVGVAVALIAYLSKNNHL

SEQ ID NO: 747217 - protein, 91 aa, Homo sapiens
AFSASTMPFSESGAVDEPSTHCLFRLAYNDFLFSSPTLQTNKAVAKGDLHQASTSSRRALFLAVLSITIGTGVYVGVAVALIAYLSKNNHL

SEQ ID NO: 747218 - protein, 160 aa, Homo sapiens
MLPEMKRESRMAEESPAQETPRLGQSSSRRGQGLSVYYSKQASPRDVVWEGPKPTRQAHPVGKRLPIPVWPASLTSASQSSADLRGAGWPLLIWVREMPETHPGLNHRLVVQSHSPCAFRKPRGPKYEWEESWEKLNQTLPMAIKEKIQQRLPLSLTLRS

SEQ ID NO: 747219 - protein, 160 aa, Homo sapiens; identical to SEQ ID NO: 747218

SEQ ID NO: 747220 - protein, 623 aa, Homo sapiens
MERPEEGKQSPPPQPWGRLLRLGAEEGEPHVLLRKREWTIGRRRGCDLSFPSNKLVSGDHCRIVVDEKSGQVTLEDTSTSGTVINKLKVVKKQTCPLQTGDVIYLVYRKNEPEHNVAYLYESLSEKQGMTQESFEMVPCCVAQAGLKLLGSSDPPTLASQSIVITGSGGGGISPKGSGPSVASDEVSSFASALPDRKTASFSSLEPQDQEDLEPVKKKMRGDGDLDLNGQLLVAQPRRNAQTVHEDVRAAAGKPDKMEETLTCIICQDLLHDCVSLQPCMHTFCAACYSGWMERSSLCPTCRCPVERICKNHILNNLVEAYLIQHPDKSRSEEDVQSMDARNKITQDMLQPKVRRSFSDEEGSSEDLLELSDVDSESSDISQPYVVCRQCPEYRRQAAQPPHCPAPEGEPGAPQALGDAPSTSVSLTTAVQDYVCPLQGSHALCTCCFQPMPDRRAEREQDPRVAPQQCAVCLQPFCHLYWGCTRTGCYGCLAPFCELNLGDKCLDGVLNNNSYESDILKNYLATRGLTWKNMLTESLVALQRGVFLLSDYRVTGDTVLCYCCGLRSFRELTYQYRQNIPASELPVAVTSRPDCYWGRNCRTQVKAHHAMKFNHICEQTRFKN

SEQ ID NO: 747221 - protein, 652 aa, Homo sapiens
MERPEEGKQSPPPQPWGRLLRLGAEEGEPHVLLRKREWTIGRRRGCDLSFPSNKLVSGDHCRIVVDEKSGQVTLEDTSTSGTVINKLKVVKKQTCPLQTGDVIYLVYRKNEPEHNVAYLYESLSEKQGMTQESFDTSGAGAGRGADPRVPPSSPATQVCFEEPQPSTSTSDLFPTASASSTEPSPAGRERSSSCGSGGGGISPKGSGPSVASDEVSSFASALPDRKTASFSSLEPQDQEDLEPVKKKMRGDGDLDLNGQLLVAQPRRNAQTVHEDVRAAAGKPDKMEETLTCIICQDLLHDCVSLQPCMHTFCAACYSGWMERSSLCPTCRCPVERICKNHILNNLVEAYLIQHPDKSRSEEDVQSMDARNKITQDMLQPKVRRSFSDEEGSSEDLLELSDVDSESSDISQPYVVCRQCPEYRRQAAQPPHCPAPEGEPGAPQALGDAPSTSVSLTTAVQDYVCPLQGSHALCTCCFQPMPDRRAEREQDPRVAPQQCAVCLQPFCHLYWGCTRTGCYGCLAPFCELNLGDKCLDGVLNNNSYESDILKNYLATRGLTWKNMLTESLVALQRGVFLLSDYRVTGDTVLCYCCGLRSFRELTYQYRQNIPASELPVAVTSRPDCYWGRNCRTQVKAHHAMKFNHICEQTRFKN

SEQ ID NO: 747222 - protein, 652 aa, Homo sapiens; identical to SEQ ID NO: 747221

SEQ ID NO: 747223 - protein, 664 aa, Homo sapiens
MERPEEGKQSPPPQPWGRLLRLGAEEGEPHVLLRKREWTIGRRRGCDLSFPSNKLVSGDHCRIVVDEKSGQVTLEDTSTSGTVINKLKVVKKQTCPLQTGDVIYLVYRKNEPEHNVAYLYESLSEKQGMTQESFEANKENVFHGTKDTSGAGAGRGADPRVPPSSPATQVCFEEPQPSTSTSDLFPTASASSTEPSPAGRERSSSCGSGGGGISPKGSGPSVASDEVSSFASALPDRKTASFSSLEPQDQEDLEPVKKKMRGDGDLDLNGQLLVAQPRRNAQTVHEDVRAAAGKPDKMEETLTCIICQDLLHDCVSLQPCMHTFCAACYSGWMERSSLCPTCRCPVERICKNHILNNLVEAYLIQHPDKSRSEEDVQSMDARNKITQDMLQPKVRRSFSDEEGSSEDLLELSDVDSESSDISQPYVVCRQCPEYRRQAAQPPHCPAPEGEPGAPQALGDAPSTSVSLTTAVQDYVCPLQGSHALCTCCFQPMPDRRAEREQDPRVAPQQCAVCLQPFCHLYWGCTRTGCYGCLAPFCELNLGDKCLDGVLNNNSYESDILKNYLATRGLTWKNMLTESLVALQRGVFLLSDYRVTGDTVLCYCCGLRSFRELTYQYRQNIPASELPVAVTSRPDCYWGRNCRTQVKAHHAMKFNHICEQTRFKN

SEQ ID NO: 747224 - protein, 652 aa, Homo sapiens; identical to SEQ ID NO: 747221

SEQ ID NO: 747225 - protein, 592 aa, Homo sapiens
MERPEEGKQSPPPQPWGRLLRLGAEEGEPHVLLRKREWTIGRRRGCDLSFPSNKLVSGDHCRIVVDEKSGQVTLEDTSTSGTVINKLKVVKKQTCPLQTGDVIYLVYRKNEPEHNVAYLYESLSEKQGMTQESFGSGGGGISPKGSGPSVASDEVSSFASALPDRKTASFSSLEPQDQEDLEPVKKKMRGDGDLDLNGQLLVAQPRRNAQTVHEDVRAAAGKPDKMEETLTCIICQDLLHDCVSLQPCMHTFCAACYSGWMERSSLCPTCRCPVERICKNHILNNLVEAYLIQHPDKSRSEEDVQSMDARNKITQDMLQPKVRRSFSDEEGSSEDLLELSDVDSESSDISQPYVVCRQCPEYRRQAAQPPHCPAPEGEPGAPQALGDAPSTSVSLTTAVQDYVCPLQGSHALCTCCFQPMPDRRAEREQDPRVAPQQCAVCLQPFCHLYWGCTRTGCYGCLAPFCELNLGDKCLDGVLNNNSYESDILKNYLATRGLTWKNMLTESLVALQRGVFLLSDYRVTGDTVLCYCCGLRSFRELTYQYRQNIPASELPVAVTSRPDCYWGRNCRTQVKAHHAMKFNHICEQTRFKN

SEQ ID NO: 747226 - protein, 572 aa, Homo sapiens
MERPEEGKQSPPPQPWGRLLRLGAEEGEPHVLLRKREWTIGRRRGCDLSFPSNKLVSGDHCRIVVDEKSGQVTLEDTSTSGTVINKLKVVKKQTCPLQTGDVIYLVYRKNEPEHRSGGGGISPKGSGPSVASDEVSSFASALPDRKTASFSSLEPQDQEDLEPVKKKMRGDGDLDLNGQLLVAQPRRNAQTVHEDVRAAAGKPDKMEETLTCIICQDLLHDCVSLQPCMHTFCAACYSGWMERSSLCPTCRCPVERICKNHILNNLVEAYLIQHPDKSRSEEDVQSMDARNKITQDMLQPKVRRSFSDEEGSSEDLLELSDVDSESSDISQPYVVCRQCPEYRRQAAQPPHCPAPEGEPGAPQALGDAPSTSVSLTTAVQDYVCPLQGSHALCTCCFQPMPDRRAEREQDPRVAPQQCAVCLQPFCHLYWGCTRTGCYGCLAPFCELNLGDKCLDGVLNNNSYESDILKNYLATRGLTWKNMLTESLVALQRGVFLLSDYRVTGDTVLCYCCGLRSFRELTYQYRQNIPASELPVAVTSRPDCYWGRNCRTQVKAHHAMKFNHICEQTRFKN

SEQ ID NO: 747227 - protein, 464 aa, Homo sapiens
MTQESFGSGGGGISPKGSGPSVASDEVSSFASALPDRKTASFSSLEPQDQEDLEPVKKKMRGDGDLDLNGQLLVAQPRRNAQTVHEDVRAAAGKPDKMEETLTCIICQDLLHDCVSLQPCMHTFCAACYSGWMERSSLCPTCRCPVERICKNHILNNLVEAYLIQHPDKSRSEEDVQSMDARNKITQDMLQPKVRRSFSDEEGSSEDLLELSDVDSESSDISQPYVVCRQCPEYRRQAAQPPHCPAPEGEPGAPQALGDAPSTSVSLTTAVQDYVCPLQGSHALCTCCFQPMPDRRAEREQDPRVAPQQCAVCLQPFCHLYWGCTRTGCYGCLAPFCELNLGDKCLDGVLNNNSYESDILKNYLATRGLTWKNMLTESLVALQRGVFLLSDYRVTGDTVLCYCCGLRSFRELTYQYRQNIPASELPVAVTSRPDCYWGRNCRTQVKAHHAMKFNHICEQTRFKN

SEQ ID NO: 747228 - protein, 341 aa, Homo sapiens
MERPEEGKQSPPPQPWGRLLRLGAEEGEPHVLLRKREWTIGRRRGCDLSFPSNKLVSGDHCRIVVDEKSGQVTLEDTSTSGTVINKLKVVKKQTCPLQTGDVIYLVYRKNEPEHNVAYLYESLSEKQGMTQESFDTSGAGAGRGADPRVPPSSPATQVCFEEPQPSTSTSDLFPTASASSTEPSPAGRERSSSCGSGGGGISPKGSGPSVASDEVSSFASALPDRKTASFSSLEPQDQEDLEPVKKKMRGDGDLDLNGQLLVAQPRRNAQTVHEDVRAAAGKPDKMEETLTCIICQDPTGPGGCTLHVRQPDDRCGLPAAFLPPVLGLHPDRLLRLPGPVL

SEQ ID NO: 747229 - protein, 246 aa, Homo sapiens
MIPIPGWTAEVCQIRVSSKSSLNRIIRGDTPRTESLQRGSAVTIPRPGAGETRRADLFKEGVEWKSFLLVLCLKLSFIIELLILSRICNEKKYVYPQCRADSAFLRHHYKQVTLPLHLAELNLGDKCLDGVLNNNSYESDILKNYLATRGLTWKNMLTESLVALQRGVFLLSDYRVTGDTVLCYCCGLRSFRELTYQYRQNIPASELPVAVTSRPDCYWGRNCRTQVKAHHAMKFNHICEQTRFKN

SEQ ID NO: 747230 - protein, 246 aa, Homo sapiens; identical to SEQ ID NO: 747229

SEQ ID NO: 747231 - protein, 669 aa, Homo sapiens
MERPEEGKQSPPPQPWGRLLRLGAEEGEPHVLLRKREWTIGRRRGCDLSFPSNKLVSGDHCRIVVDEKSGQVTLEDTSTSGTVINKLKVVKKQTCPLQTGDVIYLVYRKNEPEHNVAYLYESLSEKQGMTQESFDTSGAGAGRGADPRVPPSSPATQVCFEEPQPSTSTSDLFPTASASSTEPSPAGRERSSSCGSGGGGISPKGSGPSVASDEVSSFASALPDRKTASFSSLEPQDQEDLEPVKKKMRGDGDLDLNGQLLVAQPRRNAQTVHEDVRAAAGKPDKMEETLTCIICQDLLHDCVSLQPCMHTFCAACYSGWMERSSLCPTCRCPVERICKNHILNNLVEAYLIQHPDKSRSEEDVQSMDARNKITQDMLQPKVRRSFSDEEGSSEDLLELSDVDSESSDISQPYVVCRQCPEYRRQAAQPPHCPAPEGEPGAPQALGDAPSTSVSLTTAVQDYVCPLQGSHALCTCCFQPMPDRRAEREQDPRVAPQQCAVCLQPFCHLYWGCTRTGCYGCLAPFCELNLGDKCLDGVLNNNSYESDILKNYLATRGLTWKNMLTESLVALQRGVFLLSDYRVTGDTVLCYCCGLRSFRELTYQYRQNIPASELPVAVTSRPDCYWGRNCRTQVKAHHAMKFNHICEQTRSQDAPLPHAARALPPRPYRA

SEQ ID NO: 747232 - protein, 448 aa, Homo sapiens
MERPEEGKQSPPPQPWGRLLRLGAEEGEPHVLLRKREWTIGRRRGCDLSFPSNKLVSGDHCRIVVDEKSGQVTLEDTSTSGTVINKLKVVKKQTCPLQTGDVIYLVYRKNEPEHNVAYLYESLSEKQGMTQESFDTSGAGAGRGADPRVPPSSPATQVCFEEPQPSTSTSDLFPTASASSTEPSPAGRERSSSCGSGGGGISPKGSGPSVASDEVSSFASALPDRKTASFSSLEPQDQEDLEPVKKKMRGDGDLDLNGQLLVAQPRRNAQTVHEDVRAAAGKPDKMEETLTCIICQDLLHDCVSLQPCMHTFCAACYSGWMERSSLCPTCRCPVERICKNHILNNLVEAYLIQHPDKSRSEEDVQSMDARNKITQDMLQPKVRRSFSDEEGSSEDLLELSDVDSESSDISQPYVVCRQCPEYRRQAAQPPHCPAPWLPPVLALPCHLE

SEQ ID NO: 747233 - protein, 410 aa, Homo sapiens
MERPEEGKQSPPPQPWGRLLRLGAEEGEPHVLLRKREWTIGRRRGCDLSFPSNKLVSGDHCRIVVDEKSGQVTLEDTSTSGTVINKLKVVKKQTCPLQTGDVIYLVYRKNEPEHNVAYLYESLSEKQGMTQESFDTSGAGAGRGADPRVPPSSPATQVCFEEPQPSTSTSDLFPTASASSTEPSPAGRERSSSCGSGGGGISPKGSGPSVASDEVSSFASALPDRKTASFSSLEPQDQEDLEPVKKKMRGDGDLDLNGQLLVAQPRRNAQTVHEDVRAAAGKPDKMEETLTCIICQDLLHDCVSLQPCMHTFCAACYSGWMERSSLCPTCRCPVERICKNHILNNLVEAYLIQHPDKSRSEEDVQSMDARNKITQDMLQPKVRRSFSDEEGSSEDLLELSDVDSESSDIR

SEQ ID NO: 747234 - protein, 112 aa, Homo sapiens
RPEEGKQSPPPQPWGRLLRLGAEEGEPHVLLRKREWTIGRRRGAGLRPGPGAGAGQSHRVAGRPHGRRCSVRSRFFRGVKCHVRTGIYSVFCPPILAHDSRTSFSLRYNCIS

SEQ ID NO: 747235 - protein, 321 aa, Homo sapiens
MERPEEGKQSPPPQPWGRLLRLGAEEGEPHVLLRKREWTIGRRRGCDLSFPSNKLVSGDHCRIVVDEKSGQVTLEDTSTSGTVINKLKVVKKQTCPLQTGDVIYLVYRKNEPEHNVAYLYESLSEKQGMTQESFGSGGGGISPKGSGPSVASDEVSSFASALPDRKTASFSSLEPQDQEDLEPVKKKMRGDGDLDLNGQLLVAQPRRNAQTVHEDVRAAAGKPDKMEETLTCIICQDPTGPGGCTLHVRQPDDSSPGLRVPSARKPRPVHLLLPAHARPESGARAGPACRPSAVCGLPAAFLPPVLGLHPDRLLRLPGPVL

SEQ ID NO: 747236 - protein, 652 aa, Homo sapiens; identical to SEQ ID NO: 747221

SEQ ID NO: 747237 - protein, 664 aa, Homo sapiens; identical to SEQ ID NO: 747223

SEQ ID NO: 747238 - protein, 161 aa, Homo sapiens
MERPEEGKQSPPPQPWGRLLRLGAEEGEPHVLLRKREWTIGRRRGCDLSFPSNKLVSGDHCRIVVDEKSGQVTLEDTRRSLALWLRLKCCCSEPIPRHCTPAWATDQVSKKKRKENMPDLNSHLNAEVLPALLGCVPFIVSSRFLKTYPWAQLGCALALHS

SEQ ID NO: 747239 - protein, 222 aa, Homo sapiens
MERPEEGKQSPPPQPWGRLLRLGAEEGEPHVLLRKREWTIGRRRGCDLSFPSNKLVSGDHCRIVVDEKSGQVTLEDTSTSGTVINKLKVVKKQTCPLQTGDVIYLVYRKNEPEHNVAYLYESLSEKQGMTQESFDTSGAGAGRGADPRVPPSSPATQVCFEEPQPSTSTSDLFPTASASSTEPSPAGRERSSSCGEVTSHEVLVLVAWFLFTTLYLCCYRGR

SEQ ID NO: 747240 - protein, 74 aa, Homo sapiens
MKTEAVVPVAARWWGWSLAASCSPLDSRLSSAAFYLLCSKWTCHPHSCVNKAAIYRAGAGSRDRLKTYTGLHGL

SEQ ID NO: 747241 - protein, 113 aa, Homo sapiens
VLIDVSPPEAEKRGSYGSTAHASEPGGQQAAACRAGSPAKPRIDFVLVWEEDLKLDRQQDSAARDRTDMHRTWRETFLDNLRAAGLCVDQVRGGCHGQGPRPCIHSVTHDLAA

SEQ ID NO: 747242 - protein, 173 aa, Homo sapiens
VSLQARCTLDSQGGCELMETVNEPETGEVSKDAVIVKQEKNNEYCLQDIDDKLSESAEDDGEDDTNDEDDDEDSNPKKNTQAPLELMAEFLRAEMAREYQLAKKLCQMILIYEPENPEAKEFFTLIEEMLLMEKTQNHEQDGENSDEDSSGESKGESDEELSDESSDEGEDGS

SEQ ID NO: 747243 - protein, 97 aa, Homo sapiens
VSLQARCTLDSQGGCELMETVNEPETGEVSKDAVIVKQEKNNEYCLQDIDDKLSESAEDDGEDDTNDEDDDEDSNPKKNTQAPLELMAEVSFTCAYN

SEQ ID NO: 747244 - protein, 520 aa, Homo sapiens [sequence omitted]

SEQ ID NO: 747245 - protein, 77 aa, Homo sapiens
PAGGGADAGGGVSGEGPGRSQKVASFAARGLQVQVERPGWPGFGLRRREMAAGGRMEDLRKWKINCKTWFLGYHPEY

SEQ ID NO: 747246 - protein, 320 aa, Homo sapiens
PAGGGADAGGGVSGEGPGRSQKVASFAARGLQVQVERPGWPGFGLRRREMAAGGRMEDGSLDITQSIEDDPLLDAQLLPHHSLQAHFRPRFHPLPTVIIVNLLWFIHLVFVVLAFLTGVLCSYPNPNEDKCPGNYTNPLKVQTVIILGKVILWILHLLLECYIQYHHSKIRNRGYNLIYRSTRHLKRLALMIQSSGNTVLLLILCMQHSFPEPGRLYLDLILAILALELICSLICLLIYTVKIRRFNKAKPEPDILEEEKIYAYPSNITSETGFRTISSLEEIVEKQGDTIEYLKRHNALLSKRLLALTSSDLGCQPSRT

SEQ ID NO: 747247 - protein, 116 aa, Homo sapiens
MRIEPIPENPKFSVPPITPHPEKKKKKKKKKNLVGRVKIRRFNKAKPEPDILEEEKIYAYPSNITSETGFRTISSLEEIVEKQGDTIEYLKRHNALLSKRLLALTSSDLGCQPSRT

SEQ ID NO: 747248 - protein, 320 aa, Homo sapiens; identical to SEQ ID NO: 747246

SEQ ID NO: 747249 - protein, 320 aa, Homo sapiens; identical to SEQ ID NO: 747246

SEQ ID NO: 747250 - protein, 167 aa, Homo sapiens
TPSGRWSEVGEELKRPGADRRVKAMPPPGKVPRKENLWLQCEWGSCSFVCSTMEKFFEHVTQHLQQHLHGSGEEEEEEEEDDPLEEEFSCLWQECGFCSLDSSADLIRHVYFHCYHTKLKQWGLQALQSQADLGPCILDFQSRNVIPDIPDHFLCLWEHCEVSRQCQ

SEQ ID NO: 747251 - protein, 517 aa, Homo sapiens
MPPPGKVPRKENLWLQCEWGSCSFVCSTMEKFFEHVTQHLQQHLHGSGEEEEEEEEDDPLEEEFSCLWQECGFCSLDSSADLIRHVYFHCYHTKLKQWGLQALQSQADLGPCILDFQSRNVIPDIPDHFLCLWEHCENSFDNPEWFYRHVEAHSLCCEYEAVGKDNPVVLCGWKGCTCTFKDRSKLREHLRSHTQEKVVACPTCGGMFANNTKFLDHIRRQTSLDQQHFQCSHCSKRFATERLLRDHMRNHVNHYKCPLCDMTCPLPSSLRNHMRFRHSEDRPFKCDCCDYSCKNLIDLQKHLDTHSEEPAYRCDFENCTFSARSLCSIKSHYRKVHEGDSEPRYKCHVCDKCFTRGNNLTVHLRKKHQFKWPSGHPRFRYKEHEDGYMRLQLVRYESVELTQQLLRQPQEGSGLGTSLNESSLQGIILETVPGEPGRKEEEEEGKGSEGTALSASQDNPSSVIHVVNQTNAQGQQEIVYYVLSEAPGEPPPVPEPPSGGIMEKLQGIAEEPEIQMV

SEQ ID NO: 747252 - protein, 540 aa, Homo sapiens
MPPPGKVPRKENLWLQCEWGSCSFVCSTMEKFFEHVTQHLQQHLHGSGEEEEEEEEDDPLVLQVEGDLSLGKCQTLPFKPLSTEEEFSCLWQECGFCSLDSSADLIRHVYFHCYHTKLKQWGLQALQSQADLGPCILDFQSRNVIPDIPDHFLCLWEHCENSFDNPEWFYRHVEAHSLCCEYEAVGKDNPVVLCGWKGCTCTFKDRSKLREHLRSHTQEKVVACPTCGGMFANNTKFLDHIRRQTSLDQQHFQCSHCSKRFATERLLRDHMRNHVNHYKCPLCDMTCPLPSSLRNHMRFRHSEDRPFKCDCCDYSCKNLIDLQKHLDTHSEEPAYRCDFENCTFSARSLCSIKSHYRKVHEGDSEPRYKCHVCDKCFTRGNNLTVHLRKKHQFKWPSGHPRFRYKEHEDGYMRLQLVRYESVELTQQLLRQPQEGSGLGTSLNESSLQGIILETVPGEPGRKEEEEEGKGSEGTALSASQDNPSSVIHVVNQTNAQGQQEIVYYVLSEAPGEPPPVPEPPSGGIMEKLQGIAEEPEIQMV

SEQ ID NO: 747253 - protein, 202 aa, Homo sapiens
DESTGTIRYDPTAIQPHGDPTDYKTCSAADELSRDSHINDRGNNLTVHLRKKHQFKWPSGHPRFRYKEHEDGYMRLQLVRYESVELTQQLLRQPQEGSGLGTSLNESSLQGIILETVPGEPGRKEEEEEGKGSEGTALSASQDNPSSVIHVVNQTNAQGQQEIVYYVLSEAPGEPPPVPEPPSGGIMEKLQGIAEEPEIQMV

SEQ ID NO: 747254 - protein, 541 aa, Homo sapiens
TPSGRWSEVGEELKRPGADRRVKAMPPPGKVPRKENLWLQCEWGSCSFVCSTMEKFFEHVTQHLQQHLHGSGEEEEEEEEDDPLEEEFSCLWQECGFCSLDSSADLIRHVYFHCYHTKLKQWGLQALQSQADLGPCILDFQSRNVIPDIPDHFLCLWEHCENSFDNPEWFYRHVEAHSLCCEYEAVGKDNPVVLCGWKGCTCTFKDRSKLREHLRSHTQEKVVACPTCGGMFANNTKFLDHIRRQTSLDQQHFQCSHCSKRFATERLLRDHMRNHVNHYKCPLCDMTCPLPSSLRNHMRFRHSEDRPFKCDCCDYSCKNLIDLQKHLDTHSEEPAYRCDFENCTFSARSLCSIKSHYRKVHEGDSEPRYKCHVCDKCFTRGNNLTVHLRKKHQFKWPSGHPRFRYKEHEDGYMRLQLVRYESVELTQQLLRQPQEGSGLGTSLNESSLQGIILETVPGEPGRKEEEEEGKGSEGTALSASQDNPSSVIHVVNQTNAQGQQEIVYYVLSEAPGEPPPVPEPPSGGIMEKLQGIAEEPEIQMV

SEQ ID NO: 747255 - protein, 413 aa, Homo sapiens
TPSGRWSEVGEELKRPGADRRVKAMPPPGKVPRKENLWLQCEWGSCSFVCSTMEKFFEHVTQHLQQHLHGSGEEEEEEEEDDPLEEEFSCLWQECGFCSLDSSADLIRHVYFHCYHTKLKQWGLQALQSQADLGPCILDFQSRNVIPDIPDHFLCLWEHCENSFDNPEWFYRHVEAHSLCCEYEAVGKDNPVVLCGWKGCTCTFKDRSKLREHLRSHTQEKVVACPTCGGMFANNTKFLDHIRRQTSLDQQHFQCSHCSKRFATERLLRDHMRNHVNHYKCPLCDMTCPLPSSLRNHMRFRHSEDRPFKCDCCDYSCKNLIDLQKHLDTHSEEPAYRCDFENCTFSARSLCSIKSHYRKVHEGDSEPRYKCHVCDKCFTRGNNLTVHLRKKHQFKWPSGHPRFRYVSQPSFPD

SEQ ID NO: 747256 - protein, 560 aa, Homo sapiens
TPSGRWSEVGEELKRPGADRRVKAMPPPGKVPRKENLWLQCEWGSCSFVCSTMEKFFEHVTQHLQQHLHGSGEEEEEEEEDDPLEEEFSCLWQECGFCSLDSSADLIRHVYFHCYHTKLKQWGLQALQSQADLGPCILDFQSRNVIPDIPDHFLCLWEHCENSFDNPEWFYRHVEAHSLCCEYEAVGKDNPVVLCGWKGCTCTFKDRSKLREHLRSHTQEKVVACPTCGGMFANNTKFLDHIRRQTSLDHEETEAQRGLNHLPEITQLKQHFQCSHCSKRFATERLLRDHMRNHVNHYKCPLCDMTCPLPSSLRNHMRFRHSEDRPFKCDCCDYSCKNLIDLQKHLDTHSEEPAYRCDFENCTFSARSLCSIKSHYRKVHEGDSEPRYKCHVCDKCFTRGNNLTVHLRKKHQFKWPSGHPRFRYKEHEDGYMRLQLVRYESVELTQQLLRQPQEGSGLGTSLNESSLQGIILETVPGEPGRKEEEEEGKGSEGTALSASQDNPSSVIHVVNQTNAQGQQEIVYYVLSEAPGEPPPVPEPPSGGIMEKLQGIAEEPEIQMV

SEQ ID NO: 747257 - protein, 203 aa, Homo sapiens
TPSGRWSEVGEELKRPGADRRVKAMPPPGKVPRKENLWLQCEWGSCSFVCSTMEKFFEHVTQHLQQHLHGSGEEEEEEEEDDPLEEEFSCLWQECGFCSLDSSADLIRHVYFHCYHTKLKQWGLQALQSQADLGPCILDFQSRNVIPDIPDHFLCLWEHCENSFDNPEWFYRHVEAHSLCCEYEAVGKDNPVVLCGWKGRAAS

SEQ ID NO: 747258 - protein, 96 aa, Homo sapiens
PGSWLRGDGWVTAPHSAGQGGASRQGGDRPLRPSAPAAAAPNEARKGEPRWQRRGPREQEFVKRRCEGRACFPSEGQRWGAETVASVPALLVMNQK

SEQ ID NO: 747259 - protein, 117 aa, Homo sapiens
QAGRVSWKETFDVSLLMSPWPLCLHGWPRPSGAYAPGSMWPVNECTPGCLLLFHGSPEDATWELSVLVSRKVSGASSAAPFGTAGAKPLNGGPLDFYEKLLMSFQTFISGIYSPMDT

SEQ ID NO: 747260 - protein, 82 aa, Homo sapiens
FLLGAEVARSGVKSGTPSLARAGAGGLCDGLGAPGAGGGRSWAGVPVNEKGLSNLPKCSPGLVPQSSAPNCAGHTPGDAGEA

SEQ ID NO: 747261 - protein, 171 aa, Homo sapiens
MASERPEPEVEEAGQVFLLMKKDYRISRNVRLAWFLSHLHQTVQATPQEMLSEQELEVLSVLPPGWQPDEPVVPRPFLLVPSTRVTFLAWQYRFVIELDLSPSTGIVDDSTGEILFDEVFHALSRCLGGLLRPFRVPGSCIDFQPEIYVTIQAYSSIIGLQSHQVLHHLSK

SEQ ID NO: 747262 - protein, 364 aa, Homo sapiens
MEPLFPASTPSWNASSPGAASGGGDNRTLVGPAPSAGARAVLVPVLYLLVCAAGLGGNTLVIYVVLRFAKMKTVTNIYILNLAVADVLYMLGLPFLATQNAASFWPFGPVLCRLVMTLDGVNQFTSVFCLTVMSVDRYLAVVHPLSSARWRRPRVAKLASAAAWVLSLCMSLPLLVFADVQEGGTCNASWPEPVGLWGAVFIIYTAVLGFFAPLLVICLCYLLIVVKVRAAGVRVGCVRRRSERKVTRMVLVVVLVFAGCWLPFFTVNIVNLAVALPQEPASAGLYFFVVILSYANSCANPVLYGFLSDNFRQSFQKVLCLRKGSGAKDADATELRPDRIRQQQEATPPAHRAAANGLMQTSKL

SEQ ID NO: 747263 - protein, 319 aa, Homo sapiens
MLFWVLGLLILCGFLWTRKGKLKIEDITDKYIFITGCDSGFGNLAARTFDKKGFHVIAACLTESGSTALKAETSERLRTVLLDVTDPENVKRTAQWVKNQVGEKGLWGLINNAGVPGVLAPTDWLTLEDYREPIEVNLFGLISVTLNMLPLVKKAQGRVINVSSVGGRLAIVGGGYTPSKYAVEGFNDSLRRDMKAFGVHVSCIEPGLFKTNLADPVKVIEKKLAIWEQLSPDIKQQYGEGYIEKSLDKLKGNKSYVNMDLSPVVECMDHALTSLFPKTHYAAGKDAKIFWIPLSHMPAALQDFLLLKQKAELANPKAV

SEQ ID NO: 747264 - protein, 323 aa, Homo sapiens
MLFWVLGLLILCGFLWTRKGKLKIEDITDKYIFITGCDSGFGNLAARTFDKKGFHVIAACLTESGSTALKAETSERLRTVLLDVTDPENVKRTAQWVKNQVGEKGLWGLINNAGVPGVLAPTDWLTLEDYREPIEVNLFGLISVTLNMLPRPQEDQPGQGGTTLPSPCTAGKLAIVGGGYTPSKYAVEGFNDSLRRDMKAFGVHVSCIEPGLFKTNLADPVKVIEKKLAIWEQLSPDIKQQYGEGYIEKSLDKLKGNKSYVNMDLSPVVECMDHALTSLFPKTHYAAGKDAKIFWIPLSHMPAALQDFLLLKQKAELANPKAV

SEQ ID NO: 747265 - protein, 323 aa, Homo sapiens; identical to SEQ ID NO: 747264

SEQ ID NO: 747266 - protein, 279 aa, Homo sapiens
MLFWVLGLLILCGFLWTRKGKLKIEDITDKYIFITGCDSGFGNLAARTFDKKGFHVIAACLTESGSTALKAETSERLRTVLLDVTDPENVKRTAQWVKNQVGEKGLWGLINNAGVPGVLAPTDWLTLEDYREPIEVNLFGLISVTLNMLPLVKKAQGRVINVSSVGGRLAIVGGGYTPSKYAVEGFNDSLRRDMKAFGVHVSCIERLDKLKGNKSYVNMDLSPVVECMDHALTSLFPKTHYAAGKDAKIFWIPLSHMPAALQDFLLLKQKAELANPKAV

SEQ ID NO: 747267 - protein, 198 aa, Homo sapiens
MLFWVLGLLILCGFLWTRKGKLKIEDITDKYIFITGCDSGFGNLAARTFDKKGFHVIAACLTESGSTALKAETSERLRTVLLDVTDPENVKRTAQWVKNQVGEKGLWGLINNAGVPGVLAPTDWLTLEDYREPIEVNLFGLISVTLNMLPLVKKAQGRVINVSSVGGRLAIVGGGYTPSKYAVEGFNDSLRSRQTERQ

SEQ ID NO: 747268 - protein, 323 aa, Homo sapiens; identical to SEQ ID NO: 747264

SEQ ID NO: 747269 - protein, 272 aa, Homo sapiens
MLFWVLGLLILCGFLWTRKGKLKIEDITDKYIFITGCDDPENVKRTAQWVKNQVGEKGLWGLINNAGVPGVLAPTDWLTLEDYREPIEVNLFGLISVTLNMLPLVKKAQGRVINVSSVGGRLAIVGGGYTPSKYAVEGFNDSLRRDMKAFGVHVSCIEPGLFKTNLADPVKVIEKKLAIWEQLSPDIKQQYGEGYIEKSLDKLKGNKSYVNMDLSPVVECMDHALTSLFPKTHYAAGKDAKIFWIPLSHMPAALQDFLLLKQKAELANPKAV

SEQ ID NO: 747270 - protein, 219 aa, Homo sapiens
MLFWVLGLLILCGFLWTRKGKLKIEDITDKYIFITGCDSGFGNLAARTFDKKGFHVIAACLTESGSTALKAETSERLRTVLLDVTDPENVKRTAQWVKNQVGEKGLWGLINNAGVPGVLAPTDWLTLEDYREPIEVNLFGLISVTLNMLPLVKKAQGRVINVSSVGGRLAIVGGGYTPSKYAVEGFNDSLRRDMKAFGVHVSCIEPGLFKTNLADPVKV

SEQ ID NO: 747271 - protein, 235 aa, Homo sapiens
HQRWQISTVLPHLFSFLSVLGLWGLINNAGVPGVLAPTDWLTLEDYREPIEVNLFGLISVTLNMLPLVKKAQGRVINVSSVGGRLAIVGGGYTPSKYAVEGFNDSLRRDMKAFGVHVSCIEPGLFKTNLADPVKVIEKKLAIWEQLSPDIKQQYGEGYIEKSLDKLKGNKSYVNMDLSPVVECMDHALTSLFPKTHYAAGKDAKIFWIPLSHMPAALQDFLLLKQKAELANPKAV

SEQ ID NO: 747272 - protein, 135 aa, Homo sapiens
MRAFLRNQKYEDMHNIIHILQIRKLRHRLSNFPRLPGILAPETVLLPFCYKVFRKKEKVKRSQKATEFIDYSIEQSHHAILTPLQTHLTMKGSSMKCSSLSSEAILFTLTLQLTQTLGLECCLLYLSKTIHPQII

SEQ ID NO: 747273 - protein, 135 aa, Homo sapiens; identical to SEQ ID NO: 747272

SEQ ID NO: 747274 - protein, 113 aa, Homo sapiens
MEKLLRLCCWYSWLLLFYYNFQVRGVYSRSQDHPGFQVLASASHYWPLENVDGIHELQDTTGDIVEGKVNKGIYLKEEKGVTLLYYGRYNSSCISKPEQCGPEDFQFFLINLS

SEQ ID NO: 747275 - protein, 145 aa, Homo sapiens
MEKLLRLCCWYSWLLLFYYNFQVRGVYSRSQDHPGFQVLASASHYWPLENVDGIHELQDTTGASRTHKLTVLPSRNATFVYSNDSAYSNLSATVDIVEGKVNKGIYLKEEKGVTLLYYGRYNSSCISKPEQCGPEDFQFFLINLS

SEQ ID NO: 747276 - protein, 384 aa, Homo sapiens
ASSRIWDDGDDFCIFSESRRPSRPSNSNISKGESRPKWKPKAKVPLQTLHMTSENQEKVKALLRDLQEQDADAGSERGLSGEEEDDEPDCCNDERYWPAGQEPSLVPDLDPLEYAGLASVEPYVPEFTVSPFAVQKLSRYGFNTERCQAVLRMCDGDVGASLEHLLTQCFSETFGERMKISEAVNQISLDECMEQRQEEAFALKSICGEKFIERIQNRVWTIGLELEYLTSRFRKSKPKESTKNVQENSLEICKFYLKGNCKFGSKCRFKHEVPPNQIVGRIERSVDDSHLNAIEDASFLYELEIRFSKDHKYPYQAPLVAFYSTNENLPLACRLHISEFLYDKALTFAETSEPVVYSLITLLEEESEIVKLLTNTHHKYSDLL

SEQ ID NO: 747277 - protein, 819 aa, Homo sapiens
MTGCGKTTQIPQFILDDSLNGPPEKVANIICTQPRRISAISVAERVAKERAERVGLTVGYQIRLESVKSSATRLLYCTTGVLLRRLEGDTALQGVSHIIVDEVHERTEESDFLLLVLKDIVSQRPGLQVILMSATLNAELFSDYFNSCPVITIPGRTFPVDQFFLEDAIAVTRYVLQDGSPYMRSMKQISKEKLKARRNRTAFEEVEEDLRLSLHLQDQDSVKDAVPDQQLDFKQLLARYKGVSKSVIKTMSIMDFEKVNLELIEALLEWIVDGKHSYPPGAILVFLPGLAEIKMLYEQLQSNSLFNNRRSNRCVIHPLHSSLSSEEQQAVFVKPPAGVTKIIISTNIAETSITIDDVVYVIDSGKMKEKRYDASKGMESLEDTFVSQANALQRKGRAGRVASGVCFHLFTSHHYNHQLLKQQLPEIQRVPLEQLCLRIKILEMFSAHNLQSVFSRLIEPPHTDSLRASKIRLRDLGALTPDERLTPLGYHLASLPVDVRIGKLMLFGSIFRCLDPALTIAASLAFKSPFVSPWDKKEEANQKKLEFAFANSDYLALLQAYKGWQLSTKEGVRASYNYCRQNFLSGRVLQEMASLKRQFTELLSDIGFAREGLRAREIEKRAQGGDGVLDATGEEANSNAENPKLISAMLCAALYPNVVQVKSPEGKFQKTSTGAVRMQPKSAELKFVTKNDGYVHIHPSSVNYQVRHFDSPYLLYHEKIKTSRVFIRDCSMVSVYPLVLFGGGQVNVQLQRGEFVVSLDDGWIRFVAASHQVAELVKELRCELDQLLQDKIKNPSIDLCTCPRGSRIISTIVKLVTTQ

SEQ ID NO: 747278 - protein, 869 aa, Homo sapiens
NGKICKQFRMKQASRQFQSILQERQSLPAWEERETILNLLRKHQVVVISGMTGCGKTTQIPQFILDDSLNGPPEKVANIICTQPRRISAISVAERVAKERAERVGLTVGYQIRLESVKSSATRLLYCTTGVLLRRLEGDTALQGVSHIIVDEVHERTEESDFLLLVLKDIVSQRPGLQVILMSATLNAELFSDYFNSCPVITIPGRTFPVDQFFLEDAIAVTRYVLQDGSPYMRSMKQISKEKLKARRNRTAFEEVEEDLRLSLHLQDQDSVKDAVPDQQLDFKQLLARYKGVSKSVIKTMSIMDFEKVNLELIEALLEWIVDGKHSYPPGAILVFLPGLAEIKMLYEQLQSNSLFNNRRSNRCVIHPLHSSLSSEEQQAVFVKPPAGVTKIIISTNIAETSITIDDVVYVIDSGKMKEKRYDASKGMESLEDTFVSQANALQRKGRAGRVASGVCFHLFTSHHYNHQLLKQQLPEIQRVPLEQLCLRIKILEMFSAHNLQSVFSRLIEPPHTDSLRASKIRLRDLGALTPDERLTPLGYHLASLPVDVRIGKLMLFGSIFRCLDPALTIAASLAFKSPFVSPWDKKEEANQKKLEFAFANSDYLALLQAYKGWQLSTKEGVRASYNYCRQNFLSGRVLQEMASLKRQFTELLSDIGFAREGLRAREIEKRAQGGDGVLDATGEEANSNAENPKLISAMLCAALYPNVVQVKSPEGKFQKTSTGAVRMQPKSAELKFVTKNDGYVHIHPSSVNYQVRHFDSPYLLYHEKIKTSRVFIRDCSMVSVYPLVLFGGGQVNVQLQRGEFVVSLDDGWIRFVAASHQVAELVKELRCELDQLLQDKIKNPSIDLCTCPRGSRIISTIVKLVTTQ

SEQ ID NO: 747279 - protein, 735 aa, Homo sapiens
MTGCGKTTQIPQFILDDSLNGPPEKVANIICTQPRRISAISVAERVAKERAERVGLTVGYQIRLESVKSSATRLLYCTTGVLLRRLEGDTALQGVSHIIVDEVHERTEESDFLLLVLKDIVSQRPGLQVILMSATLNAELFSDYFNSCPVITIPGRTFPVDQFFLEDAIAVTRYVLQDGSPYMRSMKQISKEKLKARRNRTAFEEVEEDLRLSLHLQDQDSVKDAVPDQQLDFKQLLARYKGVSKSVIKTMSIMDFEKVNLELIEALLEWIVDGKHSYPPGAILVFLPGLAEIKMLYEQLQSNSLFNNRRSNRCVIHPLHSSLSSEEQQAVFVKPPAGVTKIIISTNIAETSITIDDVVYVIDSGKMKEKRYDASKGMESLEDTFVSQANALQRKGRAGRVASGVCFHLFTSHHYNHQLLKQQLPEIQRVPLEQLCLRIKILEMFSAHNLQSVFSRLIEPPHTDSLRASKIRLRDLGALTPDERLTPLGYHLASLPVDVRIGKLMLFGSIFRCLDPALTIAASLAFKSPFVSPWDKKEEANQKKLEFAFANSDYLALLQAYKGWQLSTKEGVRASYNYCRQNFLSGRVLQEMASLKRQFTELLSDIGFAREGLRAREIEKRAQGGDGVLDATGEEANSNAENPKLISAMLCAALYPNVVQVKSPEGKFQKTSTGAVRMQPKSAELKFVTKNDGYVHIHPSSVNYQVAELVKELRCELDQLLQDKIKNPACLSLSL

SEQ ID NO: 747280 - protein, 593 aa, Homo sapiens
MTGCGKTTQIPQFILDDSLNGPPEKVANIICTQPRRISAISVAERVAKERAERVGLTVGYQIRLESVKSSATRLLYCTTGVLLRRLEGDTALQGVSHIIVDEVHERTEESDFLLLVLKDIVSQRPGLQVILMSATLNAELFSDYFNSCPVITIPGRTFPVDQFFLEDAIAVTRYVLQDGSPYMRSMKQISKEKLKARRNRTAFEEVEEDLRLSLHLQDQDSVKDAVPDQQLDFKQLLARYKGVSKSVIKTMSIMDFEKVNLELIEALLEWIVDGKHSYPPGAILVFLPGLAEIKMLYEQLQSNSLFNNRRSNRCVIHPLHSSLSSEEQQAVFVKPPAGVTKIIISTNIAETSITIDDVVYVIDSGKMKEKRYDASKGMESLEDTFVSQANALQRKGRAGRVASGVCFHLFTSHHYNHQLLKQQLPEIQRVPLEQLCLRIKILEMFSAHNLQSVFSRLIEPPHTDSLRASKIRLRDLGALTPDERLTPLGYHLASLPVDVRIGKLMLFGSIFRCLDPALTIAASLAFKSPFVSPWDKKEEANQKKLEFAFANSDYLALLQAYKGWQLSTKEGVRASYNYCRQNFLSGRVLQEKR

SEQ ID NO: 747281 - protein, 124 aa, Homo sapiens
MQPKSAELKFVTKNDGYVHIHPSSVNYQVRHFDSPYLLYHEKIVLFGGGQVNVQLQRGEFVVSLDDGWIRFVAASHQVAELVKELRCELDQLLQDKIKNPSIDLCTCPRGSRIISTIVKLVTTQ

SEQ ID NO: 747282 - protein, 408 aa, Homo sapiens
MTSENQEKVKALLRDLQEQDADAGSERGLSGEEEDDEPDCCNDERYWPAGQEPSLVPDLDPLEYAGLASVEPYVPEFTVSPFAVQKLSRYGFNTERCQAVLRMCDGDVGASLEHLLTQCFSETFGERMKISEAVNQISLDECMEQRQEEAFALKSICGEKFIERIQNRVWTIGLELEYLTSRFRKSKPKESTKNVQENSLEICKFYLKGNCKFGSKCRFKHEVPPNQIVGRIERSVDDSHLNAIEDASFLYELEIRFSKDHKYPYQAPLVAFYSTNENLPLACRLHISEFLYDKALTFAETSEPVVYSLITLLEEESEIVKLLTNTHHKYSDPPVNFLPVPSRTRINNPACHKTVIPNNSFVSNQIPEVEKASESEESDEDDGPAPVIVENESYVNLKKKISKRYDWQ

SEQ ID NO: 747283 - protein, 158 aa, Homo sapiens
MTSENQEKVKALLRDLQEQDADAGSERGLSGEEEDDEPDCCNDERYWPAGQEPSLVPDLDPLEYAGLASVEPYVPEFTVSPFAVQKLSRYGFNTERCQAVLRMCDGDVGASLEHLLTQCFSETFGERMKISEAVNQISLDECMEQRQEEAFALKSICG

SEQ ID NO: 747284 - protein, 122 aa, Homo sapiens
ASSRIWDDGDDFCIFSESRRPSRPSNSNISKGESRPKWKPKAKVPLQTLHMTSENQEKVKALLRDLQEQDADAGSERGLSGEEEDDEPDCCNDERYWPAGQEPSLVPERSQNREGEKKPKIM

SEQ ID NO: 747285 - protein, 1217 aa, Homo sapiens
MFLYNLTLQRATGISFAIHGNFSGTKQQEIVVSRGKILELLRPDPNTGKVHTLLTVEVFGVIRSLMAFRLTGGTKDYIVVGSDSGRIVILEYQPSKNMFEKIHQETFGKSGCRRIVPGQFLAVDPKGRAVMISAIEKQKLVYILNRDAAARLTISSPLEAHKANTLVYHVVGVDVGFENPMFACLEMDYEEADNDPTGEAAANTQQTLTFYELDLGLNHVVRKYSEPLEEHGNFLITVPGGSDGPSGVLICSENYITYKNFGDQPDIRCPIPRRRNDLDDPERGMIFVCSATHKTKSMFFFLAQTEQGDIFKITLETDEDMVTEIRLKYFDTVPVAAAMCVLKTGFLFVASEFGNHYLYQIAHLGDDDEEPEFSSAMPLEEGDTFFFQPRPLKNLVLVDELDSLSPILFCQIADLANEDTPQLYVACGRGPRSSLRVLRHGLEVSEMAVSELPGNPNAVWTVRRHIEDEFDAYIIVSFVNATLVLSIGETVEEVTDSGFLGTTPTLSCSLLGDDALVQVYPDGIRHIRADKRVNEWKTPGKKTIVKCAVNQRQVVIALTGGELVYFEMDPSGQLNEYTERKEMSADVVCMSLANVPPGEQRSRFLAVGLVDNTVRIISLDPSDCLQPLSMQALPAQPESLCIVEMGGTEKQDELGERGSIGFLYLNIGLQNGVLLRTVLDPVTGDLSDTRTRYLGSRPVKLFRVRMQGQEAVLAMSSRSWLSYSYQSRFHLTPLSYETLEFASGFASEQCPEGIVAISTNTLRILALEKLGAVFNQVAFPLQYTPRKFVIHPESNNLIIIETDHNAYTEATKAQRKQQMAEEMVEAAGEDERELAAEMAAAFLNENLPESIFGAPKAGNGQWASVIRVMNPIQGNTLDLVQLEQNEAAFSVAVCRFSNTGEDWYVLVGVAKDLILNPRSVAGGFVYTYKLVNNGEKLEFLHKTPVEEVPAAIAPFQGRVLIGVGKLLRVYDLGKKKLLRKCENKHIANYISGIQTIGHRVIVSDVQESFIWVRYKRNENQLIIFADDTYPRWVTTASLLDYDTVAGADKFGNICVVRLPPNTNDEVDEDPTGNKALWDRGLLNGASQKAEVIMNYHVGETVLSLQKTTLIPGGSESLVYTTLSGGIGILVPFTSHEDHDFFQHVEMHLRSEHPPLCGRDHLSFRSYYFPVKNVIDGDLCEQFNSMEPNKQKNVSEELDRTPPEVSKKLEDIRTRYAF

SEQ ID NO: 747286 - protein, 1217 aa, Homo sapiens; identical to SEQ ID NO: 747285

SEQ ID NO: 747287 - protein, 255 aa, Homo sapiens
MFLYNLTLQRATGISFAIHGNFSGTKQQEIVVSRGKILELLRPDPNTGKVHTLLTVEVFGVIRSLMAFRLTGGTKDYIVVGSDSGRIVILEYQPSKNMFEKIHQETFGKSGCRRIVPGQFLAVDPKGRAVMISAIEKQKLVYILNRDAAARLTISSPLEAHKANTLVYHVVGVDVGFENPMFACLEMDYEEADNDPTGEAAANTQQTLTFYELDLGLNHVVRKYSEPLEEHGNFLITVPGGSDGPSGVLTKPSLH

SEQ ID NO: 747288 - protein, 214 aa, Homo sapiens
MFLYNLTLQRATGISFAIHGNFSGTKQQEIVVSRGKILELLRPDPNTGKVHTLLTVEVFGVIRSLMAFRLTGGTKDYIVVGSDSGRIVILEYQPSKNMFEKIHQETFGKSGCRRIVPGQFLAVDPKGRAVMISAIEKQKLVYILNRDAAARLTISSPLEAHKANTLVYHVVGVDVGFENPMFACLEMDYEEADNDPTGEAAANTQQSHPCIDMS

SEQ ID NO: 747289 - protein, 1072 aa, Homo sapiens
MAPPTGVLSSLLLLVTIAGCARKQCSEGRTYSNAVISPNLETTRIMRVSHTFPVVDCTAACCDLSSCDLAWWFEGRCYLVSCPHKENCEPKKMGPIRSYLTFVLRPVQRPAQLLDYGDMMLNRGSPSGIWGDSPEDIRKDLPFLGKDWGLEEMSEYADDYRELEKDLLQPSGKQEPRGSAEYTDWGLLPGSEGAFNSSVGDSPAVPAETQQDPELHYLNESASTPAPKLPERSVLLPLPTTPSSGEVLEKEKASQLQEQSSNSSGKEVLMPSHSLPPASLELSSVTVEKSPVLTVTPGSTEHSIPTPPTSAAPSESTPSELPISPTTAPRTVKELTVSAGDNLIITLPDNEVELKAFVAPAPPVETTYNYEWNLISHPTDYQGEIKQGHKQTLNLSQLSVGLYVFKVTVSSENAFGEGFVNVTVKPARRVNLPPVAVVSPQLQELTLPLTSALIDGSQSTDDTEIVSYHWEEINGPFIEEKTSVDSPVLRLSNLDPGNYSFRLTVTDSDGATNSTTAALIVNNAVDYPPVANAGPNHTITLPQNSITLNGNQSSDDHQIVLYEWSLGPGSEGKHVVMQGVQTPYLHLSAMQEGDYTFQLKVTDSSRQQSTAVVTVIVQPENNRPPVAVAGPDKELIFPVESATLDGSSSSDDHGIVFYHWEHVRGPSAVEMENIDKAIATVTGLQVGTYHFRLTVKDQQGLSSTSTLTVAVKKENNSPPRARAGGRHVLVLPNNSITLDGSRSTDDQRIVSYLWIRDGQSPAAGDVIDGSDHSVALQLTNLVEGVYTFHLRVTDSQGASDTDTATVEVQPDPRKSGLVELTLQVGVGQLTEQRKDTLVRQLAVLLNVLDSDIKVQKIRAHSDLSTVIVFYVQSRPPFKVLKAAEVARNLHMRLSKEKADFLLFKVLRVDTAGCLLKCSGHGHCDPLTKRCICSHLWMENLIQRYIWDGESNCEWSIFYVTVLAFTLIVLTGGFTWLCICCCKRQKRTKIRKKTKYTILDNMDEQERMELRPKYGIKHRSTEHNSSLMVSESEFDSDQDTIFSREKMERGNPKVSMNGSIRNGASFSYCSKDR

SEQ ID NO: 747290 - protein, 1072 aa, Homo sapiens; identical to SEQ ID NO: 747289

SEQ ID NO: 747291 - protein, 317 aa, Homo sapiens
MGTDNQTWVSEFILLGLSSDWDTRVSLFVLFLVMYVVTVLGNCLIVLLIRLDSRLHTPMYFFLTNLSLVDVSYATSVVPQLLAHFLAEHKAIPFQSCAAQLFFSLALGGIEFVLLAVMAYDRYVAVCDALRYSAIMHGGLCARLAITSWVSGFISSPVQTAITFQLPMCRNKFIDHISCELLAVVRLACVDTSSNEVTIMVSSIVLLMTPFCLVLLSYIQIISTILKIQSREGRKKAFHTCASHLTVVALCYGVAIFTYIQPHSSPSVLQEKLFSVFYAILTPMLNPMIYSLRNKEVKGAWQKLLWKFSGLTSKLAT

SEQ ID NO: 747292 - protein, 757 aa, Homo sapiens
MTSGSVFFYILIFGKYFSHGGGQDVKCSLGYFPCGNITKCLPQLLHCNGVDDCGNQADEDNCGDNNGWSMQFDKYFASYYKMTSQYPFEAETPECLVGSVPVQCLCQGLELDCDETNLRAVPSVSSNVTAMSLQWNLIRKLPPDCFKNYHDLQKLYLQNNKITSISIYAFRGLNSLTKLYLSHNRITFLKPGVFEDLHRLEWLIIEDNHLSRISPPTFYGLNSLILLVLMNNVLTRLPDKPLCQHMPRLHWLDLEGNHIHNLRNLTFISCSNLTVLVMRKNKINHLNENTFAPLQKLDELDLGSNKIENLPPLIFKDLKELSQLNLSYNPIQKIQANQFDYLVKLKSLSLEGIEISNIQQRMFRPLMNLSHIYFKKFQYCGYAPHVRSCKPNTDGISSLENLLASIIQRVFVWVVSAVTCFGNIFVICMRPYIRSENKLYAMSIISLCCADCLMGIYLFVIGGFDLKFRGEYNKHAQLWMESTHCQLVGSLAILSTEVSVLLLTFLTLEKYICIVYPFRCVRPGKCRTITVLILIWITGFIVAFIPLSNKEFFKNYYGTNGVCFPLHSEDTESIGAQIYSVAIFLGINLAAFIIIVFSYGSMFYSVHQSAITATEIRNQVKKEMILAKRFFFIVFTDALCWIPIFVVKFLSLLQVEIPGTITSWVVIFILPINSALNPILYTLTTRPFKEMIHRFWYNYRQRKSMDSKGQKTYAPSFIWVEMWPLQEMPPELMKPDLFTYPCEMSLISQSTRLNSYS

SEQ ID NO: 747293 - protein, 484 aa, Homo sapiens
MSRSTQELLGYHCRLQDKLQEQEGSLAAEGRHSLASAADHMKVVPSLLLSVLLAQVWLVPGLAPSPQSPETPAPQNQTSRVVQAPKEEEEDEQEASEEKASEEEKAWLMASRQQLAKETSNFGFSLLRKISMRHDGNMVFSPFGMSLAMTGLMLGATGPTETQIKRGLHLQALKPTKPGLLPSLFKGLRETLSRNLELGLTQGSFAFIHKDFDVKETFFNLSKRYFDTECVPMNFRNASQAKRLMNHYINKETRGKIPKLFDEINPETKLILVDYILFKGKWLTPFDPVFTEVDTFHLDKYKTIKVPMMYGAGKFASTFDKNFRCHVLKLPYQGNATMLVVLMEKMGDHLALEDYLTTDLVETWLRNMKTRNMEVFFPKFKLDQKYEMHELLRQMGIRRIFSPFADLSELSATGRNLQVSRVLQRTVIEVDERGTEAVAGILSEITAYSMPPVIKVDRPFHFMIYEETSGMLLFLGRVVNPTLL

SEQ ID NO: 747294 - protein, 160 aa, Homo sapiens
MYGAGKFASTFDKNFRCHVLKLPYQGNATMLVVLMEKMGDHLALEDYLTTDLVETWLRNMKKEMHELLRQMGIRRIFSPFADLSELSATGRNLQVSRVLQRTVIEVDERGTEAVAGILSEITAYSMPPVIKVDRPFHFMIYEETSGMLLFLGRVVNPTLL

SEQ ID NO: 747295 - protein, 160 aa, Homo sapiens; identical to SEQ ID NO: 747294

SEQ ID NO: 747296 - protein, 488 aa, Homo sapiens
LKVLGCKAEALVSALNEGLFQDPRPHTGSLAAEGRHSLASAADHMKVVPSLLLSVLLAQVWLVPGLAPSPQSPETPAPQNQTSRVVQAPKEEEEDEQEASEEKASEEEKAWLMASRQQLAKETSNFGFSLLRKISMRHDGNMVFSPFGMSLAMTGLMLGATGPTETQIKRGLHLQALKPTKPGLLPSLFKGLRETLSRNLELGLTQGSFAFIHKDFDVKETFFNLSKRYFDTECVPMNFRNASQAKRLMNHYINKETRGKIPKLFDEINPETKLILVDYILFKGKWLTPFDPVFTEVDTFHLDKYKTIKVPMMYGAGKFASTFDKNFRCHVLKLPYQGNATMLVVLMEKMGDHLALEDYLTTDLVETWLRNMKTRNMEVFFPKFKLDQKYEMHELLRQMGIRRIFSPFADLSELSATGRNLQVSRVLQRTVIEVDERGTEAVAGILSEITAYSMPPVIKVDRPFHFMIYEETSGMLLFLGRVVNPTLL

SEQ ID NO: 747297 - protein, 110 aa, Homo sapiens
SRNLELGLTQGSFAFIHKDFDVKETFFNLSKRYFDTECVPMNFRNASQAKRLMNHYINKETRGKIPKLFDEINPETKLILVDYILFKGTLIMFCSPKATGPYDCLSLSFR

SEQ ID NO: 747298 - protein, 333 aa, Homo sapiens [sequence omitted]

SEQ ID NO: 747299 - protein, 270 aa, Homo sapiens
MSWIKEGELSLWERFCANIIKAGPMPKHIAFIMDGNRRYAKKCQVERQEGHSQGFNKLAETLRWCLNLGILEVTVYAFSIENFKRSKSEVDGLMDLARQKFSRLMEEKEKLQKHGVCIRVLGDLHLLPLDLQELIAQAVQATKNYNKCFLNVCFAYTSRHEISNAVREMAWGVEQGLLDPRYPELFCMVIVKENRPGPAWQLTPVILAHWEAEVGSPLEAGQEFKTSLANMAKLPLFNNNNKKAGLYQTIKPLCAMYLARGLIRGACGKI

SEQ ID NO: 747300 - protein, 93 aa, Homo sapiens
AAAYYYYYYYQNSRLCLPMLWIIEGKLGLGERVWGYEENAGPMPKHIAFIMDGNRRYAKKCQVERQEGHSQGFNKLAEVGVYGRAQSEQSVER

SEQ ID NO: 747301 - protein, 333 aa, Homo sapiens [sequence omitted]

SEQ ID NO: 747302 - protein, 333 aa, Homo sapiens [sequence omitted]

SEQ ID NO: 747303 - protein, 294 aa, Homo sapiens [sequence omitted]

SEQ ID NO: 747304 - protein, 333 aa, Homo sapiens [sequence omitted]

SEQ ID NO: 747305 - protein, 333 aa, Homo sapiens [sequence omitted]

SEQ ID NO: 747306 - protein, 333 aa, Homo sapiens [sequence omitted]

SEQ ID NO: 747307 - protein, 299 aa, Homo sapiens [sequence omitted]

SEQ ID NO: 747308 - protein, 333 aa, Homo sapiens [sequence omitted]

SEQ ID NO: 747309 - protein, 234 aa, Homo sapiens
RGSPSAHQREKLQKHGVCIRVLGDLHLLPLDLQELIAQAVQATKNYNKCFLNVCFAYTSRHEISNAVREMAWGVEQGLLDPSDISESLLDKCLYTNRSPHPDILIRTSGEVRLSDFLLWQTSHSCLVFQPVLWPEYTFWNLFEAILQFQMNHSMLQKARDMYAEERKRQQLERDQATVTEQLLREGLQASGDAQLRRTRLHKLSARREERVQGFLQALELKRADWLARLGTASA

SEQ ID NO: 747310 - protein, 270 aa, Homo sapiens; identical to SEQ ID NO: 747299

SEQ ID NO: 747311 - protein, 300 aa, Homo sapiens
MSWIKEGELSLWERFCANIIKAGPMPKHIAFIMDGNRRYAKKCQVERQEGHSQGFNKLAETLRWCLNLGILEVTVYAFSIENFKRSKSEVDGLMDLARQKFSRLMEEKEKLQKHGVCIRVLGDLHLLPLDLQELIAQAVQATKNYNKCFLNVCFAYTSRHEISNAVREMAWGVEQGLLDPSDISESLLDKCLYTNRSPHPDILIRTSGEVRLSDFLLWQTLNPAGVHPVLCQSIHLELSRHRRSNDIVVKADSSRRSHWRRTDTPRRATWPADAKTSEDPNTKAGEKRRALSSGPGSAPE

SEQ ID NO: 747312 - protein, 522 aa, Homo sapiens
MDFLLLGLCLYWLLRRPSGVVLCLLGACFQMLPAAPSGCPQLCRCEGRLLYCEALNLTEAPHNLSGLLGLSLRYNSLSELRAGQFTGLMQLTWLYLDHNHICSVQGDAFQKLRRVKELTLSSNQITQLPNTTFRPMPNLRSVDLSYNKLQALAPDLFHGLRKLTTLHMRANAIQFVPVRIFQDCRSLKFLDIGYNQLKSLARNSFAGLFKLTELHLEHNDLVKVNFAHFPRLISLHSLCLRRNKVAIVVSSLDWVWNLEKMDLSGNEIEYMEPHVFETVPHLQSLQLDSNRLTYIEPRILNSWKSLTSITLAGNLWDCGRNVCALASWLNNFQGRYDGNLQCASPEYAQGEDVLDAVYAFHLCEDGAEPTSGHLLSAVTNRSDLGPPASSATTLADGGEGQHDGTFEPATVALPGGEHAENAVQIHKVVTGTMALIFSFLIVVLVLYVSWKCFPASLRQLRQCFVTQRRKQKQKQTMHQMAAMSAQEYYVDYKPNHIEGALVIINEYGSCTCHQQPARECEV

SEQ ID NO: 747313 - protein, 102 aa, Homo sapiens
ACARLWISRAGATFTSSPRGPIFLYQYVVSLMRSAWKPVAWCGPGRLLRGGCCWTLKVGEKITDGIWEHAEQRYCFTLACPFLHGLDSPFIWIPPLYFLLQP

SEQ ID NO: 747314 - protein, 122 aa, Homo sapiens
YGSEGRTMGGCPVRKRRRNGSKEGNHHSTQPKRNKRNPIFQDSQDTEFSWSDNERSSSRINIPERASGPEGNLNQIVTEPDANFPQFLHEGYVPCQGLYSHINQTLKEAHFNSLQQRGQAPT

SEQ ID NO: 747315 - protein, 114 aa, Homo sapiens
MLVLWLKRRRNGSKEGNHHSTQPKRNKRNPIFQDSQDTEFSWSDNERSSSRINIPERASGPEGNLNQIVTEPDANFPQFLHEGYVPCQGLYSHINQTLKEAHFNSLQQRGQAPT

SEQ ID NO: 747316 - protein, 151 aa, Homo sapiens
SELWSPRSSRFAFSAKISGLRAETQRICIFFRGWWRSALMTCRKRRRNGSKEGNHHSTQPKRNKRNPIFQDSQDTEFSWSDNERSSSRINIPERASGPEGNLNQIVTEPDANFPQFLHEGYVPCQGLYSHINQTLKEAHFNSLQQRGQAPT

SEQ ID NO: 747317 - protein, 122 aa, Homo sapiens; identical to SEQ ID NO: 747314

SEQ ID NO: 747318 - protein, 122 aa, Homo sapiens; identical to SEQ ID NO: 747314

SEQ ID NO: 747319 - protein, 122 aa, Homo sapiens
YGSEGRTMGGCPVRKRRRNGSKEGNHHSTQPKRNKRNPIFQDSQDTEFSWSDNERSSSRINIPERASGPEGNLNQIVTEPDANFPQFLHEGLSKPVYVINWFMSFGPEIKLNTSQQGRNQAV

SEQ ID NO: 747320 - protein, 122 aa, Homo sapiens; identical to SEQ ID NO: 747314

SEQ ID NO: 747321 - protein, 136 aa, Homo sapiens
VRALVPTVITLCFLSQDLGAQGGNAADMYFLPGLVALGSHDLQVTVLAGARPCLPRAPPFVLEKKSREAFSERTCWFFGCQCLTSPGGGGEVGMWSLAKTQSVDNSILFFKLAFPRKHEEGHMAGRRRRKPIDSYR

SEQ ID NO: 747322 - protein, 286 aa, Homo sapiens
MSGALDVLQMKEEDVLKFLAAGTHLGGTNLDFQMEQYIYKRKSDGIYIINLKRTWEKLLLAARAIVAIENPADVSVISSRNTGQRAVLKFAAATGATPIAGRFTPGTFTNQIQAAFREPRLLVVTDPRADHQPLTEASYVNLPTIALCNTDSPLRYVDIAIPCNNKGAHSVGLMWWMLAREVLRMRGTISREHPWEVMPDLYFYRDPEEIEKEEQAAAEKAVTKEEFRVNGLLRSEFTVLSLRLQTGLKVYRCPLCLFSNSLLKTGALSLPRKTGLQLPLLRPLNG

SEQ ID NO: 747323 - protein, 37 aa, Homo sapiens
MITLTIINFPLGTREGLGDPHLGTQTAHWVAKDHRTG

SEQ ID NO: 747324 - protein, 108 aa, Homo sapiens
GQGPPRKQLGRRGGLLGSCPAPITQRPVPRAPHPRGLSPGRQQAVLSKEASGHWEVAGKSLQRSPPGALWAPGPLLLQGQKHGFPEASCLAALTLSEEGFKSQELKEN

SEQ ID NO: 747325 - protein, 497 aa, Homo sapiens
MDPLGAPSQFVDVDTLPSWGDSCQDELNSSDTTAEIFQEDTVRSPFLYNKDVNGKVVLWKGDVALLNCTAIVNTSNESLTDKNPVSESIFMLAGPDLKEDLQKLKGCRTGEAKLTKGFNLAARFIIHTVGPKYKSRYRTAAESSLYSCYRNVLQLAKEQSMSSVGFCVINSAKRGYPLEDATHIALRTVRRFLEIHGETIEKVVFAVSDLEEGTYQKLLPLYFPRSLKEENRSLPYLPADIGNAEGEPVVPERQIRISEKPGAPEDNQEEEDEGLGVDLSFIGSHAFARMEGDIDKQRKLILQGQLSEAALQKQHQRNYNRWLCQARSEDLSDIASLKALYQTGVDNCGRTVMVVVGRNIPVTLIDMDKALLYFIHVMDHIAVKEYVLVYFHTLTSEYNHLDSDFLKKLYDVVDVKYKRNLKAVYFVHPTFRSKVSTWFFTTFSVSGLKDKIHHVDSLHQLFSAISPEQIDFPPFVLEYDARENGPYYTSYPPSPDL

SEQ ID NO: 747326 - protein, 318 aa, Homo sapiens [sequence omitted]

SEQ ID NO: 747327 - protein, 496 aa, Homo sapiens
MDPLGAPSQFVDVDTLPSWGDSCQDELNSSDTTAEIFQEDTVRSPFLYNKDVNGKVVLWKGDVALLNCTAIVNTSNESLTDKNPVSESIFMLAGPDLKEDLQKLKGCRTGEAKLTKGFNLAARFIIHTVGPKYKSRYRTAAESSLYSCYRNVLQLAKEQSMSSVGFCVINSAKRGYPLEDATHIALRTVRRFLEIHGETIEKVVFAVSDLEEGTYQKLLPLYFPRSLKEENRSLPYLPADIGNAEGEPVVPERQIRISEKPGAPEDNQEEEDEGLGVDLSFIGSHAFARMEGDIDKQRKLILQGQLSEAALQKQHQRNYNRWLCQARSEDLSDIASLKALYQTGVDNCGRTVMVVVGRNIPVTLIDMDKALLYFIHVMDHIAVKEYVLVYFHTLTSEYNHLDSDFLKKLYDVVDVKYKRNLKAVYFVHPTFRSKVSTWFFTTFSVSGLKDKIHHVDSLHQLFSAISPEQIDFPPFVLEYDARVRSTRSSPSPGMVY

SEQ ID NO: 747328 - protein, 740 aa, Homo sapiens
QRDWCFCEAVRPKVTFIKRMELGKGKLLRTGLNALHQAVHPIHGLAWTDGNQVVLTDLRLHSGEVKFGDSKVIGQFECVCGLSWAPPVADDTPVLLAVQHEKHVTVWQLCPSPMESSKWLTSQTCEIRGSLPILPQGCVWHPKCAILTVLTAQDVSIFPNVHSDDSQVKADINTQGRIHCACWTQDGLRLVVAVGSSLHSYIWDSAQKTLHRCSSCLVFDVDSHVCSITATVDSQVAIATELPLDKICGLNASETFNIPPNSKDMTPYALPVIGEVRSMDKEATDSETNSEVSVSSSYLEPLDLTHIHFNQHKSEGNSLICLRKKDYLTGTGQDSSHLVLVTFKKAVTMTRKVTIPGILVPDLIAFNLKAHVVAVASNTCNIILIYSVIPSSVPNIQQIRLENTERPKGICFLTDQLLLILVGKQKLTDTTFLPSSKSDQYAISLIVREIMLEEEPSITSGESQTTYSTFSAPLNKANRKKLIESLSPDFCHQNKGLLLTVNTSSQNGRPGRTLIKEIQSPLSSICDGSIALDAEPVTQPASLPRHSSTPDHTSTLEPPRLPQRKNLQSEKETYQLSKEVEILSRNLVEMQRCLSELTNRLHNGKKSSSVYPLSQDLPYVHIIYQKPYYLGPVVEKRAVLLCDGKLRLSTVQQTFGLSLIEMLHDSHWILLSADSEGFIPLTFTATQEIIIRDGSLSRSDVFRDSFSHSPGAVSSLKVFTGLAAPSLDTTGCCNHVDGMA

SEQ ID NO: 747329 - protein, 740 aa, Homo sapiens; identical to SEQ ID NO: 747328

SEQ ID NO: 747330 - protein, 230 aa, Homo sapiens
RLGTRPVVESAEASICDGSIALDAEPVTQPASLPRHSSTPDHTSTLEPPRLPQRKNLQSEKETYQLSKEVEILSRNLVEMQRCLSELTNRLHNGKKSSSVYPLSQDLPYVHIIYQKPYYLGPVVEKRAVLLCDGKLRLSTVQQTFGLSLIEMLHDSHWILLSADSEGFIPLTFTATQEIIIRDGSLSRSDVFRDSFSHSPGAVSSLKVFTGLAAPSLDTTGCCNHVDGMA

SEQ ID NO: 747331 - protein, 740 aa, Homo sapiens; identical to SEQ ID NO: 747328

SEQ ID NO: 747332 - protein, 637 aa, Homo sapiens
QRDWCFCEAVRPKVTFIKRMELGKGKLLRTGLNALHQAVHPIHGLAWTDGNQVVLTDLRLHSGEVKADINTQGRIHCACWTQDGLRLVVAVGSSLHSYIWDSAQKTLHRCSSCLVFDVDSHVCSITATVDSQVAIATELPLDKICGLNASETFNIPPNSKDMTPYALPVIGEVRSMDKEATDSETNSEVSVSSSYLEPLDLTHIHFNQHKSEGNSLICLRKKDYLTGTGQDSSHLVLVTFKKAVTMTRKVTIPGILVPDLIAFNLKAHVVAVASNTCNIILIYSVIPSSVPNIQQIRLENTERPKGICFLTDQLLLILVGKQKLTDTTFLPSSKSDQYAISLIVREIMLEEEPSITSGESQTTYSTFSAPLNKANRKKLIESLSPDFCHQNKGLLLTVNTSSQNGRPGRTLIKEIQSPLSSICDGSIALDAEPVTQPASLPRHSSTPDHTSTLEPPRLPQRKNLQSEKETYQLSKEVEILSRNLVEMQRCLSELTNRLHNGKKSSSVYPLSQDLPYVHIIYQKPYYLGPVVEKRAVLLCDGKLRLSTVQQTFGLSLIEMLHDSHWILLSADSEGFIPLTFTATQEIIIRDGSLSRSDVFRDSFSHSPGAVSSLKVFTGLAAPSLDTTGCCNHVDGMA

SEQ ID NO: 747333 - protein, 740 aa, Homo sapiens; identical to SEQ ID NO: 747328

SEQ ID NO: 747334 - protein, 510 aa, Homo sapiens
PSPENCRQFAGASQWPFRQGYGGLDWASEAFSQLYNPSFDCHVSEPNVILDISNYTPQKVKQQTAVSETFSESSSDSTQFNQPVGGGGFRRANSEASSSEGQSSLSSLEKLMMDWNEASSAPGYNWNQSVLFQSSSKPGRGRRKKVDLFEASHLGFPTSASAAASGYPSKRSTGPRQPRGGRGGGACSAKKERGGAAAKAKFIPKPQPVNPLFQDSPDLGLDYYSGDSSMSPLPSQSRAFGVGERDPCDFIGPYSMNPSTPSDGTFGQGFHCDSPSLGAPELDGKHFPPLAHPPTVFDAGLQKAYSPTCSPTLGFKEELRPPPTKLAACEPLKHGLQGASLGHAAAAQAHLSCRDLPLGQPHYDSPSCKGTAYWYPPGSAARSPPYEGKVGTGLLADFLGRTEAACLSAPHLASPPATPKADKEPLEMARPPGPPRGPAAAAAGYGCPLLSDLTLSPVPRDSLLPLQDTAYRYPGFMPQAHPGLGGGPKSGFLGPMAEPHPEDTFTVTSL

SEQ ID NO: 747335 - protein, 110 aa, Homo sapiens
QASNDVRGHGGTSPRGHIHRHIPVVPTEVPTGPRGFVPGFQKTNAKIPPSVHIVLWQELLPLCLPPCPLHPLQTHLPPPPPTHLLHAEAEGEPFLHKTSNCKYFLKMYKT

SEQ ID NO: 747336 - protein, 510 aa, Homo sapiens; identical to SEQ ID NO: 747334

SEQ ID NO: 747337 - protein, 52 aa, Homo sapiens
LTLLNPGRSWVGVSLFTSLISEHSRCVPLTPASSLVFLCSFQKTNAKIPPSV

SEQ ID NO: 747338 - protein, 1080 aa, Homo sapiens
MPAKGRYFLNEGEEGPDQDALYEKYQLTSQHGPLLLTLLLVAATACVALIIIAFSQGDPSRHQAILGMAFLVLAVFAALSVLMYVECLLRRWLRALALLTWACLVALGYVLVFDAWTKAACAWEQVPFFLFIVFVVYTLLPFSMRGAVAVGAVSTASHLLVLGSLMGGFTTPSVRVGLQLLANAVIFLCGNLTGAFHKHQMQDASRDLFTYTVKCIQIRRKLRIEKRQQENLLLSVLPAHISMGMKLAIIERLKEHGDRRCMPDNNFHSLYVKRHQNVSILYADIVGFTQLASDCSPKELVVVLNELFGKFDQIAKANECMRIKILGDCYYCVSGLPVSLPTHARNCVKMGLDMCQAIKQVREATGVDINMRVGIHSGNVLCGVIGLRKWQYDVWSHDVSLANRMEAAGVPGRVHITEATLKHLDKAYEVEDGHGQQRDPYLKEMNIRTYLVIDPRSQQPPPPSQHLPRPKGDAALKMRASVRMTRYLESWGAARPFAHLNHRESVSSGETHVPNGRRPKSVPQRHRRTPDRSMSPKGRSEDDSYDDEMLSAIEGLSSTRPCCSKSDDFYTFGSIFLEKGFEREYRLAPIPRARHDFACASLIFVCILLVHVLLMPRTAALGVSFGLVACVLGLVLGLCFATKFSRCCPARGTLCTISERVETQPLLRLTLAVLTIGSLLTVAIINLPLMPFQVPELPVGNETGLLAASSKTRALCEPLPYYTCSCVLGFIACSVFLRMSLEPKVVLLTVALVAYLVLFNLSPCWQWDCCGQGLGNLTKPNGTTSGTPSCSWKDLKTMTNFYLVLFYITLLTLSRQIDYYCRLDCLWKKKFKKEHEEFETMENVNRLLLENVLPAHVAAHFIGDKLNEDWYHQSYDCVCVMFASVPDFKVFYTECDVNKEGLECLRLLNEIIADFDELLLKPKFSGVEKIKTIGSTYMAAAGLSVASGHENQELERQHAHIGVMVEFSIALMSKLDGINRHSFNSFRLRVGINHGPVIAGVIGARKPQYDIWGNTVNVASRMESTGELGKIQVTEETCTILQGLGYSCECRGLINVKGKGELRTYFVCTDTAKFQGLGLN

SEQ ID NO: 747339 - protein, 68 aa, Homo sapiens
IHYCCSSQTPLHITCTSSCSSRVWSILPSSPAVCLEERLSAAMERNHNRRWHKEAIFSSSVIVPRSVF

SEQ ID NO: 747340 - protein, 113 aa, Homo sapiens
MVWLKEWPEPWDSFAAFSLVPVVFRFSRLLLLLLNSIFQPGMVVHTSNPCTLGGRGRRITWDWEFETSLSNMANLVSSESTKISWVWWHMPVVPAAREAEAGELLGPGRWRLR

SEQ ID NO: 747341 - protein, 106 aa, Homo sapiens
MQKIVQTDEITNTQAFRKGKRKRTETMDSENANSDMDKGQRDPYSGNAFLPGESSSEDEEPLAELSKEELCAKIKSLKEKLTNTRKENSRLRQSLVMLQAWSRELP

SEQ ID NO: 747342 - protein, 279 aa, Homo sapiens
MQKIVQTDEITNTQAFRKGKRKRTETMDSENANSDMDKGQRDPYSGNAFLPGESSSEDEEPLAELSKEELCAKIKSLKEKLTNTRKENSRLRQSLVMLQVLPQAVTQFEELVGMAEALLKGGGTMSTSASTLWRATNNSSPDSFASTCSNSNSNSSSPVSLKPEEEHQTDEKQFQIEKWQIARCNKSKPQKFINDLMQVLYTNEYMATHSLTGAKSSTSRDKAVKPAMNQNEVQEIIGVTKQLFPNTDDVSIRRMIGQKLNNCTKKPNLSKNLNSQDIK

SEQ ID NO: 747343 - protein, 181 aa, Homo sapiens
MLLPQAVTQFEELVGMAEALLKGGGTMSTSASTLWRATNNSSPDSFASTCSNSNSNSSSPVSLKPEEEHQTDEKQFQIEKWQIARCNKSKPQKFINDLMQVLYTNEYMATHSLTGAKSSTSRDKAVKPAMNQNEVQEIIGVTKQLFPNTDDVSIRRMIGQKLNNCTKKPNLSKNLNSQDIK

SEQ ID NO: 747344 - protein, 129 aa, Homo sapiens
MQKIVQTDEITNTQAFRKGKRKRTETMDSENANSDMDKGQRDPYSGNAFLPGESSSEDEEPLAELSKEELCAKIKSLKEKLTNTRKENSRLRQSLVMLQGNKLDITTEKTILHGGMKTLNVVTTSSHPV

SEQ ID NO: 747345 - protein, 175 aa, Homo sapiens
MQKIVQTDEITNTQAFRKGKRKRTETMDSENANSDMDKGQRDPYSGNAFLPGESSSEDEEPLAELSKEELCAKIKSLKEKLTNTRKENSRLRQSLVMLQVLPQAVTQFEELVGMAEALLKGGGTMSTSASTLWRATNNSSPDSFASTCSNSNSNSSSPVSLKPEEEHQTDEKQFR

SEQ ID NO: 747346 - protein, 213 aa, Homo sapiens
MDPLQKRNPASPSKSSPMTAAETSQEGPAPSQPSYSEQPMMGLSNLSPGPGPSQAVPLPEGLLRQRYREEKTLEERRWERLEFLQRKKAFLRHVRRRHRDHMAPYAVGREARISPLGDRSQNRFRCECRYCQSHRPNLSGIPGESNRAPHPSSWETLVQGLSGLTLSLGTNQPGPLPEAALQPQETEEKRQRERQQESKIMFQRLLKQWLEEN

SEQ ID NO: 747347 - protein, 213 aa, Homo sapiens; identical to SEQ ID NO: 747346

SEQ ID NO: 747348 - protein, 213 aa, Homo sapiens; identical to SEQ ID NO: 747346

SEQ ID NO: 747349 - protein, 213 aa, Homo sapiens; identical to SEQ ID NO: 747346

SEQ ID NO: 747350 - protein, 213 aa, Homo sapiens; identical to SEQ ID NO: 747346

SEQ ID NO: 747351 - protein, 213 aa, Homo sapiens; identical to SEQ ID NO: 747346

SEQ ID NO: 747352 - protein, 213 aa, Homo sapiens; identical to SEQ ID NO: 747346

SEQ ID NO: 747353 - protein, 213 aa, Homo sapiens; identical to SEQ ID NO: 747346

SEQ ID NO: 747354 - protein, 213 aa, Homo sapiens; identical to SEQ ID NO: 747346

SEQ ID NO: 747355 - protein, 213 aa, Homo sapiens; identical to SEQ ID NO: 747346

SEQ ID NO: 747356 - protein, 213 aa, Homo sapiens; identical to SEQ ID NO: 747346

SEQ ID NO: 747357 - protein, 159 aa, Homo sapiens
MDPLQKRNPASPSKSSPMTAAETSQEGPAPSQPSYSEQPMMGLSNLSPGPGPSQAVPLPEGLLRQRYREEKTLEERRWERLEFLQRKKAFLRHVRRRHRDHMAPYAVGREARISPLGDRSQNRFRCECRYCQSHTAEQLWESMTRSTADTTLPVALVEL

SEQ ID NO: 747358 - protein, 124 aa, Homo sapiens [sequence omitted]

SEQ ID NO: 747359 - protein, 124 aa, Homo sapiens [sequence omitted]

SEQ ID NO: 747360 - protein, 80 aa, Homo sapiens
RTGTTIAELKFRQRERGGCVAFDTVEFFGYSPTDSPKGAGDATPAKFALVICFTPSRQREQLEKSRRLSRSNMAQMPQGH

SEQ ID NO: 747361 - protein, 213 aa, Homo sapiens; identical to SEQ ID NO: 747346

SEQ ID NO: 747362 - protein, 213 aa, Homo sapiens; identical to SEQ ID NO: 747346

SEQ ID NO: 747363 - protein, 213 aa, Homo sapiens; identical to SEQ ID NO: 747346

SEQ ID NO: 747364 - protein, 213 aa, Homo sapiens; identical to SEQ ID NO: 747346

SEQ ID NO: 747365 - protein, 213 aa, Homo sapiens; identical to SEQ ID NO: 747346

SEQ ID NO: 747366 - protein, 213 aa, Homo sapiens; identical to SEQ ID NO: 747346

SEQ ID NO: 747367 - protein, 213 aa, Homo sapiens; identical to SEQ ID NO: 747346

SEQ ID NO: 747368 - protein, 102 aa, Homo sapiens [sequence omitted]

SEQ ID NO: 747369 - protein, 126 aa, Homo sapiens
TLANLHKKTIFIFIVTKKARIISFNPYTIIMKWVILYSQKEVNHFLFSTDTTSSGGCISVSYWRHFLFLQILFLTVKVACYSYKQSIKPKRAFINHLHLHFFLTVDGFKKPFQDEILQVFFMSSEG

SEQ ID NO: 747370 - protein, 45 aa, Homo sapiens
QRRDMIKVMYQIVRRRRRNSSSGIIILSSVIHHIDIDMTRAGFLN

SEQ ID NO: 747371 - protein, 111 aa, Homo sapiens
PGYAGRTELPENLKALFRPCAMVAPDIELICEILLVAEGFVDARALARKFITLYTLCKELLSKQDHYDWGLRAIKSVLVVAGSLKRGDKNRPEDQVLHESIKGFQYAQNSD

SEQ ID NO: 747372 - protein, 71 aa, Homo sapiens
VLILVPISQDWLSLSQDTTWHSATSAKEMRNLRGNKCEEEDDSRGPEIQGKDRGPRMVHCREDRLKDLGTG

SEQ ID NO: 747373 - protein, 107 aa, Homo sapiens
MCLCCLLQKSKNGSNVVDALSLESSESSPSLVIGSRSTTGSRMHRQYAGPYSQDRDCSAWATERDSVSKKKKKIIRENGSSSLLIEALSNSSHKCQADIRHILNKNG

SEQ ID NO: 747374 - protein, 297 aa, Homo sapiens
MSAWAAASLSRAAARCLLARGPGVRAAPPRDPRPSHPEPRGCGAAPGRTLHFTAAVPAGHNKWSKVRHIKGPKDVERSRIFSKLCLNIRLAVKEGGPNPEHNSNLANILEVCRSKHMPKSTIETALKMEKSKDTYLLYEGRGPGGSSLLIEALSNSSHKCQADIRHILNKNGGVMAVGARHSFDKKGVIVVEVEDREKKAVNLERALEMAIEAGAEDVKETEDEEERNVFKFICDASSLHQVRKKLDSLGLCSVSCALEFIPNSKVQLAEPDLEQAAHLIQALSNHEDVIHVYDNIE

SEQ ID NO: 747375 - protein, 130 aa, Homo sapiens
MNKNGGVMAVGARHSFDKKGVIVVEVEDREKKAVNLERALEMAIEAGAEDVKETEDEEERNVFKFICDASSLHQVRKKLDSLGLCSVSCALEFIPNSKVQLAEPDLEQAAHLIQALSNHEDVIHVYDNIE

SEQ ID NO: 747376 - protein, 124 aa, Homo sapiens
MSAWAAASLSRAAARCLLARGPGVRAAPPRDPRPSHPEPRGCGAAPGRTLHFTAAVPAGHNKWSKVRHIKGPKDVERSRIFSKLCLNIRLAVKACQLCCCLRAIWMSVPTPSRMQGRTTQLVRL

SEQ ID NO: 747377 - protein, 130 aa, Homo sapiens
MLAGTRPRGQGGSSARPPALPPRAPGLRCRSGQDAALYRGCPRRAQQVVQSQAHQGSEGRRKESHLLQTLFEHPPGSESRRPKDRTCDLEAKGISLVGPPCQLCCCLRAIWMSVPTPSRMQGRTTQLVRL

SEQ ID NO: 747378 - protein, 145 aa, Homo sapiens
MELHFLSDGYMLLGGGWVSGPMSAWAAASLSRAAARCLLARGPGVRAAPPRDPRPSHPEPRGCGAAPGRTLHFTAAVPAGHNKWSKVRHIKGPKDVERSRIFSKLCLNIRLAVKACQLCCCLRAIWMSVPTPSRMQGRTTQLVRL

SEQ ID NO: 747379 - protein, 303 aa, Homo sapiens
RAPSPGCRGDSVGSLAVEPPRAGPSLWISGDRHRRPRGPELLVPAVEETRRRWPLLHFTAAVPAGHNKWSKVRHIKGPKDVERSRIFSKLCLNIRLAVKEGGPNPEHNSNLANILEVCRSKHMPKSTIETALKMEKSKDTYLLYEGRGPGGSSLLIEALSNSSHKCQADIRHILNKNGGVMAVGARHSFDKKGVIVVEVEDREKKAVNLERALEMAIEAGAEDVKETEDEEERNVFKFICDASSLHQVRKKLDSLGLCSVSCALEFIPNSKVQLAEPDLEQAAHLIQALSNHEDVIHVYDNIE

SEQ ID NO: 747380 - protein, 181 aa, Homo sapiens
MPKSTIETALKMEKSKDTYLLYEGRGPGGSSLLIEALSNSSHKCQADIRHILNKNGGVMAVGARHSFDKKGVIVVEVEDREKKAVNLERALEMAIEAGAEDVKETEDEEERNVFKFICDASSLHQVRKKLDSLGLCSVSCALEFIPNSKVQLAEPDLEQAAHLIQALSNHEDVIHVYDNIE

SEQ ID NO: 747381 - protein, 232 aa, Homo sapiens
MCLCCLLQKSKNGSNVVDALSLESSESSPSLVIGSRSTTGSRMHRQYAGPYSQDRDCSAWATERDSVSKKKKKIIRENGSSSLLIEALSNSSHKCQADIRHILNKNGGVMAVGARHSFDKKGVIVVEVEDREKKAVNLERALEMAIEAGAEDVKETEDEEERNVFKFICDASSLHQVRKKLDSLGLCSVSCALEFIPNSKVQLAEPDLEQAAHLIQALSNHEDVIHVYDNIE

SEQ ID NO: 747382 - protein, 166 aa, Homo sapiens
MSAWAAASLSRAAARCLLARGPGVRAAPPRDPRPSHPEPRGCGAAPGRTLHFTAAVPAGHNKWSKVRHIKGPKDVERSRIFSKLCLNIRLAVKEGGPNPEHNSNLANILEVCRSKHMPKSTIETALKMEKSKDTYLLYEGRGPGGSSLLIEALSNSSHKCQADLRP

SEQ ID NO: 747383 - protein, 172 aa, Homo sapiens
RAPSPGCRGDSVGSLAVEPPRAGPSLWISGDRHRRPRGPELLVPAVEETRRRWPLLHFTAAVPAGHNKWSKVRHIKGPKDVERSRIFSKLCLNIRLAVKEGGPNPEHNSNLANILEVCRSKHMPKSTIETALKMEKSKDTYLLYEGRGPGGSSLLIEALSNSSHKCQADLRP

SEQ ID NO: 747384 - protein, 134 aa, Homo sapiens
MKSLTWILGLWALAACFTPGESQRGPRGPYPPGPLAPPPPPCFPFGTGFVPPPHPPPYGPGRFPPPLSPPYGPGRIPPSPPPPYGPGRIQSHSLPPPYGPGYPQPPSQPRPYPPGPPFFPVNSPTDPALPTPAP

SEQ ID NO: 747385 - protein, 333 aa, Homo sapiens
MESSGNPESTTFFYYDLQSQPCENQAWVFATLATTVLYCLVFLLSLVGNSLVLWVLVKYESLESLTNIFILNLCLSDLVFACLLPVWISPYHWGWVLGDFLCKLLNMIFSISLYSSIFFLTIMTIHRYLSVVSPLSTLRVPTLRCRVLVTMAVWVASILSSILDTIFHKVLSSGCDYSELTWYLTSVYQHNLFFLLSLGIILFCYVEILRTLFRSRSKRRHRTVKLIFAIVVAYFLSWGPYNFTLFLQTLFRTQIIRSCEAKQQLEYALLICRNLAFSHCCFNPVLYVFVGVKFRTHLKHVLRQFWFCRLQAPSPASIPHSPGAFAYEGASFY

SEQ ID NO: 747386 - protein, 139 aa, Homo sapiens [sequence omitted]

SEQ ID NO: 747387 - protein, 139 aa, Homo sapiens
RIEPVPPTSPTVRVRLHPFHVIRINKMLSCAGADRLQTGMRGAFGKPQGTVARVHIGQVIMSIRTKLQNKEHVIEALRRAKFKFPGRQKIHISKKWGFTKFNADEFEDMVAEKRLIPDGCGVKYIPSRGPLDKWRALHS

SEQ ID NO: 747388 - protein, 128 aa, Homo sapiens
SRKGKLKRTLKREFKMLSCAGADRLQTGMRGAFGKPQGTVARVHIGQVIMSIRTKLQNKEHVIEALRRAKFKFPGRQKIHISKKWGFTKFNADEFEDMVAEKRLIPDGCGVKYIPSRGPLDKWRALHS

SEQ ID NO: 747389 - protein, 105 aa, Homo sapiens
MKSKCRIFFFLKDICALSLRCATEDPGVAMGRRPACCYRYCKNKPYPKSRFCRGVPDAKIRIFDLGRKKAKVDEFPLCGHMVSDEYEQLSSEAWRLPEFVPISTW

SEQ ID NO: 747390 - protein, 105 aa, Homo sapiens; identical to SEQ ID NO: 747389

SEQ ID NO: 747391 - protein, 412 aa, Homo sapiens
MGSPWNGSDGPEGAREPPWPALPPCDERRCSPFPLGALVPVTAVCLCLFVVGVSGNVVTVMLIGRYRDMRTTTNLYLGSMAVSDLLILLGLPFDLYRLWRSRPWVFGPLLCRLSLYVGEGCTYATLLHMTALSVERYLAICRPLRARVLVTRRRVRALIAVLWAVALLSAGPFLFLVGVEQDPGISVVPGLNGTARIASSPLASSPPLWLSRAPPPSPPSGPETAEAAALFSRECRPSPAQLGALRVMLWVTTAYFFLPFLCLSILYGLIGRELWSSRRPLRGPAASGRERGHRQTVRVLLVVVLAFIICWLPFHVGRIIYINTEDSRMMYFSQYFNIVALQLFYLSASINPILYNLISKKYRAAAFKLLLARKSRPRGFHRSRDTAGEVAGDTGGDTVGYTETSANVKTMG

SEQ ID NO: 747392 - protein, 373 aa, Homo sapiens [sequence omitted]

SEQ ID NO: 747393 - protein, 309 aa, Homo sapiens
MGFVLLRLSAHPELEKTFFVLILLMYLVILLGNGVLILVTILDSRLHTPMYFFLGNLSFLDICFTTSSVPLVLDSFLTPQETISFSACAVQMALSFAMAGTECLLLSMMAFDRYVAICNPLRYSVIMSKAAYMPMAASSWAIGGAASVVHTSLAIQLPFCGDNVINHFTCEILAVLKLACADISINVISMEVTNVIFLGVPVLFISFSYVFIITTILRIPSAEGRKKVFSTCSAHLTVVIVFYGTLFFMYGKPKSKDSMGADKEDLSDKLIPLFYGVVTPMLNPIIYSLRNKDVKAAVRRLLRPKGFTQ

SEQ ID NO: 747394 - protein, 505 aa, Homo sapiens
GLTLFFVVLGSLSVQVFSFRWFVHDFSTEDSATAAAASSCPQPGADCKTVVGGGSAAGEGEARPSTPQRQASNASKSNIAAANSGSNSSGATRASGKHRSASCSFCIWLLQSLIHILQLGQIWRYFHTIYLGIRSRQSGENDRWRFYWKMVYEYADVSMLHLLATFLESAPQLVLQLCIIVQTHSLQALQGFTAAASLVSLAWALASYQKALRDSRDDKKPISYMAVIIQFCWHFFTIAARVITFALFASVFQLYFGIFIVLHWCIMTFWIVHCETEFCITKWEEIVFDMVVGIIYIFSWFNVKEGRTRCRLFIYYFVILLENTALSALWYLYKAPQIADAFAIPALCVVFSSFLTGVVFMLMYYAFFHPNGPRFGQSPSCACEDPAAAFTLPPDVATSTLRSISNNRSVVSDRDQKFAERDGCVPVFQVRPTAPSTPSSRPPRIEESVIKIDLFRNRYPAWERHVLDRSLRKAILAFECSPSPPRLQYKDDALIQERLEYETTL

SEQ ID NO: 747395 - protein, 439 aa, Homo sapiens
MPAPQRKHRRGGFSHRCFPTPQTAMTPQPAGPPDGGWGWVVAAAAFAINGLSYGLLRSLGLAFPDLAEHFDRSAQDTAWISALALAVQQAASPVGSALSTRWGARPVVMVGGVLASLGFVFSAFASDLLHLYLGLGLLAGFGWALVFAPALGTLSRYFSRRRVLAVGLALTGNGASSLLLAPALQLLLDTFGWRGALLLLGAITLHLTPCGALLLPLVLPGDPPAPPRSPLAALGLSLFTRRAFSIFALGTALVGGGYFVPYVHLAPHALDRGLGGYGAALVVAVAAMGDAGARLVCGWLADQGWVPLPRLLAVFGALTGLGLWVVGLVPVVGGEESWGGPLLAAAVAYGLSAGSYAPLVFGVLPGLVGVGGVVQATGLVMMLMSLGGLLGPPLSGFLRDETGDFTASFLLSGSLILSGSFIYIGLPRALPSCGPASPP

SEQ ID NO: 747396 - protein, 83 aa, Homo sapiens
GQGEEPLVRGRQTANEKCWREFGGPGACLPLTPPLSGPVGSALSTRWGARPVVMVGGVLASLGFVFSAFASDLLHLYLGLGLL

SEQ ID NO: 747397 - protein, 152 aa, Homo sapiens
LDSILKVAKKERTMSSLPVPYKLPVSLSVGSCVIIKGTPIHSFINDPQLQVDFYTDMDEDSDIAFRFRVHFGNHVVMNRREFGIWMLEETTDYVPFEDGKQFELCIYVHYNEYEIKVNGIRIYGFVHRIPPSFVKMVQVSRDISLTSVCVCN

SEQ ID NO: 747398 - protein, 126 aa, Homo sapiens
LDSILKVAKKEEQCLLYPNDPQLQVDFYTDMDEDSDIAFRFRVHFGNHVVMNRREFGIWMLEETTDYVPFEDGKQFELCIYVHYNEYEIKVNGIRIYGFVHRIPPSFVKMVQVSRDISLTSVCVCN

SEQ ID NO: 747399 - protein, 93 aa, Homo sapiens
YTQVPNTILNTGTTHRYHSTTHKYSLSAVPTQALPTGTTHSAKHRYCTQVPSTVLHTSTAHSTKQYCTQVSCTVPNTVLHTVHKQSTAHRYSL

SEQ ID NO: 747400 - protein, 104 aa, Homo sapiens
ELLGELWAGRTRVPPQGLELADREGQDPGRWPRTTPPVLEATSQVMWKPVLLPEALKLAPGVSMWNRSTQVLLSSGVPEQEDKEGSTFPPVEQHPIQTGAPKPR

SEQ ID NO: 747401 - protein, 681 aa, Homo sapiens
RLPAGRWIPADPRAESTAHRAEPGQTEPRRASQRASARGRADRSEPSGAGRGAPCRALRGVPRRPRAPAPGHEPLRDSALSPPPVQRPRTRRRLPACRSPLRIPSTRMELKAEEEEVGGVQPVSIQAFASSSTLHGLAHIFSYERLSLKRALWALCFLGSLAVLLCVCTERVQYYFHYHHVTKLDEVAASQLTFPAVTLCNLNEFRFSQVSKNDLYHAGELLALLNNRYEIPDTQMADEKQLEILQDKANFRSFKPKPFNMREFYDRAGHDIRDMLLSCHFRGEVCSAEDFKVVFTRYGKCYTFNSGRDGRPRLKTMKGGTGNGLEIMLDIQQDEYLPVWGETDETSFEAGIKVQIHSQDEPPFIDQLGFGVAPGFQTFVACQEQRLIYLPPPWGTCKAVTMDSDLDFFDSYSITACRIDCETRYLVENCNCRMVHMPGDAPYCTPEQYKECADPALDFLVEKDQEYCVCEMPCNLTRYGKELSMVKIPSKASAKYLAKKFNKSEQYIGENILVLDIFFEVLNYETIEQKKAYEIAGLLGELLMTPVPFSCHGHGVAPYHPKAGCSLLSHEGPPPQRPFPKPCCLGDIGGQMGLFIGASILTVLELFDYAYEVIKHKLCRRGKCQKEAKRSSADKGVALSLDDVKRHNPCESLRGHPAGMTYAANILPHHPARGTFEDFTC

SEQ ID NO: 747402 - protein, 635 aa, Homo sapiens
RLPAGRWIPADPRAESTAHRAEPGQTEPRRASQRASARGRADRSEPSGAGRGAPCRALRGVPRRPRAPAPGHEPLRDSALSPPPVQRPRTRRRLPACRSPLRIPSTRMELKAEEEEVGGVQPVSIQAFASSSTLHGLAHIFSYERLSLKRALWALCFLGSLAVLLCVCTERVQYYFHYHHVTKLDEVAASQLTFPAVTLCNLNEFRFSQVSKNDLYHAGELLALLNNRYEIPDTQMADEKQLEILQDKANFRSFKPKPFNMREFYDRAGHDIRDMLLSCHFRGEVCSAEDFKVVFTRYGKCYTFNSGRDGRPRLKTMKGGTGNGLEIMLDIQQDEYLPVWGETDETSFEAGIKVQIHSQDEPPFIDQLGFGVAPGFQTFVACQEQRLIYLPPPWGTCKAVTMDSDLDFFDSYSITACRIDCETRYLVENCNCRMVHMPGDAPYCTPEQYKECADPALDFLVEKDQEYCVCEMPCNLTRYGKELSMVKIPSKASAKYLAKKFNKSEQYIGENILVLDIFFEVLNYETIEQKKAYEIAGLLGDIGGQMGLFIGASILTVLELFDYAYEVIKHKLCRRGKCQKEAKRSSADKGVALSLDDVKRHNPCESLRGHPAGMTYAANILPHHPARGTFEDFTC

SEQ ID NO: 747403 - protein, 681 aa, Homo sapiens; identical to SEQ ID NO: 747401

SEQ ID NO: 747404 - protein, 635 aa, Homo sapiens; identical to SEQ ID NO: 747402

SEQ ID NO: 747405 - protein, 349 aa, Homo sapiens
RLPAGRWIPADPRAESTAHRAEPGQTEPRRASQRASARGRADRSEPSGAGRGAPCRALRGVPRRPRAPAPGHEPLRDSALSPPPVQRPRTRRRLPACRSPLRIPSTRMELKAEEEEVGGVQPVSIQAFASSSTLHGLAHIFSYERLSLKRALWALCFLGSLAVLLCVCTERVQYYFHYHHVTKLDEVAASQLTFPAVTLCNLNEFRFSQVSKNDLYHAGELLALLNNRYEIPDTQMADEKQLEILQDKANFRSFKPKPFNMREFYDRAGHDIRDMLLSCHFRGEVCSAEDFKVLHTLWKVLHVLGHHNGSSPGRVVSVVSMQPFLAKFLDLIDSNELLEDIVIKASDFK

SEQ ID NO: 747406 - protein, 129 aa, Homo sapiens
VIKHKLCRRGKCQKEAKRSSADKGVALSLDDVKRHVRERARAPSSPPVPPPPQEPRPPPPTRLCHHLLSFASRMPQHYLKPFRGITRPCPVPFPQNPCESLRGHPAGMTYAANILPHHPARGTFEDFTC

SEQ ID NO: 747407 - protein, 77 aa, Homo sapiens
MDSDLDFFDSYSITACRIDCETRYLVENCNCRMVHMPGQAWGSEHTPGVPGPLLPFTSSPSISISQPQFQPTPSHTH

SEQ ID NO: 747408 - protein, 319 aa, Homo sapiens
MKGGTGNGLEIMLDIQQDEYLPVWGETDETSFEAGIKVQIHSQDEPPFIDQLGFGVAPGFQTFVACQEQRLIYLPPPWGTCKAVTMDSDLDFFDSYSITACRIDCETRYLVENCNCRMVHMPGDAPYCTPEQYKECADPALDFLVEKDQEYCVCEMPCNLTRYGKELSMVKIPSKASAKYLAKKFNKSEQYIGENILVLDIFFEVLNYETIEQKKAYEIAGLLGDIGGQMGLFIGASILTVLELFDYAYEVIKHKLCRRGKCQKEAKRSSADKGVALSLDDVKRHNPCESLRGHPAGMTYAANILPHHPARGTFEDFTC

SEQ ID NO: 747409 - protein, 210 aa, Homo sapiens
RLPAGRWIPADPRAESTAHRAEPGQTEPRRASQRASARGRADRSEPSGAGRGAPCRALRGVPRRPRAPAPGHEPLRDSALSPPPVQRPRTRRRLPACRSPLRIPSTRMELKAEEEEVGGVQPVSIQAFASSSTLHGLAHIFSYERLSLKRALWALCFLGSLAVLLCVCTERVQYYFHYHHVTKLDEVAASQLTFPAVTLCNLNEFREPKA

SEQ ID NO: 747410 - protein, 76 aa, Homo sapiens
LVLDIFFEVLNYETIEQKKAYEIAGLLGELLMTPVPFSCHGHGVAPYHPKAGCSLLSHEGPPPQRPFPKPCCLGKW

SEQ ID NO: 747411 - protein, 407 aa, Homo sapiens
LNSSAQERLIPLGHASKSAPMNGHCFAENGPSQKSSLPPLLIPPSENLGPHEEDQVVCGFKKLTVNGVCASTPPLTPIKNSPSLFPCAPLCERGSRPLPPLPISEALSLDDTDCEVEFLTSSDTDFLLEDSTLSDFKYDVPGRRSFRGCGQINYAYFDTPAVSAADLSYVSDQNGGVPDPNPPPPQTHRRLRRSHSGPAGSFNKPAIRISNCCIHRASPNSDEDKPEVPPRVPIPPRPVKPDYRRWSAEVTSSTYSDEDRPPKVPPREPLSPSNSRTPSPKSLPSYLNGVMPPTQSFAPDPKYVSSKALQRQNSEGSASKVPCILPIIENGKKVSSTHYYLLPERPPYLDKYEKFFREAEETNGGAQIQPLPADCGISSATEKPDSKTKMDLGGHVKRKHLSYVVSP

SEQ ID NO: 747412 - protein, 271 aa, Homo sapiens
TKGITGFLVFVSFFFGDGVSLCHPGWRSVVARSWLTTSSAPQVHTILPPQTHRRLRRSHSGPAGSFNKPAIRISNCCIHRASPNSDEDKPEVPPRVPIPPRPVKPDYRRWSAEVTSSTYSDEDRPPKVPPREPLSPSNSRTPSPKSLPSYLNGVMPPTQSFAPDPKYVSSKALQRQNSEGSASKVPCILPIIENGKKVSSTHYYLLPERPPYLDKYEKFFREAEETNGGAQIQPLPADCGISSATEKPDSKTKMDLGGHVKRKHLSYVVSP

SEQ ID NO: 747413 - protein, 360 aa, Homo sapiens [sequence omitted]

SEQ ID NO: 747414 - protein, 306 aa, Homo sapiens
ETIFVRRGSRCFLGSGYARKDIGSNRGVPQGSWELEEPRTPPSSGFELLCPWVKRPCSACELLPGRAAMALRNVPFRSEVLGWDPDSLADYFKKLNYKDCEKAVKKYHIDGARFLNLTENDIQKFPKLRVPILSKLSQEINKNEERRSIFTRKPQVPRFPEETESHEEDNGGWSSFEEDDYESPNDDQDGEDDGDYESPNEEEEAPVEDDADYEPPPSNDEEALQNSILPAKPFPNSNSMYIDRPPSGKTPQQPPVPPQRPMAALPPPPAGRNHSPLPHPQPRSRSRTTNGKPPAPKDRARNPPER

SEQ ID NO: 747415 - protein, 295 aa, Homo sapiens
ALLRAEHNLETQRLWVKLKRVRRSEDEATPPSSGFELLCPWVKRPCSACELLPGRAAMALRNVPFRSEVLGWDPDSLADYFKKLNYKDCEKAVKKYHIDGARFLNLTENDIQKFPKLRVPILSKLSQEINKNEERRSIFTRKPQVPRFPEETESHEEDNGGWSSFEEDDYESPNDDQDGEDDGDYESPNEEEEAPVEDDADYEPPPSNDEEALQNSILPAKPFPNSNSMYIDRPPSGKTPQQPPVPPQRPMAALPPPPAGRNHSPLPHPQPRSRSRTTNGKPPAPKDRARNPPER

SEQ ID NO: 747416 - protein, 363 aa, Homo sapiens
VLSTTVNVDGHVLAVSDNMFVHNNSKHGRRARRLDPSEATPCIKAISPSEGWTTGGAMVIIIGDNFFDGLQVVFGTMLVWSELITPHAIRVQTPPRHIPGVVEVTLSYKSKQFCKGAPGRFIYTALNEPTIDYGFQRLQKVIPRHPGDPERLAKEMLLKRAADLVEALYGTPHNNQDIILKRAADIAEALYSVPRNPSQLPALSSSPAHSGMMGINSYGSQLGVSISESTQGNNQGYIRNTSSISPRGYSSSSTPQQSNYSTSSNSMNGYSNVPMANLGVPGSPGFLNGSPTGSPYGIMSLSPTVGSSSTSSILPFSSSVFPAVKQKSAFAPVIRPQGSPSPACSSGNGNGFRAMTGLVVPPM

SEQ ID NO: 747417 - protein, 135 aa, Homo sapiens
VLSTTVNVDGHVLAVSDNMFVHNNSKHGRRARRLDPSEGRAACAQHSRHMKFSTNFLVRTSNLCLGVRAEKVHRTMWVFFFLNEVVNTDSSLLHCKAHTSTSPCQVLMPPTLFHPVLCFPFCETGISGKHRPMTS

SEQ ID NO: 747418 - protein, 80 aa, Homo sapiens
HIEVSLLGRTGSHDYEQKSHNRLLASWGKTEARSVTQSKSKSLKTREADCVGLGLRMKPCNPPGGRWCKSQSPKAKDQEV

SEQ ID NO: 747419 - protein, 424 aa, Homo sapiens
MASMPPTPEAQGPILFEDLAVYFSQEECVTLHPAQRSLSKDGTKESLEDAALMGEEGKPEINQQLSLESMELDELALEKYPIAAPLVPYPEKSSEDGVGNPEAKILSGTPTYKRRVISLLVTIENHTPLVELSEYLGTNTLSEILDSPWEGAKNVYKCPECDQNFSDHSYLVLHQKIHSGEKKHKCGDCGKIFNHRANLRTHRRIHTGEKPYKCAKCSASFRQHSHLSRHMNSHVKEKPYTCSICGRGFMWLPGLAQHQKSHSAENTYESTNCDKHFNEKPNLALPEETFVSGPQYQHTKCMKSFRQSLYPALSEKSHDEDSERCSDDGDNFFSFSKFKPLQCPDCDMTFPCFSELISHQNIHTEERPHKCKTCEESFALDSELACHQKSHMLAEPFKCTVCGKTFKSNLHLITHKRTHIKNTT

SEQ ID NO: 747420 - protein, 435 aa, Homo sapiens
MGDWSFLGRLLENAQEHSTVIGKVWLTVLFIFRILVLGAAAEDVWGDEQSDFTCNTQQPGCENVCYDRAFPISHIRFWALQIIFVSTPTLIYLGHVLHIVRMEEKKKEREEEEQLKRESPSPKEPPQDNPSSRDDRGRVRMAGALLRTYVFNIIFKTLFEVGFIAGQYFLYGFELKPLYRCDRWPCPNTVDCFISRPTEKTIFIIFMLAVACASLLLNMLEIYHLGWKKLKQGVTSRLGPDASEAPLGTADPPPLPPSSRPPAVAIGFPPYYAHTAAPLGQARAVGYPGAPPPAADFKLLALTEARGKGQSAKLYNGHHHLLMTEQNWANQAAERQPPALKAYPAASTPAAPSPVGSSSPPLAHEAEAGAAPLLLDGSGSSLEGSALAGTPEEEEQAVTTAAQMHQPPLPLGDPGRASKASRASSGRARPEDLAI

SEQ ID NO: 747421 - protein, 321 aa, Homo sapiens
MSLQKLMEPEAGTNRTAVAEFILLGLVQTEEMQPVVFVLLLFAYLVTIGGNLSILAAVLVEPKLHAPMYFFLGNLSVLDVGCITVTVPAMLGRLLSHKSTISYDACLSQLFFFHLLAGMDCFLLTAMAYDRLLAICQPLTYSTRMSQTVQRMLVAASWACAFTNALTHTVAMSTLNFCGPNEVNHFYCDLPQLFQLSCSSTQLNELLLFVAAAFMAVAPLVFISVSYAHVVAAVLQIRSAEGRKKAFSTCGSHLTVVGIFYGTGVFSYMRLGSVESSDKDKGVGVFMTVINPMLNPLIYSLRNTDVQGALCQLLVGERSLT

SEQ ID NO: 747422 - protein, 129 aa, Homo sapiens
LKLLNKLGSLFSKEIMFSVRPPKKSWKKIFNLSGGEKTLSSLALVFALHHYKPTPLYFMDEIDAALDFKNVSIVAFYIYEQTKNAQFIIISLRNNMFEISDRLIGIYKTYNITKSVAVNPKEIASKGLC

SEQ ID NO: 747423 - protein, 1288 aa, Homo sapiens
MPRKGTQPSTARRREEGPPPPSPDGASSDAEPEPPSGRTESPATAAETASEELDNRSLEEILNSIPPPPPPAMTNEAGAPRLMITHIVNQNFKSYAGEKILGPFHKRFSCIIGPNGSGKSNVIDSMLFVFGYRAQKIRSKKLSVLIHNSDEHKDIQSCTVEVHFQKIIDKEGDDYEVIPNSNFYVSRTACRDNTSVYHISGKKKTFKDVGNLLRSHGIDLDHNRFLILQGEVEQIAMMKPKGQTEHDEGMLEYLEDIIGCGRLNEPIKVLCRRVEILNEHRGEKLNRVKMVEKEKDALEGEKNIAIEFLTLENEIFRKKNHVCQYYIYELQKRIAEMETQKEKIHEDTKEINEKSNILSNEMKAKNKDVKDTEKKLNKITKFIEENKEKFTQLDLEDVQVREKLKHATSKAKKLEKQLQKDKEKVEEFKSIPAKSNNIINETTTRNNALEKEKEKEEKKLKEVMDSLKQETQGLQKEKESREKELMGFSKSVNEARSKMDVAQSELDIYLSRHNTAVSQLTKAKEALIAASETLKERKAAIRDIEGKLPQTEQELKEKEKELQKLTQEETNFKSLVHDLFQKVEEAKSSLAMNRSRGKVLDAIIQEKKSGRIPGIYGRLGDLGAIDEKYDVAISSCCHALDYIVVDSIDIAQECVNFLKRQNIGVATFIGLDKMAVWAKKMTEIQTPENTPRLFDLVKVKDEKIRQAFYFALRDTLVADNLDQATRVAYQKDRRWRVVTLQGQIIEQSGTMTGGGSKVMKGRMGSSLVIEISEEEVNKMESQLQNDSKKAMQIQEQKVQLEERVVKLRHSEREMRNTLEKFTASIQRLIEQEEYLNVQVKELEANVLATAPDKKKQKLLEENVSAFKTEYDAVAEKAGKVEAEVKRLHNTIVEINNHKLKAQQDKLDKINKQLDECASAITKAQVAIKTADRNLQKAQDSVLRTEKEIKDTEKEVDDLTAELKSLEDKAAEVVKNTNAAEESLPEIQKEHRNLLQELKVIQENEHALQKDALSIKLKLEQIDGHIAEHNSKIKYWHKEISKISLHPIEDNPIEEISVLSPEDLEAIKNPDSITNQIALLEARCHEMKPNLGAIAEYKKKEELYLQRVAELDKITYERDSFRQAYEDLRKQRLNEFMAGFYIITNKLKENYQMLTLGGDAELELVDSLDPFSEGIMFSVRPPKKSWKKIFNLSGGEKTLSSLALVFALHHYKPTPLYFMDEIDAALDFKNVSIVAFYIYEQTKNAQFIIISLRNNMFEISDRLIGIYKTYNITKSVAVNPKEIASKGLC

SEQ ID NO: 747424 - protein, 1288 aa, Homo sapiens; identical to SEQ ID NO: 747423

SEQ ID NO: 747425 - protein, 1288 aa, Homo sapiens; identical to SEQ ID NO: 747423

SEQ ID NO: 747426 - protein, 1288 aa, Homo sapiens; identical to SEQ ID NO: 747423

SEQ ID NO: 747427 - protein, 1216 aa, Homo sapiens
MTNEAGAPRLMITHIVNQNFKSYAGEKILGPFHKRFSCIIGPNGSGKSNVIDSMLFVFGYRAQKIRSKKLSVLIHNSDEHKDIQSCTVEVHFQKIIDKEGDDYEVIPNSNFYVSRTACRDNTSVYHISGKKKTFKDVGNLLRSHGIDLDHNRFLILQGEVEQIAMMKPKGQTEHDEGMLEYLEDIIGCGRLNEPIKVLCRRVEILNEHRGEKLNRVKMVEKEKDALEGEKNIAIEFLTLENEIFRKKNHVCQYYIYELQKRIAEMETQKEKIHEDTKEINEKSNILSNEMKAKNKDVKDTEKKLNKITKFIEENKEKFTQLDLEDVQVREKLKHATSKAKKLEKQLQKDKEKVEEFKSIPAKSNNIINETTTRNNALEKEKEKEEKKLKEVMDSLKQETQGLQKEKESREKELMGFSKSVNEARSKMDVAQSELDIYLSRHNTAVSQLTKAKEALIAASETLKERKAAIRDIEGKLPQTEQELKEKEKELQKLTQEETNFKSLVHDLFQKVEEAKSSLAMNRSRGKVLDAIIQEKKSGRIPGIYGRLGDLGAIDEKYDVAISSCCHALDYIVVDSIDIAQECVNFLKRQNIGVATFIGLDKMAVWAKKMTEIQTPENTPRLFDLVKVKDEKIRQAFYFALRDTLVADNLDQATRVAYQKDRRWRVVTLQGQIIEQSGTMTGGGSKVMKGRMGSSLVIEISEEEVNKMESQLQNDSKKAMQIQEQKVQLEERVVKLRHSEREMRNTLEKFTASIQRLIEQEEYLNVQVKELEANVLATAPDKKKQKLLEENVSAFKTEYDAVAEKAGKVEAEVKRLHNTIVEINNHKLKAQQDKLDKINKQLDECASAITKAQVAIKTADRNLQKAQDSVLRTEKEIKDTEKEVDDLTAELKSLEDKAAEVVKNTNAAEESLPEIQKEHRNLLQELKVIQENEHALQKDALSIKLKLEQIDGHIAEHNSKIKYWHKEISKISLHPIEDNPIEEISVLSPEDLEAIKNPDSITNQIALLEARCHEMKPNLGAIAEYKKKEELYLQRVAELDKITYERDSFRQAYEDLRKQRLNEFMAGFYIITNKLKENYQMLTLGGDAELELVDSLDPFSEGIMFSVRPPKKSWKKIFNLSGGEKTLSSLALVFALHHYKPTPLYFMDEIDAALDFKNVSIVAFYIYEQTKNAQFIIISLRNNMFEISDRLIGIYKTYNITKSVAVNPKEIASKGLC

SEQ ID NO: 747428 - protein, 1288 aa, Homo sapiens; identical to SEQ ID NO: 747423

SEQ ID NO: 747429 - protein, 1216 aa, Homo sapiens; identical to SEQ ID NO: 747427

SEQ ID NO: 747430 - protein, 952 aa, Homo sapiens
METQKEKIHEDTKEINEKSNILSNEMKAKNKDVKDTEKKLNKITKFIEENKEKFTQLDLEDVQVREKLKHATSKAKKLEKQLQKDKEKVEEFKSIPAKSNNIINETTTRNNALEKEKEKEEKKLKEVMDSLKQETQGLQKEKESREKELMGFSKSVNEARSKMDVAQSELDIYLSRHNTAVSQLTKAKEALIAASETLKERKAAIRDIEGKLPQTEQELKEKEKELQKLTQEETNFKSLVHDLFQKVEEAKSSLAMNRSRGKVLDAIIQEKKSGRIPGIYGRLGDLGAIDEKYDVAISSCCHALDYIVVDSIDIAQECVNFLKRQNIGVATFIGLDKMAVWAKKMTEIQTPENTPRLFDLVKVKDEKIRQAFYFALRDTLVADNLDQATRVAYQKDRRWRVVTLQGQIIEQSGTMTGGGSKVMKGRMGSSLVIEISEEEVNKMESQLQNDSKKAMQIQEQKVQLEERVVKLRHSEREMRNTLEKFTASIQRLIEQEEYLNVQVKELEANVLATAPDKKKQKLLEENVSAFKTEYDAVAEKAGKVEAEVKRLHNTIVEINNHKLKAQQDKLDKINKQLDECASAITKAQVAIKTADRNLQKAQDSVLRTEKEIKDTEKEVDDLTAELKSLEDKAAEVVKNTNAAEESLPEIQKEHRNLLQELKVIQENEHALQKDALSIKLKLEQIDGHIAEHNSKIKYWHKEISKISLHPIEDNPIEEISVLSPEDLEAIKNPDSITNQIALLEARCHEMKPNLGAIAEYKKKEELYLQRVAELDKITYERDSFRQAYEDLRKQRLNEFMAGFYIITNKLKENYQMLTLGGDAELELVDSLDPFSEGIMFSVRPPKKSWKKIFNLSGGEKTLSSLALVFALHHYKPTPLYFMDEIDAALDFKNVSIVAFYIYEQTKNAQFIIISLRNNMFEISDRLIGIYKTYNITKSVAVNPKEIASKGLC

SEQ ID NO: 747431 - protein, 1029 aa, Homo sapiens
MPRKGTQPSTARRREEGPPPPSPDGASSDAEPEPPSGRTESPATAAETASEELDNRSLEEILNSIPPPPPPAMTNEAGAPRLMITHIVNQNFKSYAGEKILGPFHKRFSCIIGPNGSGKSNVIDSMLFVFGYRAQKIRSKKLSVLIHNSDEHKDIQSCTVEVHFQKIIDKEGDDYEVIPNSNFYVSRTACRDNTSVYHISGKKKTFKDVGNLLRSHGIDLDHNRFLILQGEVEQIAMMKPKGQTEHDEGMLEYLEDIIGCGRLNEPIKVLCRRVEILNEHRGEKLNRVKMVEKEKDALEGEKNIAIEFLTLENEIFRKKNHVCQYYIYELQKRIAEMETQKEKIHEDTKEINEKSNILSNEMKAKNKDVKDTEKKLNKITKFIEENKEKFTQLDLEDVQVREKLKHATSKAKKLEKQLQKDKEKVEEFKSIPAKSNNIINETTTRNNALEKEKEKEEKKLKEVMDSLKQETQGLQKEKESREKELMGFSKSVNEARSKMDVAQSELDIYLSRHNTAVSQLTKAKEALIAASETLKERKAAIRDIEGKLPQTEQELKEKEKELQKLTQEETNFKSLVHDLFQKVEEAKSSLAMNRSRGKVLDAIIQEKKSGRIPGIYGRLGDLGAIDEKYDVAISSCCHALDYIVVDSIDIAQECVNFLKRQNIGVATFIGLDKMAVWAKKMTEIQTPENTPRLFDLVKVKDEKIRQAFYFALRDTLVADNLDQATRVAYQKDRRWRVVTLQGQIIEQSGTMTGGGSKVMKGRMGSSLVIEISEEEVNKMESQLQNDSKKAMQIQEQKVQLEERVVKLRHSEREMRNTLEKFTASIQRLIEQEEYLNVQVKELEANVLATAPDKKKQKLLEENVSAFKTEYDAVAEKAGKVEAEVKRLHNTIVEINNHKLKAQQDKLDKINKQLDECASAITKAQVAIKTADRNLQKAQDSVLRTEKEIKDTEKEVDDLTAELKSLEDKAAEVVKNTNAAEESLPEIQKEHRNLLQELKVIQENEHALQKDALSIKLKLKSNCTFGSPVS

SEQ ID NO: 747432 - protein, 1288 aa, Homo sapiens; identical to SEQ ID NO: 747423

SEQ ID NO: 747433 - protein, 1288 aa, Homo sapiens; identical to SEQ ID NO: 747423

SEQ ID NO: 747434 - protein, 1288 aa, Homo sapiens; identical to SEQ ID NO: 747423

SEQ ID NO: 747435 - protein, 1052 aa, Homo sapiens [sequence omitted]

SEQ ID NO: 747436 - protein, 1163 aa, Homo sapiens
MLFVFGYRAQKIRSKKLSVLIHNSDEHKDIQSCTVEVHFQKIIDKEGDDYEVIPNSNFYVSRTACRDNTSVYHISGKKKTFKDVGNLLRSHGIDLDHNRFLILQGEVEQIAMMKPKGQTEHDEGMLEYLEDIIGCGRLNEPIKVLCRRVEILNEHRGEKLNRVKMVEKEKDALEGEKNIAIEFLTLENEIFRKKNHVCQYYIYELQKRIAEMETQKEKIHEDTKEINEKSNILSNEMKAKNKDVKDTEKKLNKITKFIEENKEKFTQLDLEDVQVREKLKHATSKAKKLEKQLQKDKEKVEEFKSIPAKSNNIINETTTRNNALEKEKEKEEKKLKEVMDSLKQETQGLQKEKESREKELMGFSKSVNEARSKMDVAQSELDIYLSRHNTAVSQLTKAKEALIAASETLKERKAAIRDIEGKLPQTEQELKEKEKELQKLTQEETNFKSLVHDLFQKVEEAKSSLAMNRSRGKVLDAIIQEKKSGRIPGIYGRLGDLGAIDEKYDVAISSCCHALDYIVVDSIDIAQECVNFLKRQNIGVATFIGLDKMAVWAKKMTEIQTPENTPRLFDLVKVKDEKIRQAFYFALRDTLVADNLDQATRVAYQKDRRWRVVTLQGQIIEQSGTMTGGGSKVMKGRMGSSLVIEISEEEVNKMESQLQNDSKKAMQIQEQKVQLEERVVKLRHSEREMRNTLEKFTASIQRLIEQEEYLNVQVKELEANVLATAPDKKKQKLLEENVSAFKTEYDAVAEKAGKVEAEVKRLHNTIVEINNHKLKAQQDKLDKINKQLDECASAITKAQVAIKTADRNLQKAQDSVLRTEKEIKDTEKEVDDLTAELKSLEDKAAEVVKNTNAAEESLPEIQKEHRNLLQELKVIQENEHALQKDALSIKLKLEQIDGHIAEHNSKIKYWHKEISKISLHPIEDNPIEEISVLSPEDLEAIKNPDSITNQIALLEARCHEMKPNLGAIAEYKKKEELYLQRVAELDKITYERDSFRQAYEDLRKQRLNEFMAGFYIITNKLKENYQMLTLGGDAELELVDSLDPFSEGIMFSVRPPKKSWKKIFNLSGGEKTLSSLALVFALHHYKPTPLYFMDEIDAALDFKNVSIVAFYIYEQTKNAQFIIISLRNNMFEISDRLIGIYKTYNITKSVAVNPKEIASKGLC

SEQ ID NO: 747437 - protein, 1006 aa, Homo sapiens
MRLNRVKMVEKEKDALEGEKNIAIEFLTLENEIFRKKNHVCQYYIYELQKRIAEMETQKEKIHEDTKEINEKSNILSNEMKAKNKDVKDTEKKLNKITKFIEENKEKFTQLDLEDVQVREKLKHATSKAKKLEKQLQKDKEKVEEFKSIPAKSNNIINETTTRNNALEKEKEKEEKKLKEVMDSLKQETQGLQKEKESREKELMGFSKSVNEARSKMDVAQSELDIYLSRHNTAVSQLTKAKEALIAASETLKERKAAIRDIEGKLPQTEQELKEKEKELQKLTQEETNFKSLVHDLFQKVEEAKSSLAMNRSRGKVLDAIIQEKKSGRIPGIYGRLGDLGAIDEKYDVAISSCCHALDYIVVDSIDIAQECVNFLKRQNIGVATFIGLDKMAVWAKKMTEIQTPENTPRLFDLVKVKDEKIRQAFYFALRDTLVADNLDQATRVAYQKDRRWRVVTLQGQIIEQSGTMTGGGSKVMKGRMGSSLVIEISEEEVNKMESQLQNDSKKAMQIQEQKVQLEERVVKLRHSEREMRNTLEKFTASIQRLIEQEEYLNVQVKELEANVLATAPDKKKQKLLEENVSAFKTEYDAVAEKAGKVEAEVKRLHNTIVEINNHKLKAQQDKLDKINKQLDECASAITKAQVAIKTADRNLQKAQDSVLRTEKEIKDTEKEVDDLTAELKSLEDKAAEVVKNTNAAEESLPEIQKEHRNLLQELKVIQENEHALQKDALSIKLKLEQIDGHIAEHNSKIKYWHKEISKISLHPIEDNPIEEISVLSPEDLEAIKNPDSITNQIALLEARCHEMKPNLGAIAEYKKKEELYLQRVAELDKITYERDSFRQAYEDLRKQRLNEFMAGFYIITNKLKENYQMLTLGGDAELELVDSLDPFSEGIMFSVRPPKKSWKKIFNLSGGEKTLSSLALVFALHHYKPTPLYFMDEIDAALDFKNVSIVAFYIYEQTKNAQFIIISLRNNMFEISDRLIGIYKTYNITKSVAVNPKEIASKGLC

SEQ ID NO: 747438 - protein, 1052 aa, Homo sapiens [sequence omitted]

SEQ ID NO: 747439 - protein, 1090 aa, Homo sapiens
VKICVKSYDRDQMDKLAFFEESNTTELLASLGEVEQIAMMKPKGQTEHDEGMLEYLEDIIGCGRLNEPIKVLCRRVEILNEHRGEKLNRVKMVEKEKDALEGEKNIAIEFLTLENEIFRKKNHVCQYYIYELQKRIAEMETQKEKIHEDTKEINEKSNILSNEMKAKNKDVKDTEKKLNKITKFIEENKEKFTQLDLEDVQVREKLKHATSKAKKLEKQLQKDKEKVEEFKSIPAKSNNIINETTTRNNALEKEKEKEEKKLKEVMDSLKQETQGLQKEKESREKELMGFSKSVNEARSKMDVAQSELDIYLSRHNTAVSQLTKAKEALIAASETLKERKAAIRDIEGKLPQTEQELKEKEKELQKLTQEETNFKSLVHDLFQKVEEAKSSLAMNRSRGKVLDAIIQEKKSGRIPGIYGRLGDLGAIDEKYDVAISSCCHALDYIVVDSIDIAQECVNFLKRQNIGVATFIGLDKMAVWAKKMTEIQTPENTPRLFDLVKVKDEKIRQAFYFALRDTLVADNLDQATRVAYQKDRRWRVVTLQGQIIEQSGTMTGGGSKVMKGRMGSSLVIEISEEEVNKMESQLQNDSKKAMQIQEQKVQLEERVVKLRHSEREMRNTLEKFTASIQRLIEQEEYLNVQVKELEANVLATAPDKKKQKLLEENVSAFKTEYDAVAEKAGKVEAEVKRLHNTIVEINNHKLKAQQDKLDKINKQLDECASAITKAQVAIKTADRNLQKAQDSVLRTEKEIKDTEKEVDDLTAELKSLEDKAAEVVKNTNAAEESLPEIQKEHRNLLQELKVIQENEHALQKDALSIKLKLEQIDGHIAEHNSKIKYWHKEISKISLHPIEDNPIEEISVLSPEDLEAIKNPDSITNQIALLEARCHEMKPNLGAIAEYKKKEELYLQRVAELDKITYERDSFRQAYEDLRKQRLNEFMAGFYIITNKLKENYQMLTLGGDAELELVDSLDPFSEGIMFSVRPPKKSWKKIFNLSGGEKTLSSLALVFALHHYKPTPLYFMDEIDAALDFKNVSIVAFYIYEQTKNAQFIIISLRNNMFEISDRLIGIYKTYNITKSVAVNPKEIASKGLC

SEQ ID NO: 747440 - protein, 1095 aa, Homo sapiens
MGFSKSVNEARSKMDVAQSELDIYLSRHNTAVSQLTKAKEALIAASETLKERKAAIRDIEGKLPQTEQELKEKEKELQKLTQEETNFKSLVHDLFQKVEEAKSSLAMNRSRGKVLDAIIQEKKSGRIPGIYGRCYELQKRIAEMETQKEKIHEDTKEINEKSNILSNEMKAKNKDVKDTEKKLNKITKFIEENKEKFTQLDLEDVQVREKLKHATSKAKKLEKQLQKDKEKVEEFKSIPAKSNNIINETTTRNNALEKEKEKEEKKLKEVMDSLKQETQGLQKEKESREKELMGFSKSVNEARSKMDVAQSELDIYLSRHNTAVSQLTKAKEALIAASETLKERKAAIRDIEGKLPQTEQELKEKEKELQKLTQEETNFKSLVHDLFQKVEEAKSSLAMNRSRGKVLDAIIQEKKSGRIPGIYGRLGDLGAIDEKYDVAISSCCHALDYIVVDSIDIAQECVNFLKRQNIGVATFIGLDKMAVWAKKMTEIQTPENTPRLFDLVKVKDEKIRQAFYFALRDTLVADNLDQATRVAYQKDRRWRVVTLQGQIIEQSGTMTGGGSKVMKGRMGSSLVIEISEEEVNKMESQLQNDSKKAMQIQEQKVQLEERVVKLRHSEREMRNTLEKFTASIQRLIEQEEYLNVQVKELEANVLATAPDKKKQKLLEENVSAFKTEYDAVAEKAGKVEAEVKRLHNTIVEINNHKLKAQQDKLDKINKQLDECASAITKAQVAIKTADRNLQKAQDSVLRTEKEIKDTEKEVDDLTAELKSLEDKAAEVVKNTNAAEESLPEIQKEHRNLLQELKVIQENEHALQKDALSIKLKLEQIDGHIAEHNSKIKYWHKEISKISLHPIEDNPIEEISVLSPEDLEAIKNPDSITNQIALLEARCHEMKPNLGAIAEYKKKEELYLQRVAELDKITYERDSFRQAYEDLRKQRLNEFMAGFYIITNKLKENYQMLTLGGDAELELVDSLDPFSEGIMFSVRPPKKSWKKIFNLSGGEKTLSSLALVFALHHYKPTPLYFMDEIDAALDFKNVSIVAFYIYEQTKNAQFIIISLRNNMFEISDRLIGIYKTYNITKSVAVNPKEIASKGLC

SEQ ID NO: 747441 - protein, 991 aa, Homo sapiens [sequence omitted]

SEQ ID NO: 747442 - protein, 940 aa, Homo sapiens
GTIQRRLAWPLRKDDSKFVKRSIFLKKLNKITKFIEENKEKFTQLDLEDVQVREKLKHATSKAKKLEKQLQKDKEKVEEFKSIPAKSNNIINETTTRNNALEKEKEKEEKKLKEVMDSLKQETQGLQKEKESREKELMGFSKSVNEARSKMDVAQSELDIYLSRHNTAVSQLTKAKEALIAASETLKERKAAIRDIEGKLPQTEQELKEKEKELQKLTQEETNFKSLVHDLFQKVEEAKSSLAMNRSRGKVLDAIIQEKKSGRIPGIYGRLGDLGAIDEKYDVAISSCCHALDYIVVDSIDIAQECVNFLKRQNIGVATFIGLDKMAVWAKKMTEIQTPENTPRLFDLVKVKDEKIRQAFYFALRDTLVADNLDQATRVAYQKDRRWRVVTLQGQIIEQSGTMTGGGSKVMKGRMGSSLVIEISEEEVNKMESQLQNDSKKAMQIQEQKVQLEERVVKLRHSEREMRNTLEKFTASIQRLIEQEEYLNVQVKELEANVLATAPDKKKQKLLEENVSAFKTEYDAVAEKAGKVEAEVKRLHNTIVEINNHKLKAQQDKLDKINKQLDECASAITKAQVAIKTADRNLQKAQDSVLRTEKEIKDTEKEVDDLTAELKSLEDKAAEVVKNTNAAEESLPEIQKEHRNLLQELKVIQENEHALQKDALSIKLKLEQIDGHIAEHNSKIKYWHKEISKISLHPIEDNPIEEISVLSPEDLEAIKNPDSITNQIALLEARCHEMKPNLGAIAEYKKKEELYLQRVAELDKITYERDSFRQAYEDLRKQRLNEFMAGFYIITNKLKENYQMLTLGGDAELELVDSLDPFSEGIMFSVRPPKKSWKKIFNLSGGEKTLSSLALVFALHHYKPTPLYFMDEIDAALDFKNVSIVAFYIYEQTKNAQFIIISLRNNMFEISDRLIGIYKTYNITKSVAVNPKEIASKGLC

SEQ ID NO: 747443 - protein, 825 aa, Homo sapiens [sequence omitted]

SEQ ID NO: 747444 - protein, 875 aa, Homo sapiens
MGFSKSVNEARVEEFKSIPAKSNNIINETTTRNNALEKEKEKEEKKLKEVMDSLKQETQGLQKEKESREKELMGFSKSVNEARSKMDVAQSELDIYLSRHNTAVSQLTKAKEALIAASETLKERKAAIRDIEGKLPQTEQELKEKEKELQKLTQEETNFKSLVHDLFQKVEEAKSSLAMNRSRGKVLDAIIQEKKSGRIPGIYGRLGDLGAIDEKYDVAISSCCHALDYIVVDSIDIAQECVNFLKRQNIGVATFIGLDKMAVWAKKMTEIQTPENTPRLFDLVKVKDEKIRQAFYFALRDTLVADNLDQATRVAYQKDRRWRVVTLQGQIIEQSGTMTGGGSKVMKGRMGSSLVIEISEEEVNKMESQLQNDSKKAMQIQEQKVQLEERVVKLRHSEREMRNTLEKFTASIQRLIEQEEYLNVQVKELEANVLATAPDKKKQKLLEENVSAFKTEYDAVAEKAGKVEAEVKRLHNTIVEINNHKLKAQQDKLDKINKQLDECASAITKAQVAIKTADRNLQKAQDSVLRTEKEIKDTEKEVDDLTAELKSLEDKAAEVVKNTNAAEESLPEIQKEHRNLLQELKVIQENEHALQKDALSIKLKLEQIDGHIAEHNSKIKYWHKEISKISLHPIEDNPIEEISVLSPEDLEAIKNPDSITNQIALLEARCHEMKPNLGAIAEYKKKEELYLQRVAELDKITYERDSFRQAYEDLRKQRLNEFMAGFYIITNKLKENYQMLTLGGDAELELVDSLDPFSEGIMFSVRPPKKSWKKIFNLSGGEKTLSSLALVFALHHYKPTPLYFMDEIDAALDFKNVSIVAFYIYEQTKNAQFIIISLRNNMFEISDRLIGIYKTYNITKSVAVNPKEIASKGLC

SEQ ID NO: 747445 - protein, 879 aa, Homo sapiens
YRGSERKESREKELMGFSKSVNEARSNNIINETTTRNNALEKEKEKEEKKLKEVMDSLKQETQGLQKEKESREKELMGFSKSVNEARSKMDVAQSELDIYLSRHNTAVSQLTKAKEALIAASETLKERKAAIRDIEGKLPQTEQELKEKEKELQKLTQEETNFKSLVHDLFQKVEEAKSSLAMNRSRGKVLDAIIQEKKSGRIPGIYGRLGDLGAIDEKYDVAISSCCHALDYIVVDSIDIAQECVNFLKRQNIGVATFIGLDKMAVWAKKMTEIQTPENTPRLFDLVKVKDEKIRQAFYFALRDTLVADNLDQATRVAYQKDRRWRVVTLQGQIIEQSGTMTGGGSKVMKGRMGSSLVIEISEEEVNKMESQLQNDSKKAMQIQEQKVQLEERVVKLRHSEREMRNTLEKFTASIQRLIEQEEYLNVQVKELEANVLATAPDKKKQKLLEENVSAFKTEYDAVAEKAGKVEAEVKRLHNTIVEINNHKLKAQQDKLDKINKQLDECASAITKAQVAIKTADRNLQKAQDSVLRTEKEIKDTEKEVDDLTAELKSLEDKAAEVVKNTNAAEESLPEIQKEHRNLLQELKVIQENEHALQKDALSIKLKLEQIDGHIAEHNSKIKYWHKEISKISLHPIEDNPIEEISVLSPEDLEAIKNPDSITNQIALLEARCHEMKPNLGAIAEYKKKEELYLQRVAELDKITYERDSFRQAYEDLRKQRLNEFMAGFYIITNKLKENYQMLTLGGDAELELVDSLDPFSEGIMFSVRPPKKSWKKIFNLSGGEKTLSSLALVFALHHYKPTPLYFMDEIDAALDFKNVSIVAFYIYEQTKNAQFIIISLRNNMFEISDRLIGIYKTYNITKSVAVNPKEIASKGLC

SEQ ID NO: 747446 - protein, 621 aa, Homo sapiens
MPRKGTQPSTARRREEGPPPPSPDGASSDAEPEPPSGRTESPATAAETASEELDNRSLEEILNSIPPPPPPAMTNEAGAPRLMITHIVNQNFKSYAGEKILGPFHKRFSCIIGPNGSGKSNVIDSMLFVFGYRAQKIRSKKLSVLIHNSDEHKDIQSCTVEVHFQKIIDKEGDDYEVIPNSNFYVSRTACRDNTSVYHISGKKKTFKDVGNLLRSHGIDLDHNRFLILQGEVEQIAMMKPKGQTEHDEGMLEYLEDIIGCGRLNEPIKVLCRRVEILNEHRGEKLNRVKMVEKEKDALEGEKNIAIEFLTLENEIFRKKNHVCQYYIYELQKRIAEMETQKEKIHEDTKEINEKSNILSNEMKAKNKDVKDTEKKLNKITKFIEENKEKFTQLDLEDVQVREKLKHATSKAKKLEKQLQKDKEKVEEFKSIPAKSNNIINETTTRNNALEKEKEKEEKKLKEVMDSLKQETQGLQKEKESREKELMGFSKSVNEARSKMDVAQSELDIYLSRHNTAVSQLTKAKEALIAASETLKERKAAIRDIEGKLPQTEQELKEKEKELQKLTQEETNFKSLVHDLFQKVEEAKSSLAMNRSRGKVLDAIIQEKKSGRIPGIYGRLVK

SEQ ID NO: 747447 - protein, 568 aa, Homo sapiens
MPRKGTQPSTARRREEGPPPPSPDGASSDAEPEPPSGRTESPATAAETASEELDNRSLEEILNSIPPPPPPAMTNEAGAPRLMITHIVNQNFKSYAGEKILGPFHKRFSCIIGPNGSGKSNVIDSMLFVFGYRAQKIRSKKLSVLIHNSDEHKDIQSCTVEVHFQKIIDKEGDDYEVIPNSNFYVSRTACRDNTSVYHISGKKKTFKDVGNLLRSHGIDLDHNRFLILQGEVEQIAMMKPKGQTEHDEGMLEYLEDIIGCGRLNEPIKVLCRRVEILNEHRGEKLNRVKMVEKEKDALEGEKNIAIEFLTLENEIFRKKNHVCQYYIYELQKRIAEMETQKEKIHEDTKEINEKSNILSNEMKAKNKDVKDTEKKLNKITKFIEENKEKFTQLDLEDVQVREKLKHATSKAKKLEKQLQKDKEKVEEFKSIPAKSNNIINETTTRNNALEKEKEKEEKKLKEVMDSLKQETQGLQKEKESREKELMGFSKSVNEARSKMDVAQSELDIYLSRHNTAVSQLTKAKEALIAASETLKERKAAIRDIEGKLPQTEQELKEKEKQKIKGSYG

SEQ ID NO: 747448 - protein, 497 aa, Homo sapiens
MPRKGTQPSTARRREEGPPPPSPDGASSDAEPEPPSGRTESPATAAETASEELDNRSLEEILNSIPPPPPPAMTNEAGAPRLMITHIVNQNFKSYAGEKILGPFHKRFSCIIGPNGSGKSNVIDSMLFVFGYRAQKIRSKKLSVLIHNSDEHKDIQSCTVEVHFQKIIDKEGDDYEVIPNSNFYVSRTACRDNTSVYHISGKKKTFKDVGNLLRSHGIDLDHNRFLILQGEVEQIAMMKPKGQTEHDEGMLEYLEDIIGCGRLNEPIKVLCRRVEILNEHRGEKLNRVKMVEKEKDALEGEKNIAIEFLTLENEIFRKKNHVCQYYIYELQKRIAEMETQKEKIHEDTKEINEKSNILSNEMKAKNKDVKDTEKKLNKITKFIEENKEKFTQLDLEDVQVREKLKHATSKAKKLEKQLQKDKEKVEEFKSIPAKSNNIINETTTRNNALEKEKEKEEKKLKEVMDSLKQETQGLQKEKEVSFFFLSVFILVAFFFLT

SEQ ID NO: 747449 - protein, 575 aa, Homo sapiens
MPRKGTQPSTARRREEGPPPPSPDGASSDAEPEPPSGRTESPATAAETASEELDNRSLEEILNSIPPPPPPAMTNEAGAPRLMITHIVNQNFKSYAGEKILGPFHKRFSCIIGPNGSGKSNVIDSMLFVFGYRAQKIRSKKLSVLIHNSDEHKDIQSCTVEVHFQKIIDKEGDDYEVIPNSNFYVSRTACRDNTSVYHISGKKKTFKDVGNLLRSHGIDLDHNRFLILQGEVEQIAMMKPKGQTEHDEGMLEYLEDIIGCGRLNEPIKVLCRRVEILNEHRGEKLNRVKMVEKEKDALEGEKNIAIEFLTLENEIFRKKNHVCQYYIYELQKRIAEMETQKEKIHEDTKEINEKSNILSNEMKAKNKDVKDTEKKLNKITKFIEENKEKFTQLDLEDVQVREKLKHATSKAKKLEKQLQKDKEKVEEFKSIPAKSNNIINETTTRNNALEKEKEKEEKKKIFGGAWALRKRFCKPHMVGERGAQEGVGTQGKGGPKRERGQNTRRVGSLPSKKRRGETERLVTKLESDISGRAKNEGTTTKEGISRGRPISKNSPGRGESRQQQQELDTQHEQKH

SEQ ID NO: 747450 - protein, 458 aa, Homo sapiens
MPRKGTQPSTARRREEGPPPPSPDGASSDAEPEPPSGRTESPATAAETASEELDNRSLEEILNSIPPPPPPAMTNEAGAPRLMITHIVNQNFKSYAGEKILGPFHKRFSCIIGPNGSGKSNVIDSMLFVFGYRAQKIRSKKLSVLIHNSDEHKDIQSCTVEVHFQKIIDKEGDDYEVIPNSNFYVSRTACRDNTSVYHISGKKKTFKDVGNLLRSHGIDLDHNRFLILQGEVEQIAMMKPKGQTEHDEGMLEYLEDIIGCGRLNEPIKVLCRRVEILNEHRGEKLNRVKMVEKEKDALEGEKNIAIEFLTLENEIFRKKNHVCQYYIYELQKRIAEMETQKEKIHEDTKEINEKSNILSNEMKAKNKDVKDTEKKLNKITKFIEENKEKFTQLDLEDVQVREKLKHATSKAKKLEKQLQKDKEKLRFKLLPEYNSYEPTEKPSEERKGTIRSWCLRTG

SEQ ID NO: 747451 - protein, 374 aa, Homo sapiens [sequence omitted]

SEQ ID NO: 747452 - protein, 242 aa, Homo sapiens
MPRKGTQPSTARRREEGPPPPSPDGASSDAEPEPPSGRTESPATAAETASEELDNRSLEEILNSIPPPPPPAMTNEAGAPRLMITHIVNQNFKSYAGEKILGPFHKRFSCIIGPNGSGKSNVIDSMLFVFGYRAQKIRSKKLSVLIHNSDEHKDIQSCTVEVHFQKIIDKEGDDYEVIPNSNFYVSRTACRDNTSVYHISGKKKTFKDVGNLLRSHGIDLDHNRFLILQEQMLMNKADDKRL

SEQ ID NO: 747453 - protein, 204 aa, Homo sapiens
MPRKGTQPSTARRREEGPPPPSPDGASSDAEPEPPSGRTESPATAAETASEELDNRSLEEILNSIPPPPPPAMTNEAGAPRLMITHIVNQNFKSYAGEKILGPFHKRFSCIIGPNGSGKSNVIDSMLFVFGYRAQKIRSKKLSVLIHNSDEHKDIQSCTVEVHFQKIIDKEGDDYEVIPNSNFYVSRTACRDNTSVYHISGKRP

SEQ ID NO: 747454 - protein, 72 aa, Homo sapiens
SSQSTHARSREHAACTAGDVMLGSNSPGWPATDASACNHGNVSGGGHPREPTAMGSLLVTDGRVSTSQTESA

SEQ ID NO: 747455 - protein, 326 aa, Homo sapiens
MSCAEVMYHPQPYGASQYLPNPMAATTCPTAYYQPAPQPGQQKKLAVFSKMQDSLEVTLPSKQEEEDEEEEEEEKDQPAEMEYLNSRCVLFTYFQGDIGSVVDEHFSRALGQAITLHPESAISKSKMGLTPLWRDSSALSSQRNSFPTSFWTSSYQPPPAPCLGGVHPDFQVTGPPGTFSAADPSPWPGHNLHQTGPAPPPAVSESWPYPLTSQVSPSYSHMHDVYMRHHHPHAHMHHRHRHHHHHHHPPAGSALDPSYGPLLMPSVHAARIPAPQCDITKTEPTTVTSATSAWAGAFHGTVDIVPSVGFDTGLQHQDKSKESPWY

SEQ ID NO: 747456 - protein, 273 aa, Homo sapiens
MSCAEVMYHPQPYGASQYLPNPMAATTCPTAYYQPAPQPGQQGDIGSVVDEHFSRALGQAITLHPESAISKSKMGLTPLWRDSSALSSQRNSFPTSFWTSSYQPPPAPCLGGVHPDFQVTGPPGTFSAADPSPWPGHNLHQTGPAPPPAVSESWPYPLTSQVSPSYSHMHDVYMRHHHPHAHMHHRHRHHHHHHHPPAGSALDPSYGPLLMPSVHAARIPAPQCDITKTEPTTVTSATSAWAGAFHGTVDIVPSVGFDTGLQHQDKSKESPWY

SEQ ID NO: 747457 - protein, 326 aa, Homo sapiens; identical to SEQ ID NO: 747455

SEQ ID NO: 747458 - protein, 97 aa, Homo sapiens
MVHSRKWGESGQRCPGGLCLHHLERHRPFSLHSLFRKEAYSQMNAPRLRDKANPWDAEGTWITSARERSPNSASRRPEVWPPVDTQLRDEQVGLSGG

SEQ ID NO: 747459 - protein, 302 aa, Homo sapiens
MNSMKTEENKSFSAMEDDQRTRPEVSKDTVMKQTHADTPVDHCLSGIRKCSSTFKLKSEVNKHETALEMQNPNLNNKECCFTFTLNGNSRKLDRSVFTAYGKPSESIYSALSANDYFSERIKNQFNKNIIVYEEKTIDGHINLGMPLKCLPSDSHFKITFGQRKSSKEDGHILRQCENPNMECILFHVVAIGRTRKKIVKINELHEKGSKLCIYALKGETIEGALCKDGRFRSDIGEFEWKLKEGHKKIYGKQSMVDEVSGKVLEMDISKKKALQQKDIHKKIKQNESATDEINHQSLIQSK

SEQ ID NO: 747460 - protein, 272 aa, Homo sapiens
MKQTHADTPVDHCLSGIRKCSSTFKLKSEVNKHETALEMQNPNLNNKECCFTFTLNGNSRKLDRSVFTAYGKPSESIYSALSANDYFSERIKNQFNKNIIVYEEKTIDGHINLGMPLKCLPSDSHFKITFGQRKSSKEDGHILRQCENPNMECILFHVVAIGRTRKKIVKINELHEKGSKLCIYALKGETIEGALCKDGRFRSDIGEFEWKLKEGHKKIYGKQSMVDEVSGKVLEMDISKKKALQQKDIHKKIKQNESATDEINHQSLIQSK

SEQ ID NO: 747461 - protein, 80 aa, Homo sapiens
RPPLGPGAPRRRHHVLGSRPRDKGINRVTRVKNAEKAKEDAKSDERGDLEQICVWRCLSSWEWLGAHVTLQDARLSITAP

SEQ ID NO: 747462 - protein, 134 aa, Homo sapiens
GRPSAPEPLGGATMYSGAGPALAPPAPPPPIQGYAFKPPPRPDFGTSGRTIKLQANFFEMDIPKIDIYHYELDIKPEKCPRRVNREIVEHMVQHFKTQIFGDRKPVFDGRKNLYTAMPLPIGRDKVQTRISRTC

SEQ ID NO: 747463 - protein, 111 aa, Homo sapiens
MFCNSAATLFCADRPQEAWAPVGVPLPAGPGYRLLGSAGLALGCQNLVQVFRGDTAQPLAPRLSHGSCSTQIHRKLPARASPECCAGPSHHLRVCENLLRSERTEDSWCFC

SEQ ID NO: 747464 - protein, 142 aa, Homo sapiens
GRPSAPEPLGGATMYSGAGPALAPPAPPPPIQGYAFKPPPRPDFGTSGRTIKLQANFFEMDIPKIDIYHYELDIKPEKCPRRVNREIVEHMVQHFKTQIFGDRKPVFDGRKNLYTAMPLPIGRDKVDLQPWKLSFRSSAPDL

SEQ ID NO: 747465 - protein, 152 aa, Homo sapiens
LHPTGQFSCTAAVTVPFSPGPWASSEASEQALAPPAPPPPIQGYAFKPPPRPDFGTSGRTIKLQANFFEMDIPKIDIYHYELDIKPEKCPRRVNREIVEHMVQHFKTQIFGDRKPVFDGRKNLYTAMPLPIGRDKVDLQPWKLSFRSSAPDL

SEQ ID NO: 747466 - protein, 872 aa, Homo sapiens
GRPSAPEPLGGATMYSGAGPALAPPAPPPPIQGYAFKPPPRPDFGTSGRTIKLQANFFEMDIPKIDIYHYELDIKPEKCPRRVNREIVEHMVQHFKTQIFGDRKPVFDGRKNLYTAMPLPIGRDKVELEVTLPGEGKDRIFKVSIKWVSCVSLQALHDALSGRLPSVPFETIQALDVVMRHLPSMRYTPVGRSFFTASEGCSNPLGGGREVWFGFHQSVRPSLWKMMLNIDVSATAFYKAQPVIEFVCEVLDFKSIEEQQKPLTDSQRVKFTKEIKGLKVEITHCGQMKRKYRVCNVTRRPASHQTFPLQQESGQTVECTVAQYFKDRHKLVLRYPHLPCLQVGQEQKHTYLPLEVCNIVAGQRCIKKLTDNQTSTMIRATARSAPDRQEEISKLMRSASFNTDPYVREFGIMVKDEMTDVTGRVLQPPSILYGGRNKAIATPVQGVWDMRNKQFHTGIEIKVWAIACFAPQRQCTEVHLKSFTEQLRKISRDAGMPIQGQPCFCKYAQGADSVEPMFRHLKNTYAGLQLVVVILPGKTPVYAEVKRVGDTVLGMATQCVQMKNVQRTTPQTLSNLCLKINVKLGGVNNILLPQGRPPVFQQPVIFLGADVTHPPAGDGKKPSIAAVVGSMDAHPNRYCATVRVQQHRQEIIQDLAAMVRELLIQFYKSTRFKPTRIIFYRDGVSEGQFQQVLHHELLAIREACIKLEKDYQPGITFIVVQKRHHTRLFCTDKNERVGKSGNIPAGTTVDTKITHPTEFDFYLCSHAGIQGTSRPSHYHVLWDDNRFSSDELQILTYQLCHTYVRCTRSVSIPAPAYYAHLVAFRARYHLVDKEHDSAEGSHTSGQSNGRDHQALAKAVQVHQDTLRTMYFA

SEQ ID NO: 747467 - protein, 872 aa, Homo sapiens; identical to SEQ ID NO: 747466

SEQ ID NO: 747468 - protein, 872 aa, Homo sapiens; identical to SEQ ID NO: 747466

SEQ ID NO: 747469 - protein, 837 aa, Homo sapiens
GRPSAPEPLGGATMYSGAGPALAPPAPPPPIQGYAFKPPPRPDFGTSGRTIKLQANFFEMDIPKIDIYHYELDIKPEKCPRRVNREIVEHMVQHFKTQIFGDRKPVFDGRKNLYTAMPLPIGRDKVELEVTLPGEGKDRIFKVSIKWVSCVSLQALHDALSGRLPSVPFETIQALDVVMRHLPSMRYTPVGRSFFTASEGCSNPLGGGREVWFGFHQSVRPSLWKMMLNIDVSATAFYKAQPVIEFVCEVLDFKSIEEQQKPLTDSQRVKFTKEIKGLKVEITHCGQMKRKYRVCNVTRRPASHQTFPLQQESGQTVECTVAQYFKDRHKLVLRYPHLPCLQVGQEQKHTYLPLEVCNIVAGQRCIKKLTDNQTSTMIRATARSAPDRQEEISKLMRSASFNTDPYVREFGIMVKDEMTDVTGRVLQPPSILYGGRNKAIATPVQGVWDMRNKQFHTGIEIKVWAIACFAPQRQCTEVHLKSFTEQLRKISRDAGMPIQGQPCFCKYAQGADSVEPMFRHLKNTYAGLQLVVVILPGKTPVYAEVKRVGDTVLGMATQCVQMKNVQRTTPQTLSNLCLKINVKLGGVNNILLPQGRPPVFQQPVIFLGADVTHPPAGDGKKPSIAAVVGSMDAHPNRYCATVRVQQHRQEIIQDLAAMVRELLIQFYKSTRFKPTRIIFYRDGVSEGQFQQVLHHELLAIREACIKLEKDYQPGITFIVVQKRHHTRLFCTDKNERVGKSGNIPAGTTVDTKITHPTEFDFYLCSHAGIQGTSRPSHYHVLWDDNRFSSDELQILTYQLCHTYVRCTRSVSIPAPAYYAHLVAFRARYHLVDKEHDR

SEQ ID NO: 747470 - protein, 279 aa, Homo sapiens
GTLLVPIFPRVQAHAQERKVLGTPDHTHCLFLQVVGSMDAHPNRYCATVRVQQHRQEIIQDLAAMVRELLIQFYKSTRFKPTRIIFYRDGVSEGQFQQVLHHELLAIREACIKLEKDYQPGITFIVVQKRHHTRLFCTDKNERVGKSGNIPAGTTVDTKITHPTEFDFYLCSHAGIQGTSRPSHYHVLWDDNRFSSDELQILTYQLCHTYVRCTRSVSIPAPAYYAHLVAFRARYHLVDKEHDSAEGSHTSGQSNGRDHQALAKAVQVHQDTLRTMYFA

SEQ ID NO: 747471 - protein, 185 aa, Homo sapiens
MDFIRFSVFQNAIREACIKLEKDYQPGITFIVVQKRHHTRLFCTDKNERVGKSGNIPAGTTVDTKITHPTEFDFYLCSHAGIQGTSRPSHYHVLWDDNRFSSDELQILTYQLCHTYVRCTRSVSIPAPAYYAHLVAFRARYHLVDKEHDSAEGSHTSGQSNGRDHQALAKAVQVHQDTLRTMYFA

SEQ ID NO: 747472 - protein, 279 aa, Homo sapiens
GTLLVPIFPRVQAHAQERKVLGTPDHTHCLFLQVVGSMDAHPNRYCATVRVQQHRQEIIQDLAAMVRELLIQFYKSTRFKPTRIIFYRDGVSEGQFQQVLHHELLAIREACIKLEKEYQPGITFIVVQKRHHTRLFCTDKNERVGKSGNIPAGTTVDTKITHPTEFDFYLCSHAGIQGTSRPSHYHVLWDDNRFSSDELQILTYQLCHTYVRCTRSVSIPAPAYYAHLVAFRARYHLVDKEHDSAEGSHTSGQSNGRDHQALAKAVQVHQDTLRTMYFA

SEQ ID NO: 747473 - protein, 375 aa, Homo sapiens
GTLLVPIFPRVQAHAQERKVLGTPDHTHCLFLQVVGSMDAHPNRYCATVRVQQHRQEIIQDLAAMVRELLIQFYKSTRFKPTRIIFYRDGVSEGQFQQVLHHELLAIREACIKLEKEYQPGITFIVVQKRHHTRLFCTDKNERVGKSGNIPAGTTVDTKITHPTEFDFYLCSHAGIQGTSRPSHYHVLWDDNRFSSDELQILTYQLCHTYGAAHECVQMKNVQRTTPQTLSNLCLKINVKLGGVNNILLPQGRPPVFQQPVIFLGADVTHPPAGDGKKPSIAAVVGSMDAHPNRYCATVRVQQHRQEIIQDLAAMHTTLTWWPSGPGTTWWIRNMTVLKEAIPLGRVTGETTKHWPRRSRFTKTLCAPCTLLDMF

SEQ ID NO: 747474 - protein, 573 aa, Homo sapiens
GRPSAPEPLGGATMYSGAGPALAPPAPPPPIQGYAFKPPPRPDFGTSGRTIKLQANFFEMDIPKIDIYHYELDIKPEKCPRRVNREIVEHMVQHFKTQIFGDRKPVFDGRKNLYTAMPLPIGRDKVELEVTLPGEGKDRIFKVSIKWVSCVSLQALHDALSGRLPSVPFETIQALDVVMRHLPSMRYTPVGRSFFTASEGCSNPLGGGREVWFGFHQSVRPSLWKMMLNIDVSATAFYKAQPVIEFVCEVLDFKSIEEQQKPLTDSQRVKFTKEIKGLKVEITHCGQMKRKYRVCNVTRRPASHQTFPLQQESGQTVECTVAQYFKDRHKLVLRYPHLPCLQVGQEQKHTYLPLEVCNIVAGQRCIKKLTDNQTSTMIRATARSAPDRQEEISKLMRSASFNTDPYVREFGIMVKDEMTDVTGRVLQPPSILYGGRNKAIATPVQGVWDMRNKQFHTGIEIKVWAIACFAPQRQCTEVHLKSFTEQLRKISRDAGMPIQGQPCFCKYAQGADSVEPMFRHLKNTYAGLQLVVVILPGKTPVYGRCGRSRWLWGAVVVSVGVCSCLSPSVFLLH

SEQ ID NO: 747475 - protein, 342 aa, Homo sapiens
GRPSAPEPLGGATMYSGAGPALAPPAPPPPIQGYAFKPPPRPDFGTSGRTIKLQANFFEMDIPKIDIYHYELDIKPEKCPRRVNREIVEHMVQHFKTQIFGDRKPVFDGRKNLYTAMPLPIGRDKVELEVTLPGEGKDRIFKVSIKWVSCVSLQALHDALSGRLPSVPFETIQALDVVMRHLPSMRYTPVGRSFFTASEGCSNPLGGGREVWFGFHQSVRPSLWKMMLNIDVSATAFYKAQPVIEFVCEVLDFKSIEEQQKPLTDSQRVKFTKEIKGLKVEITHCGQMKRKYRVCNVTRRPASHQTFRCSRTTANGGAVAIFKTGQVGLEPTRIYVAGGNYF

SEQ ID NO: 747476 - protein, 279 aa, Homo sapiens; identical to SEQ ID NO: 747472

SEQ ID NO: 747477 - protein, 71 aa, Homo sapiens
AHTCCKVCHACSHTRNYFTEEERAVHCHMLRPEIHKNYLLCVVAFSDGGLTCLGPDTDIENLLKPPNFKYK

SEQ ID NO: 747478 - protein, 267 aa, Homo sapiens [sequence omitted]

SEQ ID NO: 747479 - protein, 250 aa, Homo sapiens [sequence omitted]

SEQ ID NO: 747480 - protein, 257 aa, Homo sapiens
PSICSSIMQVQLGQVEIKCPITECFEFLEETTVVYNLTHEDSIKYKYFLELGRIDSSTKPCPQCKHFTTFKKKGHIPTPSRSESKYKIQCPTCQFVWCFKCHSPWHEGVNCKEYKKGDKLLRHWASEIEHGQRNAQKCPKCKIHIQRTEGCDHMTCSQCNTNFCYRCGERYRQLRFFGDHTSNLSIFGCKYRYLPERPHLRRLVRGSVCAGKLFIAPLIMVLGLALGAIAVVIGLFVFPIYCLCKKQRKRSRTGMHW

SEQ ID NO: 747481 - protein, 232 aa, Homo sapiens
MGRRIHSELRNRAPSDVKELALDNSRSNEGKLEALTDEFEELEFLSKINGGLTSISDLPKLKLRKLELRVSGGLEVLAEKCPNLTHLYLSGNKIKDLSTIEPLKQLENLKSLDLFNCEVTNLNDYGENVFKLLLQLTYLDSCYWDHKEAPYSDIEDHVEGLDDEEEGEHEEEYDEDAQVVEDEEGEEEEEEGEEEDVSGGDEEDEEGYNDGEVDGEEDEEELGEEERGQKRK

SEQ ID NO: 747482 - protein, 109 aa, Homo sapiens
PYMLRLYPGPMVTEAEGKGGPEMASLSSSVVPVSFISTLRESVLDPGVGGEGASDKQRSKLSLSHSMIPAAKIHTELCLPAFFSPAGTQRRFQQPQHHLTLSIIHTAAR

SEQ ID NO: 747483 - protein, 108 aa, Homo sapiens
WPATTHSRVLRQIAYYLSSTLQQGDSAKTYLLKSQLELLISINVKPKILRRTEGVPHNLDWSPSLQLPQLSTGLSSHLRPHCATWNFPTWADSSRHHQLDASSALCSW

SEQ ID NO: 747484 - protein, 115 aa, Homo sapiens
RQHHCTPTYPPPFYRHLPPTVSPLNQTCDLGDSAKTYLLKSQLELLISINVKPKILRRTEGVPHNLDWSPSLQLPQLSTGLSSHLRPHCATWNFPTWADSSRHHQLDASSALCSW

SEQ ID NO: 747485 - protein, 747 aa, Homo sapiens
MEIPNPPTSKCITYWKRKVKSEYMRLRQLKRLQANMGAKALYVANFAKVQEKTQILNEEWKKLRVQPVQSMKPVSGHPFLKKCTIESIFPGFASQHMLMRSLNTVALVPIMYSWSPLQQNFMVEDETVLCNIPYMGDEVKEEDETFIEELINNYDGKVHGEEEMIPGSVLISDAVFLELVDALNQYSDEEEEGHNDTSDGKQDDSKEDLPVTRKRKRHAIEGNKKSSKKQFPNDMIFSAIASMFPENGVPDDMKERYRELTEMSDPNALPPQCTPNIDGPNAKSVQREQSLHSFHTLFCRRCFKYDCFLHPFHATPNVYKRKNKEIKIEPEPCGTDCFLLLEGAKEYAMLHNPRSKCSGRRRRRHHIVSASCSNASASAVAETKEGDSDRDTGNDWASSSSEANSRCQTPTKQKASPAPPQLCVVEAPSEPVEWTGAEESLFRVFHGTYFNNFCSIARLLGTKTCKQVFQFAVKESLILKLPTDELMNPSQKKKRKHRLWAAHCRKIQLKKDNSSTQVYNYQPCDHPDRPCDSTCPCIMTQNFCEKFCQCNPDCQNRFPGCRCKTQCNTKQCPCYLAVRECDPDLCLTCGASEHWDCKVVSCKNCSIQRGLKKHLLLAPSDVAGWGTFIKESVQKNEFISEYCGELISQDEADRRGKVYDKYMSSFLFNLNNDFVVDATRKGNKIRFANHSVNPNCYAKVVMVNGDHRIGIFAKRAIQAGEELFFDYRYSQADALKYVGIERETDVL

SEQ ID NO: 747486 - protein, 747 aa, Homo sapiens; identical to SEQ ID NO: 747485

SEQ ID NO: 747487 - protein, 703 aa, Homo sapiens [sequence omitted]

SEQ ID NO: 747488 - protein, 747 aa, Homo sapiens; identical to SEQ ID NO: 747485

SEQ ID NO: 747489 - protein, 399 aa, Homo sapiens [sequence omitted]

SEQ ID NO: 747490 - protein, 399 aa, Homo sapiens [sequence omitted]

SEQ ID NO: 747491 - protein, 399 aa, Homo sapiens [sequence omitted]

SEQ ID NO: 747492 - protein, 399 aa, Homo sapiens [sequence omitted]

SEQ ID NO: 747493 - protein, 399 aa, Homo sapiens [sequence omitted]

SEQ ID NO: 747494 - protein, 747 aa, Homo sapiens; identical to SEQ ID NO: 747485

SEQ ID NO: 747495 - protein, 68 aa, Homo sapiens
KQRYGVSESYRESQRGICQKMVMVNGDHRIGIFAKRAIQAGEELFFDYRYSQADALKYVGIERETDVL

SEQ ID NO: 747496 - protein, 83 aa, Homo sapiens
CIIMSEHRGSTCCYTASCMHIAKVEFRYMLRNEPMYTAVYLSCGVHLIISTCMHQQRYATRISFNNVLELEKPLRTKVSRVPA

SEQ ID NO: 747497 - protein, 161 aa, Homo sapiens
MAAVETFRWRKRWRWRRYAGGHDTTAAAINWSLYLLGSNPEVQKKVDHELDDVFGKSDRPATVEDLKKLRYLECVIKETLRLFPSVPLFARSVSEDCEVAGYRVLKGTEAVIIPYALHRDPRYFPNPEEFQPERFFPENAQGRHPYAYVPFSAGPRNCIVI

SEQ ID NO: 747498 - protein, 161 aa, Homo sapiens; identical to SEQ ID NO: 747497

SEQ ID NO: 747499 - protein, 161 aa, Homo sapiens; identical to SEQ ID NO: 747497

SEQ ID NO: 747500 - protein, 161 aa, Homo sapiens; identical to SEQ ID NO: 747497

SEQ ID NO: 747501 - protein, 575 aa, Homo sapiens
GRDLELRAGASGRGSGWVPEGETYGWAELGAALAWLFRRRGRSGGAEPRGVGRGVILVLGADSGTGLRAREAGSAVEAEELVKGSPAWEPPANDTREEAGPPAAGEDEASWTAPGGELAGPEEVLQESAAVTGTAWLEADSPGLGGVTAEAGSGDAQALPATLQAPHEVLGQSIMPPAIPEATEASGPPSPTPGDKLSPASELPKESPLEVWLNLGGSTPDPQVPELTYPFQGTLEPQPASDIIDIDYFEGLDGEGRGADLGSFPGSPGTSENHPDTEGETPSWSLLDLYDDFTPFDESDFYPTTSFYDDLDEEEEEEEDDKDAVGGGDLEDENELLVPTGKPGLGPGTGQPTSRWHAVPPQHTLGSVPGSSIALRPRPGEPGRDLASSENGTECRSGFVRHNGSCRSVCDLFPSYCHNGGQCYLVENIGAFCRCNTQDYIWHKGMRCESIITDFQVMCVAVGSAALVLLLLFMMTVFFAKKLYLLKTENTKLRRTNKFRTPSELHNDNFSLSTIAEGSHPNDDPSAPHKIQEVLKSCLKEEESFNIQNSMSPKLEGGKGDQADLDVNCLQNNLT

SEQ ID NO: 747502 - protein, 539 aa, Homo sapiens
MGRAGGGGPGRGPPPLLLFLGAALVLASGAVPAREAGSAVEAEELVKGSPAWEPPANDTREEAGPPAAGEDEASWTAPGGELAGPEEVLQESAAVTGTAWLEADSPGLGGVTAEAGSGDAQALPATLQAPHEVLGQSIMPPAIPEATEASGPPSPTPGDKLSPASELPKESPLEVWLNLGGSTPDPQVPELTYPFQGTLEPQPASDIIDIDYFEGLDGEGRGADLGSFPGSPGTSENHPDTEGETPSWSLLDLYDDFTPFDESDFYPTTSFYDDLDEEEEEEEDDKDAVGGGDLEDENELLVPTGKPGLGPGTGQPTSRWHAVPPQHTLGSVPGSSIALRPRPGEPGRDLASSENGTECRSGFVRHNGSCRSVCDLFPSYCHNGGQCYLVENIGAFCRCNTQDYIWHKGMRCESIITDFQVMCVAVGSAALVLLLLFMMTVFFAKKLYLLKTENTKLRRTNKFRTPSELHNDNFSLSTIAEGSHPNDDPSAPHKIQEVLKSCLKEEESFNIQNSMSPKLEGGKGDQADLDVNCLQNNLT

SEQ ID NO: 747503 - protein, 260 aa, Homo sapiens
MAAFLLLPLPLQAVLNLVTKTSCLEEKSAHGPPLLKTFLTLQPTLYSGFQDPATGPCTRTRPRPGEPGRDLASSENGTECRSGFVRHNGSCRSVCDLFPSYCHNGGQCYLVENIGAFCRCNTQDYIWHKGMRCESIITDFQVMCVAVGSAALVLLLLFMMTVFFAKKLYLLKTENTKLRRTNKFRTPSELHNDNFSLSTIAEGSHPNDDPSAPHKIQEVLKSCLKEEESFNIQNSMSPKLEGGKGDQADLDVNCLQNNLT

SEQ ID NO: 747504 - protein, 380 aa, Homo sapiens
MNPCGWLGAVGPTLPNFPKWAASLLEPRVLPWQAQVAHPVSGGPSPWISRPDTAQLDGTMAPAFLLLLLLWPQGCVSGPSADSVYTKVRLLEGETLSVQCSYKGYKNRVEGKVWCKIRKKKCEPGFARVWVKGPRYLLQDDAQAKVVNITMVALKLQDSGRYWCMRNTSGILYPLMGFQLDVSPAPQTERNIPFTHLDNILKGGTVTTGQAPTSGPDAPFTTGVMVFTPGLITLPRLLASTRPASKTGYSFTATSTTSQGPRRTMGSQTVTASPSNARDSSAGPESISTKSGDLSTRSPTTGLCLTSRSLLNRLPSMPSIRHQDVYSTVLGVVLTLLVLMLIMVYGFWKKRHMASYSMCSDPSTRDPPGRPEPYVEVYLI

SEQ ID NO: 747505 - protein, 134 aa, Homo sapiens
MRPSLPNSTVPTTRTTPPVPQKQCQQPRHGFHVMQKWSFHVLWPPDSAESVGILDCPATPCVCLRIGAPQPTGSSERDHTIAWSPLTGHRNSCAKLKSGPYIDKTQTTSSTGAQGGPGSEMEQLDHDMIEPRDS

SEQ ID NO: 747506 - protein, 125 aa, Homo sapiens
GAAHAPRPTGGRARRVLRFLGGREEPRAPTAGAGEKAPRRGPHPWKGGVHPPERHGAPRARRLKARRLLQLLGAEECQPGGSRTRRLVLELHTQGRMREPEARVCVPEARVWVPMVFVLGVGAER

SEQ ID NO: 747507 - protein, 101 aa, Homo sapiens
ASYTCTREERRGSASRFTSFSFVSAFFSHFLATLALERQKGEAKAGPRNGEGTWPSHKWSFCSARRDALERPLPSATVFLCQLVGGDWTSEEGVGAPRTHS

SEQ ID NO: 747508 - protein, 119 aa, Homo sapiens
MTGDFFRVWLLQHTGLRQHPAPAAWAAPVTAGARSLQSVSSAAASVNLNQRHLAAFSATLFRSGSKPRDQETSCLSAGTQARRQEARLTPCLRLPEERAMRKAGLSSQDTREKPQATAP

SEQ ID NO: 747509 - protein, 204 aa, Homo sapiens
ASYTCTREERRGSASRFTSFSFVSAFFSHFLATLALERQKGEAKAGPRNGEGTWPSHKWSFCSARRDALERPLPSATVFLCQLVGEGRKAAGRGARAGETLFYASWVPLLPIPWRGVELAGKCPRVRGAEPPAAILCLRVALAGRGKRDTDLAGVPRSLTSCFVHELLLGVRGPTARRDLEQGGSGSFPYPRILSHSLHASTRR

SEQ ID NO: 747510 - protein, 101 aa, Homo sapiens; identical to SEQ ID NO: 747507

SEQ ID NO: 747511 - protein, 110 aa, Homo sapiens
ASYTCTREERRGSASRFTSFSFVSAFFSHFLATLALERQKGEAKAGPRNGEGTWPSHKWSFCSARRDALERPLPSATVFLCQLVDLDIYSVQPLLWHSNSIGKQLDVASP

SEQ ID NO: 747512 - protein, 101 aa, Homo sapiens; identical to SEQ ID NO: 747507

SEQ ID NO: 747513 - protein, 101 aa, Homo sapiens; identical to SEQ ID NO: 747507

SEQ ID NO: 747514 - protein, 112 aa, Homo sapiens
SRWEDCLGPGVRVQPGQHREISSLQKIFKFSWVCGVHLWPQLTTWEAEAGGSLEPRRMKLTSEFKVFGELCRCNLSVTNKKSNQLLLAKGRWKTNRCRYTPVWVTKLDRISK

SEQ ID NO: 747515 - protein, 179 aa, Homo sapiens
MLSLDFLDDVRRMNKRQLYYQVLNFGMIVSSALMIWKGLMVITGSESPIVVVLSGSMEPAFHRGDLLFLTNRVEDPIRVGEIVVFRIEGREIPIVHRVLKIHEKQNGHIKFLTKGDNNAVDDRGLYKQGQHWLEKKDVVGRARGFVPYIGIVTILMNDYPKFKYAVLFLLGLFVLVHRE

SEQ ID NO: 747516 - protein, 153 aa, Homo sapiens
MIVSSALMIWKGLMVITGSESPIVVVLSGSMEPAFHRGDLLFLTNRVEDPIRVGEIVVFRIEGREIPIVHRVLKIHEKQNGHIKFLTKGDNNAVDDRGLYKQGQHWLEKKDVVGRARGFVPYIGIVTILMNDYPKFKYAVLFLLGLFVLVHRE

SEQ ID NO: 747517 - protein, 161 aa, Homo sapiens
MLSLDFLDDVRRMNKRQLYYQVLNFGMIVSSALMIWKGLMVITGSESPIVVVLSGSMEPAFHRGDLLFLTNRVEDPIRVGEIVVFRIEGREIPIVHRVLKIHEKQNGHIKFLTKGDNNAVDDRGLYKQGQHWLEKILMNDYPKFKYAVLFLLGLFVLVHRE

SEQ ID NO: 747518 - protein, 194 aa, Homo sapiens
YYYFAALDVLLAVPAMLSLDFLDDVRRMNKRQLYYQVLNFGMIVSSALMIWKGLMVITGSESPIVVVLSGSMEPAFHRGDLLFLTNRVEDPIRVGEIVVFRIEGREIPIVHRVLKIHEKQNGHIKFLTKGDNNAVDDRGLYKQGQHWLEKKDVVGRARGFVPYIGIVTILMNDYPKFKYAVLFLLGLFVLVHRE

SEQ ID NO: 747519 - protein, 117 aa, Homo sapiens
MLSLDFLDDVRRMNKRQLYYQVLNFGMIVSSALMIWKGLMVITGSESPIVVVLSGSMEPAFHRGDLLFLTNRVEDPIRVGEIVVFRIEGREIPIVHRVLKIHEKICSLYWNCDDPHE

SEQ ID NO: 747520 - protein, 112 aa, Homo sapiens
MLSLDFLDDVRRMNKRQLYYQVLNFGMIVSSALMIWKGLMVITGSESPIVVVLSGSMEPAFHRGDLLFLTNRVEDPIRVGEIVVFRIEGREIPIVHRVLKIHEKARPLSRTL

SEQ ID NO: 747521 - protein, 132 aa, Homo sapiens
LRGLVAMAPGGIRPLLEDRGDSDHSLWLGRETEAAAAQGKRGCSGGSRKMSGEDEQQEQTIAEDLVVTKYKMGGDIANRVLRSLVEASSSGVSVLSLCEKGDAMIMEETGKIFKKEQGNEERYCFSHQHFGK

SEQ ID NO: 747522 - protein, 136 aa, Homo sapiens
REKGANYRLGTRLGVARPLLEDRGDSDHSLWLGRETEAAAAQGKRGCSGGSRKMSGEDEQQEQTIAEDLVVTKYKMGGDIANRVLRSLVEASSSGVSVLSLCEKGDAMIMEETGKIFKKEQGNEERYCFSHQHFGK

SEQ ID NO: 747523 - protein, 210 aa, Homo sapiens
MLSHQLKQHVIDGEKTIIQNPTDQQKKDHEKAEFEVHEVYAVDVLVSSGEGKAKDAGQRTTIYKRDPSKQYGLKMKTSRAFFSEVERRFDAMPFTLRAFEDEKKARMGVVECAKHELLQPFNVLYEKEGEFVAQFKFTVLLMPNGPMRITSGPFEPDLYKSEMEVQDAELKALLQSSASRKTQKKKKKKASKTAENATSGETLEENEAGD

SEQ ID NO: 747524 - protein, 210 aa, Homo sapiens; identical to SEQ ID NO: 747523

SEQ ID NO: 747525 - protein, 210 aa, Homo sapiens; identical to SEQ ID NO: 747523

SEQ ID NO: 747526 - protein, 210 aa, Homo sapiens; identical to SEQ ID NO: 747523

SEQ ID NO: 747527 - protein, 210 aa, Homo sapiens; identical to SEQ ID NO: 747523

SEQ ID NO: 747528 - protein, 210 aa, Homo sapiens; identical to SEQ ID NO: 747523

SEQ ID NO: 747529 - protein, 210 aa, Homo sapiens; identical to SEQ ID NO: 747523

SEQ ID NO: 747530 - protein, 291 aa, Homo sapiens
PLLVNSKPTGLNRQPISFTVVAVVDVAQGTQVTGRKADVIKAAHLCAEAALRLVKPGNQNTQVTEAWNKVAHSFNCTPIEGMLSHQLKQHVIDGEKTIIQNPTDQQKKDHEKAEFEVHEVYAVDVLVSSGEGKAKDAGQRTTIYKRDPSKQYGLKMKTSRAFFSEVERRFDAMPFTLRAFEDEKKARMGVVECAKHELLQPFNVLYEKEGEFVAQFKFTVLLMPNGPMRITSGPFEPDLYKSEMEVQDAELKALLQSSASRKTQKKKKKKASKTAENATSGETLEENEAGD

SEQ ID NO: 747531 - protein, 210 aa, Homo sapiens; identical to SEQ ID NO: 747523

SEQ ID NO: 747532 - protein, 126 aa, Homo sapiens
PSVHLQKRELTGGTSVDHSLWLGRETEAAAAQGKRGCSGGSRKMSGEDEQQEQTIAEDLVVTKYKMGGDIANRVLRSLVEASSSGVSVLSLCEKGDAMIMEETGKIFKKEQGNEERYCFSHQHFGK

SEQ ID NO: 747533 - protein, 168 aa, Homo sapiens
DAWVDPRVGKAKDAGQRTTIYKRDPSKQYGLKMKTSRAFFSEVERRFDAMPFTLRAFEDEKKARMGVVECAKHELLQPFNVLYEKEGEFVAQFKFTVLLMPNGPMRITSGPFEPDLYKSEMEVQDAELKALLQSSASRKTQKKKKKKASKTAENATSGETLEENEAGD

SEQ ID NO: 747534 - protein, 229 aa, Homo sapiens
MLSHQLKQHVIDGEKTIIQNPTDQQKKDHEKAEFEVHEVYAVDVLVSSGEGKPRMQDREPLFTNETPLDSLAKDAGQRTTIYKRDPSKQYGLKMKTSRAFFSEVERRFDAMPFTLRAFEDEKKARMGVVECAKHELLQPFNVLYEKEGEFVAQFKFTVLLMPNGPMRITSGPFEPDLYKSEMEVQDAELKALLQSSASRKTQKKKKKKASKTAENATSGETLEENEAGD

SEQ ID NO: 747535 - protein, 126 aa, Homo sapiens; identical to SEQ ID NO: 747532

SEQ ID NO: 747536 - protein, 126 aa, Homo sapiens; identical to SEQ ID NO: 747532

SEQ ID NO: 747537 - protein, 129 aa, Homo sapiens
PPPPPPRAPSSARYEAGWCACLPAPLLARAFARPLLEDRGDSDHSLWLGRETEAAAAQGKRGCSGGSRKMSGEDEQQEQTIAEDLVVTKYKMGGDIANSECGLGGRGIRLIGKGNRLARKGLERRGHAD

SEQ ID NO: 747538 - protein, 309 aa, Homo sapiens
YAWSTWKSEQGTQVTGRKADVIKAAHLCAEAALRLVKPGNQNTQVTEAWNKVAHSFNCTPIEGMLSHQLKQHVIDGEKTIIQNPTDQQKKDHEKAEFEVHEVYAVDVLVSSGEGKAKDAGQRTTIYKRDPSKQYGLKMKTSRAFFSEVERRFDAMPFTLRAFEDEKKARMGVVECAKHELLQPFNVLYEKEGEFVAQFKFTVLLMPNGPMRITSGPFEPDLYKSEMEVQDAELKALLQSSASRKTQKKKKKKLQDCENAPGEHLENATGLGVHLQVVFDYPSQTKLEGVFPKRPKGFGPHPTFKTRLRG

SEQ ID NO: 747539 - protein, 210 aa, Homo sapiens; identical to SEQ ID NO: 747523

SEQ ID NO: 747540 - protein, 210 aa, Homo sapiens; identical to SEQ ID NO: 747523

SEQ ID NO: 747541 - protein, 210 aa, Homo sapiens; identical to SEQ ID NO: 747523

SEQ ID NO: 747542 - protein, 210 aa, Homo sapiens; identical to SEQ ID NO: 747523

SEQ ID NO: 747543 - protein, 210 aa, Homo sapiens; identical to SEQ ID NO: 747523

SEQ ID NO: 747544 - protein, 210 aa, Homo sapiens; identical to SEQ ID NO: 747523

SEQ ID NO: 747545 - protein, 210 aa, Homo sapiens; identical to SEQ ID NO: 747523

SEQ ID NO: 747546 - protein, 126 aa, Homo sapiens; identical to SEQ ID NO: 747532

SEQ ID NO: 747547 - protein, 191 aa, Homo sapiens
MLSHQLKQHVIDGEKTIIQNPTDQQKKDHEKAEFEVHEVYAVDVLVSSGEGKAKDAGQRTTIYKRDPSKQYGLKMKTSRAFFSEVERRFDAMPFTLRAFEDEKKARMGVVECAKHELLQPFNVLYEKEGEFVAQFKFTVLLMPNGPMRITSGPFEPDLYKSEMEVQDAELKAPQSRSENRKKKRGQRDAWT

SEQ ID NO: 747548 - protein, 151 aa, Homo sapiens
PSVHLQKRELTGGTSVDHSLWLGRETEAAAAQGKRGCSGGSRKMSGEDEQQEQTIAEDLVVTKYKMGGDIANRVLRSLVEASSSGVSVLSLCEKGDAMIMEETGKIFKKEQGNEESDLGVHVDGFIANVAHTFVVDVAQGDPSNREESRCY

SEQ ID NO: 747549 - protein, 233 aa, Homo sapiens
FGTRQRTTIYKRDPSKQYGLKMKTSRAFFSEVERRFDAMPFTLRAFEDEKKARMGVVECAKHELLQPFNVLYEKRAKDAGQRTTIYKRDPSKQYGLKMKTSRAFFSEVERRFDAMPFTLRAFEDEKKARMGVVECAKHELLQPFNVLYEKEGEFVAQFKFTVLLMPNGPMRITSGPFEPDLYKSEMEVQDAELKALLQSSASRKTQKKKKKKASKTAENATSGETLEENEAGD

SEQ ID NO: 747550 - protein, 126 aa, Homo sapiens; identical to SEQ ID NO: 747532

SEQ ID NO: 747551 - protein, 126 aa, Homo sapiens; identical to SEQ ID NO: 747532

SEQ ID NO: 747552 - protein, 919 aa, Homo sapiens
MGTTAPGPIHLLELCDQKLMEFLCNMDNKDLVWLEEIQEEAERMFTREFSKEPELMPKTPSQKNRRKKRRISYVQDENRDPIRRRLSRRKSRSSQLSSRRLRSKDSVEKLATVVGENGSVLRRVTRAAAAAAAATMALAAPSSPTPESPTMLTKKPEDNHTQCQLVPVVEIGISERQNAEQHVTQLMSTEPLPRTLSPTPASATAPTSQGIPTSDEESTPKKSKARILESITVSSLMATPQDPKGQGVGTGRSASKLRIAQVSPGPRDSPAFPDSPWRERVLAPILPDNFSTPTGSRTDSQSVRHSPIAPSSPSPQVLAQKYSLVAKQESVVRRASRRLAKKTAEEPAASGRIICHSYLERLLNVEVPQKVGSEQKEPPEEAEPVAAAEPEVPENNGNNSWPHNDTEIANSTPNPKPAASSPETPSAGQQEAKTDQADGPREPPQSARRKRSYKQAVSELDEEQHLEDEELQPPRSKTPSSPCPASKVVRPLRTFLHTVQRNQMLMTPTSAPRSVMKSFIKRNTPLRMDPKEKERQRLENLRRKEEAEQLRRQKVEEDKRRRLEEVKLKREERLRKVLQARERVEQMKEEKKKQIEQKFAQIDEKTEKAKEERLAEEKAKKKAAAKKMEEVEARRKQEEDARRLRWLQQEEEERRHQELLQKKKEEEQERLRKAAEAKRLAEQREQERREQERREQERREQERREQERREQERREQERQLAEQERRREQERLQAERELQEREKALRLQKEQLQRELEEKKKKEEQQRLAERQLQEEQEKKAKEAAGASKALNVTVDVQSPACTSSPITPQGHKAPPQINPHNYGMDLNSDDSTDDEAHPRKPIPTWARGTPLSQAIIHQYYQPPNLLELFGTILPLDLEDIFKKSKPRYHKRTSSAVWNSPPLQGARVPSSLAYSLKKH

SEQ ID NO: 747553 - protein, 525 aa, Homo sapiens
MGTTAPGPIHLLELCDQKLMEFLCNMDNKDLVWLEEIQEEAERMFTREFSKEPELMPKTPSQKNRRKKRRISYVQDENRDPIRRRLSRRKSRSSQLSSRRLRSKDSVEKLATVVGENGSVLRRVTRAAAAAAAATMALAAPSSPTPESPTMLTKKPEDNHTQCQLVPVVEIGISERQNAEQHVTQLMSTEPLPRTLSPTPASATAPTSQGIPTSDEESTPKKSKARILESITVSSLMATPQDPKGQGVGTGRSASKLRIAQVSPGPRDSPAFPDSPWRERVLAPILPDNFSTPTGSRTDSQSVRHSPIAPSSPSPQVLAQKYSLVAKQESVVRRASRRLAKKTAEEPAASGRIICHSYLERLLNVEVPQKVGSEQKEPPEEAEPVAAAEPEVPENNGNNSWPHNDTEIANSRKLQRELDEATESNEAMGREVNALKSKLRRGNETSFAPSRRSGGHRIITNADASEEHTYTRDADFTGSKSSFIINIFTNLHHNKFILLLYPPLAMTQRRPQSTLLLPSHRYRLE

SEQ ID NO: 747554 - protein, 81 aa, Homo sapiens
PKVAAAGAYARGRTHGGVSGELSRSLQPALLYLRVPCLPPPLKSVAQSESRGCACALHLVRCGCERRAFSDTARLLCFRAL

SEQ ID NO: 747555 - protein, 323 aa, Homo sapiens
LFARSPLGGALEARRMRPEGSLTYRVPERLRQGSCGVGRAAQALVCASAKEGTAFRMEAVQEGAAGVESEQAALGEEAVLLLDDIMAEVEVVAEEEGLVERREEAQRAQQAVPGPGPMTPESALEELLAVQVELEPVNAQARKAFSRQREKMERRRKPHLDRRGAVIQSVPGFWANVIANHPQMSALITDEDEDMLSYMVSLEVEEEKHRVHLCKIMLFFRSNPYFQNKVITKEYLVNITEYRASHSTPIEWYPDYEVEAYRRRHHNSSLNFFNWFSDHNFAGSNKIAEILCKDLWRNPLQYYKRMKPPEEGTETSGDSQLLS

SEQ ID NO: 747556 - protein, 406 aa, Homo sapiens
MAAAVRQDLAQLMNSSGSHKDLAGKYRQILEKAIQLSGAEQLEALKAFVEAMVNENVSLVISRQLLTDFCTHLPNLPDSTAKEIYHFTLEKIQPRVISFEEQVASIRQHLASIYEKEEDWRNAAQVLVGIPLETGQKQYNVDYKLETYLKIARLYLEDDDPVQAEAYINRASLLQNESTNEQLQIHYKVCYARVLDYRRKFIEAAQRYNELSYKTIVHESERLEALKHALHCTILASAGQQRSRMLATLFKDERCQQLAAYGILEKMYLDRIIRGNQLQEFAAMLMPHQKATTADGSSILDRAVIEHNLLSASKLYNNITFEELGALLEIPAAKAEKIASQMITEGRMNGFIDQIDGIVHFETREALPTWDKQIQSLCFQVNNLLEKISQTAPEWTAQAMEAQMAQ

SEQ ID NO: 747557 - protein, 406 aa, Homo sapiens; identical to SEQ ID NO: 747556

SEQ ID NO: 747558 - protein, 394 aa, Homo sapiens
MNSSGSHKDLAGKYRQILEKAIQLSGAEQLEALKAFVEAMVNENVSLVISRQLLTDFCTHLPNLPDSTAKEIYHFTLEKIQPRVISFEEQVASIRQHLASIYEKEEDWRNAAQVLVGIPLETGQKQYNVDYKLETYLKIARLYLEDDDPVQAEAYINRASLLQNESTNEQLQIHYKVCYARVLDYRRKFIEAAQRYNELSYKTIVHESERLEALKHALHCTILASAGQQRSRMLATLFKDERCQQLAAYGILEKMYLDRIIRGNQLQEFAAMLMPHQKATTADGSSILDRAVIEHNLLSASKLYNNITFEELGALLEIPAAKAEKIASQMITEGRMNGFIDQIDGIVHFETREALPTWDKQIQSLCFQVNNLLEKISQTAPEWTAQAMEAQMAQ

SEQ ID NO: 747559 - protein, 398 aa, Homo sapiens
MCDVPVLQAVVNSIKHRYRQILEKAIQLSGAEQLEALKAFVEAMVNENVSLVISRQLLTDFCTHLPNLPDSTAKEIYHFTLEKIQPRVISFEEQVASIRQHLASIYEKEEDWRNAAQVLVGIPLETGQKQYNVDYKLETYLKIARLYLEDDDPVQAEAYINRASLLQNESTNEQLQIHYKVCYARVLDYRRKFIEAAQRYNELSYKTIVHESERLEALKHALHCTILASAGQQRSRMLATLFKDERCQQLAAYGILEKMYLDRIIRGNQLQEFAAMLMPHQKATTADGSSILDRAVIEHNLLSASKLYNNITFEELGALLEIPAAKAEKIASQMITEGRMNGFIDQIDGIVHFETREALPTWDKQIQSLCFQVNNLLEKISQTAPEWTAQAMEAQMAQ

SEQ ID NO: 747560 - protein, 355 aa, Homo sapiens
MVNENVSLVISRQLLTDFCTHLPNLPDSTAKEIYHFTLEKIQPRVISFEEQVASIRQHLASIYEKEEDWRNAAQVLVGIPLETGQKQYNVDYKLETYLKIARLYLEDDDPVQAEAYINRASLLQNESTNEQLQIHYKVCYARVLDYRRKFIEAAQRYNELSYKTIVHESERLEALKHALHCTILASAGQQRSRMLATLFKDERCQQLAAYGILEKMYLDRIIRGNQLQEFAAMLMPHQKATTADGSSILDRAVIEHNLLSASKLYNNITFEELGALLEIPAAKAEKIASQMITEGRMNGFIDQIDGIVHFETREALPTWDKQIQSLCFQVNNLLEKISQTAPEWTAQAMEAQMAQ

SEQ ID NO: 747561 - protein, 406 aa, Homo sapiens; identical to SEQ ID NO: 747556

SEQ ID NO: 747562 - protein, 331 aa, Homo sapiens
MRSPGVIHAEARLENIQSYSDFLCREQVASIRQHLASIYEKEEDWRNAAQVLVGIPLETGQKQYNVDYKLETYLKIARLYLEDDDPVQAEAYINRASLLQNESTNEQLQIHYKVCYARVLDYRRKFIEAAQRYNELSYKTIVHESERLEALKHALHCTILASAGQQRSRMLATLFKDERCQQLAAYGILEKMYLDRIIRGNQLQEFAAMLMPHQKATTADGSSILDRAVIEHNLLSASKLYNNITFEELGALLEIPAAKAEKIASQMITEGRMNGFIDQIDGIVHFETREALPTWDKQIQSLCFQVNNLLEKISQTAPEWTAQAMEAQMAQ

SEQ ID NO: 747563 - protein, 406 aa, Homo sapiens; identical to SEQ ID NO: 747556

SEQ ID NO: 747564 - protein, 289 aa, Homo sapiens
NIPHSNSRLIEKTMKRKSYEQYNVDYKLETYLKIARLYLEDDDPVQAEAYINRASLLQNESTNEQLQIHYKVCYARVLDYRRKFIEAAQRYNELSYKTIVHESERLEALKHALHCTILASAGQQRSRMLATLFKDERCQQLAAYGILEKMYLDRIIRGNQLQEFAAMLMPHQKATTADGSSILDRAVIEHNLLSASKLYNNITFEELGALLEIPAAKAEKIASQMITEGRMNGFIDQIDGIVHFETREALPTWDKQIQSLCFQVNNLLEKISQTAPEWTAQAMEAQMAQ

SEQ ID NO: 747565 - protein, 162 aa, Homo sapiens
MLATLFKDERCQQLAAYGILEKMYLDRIIRGNQLQEFAAMLMPHQKATTADGSSILDRAVIEHNLLSASKLYNNITFEELGALLEIPAAKAEKIASQMITEGRMNGFIDQIDGIVHFETREALPTWDKQIQSLCFQVNNLLEKISQTAPEWTAQAMEAQMAQ

SEQ ID NO: 747566 - protein, 142 aa, Homo sapiens
APLKVSPPARGNQLQEFAAMLMPHQKATTADGSSILDRAVIEHNLLSASKLYNNITFEELGALLEIPAAKAEKIASQMITEGRMNGFIDQIDGIVHFETREALPTWDKQIQSLCFQVNNLLEKISQTAPEWTAQAMEAQMAQ

SEQ ID NO: 747567 - protein, 121 aa, Homo sapiens
LGFPKCWDDRGSSILDRAVIEHNLLSASKLYNNITFEELGALLEIPAAKAEKIASQMITEGRMNGFIDQIDGIVHFETREALPTWDKQIQSLCFQVNNLLEKISQTAPEWTAQAMEAQMAQ

SEQ ID NO: 747568 - protein, 249 aa, Homo sapiens
MAAAVRQDLAQLMNSSGSHKDLAGKYRQILEKAIQLSGAEQLEALKAFVEAMVNENVSLVISRQLLTDFCTHLPNLPDSTAKEIYHFTLEKIQPRVISFEEQVASIRQHLASIYEKEEDWRNAAQVLVGIPLETGQKQYNVDYKLETYLKIARLYLEDDDPVQAEAYINRASLLQNESTNEQLQIHYKVCYARVLDYRRKFIEAAQRYNELSYKTIVHESERLEALKHALHCTILASAGLQRSRCYISF

SEQ ID NO: 747569 - protein, 345 aa, Homo sapiens
MAAAVRQDLAQLMNSSGSHKDLAGKYRQILEKAIQLSGAEQLEALKAFVEAMVNENVSLVISRQLLTDFCTHLPNLPDSTAKEIYHFTLEKIQPRVISFEEQVASIRQHLASIYEKEEDWRNAAQVLVGIPLETGQKEKRRENQIEDKTKTGTKIENRDEKELNQEERAKLKTRIRRNGQTQTESNEKDEHTFSIDEYNPMNKKQILEQRNEIRDEEMMKETQEGQPKDHRADSYWRRSHHLRTHISCKGADDSKGKALQRRVFPRCTKRITPFTRKAGPGQCSEKSHCTMPRCGAAAHHGREKAPHRTAKPQEGRRPMNAVKEEKREPTGHRKHGPDLPNTEGG

SEQ ID NO: 747570 - protein, 105 aa, Homo sapiens
MAAAVRQDLAQLMNSSGSHKDLAGKYRQILEKAIQLSGAEQLEALKAFVEAMVNENVSLVISRQLLTDFCTHLPNLPDSTAKEIYHFTLEKIQPRVISFEEQVKI

SEQ ID NO: 747571 - protein, 234 aa, Homo sapiens
AEPREPRTPSCTCAGGSMTVELWLRLRGKGLAMLHVTRGVWGSRVRVWPLLPALLGPPRALSSLAAKMGEYRKMWNPREPRDWAQQYRERFIPFSKEQLLRLLIQQEFHSSPAEKAALEAFSAHVDFCTLFHYHQILARLQALYDPINPDRETLDQPSLTDPQRLSNEQEVLRALEPLLAQANFSPLSEDTLAYALVVHHPQDEVQVTVNLDQPGWESWLHGTAPSCHSFLYLS

SEQ ID NO: 747572 - protein, 618 aa, Homo sapiens
AEPREPRTPSCTCAGGSMTVELWLRLRGKGLAMLHVTRGVWGSRVRVWPLLPALLGPPRALSSLAAKMGEYRKMWNPREPRDWAQQYRERFIPFSKEQLLRLLIQQEFHSSPAEKAALEAFSAHVDFCTLFHYHQILARLQALYDPINPDRETLDQPSLTDPQRLSNEQEVLRALEPLLAQANFSPLSEDTLAYALVVHHPQDEVQVTVNLDQYVYIHFWALGQRVGQMPLKSSVGSRRGFFTKLPPAERCGGPCSPAAARGSKVRVKRGLTGKVSTTLDSQGKRKDGDSSPHFPIRKTEARQREVHILKMRHGQDSNKQSARPIPGIDGAIEPIPCGWTQLIPGFFPMITESLLRWLCDCRARVSVLGLEGAPRAVQSRILLLPLSLSLRRYFKRVVLAARTKRGHLVLKSFKDTPLEGLEQLLPELKVRTPTLQRALLNLMLVVSGVAIFVNVGMVVLTDLKVATSLLLLLFAIFMGLRASKMFGQRRSAQALELAHMLYYRSTSNNSELLSALALRAQDEHTKEALLAHSFLARRPGGTQGSPEETSRWLRSEVENWLLAKSGCEVTFNGTRALAHLQALTPSMGLYPPPGFPKLDPVAPITSEPPQATPSSNIS

SEQ ID NO: 747573 - protein, 477 aa, Homo sapiens
AEPREPRTPSCTCAGGSMTVELWLRLRGKGLAMLHVTRGVWGSRVRVWPLLPALLGPPRALSSLAAKMGEYRKMWNPREPRDWAQQYRERFIPFSKEQLLRLLIQQEFHSSPAEKAALEAFSAHVDFCTLFHYHQILARLQALYDPINPDRETLDQPSLTDPQRLSNEQEVLRALEPLLAQANFSPLSEDTLAYALVVHHPQDEVQVTVNLDQYVYIHFWALGQRVGQMPLKSSVGSRRGFFTKLPPAERRYFKRVVLAARTKRGHLVLKSFKDTPLEGLEQLLPELKVRTPTLQRALLNLMLVVSGVAIFVNVGMVVLTDLKVATSLLLLLFAIFMGLRASKMFGQRRSAQALELAHMLYYRSTSNNSELLSALALRAQDEHTKEALLAHSFLARRPGGTQGSPEETSRWLRSEVENWLLAKSGCEVTFNGTRALAHLQALTPSMGLYPPPGFPKLDPVAPITSEPPQATPSSNIS

SEQ ID NO: 747574 - protein, 426 aa, Homo sapiens
TPAQSFLWLRLRGKGLAMLHVTRGVWGSRVRVWPLLPALLGPPRALSSLAAKMGEYRKMWNPREPRDWAQQYRERFIPFSKEQLLRLLIQALYDPINPDRETLDQPSLTDPQRLSNEQEVLRALEPLLAQANFSPLSEDTLAYALVVHHPQDEVQVTVNLDQYVYIHFWALGQRVGQMPLKSSVGSRRGFFTKLPPAERRYFKRVVLAARTKRGHLVLKSFKDTPLEGLEQLLPELKVRTPTLQRALLNLMLVVSGVAIFVNVGMVVLTDLKVATSLLLLLFAIFMGLRASKMFGQRRSAQALELAHMLYYRSTSNNSELLSALALRAQDEHTKEALLAHSFLARRPGGTQGSPEETSRWLRSEVENWLLAKSGCEVTFNGTRALAHLQALTPSMGLYPPPGFPKLDPVAPITSEPPQATPSSNIS

SEQ ID NO: 747575 - protein, 477 aa, Homo sapiens; identical to SEQ ID NO: 747573

SEQ ID NO: 747576 - protein, 597 aa, Homo sapiens
TPAQSFLWLRLRGKGLAMLHVTRGVWGSRVRVWPLLPALLGPPRALSSLAAKMGEYRKMWNPREPRDWAQQYRERFIPFSKEQLLRLLIQALYDPINPDRETLDQPSLTDPQRLSNEQEVLRALEPLLAQANFSPLSEDTLAYALVVHHPQDEVQVTVNLDQYVYIHFWALGQRVGQMPLKSSVGSRRGFFTKLPPAERCGGPCSPAAARGSKVRVKRGLTGQCLVWVSGPQAGSGEMGGVTHPNAVFSSQGKVSTTLDSQGKRKDGDSSPHFPIRKTEARQREVHILKMRHGQDSNKQSARPIPGIDGAIEPIPCGWTQLIPGFFPMITESLLRWLCDCRARVSVLGLEGAPRAVQSQILLLPLSLSLRRYFKRVVLAARTKRGHLVLKSFKDTPLEGLEQLLPELKVRTPTLQRALLNLMLVVSGVAIFVNVGMVVLTDLKVATSLLLLLFAIFMGLRASKMFGQRRSAQALELAHMLYYRSTSNNSELLSALALRAQDEHTKEALLAHSFLARRPGGTQGSPEETSRWLRSEVENWLLAKSGCEVTFNGTRALAHLQALTPSMGLYPPPGFPKLDPVAPITSEPPQATPSSNIS

SEQ ID NO: 747577 - protein, 115 aa, Homo sapiens
MGFSKKQGRESASDMRTIQGKGAVPPKHDEPLEARYSHGVYPRAPVRMSHRQSVSPEYEGMGTSRSHHPCDWPVAASSSHRTSARNGKRSPLGEWGGKRVPLQAAGEQSAPLGRV

SEQ ID NO: 747578 - protein, 105 aa, Homo sapiens
MRTAEARQIACDELFTNEAEEYSLYEAVKFLMLNRAIELYNDKEKGKEVPFFSVLLFARDTSNDPGQLLRNHLNQVGHTGGLEQVSCAFEHVLPQNKAALLIKLD

SEQ ID NO: 747579 - protein, 348 aa, Homo sapiens
MPQPEAWPGASCAETPAREAAATARDGGKAAASGQPRPEMQCPAEHEEDMYRAADEIEKEKELLIHERGASEPRLSVAPEMDIMDYCKKEWRGNTQKATCMKMGYEEVSQKFTSIRRVRGDNYCALRATLFQAMSQAVGLPPWLQDPELMLVLPEKLISKYNWIKQWKLGLKFDGKNEDLVDKIKESLTLLRKKWAGLAEMRTAEARQIACDELFTNEAEEYSLYEAVKFLMLNRAIELYNDKEKGKEVPFFSVLLFARDTSNDPGQLLRNHLNQVGHTGGLEQVEMFLLAYAVRHTIQVYRLSKYNTEEFITVYPTDPPKDWPVVTLIAEDDRHYNIPVRVCEETSL

SEQ ID NO: 747580 - protein, 268 aa, Homo sapiens
MDIMDYCKKEWRGNTQKATCMKMGYEEVSQKFTSIRRVRGDNYCALRATLFQAMSQAVGLPPWLQDPELMLVLPEKLISKYNWIKQWKLGLKFDGKNEDLVDKIKESLTLLRKKWAGLAEMRTAEARQIACDELFTNEAEEYSLYEAVKFLMLNRAIELYNDKEKGKEVPFFSVLLFARDTSNDPGQLLRNHLNQVGHTGGLEQVEMFLLAYAVRHTIQVYRLSKYNTEEFITVYPTDPPKDWPVVTLIAEDDRHYNIPVRVCEETSL

SEQ ID NO: 747581 - protein, 268 aa, Homo sapiens; identical to SEQ ID NO: 747580

SEQ ID NO: 747582 - protein, 348 aa, Homo sapiens; identical to SEQ ID NO: 747579

SEQ ID NO: 747583 - protein, 268 aa, Homo sapiens; identical to SEQ ID NO: 747580

SEQ ID NO: 747584 - protein, 148 aa, Homo sapiens [sequence omitted]

SEQ ID NO: 747585 - protein, 158 aa, Homo sapiens
MPQPEAWPGASCAETPAREAAATARDGGKAAASGQPRPEMQCPAEHEEDMYRAADEIEKEKELLIHERGASEPRLSVAPEMDIMDYCKKEWRGNTQKATCMKMGYEEVSQKFTSIRRVRGDNYCALRATLFQAMSQAVGLPPWLQDPELMLVRYQKNS

SEQ ID NO: 747586 - protein, 133 aa, Homo sapiens
IDKHQFQVLRPQKPLRTQSHLFNSKSTMTHGKLMNPWWPAGKKQCCYILVFAIGGNSYYGMISSVCICSSCPNKVAHWGLKQQRCNSSQFRRREVRDHSVGRSDSSQGLSPWTAEADSYLCPHMVVPLCVSVS

SEQ ID NO: 747587 - protein, 45 aa, Homo sapiens [sequence omitted]

SEQ ID NO: 747588 - protein, 227 aa, Homo sapiens
MAPCHIRKYQESDRQWVVGLLSRGMAEHAPATFRQLLKLPRTLILLLGGPLALLLVSGSWLLALVFSISLFPALWFLAKKPWTEYVDMTLCTDMSDITKSYLSERGSCFWVAESEEKVVGMVGALPVDDPTLREKRLQLFHLFVDSEHRRQGIAKALVRTVLQFARDQGYSEVILDTGTIQLSAMALYQSMGFKKTGQSFFCVWARLVALHTVHFIYHLPSSKVGSL

SEQ ID NO: 747589 - protein, 227 aa, Homo sapiens; identical to SEQ ID NO: 747588

SEQ ID NO: 747590 - protein, 227 aa, Homo sapiens; identical to SEQ ID NO: 747588

SEQ ID NO: 747591 - protein, 227 aa, Homo sapiens; identical to SEQ ID NO: 747588

SEQ ID NO: 747592 - protein, 410 aa, Homo sapiens
METRPTALMSSTVAAAAPAAGAASRKESPGRWGLGEDPTGVSPSLQCRVCGDSSSGKHYGIYACNGCSGFFKRSVRRRLIYRCQVGAGMCPVDKAHRNQCQACRLKKCLQAGMNQDAVQNERQPRSTAQVHLDSMESNTESRPESLVAPPAPAGRSPRGPTPMSAARALGHHFMASLITAETCAKLEPEDADENIDVTSNDPEFPSSPYSSSSPCGLDSIHETSARLLFMAVKWAKNLPVFSSLPFRDQVILLEEAWSELFLLGAIQWSLPLDSCPLLAPPEASAAGGAQGRLTLASMETRVLQETISRFRALAVDPTEFACMKALVLFKPETRGLKDPEHVEALQDQSQVMLSQHSKAHHPSQPVRFGKLLLLLPSLRFITAERIELLFFRKTIGNTPMEKLLCDMFKN

SEQ ID NO: 747593 - protein, 367 aa, Homo sapiens
METRPTALMSSTVAAAAPAAGAASRKESPGRWGLGEDPTGVSPSLQCRVCGDSSSGKHYGIYACNGCSGFFKRSVRRRLIYRCQVGAGMCPVDKAHRNQCQACRLKKCLQAGMNQDAVQNERQPRSTAQVHLDSMESNTESRPESLVAPPAPAGRSPRGPTPMSAARALGHHFMASLITAETCAKLEPEDADENIDVTSNDPEFPSSPYSSSSPCGLDSIHETSARLLFMAVKWAKNLPVFSSLPFRDQVILLEEAWSELFLLGAIQWSLPLDSCPLLAPPEASAAGGAQGRLTLASMETRVLQETISRFRALAVDPTEFACMKALVLFKPETRGLKDPEHVEALQDQSQVMLSQHSKAHHPSQPVR

SEQ ID NO: 747594 - protein, 386 aa, Homo sapiens
MSHFLRDTWLAGDGEGVSPSLQCRVCGDSSSGKHYGIYACNGCSGFFKRSVRRRLIYRCQVGAGMCPVDKAHRNQCQACRLKKCLQAGMNQDAVQNERQPRSTAQVHLDSMESNTESRPESLVAPPAPAGRSPRGPTPMSAARALGHHFMASLITAETCAKLEPEDADENIDVTSNDPEFPSSPYSSSSPCGLDSIHETSARLLFMAVKWAKNLPVFSSLPFRDQVILLEEAWSELFLLGAIQWSLPLDSCPLLAPPEASAAGGAQGRLTLASMETRVLQETISRFRALAVDPTEFACMKALVLFKPETRGLKDPEHVEALQDQSQVMLSQHSKAHHPSQPVRFGKLLLLLPSLRFITAERIELLFFRKTIGNTPMEKLLCDMFKN

SEQ ID NO: 747595 - protein, 129 aa, Homo sapiens [sequence omitted]

SEQ ID NO: 747596 - protein, 365 aa, Homo sapiens
MASTESSLLRSLGLSPGPGSSEVELDCWFDEDFKFILLPVSYAVVFVLGLGLNAPTLWLFIFRLRPWDATATYMFHLALSDTLYVLSLPTLIYYYAAHNHWPFGTEICKFVRFLFYWNLYCSVLFLTCISVHRYLGICHPLRALRWGRPRLAGLLCLAVWLVVAGCLVPNLFFVTTSNKGTTVLCHDTTRPEEFDHYVHFSSAVMGLLFGVPCLVTLVCYGLMARRLYQPLPGSAQSSSRLRSLRTIAVVLTVFAVCFVPFHITRTIYYLARLLEADCRVLNIVNVVYKVTRPLASANSCLDPVLYLLTGDKYRRQLRQLCGGGKPQPRTAASSLALVSLPEDSSCRWAATPQDSSCSTPRADRL

SEQ ID NO: 747597 - protein, 40 aa, Homo sapiens
MKAESTNTGSKWRPESQVCIPTHHDWQTSSGFKGTAGLFL

SEQ ID NO: 747598 - protein, 312 aa, Homo sapiens
MDGGNQSEGSEFLLLGMSESPEQQRILFWMFLSMYLVTVVGNVLIILAISSDSRLHTPVYFFLANLSFTDLFFVTNTIPKMLVNLQSHNKAISYAGCLTQLYFLVSLVALDNLILAVMAYDRYVAICCPLHYTTAMSPKLCILLLSLCWVLSVLYGLIHTLLMTRVTFCGSRKIHYIFCEMYVLLRMACSNIQINHTVLIATGCFIFLIPFGFVIISYVLIIRAILRIPSVSKKYKAFSTCASHLGAVSLFYGTLCMVYLKPLHTYSVKDSVATVMYAVVTPMMNPFIYSLRNKDMHGALGRLLDKHFKRLT

SEQ ID NO: 747599 - protein, 123 aa, Homo sapiens
MILENMLCQNRKVNQVGGRHRISLKELQFEGDAKRISKKMTISDTRGIGAHQVGRSTNLDWGLSEGSRRKTLLKMKLTYYLILLNILRQVFICEWCLHDHNINTEYCSKNMTSLYVEDEMNRN

SEQ ID NO: 747600 - protein, 1002 aa, Homo sapiens
MGVAGRNRPGAAWAVLLLLLLAPLLLLQGTSPGRGRARGRRRVSVRPHVDECAQGLDDCHADALCQNTPTSYKCSCKPGYQGEGRQCEDIDECGNELNGGCVHDCLNIPGNYRCTCFDGFMLAHDGHNCLDVDECLENNGGCQHTCVNVMGSYECCCKEGFFLSDNQHTCIHRSEEGLSCMNKDHGCSHICKEAPRGSVACECRPGFELAKNQRDCILTCNHGNGGCQHSCDDTADGPECSCHPQYKMHTDGRSCLEREDTVLEVTESNTTSVVDGDKRVKRRLLMETCAVNNGGCDRTCKDTSTGVHCSCPVGFTLQLDGKTCKDIDECQTRNGGCDHFCKNIVGSFDCGCKKGFKLLTDEKSCQDVDECSLDRTCDHSCINHPGTFACACNRGYTLYGFTHCGDTNECSINNGGCQQVCVNTVGSYECQCHPGYKLHWNKKDCVEVKGLLPTSVSPRVSLHCGKSGGGDGCFLRCHSGIHLSSDVTTIRTSVTFKLNEGKCSLKNAELFPEGLRPALPEKHSSVKESFRYVNLTCSSGKQVPGAPGRPSTPKEMFITVEFELETNQKEVTASCDLSCIVKRTEKRLRKAIRTLRKAVHREQFHLQLSGMNLDVAKKPPRTSERQAESCGVGQGHAENQCVSCRAGTYYDGARERCILCPNGTFQNEEGQMTCEPCPRPGNSGALKTPEAWNMSECGGLCQPGEYSADGFAPCQLCALGTFQPEAGRTSCFPCGGGLATKHQGATSFQDCETRVQCSPGHFYNTTTHRCIRCPVGTYQPEFGKNNCVSCPGNTTTDFDGSTNITQCKNRRCGGELGDFTGYIESPNYPGNYPANTECTWTINPPPKRRILIVVPEIFLPIEDDCGDYLVMRKTSSSNSVTTYETCQTYERPIAFTSRSKKLWIQFKSNEGNSARGFQVPYVTYDEDYQELIEDIVRDGRLYASENHQEILKDKKLIKALFDVLAHPQNYFKYTAQESREMFPRSFIRLLRSKVSRFLRPYK

SEQ ID NO: 747601 - protein, 158 aa, Homo sapiens
PPSSSVSLVCELQVWQGLAWARAPQPKAWVSLGLFDQDQRVLSGRWRLPLRALPLDPSLSLGQLNGIPQAGQAELFLRLVNARDAAVQTLAEINPASVHEYQYPPPVSSTSSLEANFLTPAVGFADPPPRTEEPLSGVKDRDEGLGPHHSSDLPPVSF

SEQ ID NO: 747602 - protein, 161 aa, Homo sapiens
SFFLLPACNLEVIAGASAAILDHEVTLRMEAICEDDATEREEAGFPLSLWSNHTSLKLLPLGIFYMLGKRNFYVVKPLLLRDFPCAAKQIQQQMGKASQGFQGDKRPLNKEQDSFLKYFSKTVRNLYSRGEATTMRFCSRGQRSGLTPKIPFNKAMPSSHW

SEQ ID NO: 747603 - protein, 378 aa, Homo sapiens
MRMLVSGRRVKKWQLIIQLFATCFLASLMFFWEPIDNHIVSHMKSYSYRYLINSYDFVNDTLSLKHTSAGPRYQYLINHKEKCQAQDVLLLLFVKTAPENYDRRSGIRRTWGNENYVRSQLNANIKTLFALGTPNPLEGEELQRKLAWEDQRYNDIIQQDFVDSFYNLTLKLLMQFSWANTYCPHAKFLMTADDDIFIHMPNLIEYLQSLEQIGVQDFWIGRVHRGAPPIRDKSSKYYVSYEMYQWPAYPDYTAGAAYVISGDVAAKVYEASQTLNSSLYIDDVFMGLCANKIGIVPQDHVFFSGEGKTPYHPCIYEKMMTSHGHLEDLQDLWKNATDPKVKTISKGFFGQIYCRLMKIILLCKISYVDTYPCRAAFI

SEQ ID NO: 747604 - protein, 376 aa, Homo sapiens
MLVSGRRVKKWQLIIQLFATCFLASLMFFWEPIDNHIVSHMKSYSYRYLINSYDFVNDTLSLKHTSAGPRYQYLINHKEKCQAQDVLLLLFVKTAPENYDRRSGIRRTWGNENYVRSQLNANIKTLFALGTPNPLEGEELQRKLAWEDQRYNDIIQQDFVDSFYNLTLKLLMQFSWANTYCPHAKFLMTADDDIFIHMPNLIEYLQSLEQIGVQDFWIGRVHRGAPPIRDKSSKYYVSYEMYQWPAYPDYTAGAAYVISGDVAAKVYEASQTLNSSLYIDDVFMGLCANKIGIVPQDHVFFSGEGKTPYHPCIYEKMMTSHGHLEDLQDLWKNATDPKVKTISKGFFGQIYCRLMKIILLCKISYVDTYPCRAAFI

SEQ ID NO: 747605 - protein, 376 aa, Homo sapiens; identical to SEQ ID NO: 747604

SEQ ID NO: 747606 - protein, 376 aa, Homo sapiens; identical to SEQ ID NO: 747604

SEQ ID NO: 747607 - protein, 378 aa, Homo sapiens; identical to SEQ ID NO: 747603

SEQ ID NO: 747608 - protein, 378 aa, Homo sapiens; identical to SEQ ID NO: 747603

SEQ ID NO: 747609 - protein, 378 aa, Homo sapiens; identical to SEQ ID NO: 747603

SEQ ID NO: 747610 - protein, 378 aa, Homo sapiens; identical to SEQ ID NO: 747603

SEQ ID NO: 747611 - protein, 251 aa, Homo sapiens
MLVSGRRVKKWQLIIQLFATCFLASLMFFWEPIDNHIVSHMKSYSYRYLINSYDFVNDTLSLKHTSAGPRYQYLINHKEKCQAQDVLLLLFVKTAPENYDRRSGIRRTWGNENYVRSQLNANIKTLFALGTPNPLEGEELQRKLAWEDQRYNDIIQQDFVDSFYNLTLKLLMQFSWANTYCPHAKFLMTADDDIFIHMPNLIEYLQSLEQIGVQDFWIGRVHRGAPPIRDKSSKYYVSCRRGREFSSSRRP

SEQ ID NO: 747612 - protein, 66 aa, Homo sapiens
MEHVVQACHRFIQASYEPLGIIRFRHLQTLKSHVRIHTGEKPYHCDPCGLHFRHKSQLRLHLRQKH

SEQ ID NO: 747613 - protein, 307 aa, Homo sapiens
MLNTTSVTEFLLLGVTDIQELQPFLFVVFLTIYFISVTGNGAVLMIVISDPRLHSLMYFFLGNLSYLDICYSTVTLPKMLQNFLSTHKAISFLGCISQLHFFHFLGSTESMLFAVMAFDLSVAICKPLRYTVIMNPQLCTQMAITIWVIGFFHALLHSVMTSRLNFCGSNRIHHFLCDIKPLLKLACGNTELNQWLLSTVTGTIAMGPFFLTLLSYFYIITYLFFKTRSCSMLCKALSTCASHFMVVILFYAPVLFTYIHPALESFMDQDRIVAIMYTVVTPVLNPLIYTLRNKEVKGALGRVIRRL

SEQ ID NO: 747614 - protein, 402 aa, Homo sapiens
PFRARRAFGGVGRAAERSRGSTAVRWRRVYADGARPEPRAPRGSPPAGLPPLPRLRLGTTSAFCWRTVLSFSALRSNGNFIAPGWKLKGLAFPLSLSLSHSPSLSLSRPPFPLLPPPFPRSRSQHLQARDPAPSTSQLSGCRPFHGRRARLQPPPPRGGRDATMGLIWLLLLSLLEPGWPAAGPGARLRRDAGGRGGVYEHLGGAPRRRKLYCATKYHLQLHPSGRVNGSLENSAYSILEITAVEVGIVAIRGLFSGRYLAMNKRGRLYASEHYSAECEFVERIHELGYNTYASRLYRTVSSTPGARRQPSAERLWYVSVNGKGRPRRGFKTRRTQKSSLFLPRVLDHRDHEMVRQLQSGLPRPPGKGVQPRRRRQKQSPDNLEPSHVQASRLGSQLEASAH

SEQ ID NO: 747615 - protein, 112 aa, Homo sapiens
CDTRPGSEKRRAGWPLPCDTWPGSEKRQAGWPLPCHVTHGLVLRSGRQGGRCHATHGLVLRSGGQGGCCSESHTLAFAVHQSETRPASSLPFMLVPSFHWIQRGFECIGWRQ

SEQ ID NO: 747616 - protein, 143 aa, Homo sapiens
MRPPEPRKATVLRGILRERPTGFQASLSLRTLISTTGFKCGLEAWLPVWTSLHLQELTSRHSWMPPPAGTSRASSRPRLHLLWDWPPQAPPGHPPAPGCSFCGTEPRRHLPGILPPQAAPSVGLSPAGTSPASSRPRLQLLWD

SEQ ID NO: 747617 - protein, 129 aa, Homo sapiens
LATPLPDNVVVVSQEEFLAVLAGVVNHPDPSHKVDHLLACRVVQVVAALVTPVPVHPLQPELAAGRRPIRHDKPTPRAPRPPARRGRPRRGWGCGGPAGAQRAAQGADFRGDTQAQPSGPAATIIRCSR

SEQ ID NO: 747618 - protein, 68 aa, Homo sapiens
GSQRWTNGFTTLKGMLCGVCLGANHHHDTLPNEQTKANWLRILTKTSQPEEAMPWVKSRTTRFQTLYF

SEQ ID NO: 747619 - protein, 325 aa, Homo sapiens
MSNDGRSRNRDRRYDEVPSDLPYQDTTIRTHPILHDSERAVSADPLPPPPLPLQPPFGPDFYSSDTEEPAIAPDLKPVRRFVPDSWKNFFRGKKKDPEWDKPVSDIRYISDGVECSPPASPARPNHRSPLNSCKDPYGGSEGTFSSRKEADAVFPRDPYGSLDRHTQTVRTYSEKVEEYNLRYSYMKSWAGLLRILGVVELLLGAGVFACVTAYIHKDSEWYNLFGYSQPYGMGGVGGLGSMYGGYYYTGPKTPFVLVVAGLAWITTIIILVLGMSMYYRTILLDSNWWPLTEFGINVALFILYMAAAIVYVNDTNRGGLCYYPL

SEQ ID NO: 747620 - protein, 93 aa, Homo sapiens
MGGVGGLGSMYGGYYYTGPKTPFVLVVAGLAWITTIIILVLGMSMYYRTILLDSNWWPLTEFGINVALFILYMAAAIVYVNDTNRGGLCYYPL

SEQ ID NO: 747621 - protein, 212 aa, Homo sapiens [sequence omitted]

SEQ ID NO: 747622 - protein, 212 aa, Homo sapiens [sequence omitted]

SEQ ID NO: 747623 - protein, 333 aa, Homo sapiens
MQAAGHPEPLDSRGSFSLPTMGANVSQDNGTGHNATFSEPLPFLYVLLPAVYSGICAVGLTGNTAVILVILRAPKMKTVTNVFILNLAVADGLFTLVLPVNIAEHLLQYWPFGELLCKLVLAVDHYNIFSSIYFLAVMSVDRYLVVLATVRSRHMPWRTYRGAKVASLCVWLGVTVLVLPFFSFAGVYSNELQVPSCGLSFPWPEQVWFKASRVYTLVLGFVLPVCTICVLYTDLLRRLRAVRLRSGAKALGKARRKVTVLVLVVLAVCLLCWTPFHLASVVALTTDLPQTPLVISMSYVITSLSYANSCLNPFLYAFLDDNFRKNFRSILRC

SEQ ID NO: 747624 - protein, 114 aa, Homo sapiens
RIISGSFCMYNHKKTLAFICFILLRQSKVKVLPPSLSTHSHTEHKYLLMMWTPFILPKFLKSLLPECLMQALNSLLTPFHPPYDARWAMLPVPAMLECLFLSSHFPPVGCFHVY

SEQ ID NO: 747625 - protein, 360 aa, Homo sapiens
MSGSVLFTAGERWRCFLTPSRSSLYWALHNFCCRKKSTTPKKITPNVTFCDENAKEPENALDKLFSSEQQASILHVLNTASTKELEAFRLLRGRRSINIVEHRENFGPFQNLESLMNVPLFKYKSTVQVCNSILCPKTGREKRKSPENRFLRKLLKPDIERERLKAVNSIISIVFGTRRIAWAHLDRKLTVLDWQQSDRWSLMRGIYSSSVYLEEISSIISKMPKADFYVLEKTGLSIQNSSLFPILLHFHIMEAMLYALLNKTFAQDGQHQVLSMNRNAVGKHFELMIGDSRTSGKELVKQFLFDSILKADPRVFFPSDKIVHYRQMFLSTELQRVEELYDSLLQAIAFYELAVFDSQP

SEQ ID NO: 747626 - protein, 176 aa, Homo sapiens
MSGSVLFTAGERWRCFLTPSRSSLYWALHNFCCRKKSTTPKKITPNVTFCDENAKEPENALDKLFSSEQQASILHVLNTASTKELEAFRLLRGRRSINIVEHRENFGPFQNLESLMNVPLFKYKSTVQVCNSILCPKTGREKRKSPENRFLRKLLKPDIERERLKEELPGLTLIVS

SEQ ID NO: 747627 - protein, 181 aa, Homo sapiens
MSGSVLFTAGERWRCFLTPSRSSLYWALHNFCCRKKSTTPKKITPNVTFCDENAKEPENALDKLFSSEQQASILHVLNTASTKELEAFRLLRGRRSINIVEHRENFGPFQNLESLMNVPLFKYKSTVQVCNSILCPKTGREKRKSPENRFLRKLLKPDIERERLKVYSSCLLYCLIFENLL

SEQ ID NO: 747628 - protein, 331 aa, Homo sapiens
MSGSVLFTAGERWRCFLTPSRSSLYWALHNFCCRKKSTTPKKITPNVTFCDENAKEPENALDKLFSSEQQASILHVLNTASTKELEAFRLLRGRRSINIVEHRENFGPFQNLESLMNVPLFKYKSTVQVCNSILCPKTGREKRKSPENRFLRKLLKPDIERERLKAVNSIISIVFGTRRIAWAHLDRKLTVLDWQQSDRWSLMRGIYSSSVYLEEISSIISKMPKADFYVLEKTGLSIQNSSLFPILLHFHIMEAMLYALLNKTFAQDGQHQVLSMNRTAWGTPLTVMGPGHWRALGRPRPKEGARGSPKNLTGFSWTRKCFNSPIGAPPP

SEQ ID NO: 747629 - protein, 225 aa, Homo sapiens
MCPCLSIKVQFKFVTPYFVQRLDGKKESHRTVNSIISIVFGTRRIAWAHLDRKLTVLDWQQSDRWSLMRGIYSSSVYLEEISSIISKMPKADFYVLEKTGLSIQNSSLFPILLHFHIMEAMLYALLNKTFAQDGQHQVLSMNRNAVGKHFELMIGDSRTSGKELVKQFLFDSILKADPRVFFPSDKIVHYRQMFLSTELQRVEELYDSLLQAIAFYELAVFDSQP

SEQ ID NO: 747630 - protein, 216 aa, Homo sapiens
MNVPLFKYKSTVQVCNSILCPKTGREKRKSPENRFLRKLLKPDIERERLKAVNSIISIVFGTRRIAWAHLDRKLTVLDWQQSDRWSLMRGIYSSSVYLEEISSIISKMPKADFYVLEKTGLSIQNSSLFPILLHFHIMEAMLYALLNKTFAQDGQHQVLSMNRTAWGTPLTVMGPGHWRALGRPRPKEGARGSPKNLTGFSWTRKCFNSPIGAPPP

SEQ ID NO: 747631 - protein, 210 aa, Homo sapiens
MLPLPSCSLPILLLFLLPSVPIESQPPPSTLPPFLAPEWDLLSPRVVLSRGAPAGPPLLFLLEAGAFRESAGAPANRSRRGVSETAPASRRGELAVCDAVSGWVTDRRTAVDLRGREVEVLGEVPAAGGSPLRQYFFETRCKADNAEEGGPGAGGGGCRGVDRRHWVSECKAKQSYVRALTADAQGRVGWRWIRIDTACVCTLLSRTGRA

SEQ ID NO: 747632 - protein, 210 aa, Homo sapiens; identical to SEQ ID NO: 747631

SEQ ID NO: 747633 - protein, 210 aa, Homo sapiens; identical to SEQ ID NO: 747631

SEQ ID NO: 747634 - protein, 130 aa, Homo sapiens
MAIWLLSTGTPKRCGWRAGVGGVDLLGSSHGLGQSSGQTGVRHRGAKFLFWPLQYPEKLAGPLTAAAPRVVERAVKSPQTSTRTPGFSCDLGHSSCPLGLDFPTCKWGCQPWLCLLHEALEDWPRLWRSL

SEQ ID NO: 747635 - protein, 75 aa, Homo sapiens
GLGFVHSPLLKRKQRTSRALMHITDWCQAPWCKIPLLAPPVPRETGWAINCCSTKGGRKSCEEPPNQYQDTWVLL

SEQ ID NO: 747636 - protein, 102 aa, Homo sapiens
SFLSNGCLARQYCGRGGSGASAGQWPPSPRSDSAGGRSLSPAASEVMQRYRWLVTSTTTWPAAHLLGGRMKRSAGQGLPMLDAHLLPNRFGVHSLNAEESGG

SEQ ID NO: 747637 - protein, 261 aa, Homo sapiens
AGCRDPGRELRAPGRPRLPGALRQVLCSLCGWLSLYISFCHLNKHRSYEWSCRLVTFTHGVLSIGLSAYIGFIDGPWPFTHPGSPNTPLQVHVLCLTLGYFIFDLGWCVYFQSEGALMLAHHTLSILGIIMALVLGESGTEVNAVLFGSELTNPLLQMRWFLRETGHYHSFTGDVVDFLFVALFTGVRIGVGACLLFCEMVSPTPKWFVKAGGVAMYAVSWCFMFSIWRFAWRKSIKKYHAWRSRRSEERQLKHNGHLKIH

SEQ ID NO: 747638 - protein, 139 aa, Homo sapiens
RARAESSPGCAPQMALALCLQVLCSLCGWLSLYISFCHLNKHRSYEWSCRLVTFTHGVLSIGLSAYIGFIDGPWPFTHPGSPNTPLQVHVLCLTLGYFIFDLGCIWRFAWRKSIKKYHAWRSRRSEERQLKHNGHLKIH

SEQ ID NO: 747639 - protein, 267 aa, Homo sapiens
MTQCCFLRVHPLFFWFWSFHHRMALALCLQVLCSLCGWLSLYISFCHLNKHRSYEWSCRLVTFTHGVLSIGLSAYIGFIDGPWPFTHPGSPNTPLQVHVLCLTLGYFIFDLGWCVYFQSEGALMLAHHTLSILGIIMALVLGESGTEVNAVLFGSELTNPLLQMRWFLRETGHYHSFTGDVVDFLFVALFTGVRIGVGACLLFCEMVSPTPKWFVKAGGVAMYAVSWCFMFSIWRFAWRKSIKKYHAWRSRRSEERQLKHNGHLKIH

SEQ ID NO: 747640 - protein, 258 aa, Homo sapiens
RARAESSPGCAPQMALALCLQVLCSLCGWLSLYISFCHLNKHRSYEWSCRLVTFTHGVLSIGLSAYIGFIDGPWPFTHPGSPNTPLQVHVLCLTLGYFIFDLGWCVYFQSEGALMLAHHTLSILGIIMALVLGESGTEVNAVLFGSELTNPLLQMRWFLRETGHYHSFTGDVVDFLFVALFTGVRIGVGACLLFCEMVSPTPKWFVKAGGVAMYAVSWCFMFSIWRFAWRKSIKKYHAWRSRRSEERQLKHNGHLKIH

SEQ ID NO: 747641 - protein, 397 aa, Homo sapiens
MRSPSAAWLLGAAILLAASLSCSGTIQGTNRSSKGRSLIGKVDGTSHVTGKGVTVETVFSVDEFSASVLTGKLTTVFLPIVYTIVFVVGLPSNGMALWVFLFRTKKKHPAVIYMANLALADLLSVIWFPLKIAYHIHGNNWIYGEALCNVLIGFFYGNMYCSILFMTCLSVQRYWVIVNPMGHSRKKANIAIGISLAIWLLILLVTIPLYVVKQTIFIPALNITTCHDVLPEQLLVGDMFNYFLSLAIGVFLFPAFLTASAYVLMIRMLRSSAMDENSEKKRKRAIKLIVTVLAMYLICFTPSNLLLVVHYFLIKSQGQSHVYALYIVALCLSTLNSCIDPFVYYFVSHDFRDHAKNALLCRSVRTVKQMQVSLTSKKHSRKSSSYSSSSTTVKTSY

SEQ ID NO: 747642 - protein, 303 aa, Homo sapiens [sequence omitted]

SEQ ID NO: 747643 - protein, 180 aa, Homo sapiens
ETFISVMTLVFLSCTGTNRSSKGRSLIGKVDGTSHVTGKGVTVETVFSVDEFSASVLTGKLTTVFLPIVYTIVFVVGLPSNGMALWVFLFRTKKKHPAVIYMANLALADLLSVIWFPLKIAYHIHGNNWIYGEALCNVLIGFFYGNMYCSILFMTCLSVQRYWVIVNPMGHSRKKANIAI

SEQ ID NO: 747644 - protein, 474 aa, Homo sapiens
TEACATPPEMGLSPNLDRQTMAEFSQKRGKRRSDEGLGSMVDFLLANARLVLGVGGAAVLGIATLAVKRFIDRATSPRDEDDTKADSWKELSLLKATPHLQPRPPPAALSQPVLPLAPSSSAPEGPAETDPEVTPQLSSPAPLCLTLQERLLAFERDRVTIPAAQVALAKQLAGDIALELQAYFRSKFPELPFGAFVPGGPLYDGLQAGAADHVRLLVPLVLEPGLWSLVPGVDTVARDPRCWAVRRTQLEFCPRGSSPWDRFLVGGYLSSRVLLELLRKALAASVNWPAIGSLLGCLIRPSMASEELLLEVQHERLELTVAVLVAVPGVDADDRLLLAWPLEGLAGNLWLQDLYPVEAARLRALDDHDAGTRRRLLLLLCAVCRGCSALGQLGRGHLTQVVLRLGEDNVDWTEEALGERFLQALELLIGSLEQASLPCHFNPSVNLFSSLREEEIDDIGYALYSGLQEPEGLL

SEQ ID NO: 747645 - protein, 508 aa, Homo sapiens
ACLSACCEVRGCPRGPSRWVPGSFTFHSQAGLSSGAVVPLPPPVVVRKLRRRQTMAEFSQKRGKRRSDEGLGSMVDFLLANARLVLGVGGAAVLGIATLAVKRFIDRATSPRDEDDTKADSWKELSLLKATPHLQPRPPPAALSQPVLPLAPSSSAPEGPAETDPEVTPQLSSPAPLCLTLQERLLAFERDRVTIPAAQVALAKQLAGDIALELQAYFRSKFPELPFGAFVPGGPLYDGLQAGAADHVRLLVPLVLEPGLWSLVPGVDTVARDPRCWAVRRTQLEFCPRGSSPWDRFLVGGYLSSRVLLELLRKALAASVNWPAIGSLLGCLIRPSMASEELLLEVQHERLELTVAVLVAVPGVDADDRLLLAWPLEGLAGNLWLQDLYPVEAARLRALDDHDAGTRRRLLLLLCAVCRGCSALGQLGRGHLTQVVLRLGEDNVDWTEEALGERFLQALELLIGSLEQASLPCHFNPSVNLFSSLREEEIDDIGYALYSGLQEPEGLL

SEQ ID NO: 747646 - protein, 508 aa, Homo sapiens; identical to SEQ ID NO: 747645

SEQ ID NO: 747647 - protein, 371 aa, Homo sapiens
MAAAAAGLGGGGAGPGPEAGDFLARYRLVSNKLKKRFLRKPNVAEAGEQFGQLGRELRAQECLPYAAWCQLAVARCQQALFHGPGEALALTEAARLFLRQERDARQRLVCPAAYGEPLQAAASALGAAVRLHLELGQPAAAAALCLELAAALRDLGQPAAAAGHFQRAAQLQLPQLPLAALQALGEAASCQLLARDYTGALAVFTRMQRLAREHGSHPVQSLPPPPPPAPQPGPGATPALPAALLPPNSGSAAPSPAALGAFSDVLVRCEVSRVLLLLLLQPPPAKLLPEHAQTLEKYSWEAFDSHGQESSGQLPEELFLLLQSLVMATHEKDTEAIKSLQVEMWPLLTAEQNHLLHLVLQETISPSGQGV

SEQ ID NO: 747648 - protein, 269 aa, Homo sapiens
MAAAAAGLGGGGAGPGPEAGDFLARYRLVSNKLKKRFLRKPNVAEAGEQFGQLGQPAAAAGHFQRAAQLQLPQLPLAALQALGEAASCQLLARDYTGALAVFTRMQRLAREHGSHPVQSLPPPPPPAPQPGPGATPALPAALLPPNSGSAAPSPAALGAFSDVLVRCEVSRVLLLLLLQPPPAKLLPEHAQTLEKYSWEAFDSHGQESSGQLPEELFLLLQSLVMATHEKDTEAIKSLQVEMWPLLTAEQNHLLHLVLQETISPSGQGV

SEQ ID NO: 747649 - protein, 371 aa, Homo sapiens; identical to SEQ ID NO: 747647

SEQ ID NO: 747650 - protein, 371 aa, Homo sapiens; identical to SEQ ID NO: 747647

SEQ ID NO: 747651 - protein, 85 aa, Homo sapiens
DAEVIYEDPEEISWEAFDSHGQESSGQLPEELFLLLQSLVMATHEKDTEAIKSLQVEMWPLLTAEQNHLLHLVLQETISPSGQGV

SEQ ID NO: 747652 - protein, 321 aa, Homo sapiens
MGEWTILERLLEAAVQQHSTMIGRILLTVVVIFRILIVAIVGETVYDDEQTMFVCNTLQPGCNQACYDRAFPISHIRYWVFQIIMVCTPSLCFITYSVHQSAKQRERRYSTVFLALDRDPPESIGGPGGTGGGGSGGGKREDKKLQNAIVNGVLQNTENTSKETEPDCLEVKELTPHPSGLRTASKSKLRRQEGISRFYIIQVVFRNALEIGFLVGQYFLYGFSVPGLYECNRYPCIKEVECYVSRPTEKTVFLVFMFAVSGICVVLNLAELNHLGWRKIKLAVRGAQAKRKSIYEIRNKDLPRVSVPNFGRTQSSDSAYV

SEQ ID NO: 747653 - protein, 121 aa, Homo sapiens
SHSHLLPRSLLPLSAWPPWAWHHHGPGTQSLVGCLCAMSPLLPTHLSLPVLEPSGTPALKDRRPCEVGIPHPPPRGALYQGGPGECFTEGGSVQAVVRTYKPGTLGDRGDRSLEPRNSRSV

SEQ ID NO: 747654 - protein, 130 aa, Homo sapiens [sequence omitted]

SEQ ID NO: 747655 - protein, 89 aa, Homo sapiens
QCSPCLEGPLYLRLQETEASPGTGPYLCLLLLPTAVQPLKLMLPGHNESGASSDKTHKNPAHGAAILGEGDPHGTKCVACAVERTSCGK

SEQ ID NO: 747656 - protein, 106 aa, Homo sapiens
MKGAVELQNLRVALSGRQPGQQGLWAAGQPLPCSGTFGGPLQRTSAPRYSSEILPERPFTFPNWHLQHSRTFYGTLSFSSPSKGPLNLKDRAEGAPHPGLEGLRSS

SEQ ID NO: 747657 - protein, 112 aa, Homo sapiens
PSTSGLCLQPGLGTAGRQIPSQTGLPSSGPRLNPQESAGALPSGWGRWNWPDWRWGDHCACHRDWPSCPTGEHIGVTGEADPSLARLHTPHPHPTIRDSHLIVIHFPSLNSN

SEQ ID NO: 747658 - protein, 68 aa, Homo sapiens
CSSGLDSLVPGDEDKPYKCQLCRSSFRYKGNLASHRTVHTGEKPYHCSICGARFNRPANLKTHSRIHS

SEQ ID NO: 747659 - protein, 136 aa, Homo sapiens
MARTKQTARKSTGGKAPRKQLATKVARKSAPATGGVKKPHRYRPGTVALREIRRYQKSTELLIRKLPFQRLMREIAQDFKTDLRFQSSAVMALQEACESYLVGLFEDTNLCVIHAKRVTIMPKDIQLARRIRGERA

SEQ ID NO: 747660 - protein, 316 aa, Homo sapiens
MPGQNYRTISEFILSGFSAFPQQLLPVLFLLYLLMFLFTLLGNLLIMATVWIERRLHTPMYLFLCALSISEILFTVAITPRMLADLLFTHRSITFVACAIQMFFSFMFGFTHSFLLMVMGYDHYVTICHPLHYNMLMSPRGCAHLVAWTWAGGSVMGMMVTMMVFHLTFCGSNVIHHFLCHVLSLLKLACGSKTSSVIMGVMLVCVTALIGCLFLIILSFVFIVAAILRIPSAEGRHKTFSTCVSHLTVVVMHYSFASLIYLKPKGLHSMYSDALMATTYTVFTPFLSPIIFSLRNKELKNAINKNFCRRFCPLSS

SEQ ID NO: 747661 - protein, 81 aa, Homo sapiens
TMLSPTFVLWDVGYPLYTYGSIFIVIVIIWQVKRSHHELNLEVERSCCWRHQKVRQRARDAASTGEVPISPLTPFHCGCFL

SEQ ID NO: 747662 - protein, 123 aa, Homo sapiens
MLSPTFVLWDVGYPLYTYGSIFIVIVIIWQVKRSHHELNLEVERSCCWRHQKVRQRARDAASTARRLSQEEDQKPQELFSVMKSQGWLPPEGSVRRILCTDPCCQICNAMALEIQQLLADEND

SEQ ID NO: 747663 - protein, 70 aa, Homo sapiens
LLRRSLGSRMVSDRVCKDFEANQFGAITLSYLPKNSGQDSGILSRSILVHKVRIKTSPRVDVKRDEIIVK

SEQ ID NO: 747664 - protein, 77 aa, Homo sapiens
LEENLGNTILNIDLGKELMTNSSKAIATKTKINRWDLIKLKSFCIAKETINRVNRQPPQWEKIFTNYASNKGLISRI

SEQ ID NO: 747665 - protein, 1262 aa, Homo sapiens
MLQQVPENINFPAEEEKILEFWTEFNCFQECLKQSKHKPKFTFYDGPPFATGLPHYGHILAGTIKDIVTRYAHQSGFHVDRRFGWDCHGLPVEYEIDKTLGIRGPEDVAKMGITEYNNQCRAIVMRYSAEWKSTVSRLGRWIDFDNDYKTLYPQFMESVWWVFKQLYDKGLVYRGVKVMPFSTACNTPLSNFESHQNYKDVQDPSVFVTFPLEEDETVSLVAWTTTPWTLPSNLAVCVNPEMQYVKIKDVARGRLLILMEARLSALYKLESDYEILERFPGAYLKGKKYRPLFDYFLKCKENGAFTVLVDNYVKEEEGTGVVHQAPYFGAEDYRVCMDFNIIRKDSLPVCPVDASGCFTTEVTDFAGQYVKDADKSIIRTLKEQGRLLVATTFTHSYPFCWRSDTPLIYKAVPSWFVRVENMVDQLLRNNDLCYWVPELVREKRFGNWLKDARDWTISRNRYWGTPIPLWVSDDFEEVVCIGSVAELEELSGAKISDLHRESVDHLTIPSRCGKGSLHRISEVFDCWFESGSMPYAQVHYPFENKREFEDAFPADFIAEGIDQTRGWFYTLLVLATALFGQPPFKNVIVNGLVLASDGQKMSKRKKNYPDPVSIIQKYGADALRLYLINSPVVRAENLRFKEEGVRDVLKDVLLPWYNAYRFLIQNVLRLQKEEEIEFLYNENTVRESPNITDRWILSFMQSLIGFFETEMAAYRLYTVVPRLVKFVDILTNWYVRMNRRRLKGENGMEDCVMALETLFSVLLSLCRLIAPYTPFLTELMYQNLKVLIDPVSVQDKDTLSIHYLMLPRVREELIDKKTESAVSQMQSVIELGRVIRDRKTIPIKYPLKEIVVIHQDPEALKDIKSLEKYIIEELNVRKVTLSTDKNKYGIRLRAEPDHMVLGKRLKGAFKAVMTSIKQLSSEELEQFQKTGTIVVEGHELHDEDIRLMYTFDQATGGTAQFEAHSDAQALVLLDVTPDQSMVDEGMAREVINRIQKLRKKCNLVPTDEITVYYKAKSEGTYLNSVIESHTEFIFTTIKAPLKPYPVSPSDKVLIQEKTQLKGSELEITLTRGSSLPGPACAYVNLNICANGSEQGGVLLLENPKGDNRLDLLKLKSVVTSIFGVKNTELAVFHDETEIQNQTDLLSLSGKTLCVTAGSAPSLINSSSTLLCQYIIRQLLNAKPQECLMGTVGTLLLENPLGQNGLTHQGLLYEAAKVFGLRSRKLKLFLNETQTQEITEDIPVKTLNMKTVYVSVLPTTADF

SEQ ID NO: 747666 - protein, 509 aa, Homo sapiens
MLQQVPENINFPAEEEKILEFWTEFNCFQECLKQSKHKPKFTFYDGPPFATGLPHYGHILAGTIKDIVTRYAHQSGFHVDRRFGWDCHGLPVEYEIDKTLGIRGPEDVAKMGITEYNNQCRAIVMRYSAEWKSTVSRLGRWIDFDNDYKTLYPQFMESVWWVFKQLYDKGLVYRGVKVMPFSTACNTPLSNFESHQNYKDVQDPSVFVTFPLEEDETVSLVAWTTTPWTLPSNLAVCVNPEMQYVKIKDVARGRLLILMEARLSALYKLESDYEILERFPGAYLKGKKYRPLFDYFLKCKENGAFTVLVDNYVKEEEGTGVVHQAPYFGAEDYRVCMDFNIIRKDSLPVCPVDASGCFTTEVTDFAGQYVKDADKSIIRTLKEQGRLLVATTFTHSYPFCWRSTLLNAKPQECLMGTVGTLLLENPLGQNGLTHQGLLYEAAKVFGLRSRKLKLFLNETQTQEITEDIPVKTLNMKTVYVSVLPTTADFLAWYLSMLVRVSPSLITPIP

SEQ ID NO: 747667 - protein, 181 aa, Homo sapiens
KLEFSDTFGSNIPKQFVPAVEGFLDAEKGLSGHKLSGRFLQDGAHHMVDSNEISFIPSRRRWLLNKALANATLCILEPIMAVEVVAPNEFQGQVIAGINRRHGVITGQDGVEDYFTLYADVPLNDMFGYSTELRSCTEGKGEYTMEYSRYQPCLPSTQEDVINKYLEATGQLPVKKGKAKN

SEQ ID NO: 747668 - protein, 272 aa, Homo sapiens
MTSSHVCCNFLNMWKKSKISTMYYLNQDAKLSNLFLQASSPTTGTAPRSQSRLSVCPSTQDICRICHCEGDEESPLITPCRCTGTLRFVHQSCLHQWIKSSDTRCCELCKYDFIMETKLKPLRKWEKLQMTTSERRKIFCSVTFHVIAITCVVWSLYVLIDRTAEEIKQGNDNGVLEWPFWTKLVVVAIGFTGGLVFMYVQCKVYVQLWRRLKAYNRVIFVQNCPDTAKKLEKNFSCNVNTDIKDAVVVPVPQTGANSLPSAEGGPPEVVSV

SEQ ID NO: 747669 - protein, 272 aa, Homo sapiens; identical to SEQ ID NO: 747668

SEQ ID NO: 747670 - protein, 151 aa, Homo sapiens
MTSSHVCCNFLNMWKKSKISTMYYLNQDAKLSNLFLQASSPTTGTAPRSQSRLSVCPSTQDICRICHCEGDEESPLITPCRCTGTLRFVHQSCLHQWIKSSDTRCCELCKYDFIMETKLKPLRKWEKLQMTTSERIVCIDRPDSGGNQARQ

SEQ ID NO: 747671 - protein, 536 aa, Homo sapiens
MSLFLRVLETLYLDASCCYRGGLQLTPRNEKSPGRSASRSSNISKASSPTTGTAPRSQSRLSVCPSTQDICRSAILHDMSEESFEYCTPVMVLSPARKESGKKSVIQRPRRRRKASERYEHAAEEQIRGRKNDFHLQISSPRWRELYTDSSDSSSTDESHWIQAKRRAQVKFRLSRRRRRNNNKPCENLAGSSTPNGIELVDLGSKGKEQQELIECESCSLNLHRGKHTRYQECNPSLTQGSSEIKRSSRNHEKSKGRYHHRDPQLLQSLRKNEIMKKTFSETDSSTEILGVPEGSKDMNDAGLQVNNPVQKPPATYDDGSDNLEVCRICHCEGDEESPLITPCRCTGTLRFVHQSCLHQWIKSSDTRCCELCKYDFIMETKLKPLRKWEKLQMTTSERRKIFCSVTFHVIAITCVVWSLYVLIDRTAEEIKQGNDNGVLEWPFWTKLVVVAIGFTGGLVFMYVQCKVYVQLWRRLKAYNRVIFVQNCPDTAKKLEKNFSCNVNTDIKDAVVVPVPQTGANSLPSAEGGPPEVVSV

SEQ ID NO: 747672 - protein, 392 aa, Homo sapiens
MSLFLRVLETLYLDASCCYRGGLQLTPRNEKSPGRSASRSSNISKASSPTTGTAPRSQSRLSVCPSTQDICRSAILHDMSEESFEYCTPVMVLSPARKESGKKSVIQRPRRRRKASERYEHAAEEQIRGRKNDFHLQISSPRWRELYTDSSDSSSTDESHWIQAKRRAQVKFRLSRRRRRNNNKPCENLAGSSTPNGIELVDLGSKGKEQQELIECESCSLNLHRGKHTRYQECNPSLTQGSSEIKRSSRNHEKSKGRYHHRDPQLLQSLRKNEIMKKTFSETDSSTEILGVPEGSKDMNDAGLQVNNPVQKPPATYDDGSDNLEVCRICHCEGDEESPLITPCRCTGTLRFVHQSCLHQWIKSSDTRCCELCKYDFIMETKLKPLRKVQYP

SEQ ID NO: 747673 - protein, 272 aa, Homo sapiens; identical to SEQ ID NO: 747668

SEQ ID NO: 747674 - protein, 647 aa, Homo sapiens
MAAGLATWLPFARAAAVGWLPLAQQPLPPAPGVKASRGDEVLVVNVSGRRFETWKNTLDRYPDTLLGSSEKEFFYDADSGEYFFDRDPDMFRHVLNFYRTGRLHCPRQECIQAFDEELAFYGLVPELVGDCCLEEYRDRKKENAERLAEDEEAEQAGDGPALPAGSSLRQRLWRAFENPHTSTAALVFYYVTGFFIAVSVIANVVETIPCRGSARRSSREQPCGERFPQAFFCMDTACVLIFTGEYLLRLFAAPSRCRFLRSVMSLIDVVAILPYYIGLLVPKNDDVSGAFVTLRVFRVFRIFKFSRHSQGLRILGYTLKSCASELGFLLFSLTMAIIIFATVMFYAEKGTNKTNFTSIPAAFWYTIVTMTTLGYGDMVPSTIAGKIFGSICSLSGVLVIALPVPVIVSNFSRIYHQNQRADKRRAQQKVRLARIRLAKSGTTNAFLQYKQNGGLEDSGSGEEQALCVRNRSAFEQQHHHLLHCLEKTTCHEFTDELTFSEALGAVSPGGRTSRSTSVSSQPVGPGSLLSSCCPRRAKRRAIRLANSTASVSRGSMQELDMLAGLRRSHAPQSRSSLNAKPHDSLDLNCDSRDFVAAIISIPTPPANTPDESQPSSPGGGGRAGSTLRNSSLGTPCLFPETVKISSL

SEQ ID NO: 747675 - protein, 218 aa, Homo sapiens
GRGLDRVGVSHNGEEGAALIALLHLLQDSGSGEEQALCVRNRSAFEQQHHHLLHCLEKTTCHEFTDELTFSEALGAVSPGGRTSRSTSVSSQPVGPGSLLSSCCPRRAKRRAIRLANSTASVSRGSMQELDMLAGLRRSHAPQSRSSLNAKPHDSLDLNCDSRDFVAAIISIPTPPANTPDESQPSSPGGGGRAGSTLRNSSLGTPCLFPETVKISSL

SEQ ID NO: 747676 - protein, 71 aa, Homo sapiens
MTKSALERRMLDAGVVVISVQPILFMCSSVKTSSLDVRTKKPKQSKDPGLHFCSGVSCMTVSMLGFSVCKP

SEQ ID NO: 747677 - protein, 131 aa, Homo sapiens
MCCPAGHCPFPPGLLPGREGTQNKEERSSEKHPFPAPCCQPPPNASPLLSTPTGHSHCPTLPSTGFHLRNCAHGSFAPSVFCQKHTQCPEVSWLISTADRIYSRNLLPSPTQASGPPDPNPFCLCRHGIRA

SEQ ID NO: 747678 - protein, 204 aa, Homo sapiens
MELVTFRDVAIEFSPEEWKCLDPAQQNLYRDVMLENYRNLVSLGFVISNPDLVTCLEQIKEPCNLKIHETAAKPPAICSPFSQDLSPVQGIEDSFHKLILKRYEKCGHENLQLRKGCKRVNECKVQKGVNNGVYQCLSTTQSKIFQCNTCVKVFSKFSNSNKHKIRHTGEKPFKCTECGRSFYMSHLTQHTGIHAGEKPYNVKN

SEQ ID NO: 747679 - protein, 199 aa, Homo sapiens
MEARDKQVLRSLRLELGAEVLVEGLVLQYLYQEGILTENHIQEINAQTTGLRKTMLLLDILPSRGPKAFDTFLDSLQEFPWVREKLKKAREEAMTDLPAGDRLTGIPSHILNSSPSDRQINQLAQRLGPEWEPMVLSLGLSQTDIYRCKANHPHNVQSQVVEAFIRWRQRFGKQATFQSLHNGLRAVEVDPSLLLHMLE

SEQ ID NO: 747680 - protein, 115 aa, Homo sapiens
MEARDKQVLRSLRLELGAEVLVEGLVLQYLYQEGILTENHIQEINAQTTGLRKTMLLLDILPSRGPKAFDTFLDSLQEFPWVREKLKKAREEAMTDLPAVAIIRLPRELSLPTLL

SEQ ID NO: 747681 - protein, 181 aa, Homo sapiens
MEARDKQVLRSLRLELGAEVLVEGLVLQYLYQEGILTENHIQEINAQTTGLRKFLDSLQEFPWVREKLKKAREEAMTDLPAGDRLTGIPSHILNSSPSDRQINQLAQRLGPEWEPMVLSLGLSQTDIYRCKANHPHNVQSQVVEAFIRWRQRFGKQATFQSLHNGLRAVEVDPSLLLHMLE

SEQ ID NO: 747682 - protein, 114 aa, Homo sapiens
MQAEYPHTEIHNIFCDRLTGIPSHILNSSPSDRQINQLAQRLGPEWEPMVLSLGLSQTDIYRCKANHPHNVQSQVVEAFIRWRQRFGKQATFQSLHNGLRAVEVDPSLLLHMLE

SEQ ID NO: 747683 - protein, 118 aa, Homo sapiens
EVCLSPSAMIVKPPHHMEGDRLTGIPSHILNSSPSDRQINQLAQRLGPEWEPMVLSLGLSQTDIYRCKANHPHNVQSQVVEAFIRWRQRFGKQATFQSLHNGLRAVEVDPSLLLHMLE

SEQ ID NO: 747684 - protein, 128 aa, Homo sapiens [sequence omitted]

SEQ ID NO: 747685 - protein, 109 aa, Homo sapiens
MEARDKQVLRSLRLELGAEVLVEGLVLQYLYQEGILTENHIQEINAQTTGLRKTMLLLDILPSRGPKAFDTFLDSLQEFPWVREKLKKAREEAMTDLPAGRPQKDHFEP

SEQ ID NO: 747686 - protein, 113 aa, Homo sapiens
GRVGRPTRPDPRVAHASRKPKRRRVGDVEPSRKPKRRRAADVEPSSPEPKRRRVGDVEPSRKPKRRRAADVEPSSPEPKRRRVGDVEPSRKPKRRRAADVEPSLPEPKRRRLS

SEQ ID NO: 747687 - protein, 349 aa, Homo sapiens
DNIKTPAERLRGPLPPSADDNLKTPSERQLTPLPPSAPPSADDNIKTPAERLRGPLPPSADDNLKTPSERQLPFHPQLHPQQMIISRHLPSVCGGRFHPQRMIISRHLPSVSSLPFHPQLHPQQMIISRHLPSVCGGRFHPQRMIISRHLPSVSSLPFHPQLHPQQMIISRHLPSTLSGCNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPEPKRRRVGDVEPSRKPKRRRAADVEPSSPEPKRRRVGDVEPSRKPKRRRAADVEPSLPEPKRRRLS

SEQ ID NO: 747688 - protein, 70 aa, Homo sapiens
LSVLRQRSAALSTDVSIGISGRTSQTGRHPVWELGFCLALRVPKGLSWAHSVRCCLLAGAEIHVSAVSFL

SEQ ID NO: 747689 - protein, 330 aa, Homo sapiens
MEGAPPGSLALRLLLFVALPASGWLTTGAPEPPPLSGAPQDGIRINVTTLKDDGDISKQQVVLNITYESGQVYVNDLPVNSGVTRISCQTLIVKNENLENLEEKEYFGIVSVRILVHEWPMTSGSSLQLIVIQEEVVEIDGKQVQQKDVTEIDILVKNRGVLRHSNYTLPLEESMLYSISRDSDILFTLPNLSKKESVSSLQTTSQYLIRNVETTVDEDVLPGKLPETPLRAEPPSSYKVMCQWMEKFRKDLCRFWSNVFPVFFQFLNIMVVGITGAAVVITILKVFFPVSEYKGILQLDKVDVIPVTAINLYPDGPEKRAENLEDKTCI

SEQ ID NO: 747690 - protein, 330 aa, Homo sapiens; identical to SEQ ID NO: 747689

SEQ ID NO: 747691 - protein, 330 aa, Homo sapiens; identical to SEQ ID NO: 747689

SEQ ID NO: 747692 - protein, 326 aa, Homo sapiens
GAGAVLQRRPERGVGMQRPGPFSTLYGRVLAPLPGRAGGAASGGGGNSWDLPGSHVRLPGRAQSGTRGGAGNTSTSCGDSNSICPAPSTMSKAEEAKKLAGRAAVENHVRNNQVLGIGSGSTIVHAVQRIAERVKQENLNLVCIPTSFQARQLILQYGLTLSDLDRHPEIDLAIDGADEVDADLNLIKGGGGCLTQEKIVAGYASRFIVIADFRKDSKNLGDQWHKGIPIEVIPMAYVPVSRAVSQKFGGVVELRMAVNKAGPVVTDNGNFILDWKFDRVHKWSEVNTAIKMIPGVVDTGLFINMAERVYFGMQDGSVNMREKPFC

SEQ ID NO: 747693 - protein, 123 aa, Homo sapiens
MQRPGPFSTLYGRVLAPLPGRAGGAASGGGGNSWDLPGSHVRLPGRAQSGTRGGAGNTSTSCGDSNSICPAPSTMSKAEEAKKLAGRAAVENHVRYQGIVNYNFFLSNIFLGLFFFFFFFIFF

SEQ ID NO: 747694 - protein, 241 aa, Homo sapiens
MQRPGPFSTLYGRVLAPLPGRAGGAASGGGGNSWDLPGSHVRLPGRAQSGTRGGAGNTSTSCGDSNSICPAPSTMSKAEEAKKLAGRAAVENHVRNNQVLGIGSGSTIVHAVQRIAERVKQENLNLVCIPTSFQARQLILQYGLTLSDLDRHPEIDLAIDGADEVDADLNLIKGGGGCLTQEKIVAGYASRFIVIADFRKDSKNLGDQWHKGIPIEVIPMAYVPVSRAVSQNLTGYTNGVK

SEQ ID NO: 747695 - protein, 326 aa, Homo sapiens; identical to SEQ ID NO: 747692

SEQ ID NO: 747696 - protein, 326 aa, Homo sapiens; identical to SEQ ID NO: 747692

SEQ ID NO: 747697 - protein, 799 aa, Homo sapiens
TGAAALATRVTQSALVPVLAMASFVTEVLAHSGRLEKEDLGTRISRLTRRVEEIKGEVCNMISKKYSEFLPSMQSAQGLITQVDKLSEDIDLLKSRIESEVRRDLHVSTGEFTDLKQQLERDSVVLSLLKQLQEFSTAIEEYNCALTEKKYVTGAQRLEEAQKCLKLLKSRKCFDLKILKSLSMELTIQKQNILYHLGEEWQKLIVWKFPPSKDTSSLESYLQTELHLYTEQSHKEEKTPMPPISSVLLAFSVLGELHSKLKSFGQMLLKYILRPLASCPSLHAVIESQPNIVIIRFESIMTNLEYPSPSEVFTKIRLVLEVLQKQLLDLPLDTDLENEKTSTVPLAEMLGDMIWEDLSECLIKNCLVYSIPTNSSKLQQYEEIIQSTEEFENALKEMRFLKGDTTDLLKYARNINSHFANKKCQDVIVAARNLMTSEIHNTVKIIPDSKINVPELPTPDEDNKLEVQKVSNTQYHEVMNLEPENTLDQHSFSLPTCRISESVKKLMELAYQTLLEATTSSDQCAVQLFYSVRNIFHLFHDVVPTYHKENLQKLPQLAAIHHNNCMYIAHHLLTLGHQFRLRLAPILCDGTATFVDLVPGFRRLGTECFLAQMRAQKGELLERLSSARNFSNMDDEENYSAASKAVRQVLHQLKRLGIVWQDVLPVNIYCKAMGTLLNTAISEVIGKITALEDISTEDGDRLYSLCKTVMDEGPQVFAPLSEESKNKKYQEEVPVYVPKWMPFKELMMMLQASLQEIGDRWADGKGPLAAAFSSSEVKALIRALFQNTERRAAALAKIK

SEQ ID NO: 747698 - protein, 223 aa, Homo sapiens
TGAAALATRVTQSALVPVLAMASFVTEVLAHSGRLEKEDLGTRISRLTRRVEEIKGEVCNMISKKYSEFLPSMQSAQGLITQVDKLSEDIDLLKSRIESEVRRDLHVSTGEFTDLKQQLERDSVVLSLLKQLQEFSTAIEEYNCALTEKKYVTGAQRLEEAQKCLKLLKSRKCFDLKILKSLSMELTIQKQNILYHLGEEWQKLIVWKFPPSKGAADLRWTAL

SEQ ID NO: 747699 - protein, 686 aa, Homo sapiens
TGAAALATRVTQSALVPVLAMASFVTEVLAHSGRLEKEDLGTRISRLTRRVEEIKGEVCNMISKKYSEFLPSMQSAQGLITQVDKLSEDIDLLKSRIESEIPAVWNLTYKLNFIYTLNNRTKRRRPLMPPISSVLLAFSVLGELHSKLKSFGQMLLKYILRPLASCPSLHAVIESQPNIVIIRFESIMTNLEYPSPSEVFTKIRLVLEVLQKQLLDLPLDTDLENEKTSTVPLAEMLGDMIWEDLSECLIKNCLVYSIPTNSSKLQQYEEIIQSTEEFENALKEMRFLKGDTTDLLKYARNINSHFANKKCQDVIVAARNLMTSEIHNTVKIIPDSKINVPELPTPDEDNKLEVQKVSNTQYHEVMNLEPENTLDQHSFSLPTCRISESVKKLMELAYQTLLEATTSSDQCAVQLFYSVRNIFHLFHDVVPTYHKENLQKLPQLAAIHHNNCMYIAHHLLTLGHQFRLRLAPILCDGTATFVDLVPGFRRLGTECFLAQMRAQKGELLERLSSARNFSNMDDEENYSAASKAVRQVLHQLKRLGIVWQDVLPVNIYCKAMGTLLNTAISEVIGKITALEDISTEDGDRLYSLCKTVMDEGPQVFAPLSEESKNKKYQEEVPVYVPKWMPFKELMMMLQASLQEIGDRWADGKGPLAAAFSSSEVKALIRALFQNTERRAAALAKIK

SEQ ID NO: 747700 - protein, 502 aa, Homo sapiens
TGAAALATRVTQSALVPVLAMASFVTEVLAHSGRLEKEDLGTRISRLTRRVEEIKGEVCNMISKKYSEFLPSMQSAQGLITQVDKLSEDIDLLKSRIESEVRRDLHVSTGEFTDLKQQLERDSVVLSLLKQLQEFSTAIEEYNCALTEKKYVTGAQRLEEAQKCLKLLKSRKCFDLKILKSLSMELTIQKQNILYHLGEEWQKLIVWKFPPSKDTSSLESYLQTELHLYTEQSHKEEKTPMPPISSVLLAFSVLGELHSKLKSFGQMLLKYILRPLASCPSLHAVIESQPNIVIIRFESIMTNLEYPSPSEVFTKIRLVLEVLQKQLLDLPLDTDLENEKTSTVPLAEMLGDMIWEDLSECLIKNCLVYSIPTNSSKLQQYEEIIQSTEEFENALKEMRFLKGDTTDLLKYARNINSHFANKKCQDVIVAARNLMTSEIHNTVKIIPDSKINVPELPTPDEDNKLEVQKVSNTQYHEVMNLEPVCEEINGTRLSDFTRGNNQ

SEQ ID NO: 747701 - protein, 716 aa, Homo sapiens
TGAAALATRVTQSALVPVLAMASFVTEVLAHSGRLEKEDLGTRISRLTRRVEEIKGEVCNMISKKYSEFLPSMQSAQGLITQVDKLSEDIDLLKSRIESEVRRDLHVSTGEFTDLKQQLERDSVVLSLLKQLQEFSTAIEEYNCALTEKKYVTGAQRLEEAQKCLKLLKSRKCFDLKILKSLSMELTIQKQNILYHLGEEWQKLIVWKFPPSKDTSSLESYLQTELHLYTEQSHKEEKTPMPPISSVLLAFSVLGELHSKLKSFGQMLLKYILRPLASCPSLHAVIESQPNIVIIRFESIMTNLEYPSPSEVFTKIRLVLEVLQKQLLDLPLDTDLENEKTSTVPLAEMLGDMIWEDLSECLIKNCLVYSIPTNSSKLQQYEEIIQSTEEFENALKEMRFLKGDTTDLLKYARNINSHFANKKCQDVIVAARNLMTSEIHNTVKIIPDSKINVPELPTPDEDNKLEVQKVSNTQYHEVMNLEPENTLDQHSFSLPTCRISESVKKLMELAYQTLLEATTSSDQCAVQLFYSVRNIFHLFHDVVPTYHKENLQKLPQLAAIHHNNCMYIAHHLLTLGHQFRLRLAPILCDGTATFVDLVPGFRRLGTECFLAQMRAQKGELLERLSSARNFSNMDDEENYSAASKAVRQVLHQLKRLGIVWQDVLPVNIYCKAMGTLLNTAISEVIGKITALEVRAIRCYTSLEMQFMSQIVTLLRK

SEQ ID NO: 747702 - protein, 403 aa, Homo sapiens
TGAAALATRVTQSALVPVLAMASFVTEVLAHSGRLEKEDLGTRISRLTRRVEEIKGEVCNMISKKYSEFLPSMQSAQGLITQVDKLSEDIDLLKSRIESEVRRDLHVSTGEFTDLKQQLERDSVVLSLLKQLQEFSTAIEEYNCALTEKKYVTGAQRLEEAQKCLKLLKSRKCFDLKILKSLSMELTIQKQNILYHLGEEWQKLIVWKFPPSKDTSSLESYLQTELHLYTEQSHKEEKTPMPPISSVLLAFSVLGELHSKLKSFGQMLLKYILRPLASCPSLHAVIESQPNIVIIRFESIMTNLEYPSPSEVFTKIRLVLEVLQKQLLDLPLDTDLENEKTSTVPLAEMLGDMIWEDLSECLIKNCLVYSIPTNSSKLQQYEEIIQSTEEFENAILGTLPFSL

SEQ ID NO: 747703 - protein, 312 aa, Homo sapiens
MADGDSGSERGGGGGPCGFQPASRGGGEQETQELASKRLDIQNKRFYLDVKQNAKGRFLKIAEVGAGGSKSRLTLSMAVAAEFRDSLGDFIEHYAQLGPSSPEQLAAGAEEGGGPRRALKSEFLVRENRKYYLDLKENQRGRFLRIRQTVNRGGGGFGAGPGPGGLQSGQTIALPAQGLIEFRDALAKLIDDYGGEDDELAGGPGGGAGGPGGGLYGELPEGTSITVDSKRFFFDVGCNKYGVFLRVSEVKPSYRNAITVPFKAWGKFGGAFCRYADEMKEIQERQRDKLYERRGGGSGGGEESEGEEVDED

SEQ ID NO: 747704 - protein, 237 aa, Homo sapiens
PTRPRTAWVDPRVRGTTTRRFVGHTKDVLSVAFSSDNRQIVSGSRDKTIKLWNTLGVCKYTVQDESHSEWVSCVRFSPNSSNPIIVSCGWDKLVKVWNLANCKLKTNHIGHTGYLNTVTVSPDGSLCASGGKDGQAMLWDLNEGKHLYTLDGGDIINALCFSPNRYWLCAATGPSIKIWDLEGKIIVDELKQEVISTSSKAEPPQCTSLAWSADGQTLFAGYTDNLVRVWQVTIGTR

SEQ ID NO: 747705 - protein, 104 aa, Homo sapiens
TKFAGVYTNEGKHLYTLDGGDIINALCFSPNRYWLCAATGPSIKIWDLEGKIIVDELKQEVISTSSKAEPPQCTSLAWSADGQTLFAGYTDNLVRVWQVTIGTR

SEQ ID NO: 747706 - protein, 98 aa, Homo sapiens
AYYYYYYNSRPLDGDIINALCFSPNRYWLCAATGPSIKIWDLEGKIIVDELKQEVISTSSKAEPPQCTSLAWSADGQTLFAGYTDNLVRVWQVTIGTR

SEQ ID NO: 747707 - protein, 132 aa, Homo sapiens
MRVFAKSENDKLLPLRGTGTTTRRFVGHTKDVLSVAFSSDNRQIVSGSRDKTIKLWNTLGVCKYTVQDESHSEWVSCVRFSPNSSNPIIVSCGWDKLVKVSVKPRQGLYQSGCAPRWSYTPSPVESFADALS

SEQ ID NO: 747708 - protein, 349 aa, Homo sapiens
RVIRRGRGCGASFSKPSSAILVAAATHALAAAMTEQMTLRGTLKGHNGWVTQIATTPQFPDMILSASRDKTIIMWKLTRDETNYGIPQRALRGHSHFVSDVVISSDGQFALSGSWDGTLRLWDLTTGTTTRRFVGHTKDVLSVAFSSDNRQIVSGSRDKTIKLWNTLGVCKYTVQDESHSEWVSCVRFSPNSSNPIIVSCGWDKLVKVWNLANCKLKTNHIGHTGYLNTVTVSPDGSLCASGGKDGQAMLWDLNEGKHLYTLDGGDIINALCFSPNRYWLCAATGPSIKIWDLEGKIIVDELKQEVISTSSKAEPPQCTSLAWSADGQTLFAGYTDNLVRVWQVTIGTR

SEQ ID NO: 747709 - protein, 343 aa, Homo sapiens
SARRATSLVPSSAILVAAATHALAAAMTEQMTLRGTLKGHNGWVTQIATTPQFPDMILSASRDKTIIMWKLTRDETNYGIPQRALRGHSHFVSDVVISSDGQFALSGSWDGTLRLWDLTTGTTTRRFVGHTKDVLSVAFSSDNRQIVSGSRDKTIKLWNTLGVCKYTVQDESHSEWVSCVRFSPNSSNPIIVSCGWDKLVKVWNLANCKLKTNHIGHTGYLNTVTVSPDGSLCASGGKDGQAMLWDLNEGKHLYTLDGGDIINALCFSPNRYWLCAATGPSIKIWDLEGKIIVDELKQEVISTSSKAEPPQCTSLAWSADGQTLFAGYTDNLVRVWQVTIGTR

SEQ ID NO: 747710 - protein, 354 aa, Homo sapiens
SARRATSLVPSSAILVAAATHALAAAMTEQMTLRGTLKGHNGWVTQIATTPQFPDMILSASRDKDLSIDVERADKTIIMWKLTRDETNYGIPQRALRGHSHFVSDVVISSDGQFALSGSWDGTLRLWDLTTGTTTRRFVGHTKDVLSVAFSSDNRQIVSGSRDKTIKLWNTLGVCKYTVQDESHSEWVSCVRFSPNSSNPIIVSCGWDKLVKVWNLANCKLKTNHIGHTGYLNTVTVSPDGSLCASGGKDGQAMLWDLNEGKHLYTLDGGDIINALCFSPNRYWLCAATGPSIKIWDLEGKIIVDELKQEVISTSSKAEPPQCTSLAWSADGQTLFAGYTDNLVRVWQVTIGTR

SEQ ID NO: 747711 - protein, 349 aa, Homo sapiens; identical to SEQ ID NO: 747708

SEQ ID NO: 747712 - protein, 260 aa, Homo sapiens
SARRATSLVPSSAILVAAATHALAAAMTEQMTLRGTLKGHNGWVTQIATTPQFPDMILSPLEIVSGSRDKTIKLWNTLGVCKYTVQDESHSEWVSCVRFSPNSSNPIIVSCGWDKLVKVWNLANCKLKTNHIGHTGYLNTVTVSPDGSLCASGGKDGQAMLWDLNEGKHLYTLDGGDIINALCFSPNRYWLCAATGPSIKIWDLEGKIIVDELKQEVISTSSKAEPPQCTSLAWSADGQTLFAGYTDNLVRVWQVTIGTR

SEQ ID NO: 747713 - protein, 349 aa, Homo sapiens; identical to SEQ ID NO: 747708

SEQ ID NO: 747714 - protein, 342 aa, Homo sapiens
RVIRRGRGCGASFSKPSSAILVAAATHALAAAMTEQMTLRGTLKGHNGWVTQIATTPQFPDMILSASRDKTIIMWKLTRDETNYGIPQRALRGHSHFVSDVVISSDGQFALSGSWDGTLRLWDLTTGTTTRRFVGHTKDVLSVAFSSDNRQIVSGSRDKTIKLWNTLGVCKYTVQDESHSEWVSCVRFSPNSSNPIIVSCGWDKLVKVWNLANCKLKTNHIGHTGYLNTVTVSPDGSLCASGGKDGQAMLWDLNEGKHLYTLDGGDIINALCFSPNRYWLCAATGPSIKIWDLEGKIIVDELKQEVISTSSKAEPPQCTSLAWSADGQTLLFNNAPYELGQT

SEQ ID NO: 747715 - protein, 341 aa, Homo sapiens
RVIRRGRGCGASFSKPSSAILVAAATHALAAAMTEQMTLRGTLKGHNGWVTQIATTPQFPDMILSASRDKTIIMWKLTRDETNYGIPQRALRGHSHFVSDVVISSDGQFALSGSWDGTLRLWDLTTGTTTRRFVGHTKDVLSVAFSSDNRQIVSGSRDKTIKLWNTLGVCKYTVQDESHSEWVSCVRFSPNSSNPIIVSCGWDKLVKVWNLANCKLKTNHIGHTGYLNTVTVSPDGSLCASGGKDGQAMLWDLNEGKHLYTLDGGDIINALCFSPNRYWLCAATGPSIKIWDLEGKIIVDELKQEVISTSSKAEPPQCTSLAWSADGQVSGSVLSGDSASS

SEQ ID NO: 747716 - protein, 372 aa, Homo sapiens
RVIRRGRGCGASFSKPSSAILVAAATHALAAAMTEQMTLRGTLKGHNGWVTQIATTPQFPDMILSASRDKTIIMWKLTRDETNYGIPQRALRGHSHFVSDVVISSDGQFALSGSWDGTLRLWDLTTGTTTRRFVGHTKDVLSVAFSSDNRQIVSGSRDKTIKLWNTLGVCKYTVQDESHSEWVSCVRFSPNSSNPIIVSCGWDKLVKVWNLANCKLKTNHIGHTGYLNTVTVSPDGSLCASGGKDGQAMLWDLNEGKHLYTLDGGDIINALCFSPNRYWLCAATGPSIKIWDLEGKIIVDELKQEVISTSSKAEPPQCTSLAWSADGQEYITTTYKLAVEMRAVSYSLPSVVAHAYWRLRWEDLLNCRGLRL

SEQ ID NO: 747717 - protein, 114 aa, Homo sapiens
LQGYTIPKGTLILPNLWSVHRDPAIWEKPEDFYPNRFLDDQGQLIKKETFIPFGIGKRVCMGEQLAKMELFLMFVSLMQSFAFALPEDSKKPLLTGRFGLTLAPHPFNITISRR

SEQ ID NO: 747718 - protein, 114 aa, Homo sapiens; identical to SEQ ID NO: 747717

SEQ ID NO: 747719 - protein, 362 aa, Homo sapiens
MGKVRCQEPHCKLPVVGSRGEVAAEIWADRRADNRQRLYVGPRAVPGLRPSSLVLGLLWPPGMGAWSPYKSHPCVTTNSSNNSCPAVPVHFTISTPPSIPPHWQGLTALVLLHSWAHGRTPRPTRSSQTHTTLRKAPNWSNSQQWPSPHPPLAPPRSSFPTFVGKGHRNAGQLRRTGQRRATAPPGVSFLAAVPLITVPQSSWGSRAPRAARSPRDNGIISGERGRLGPGLRRRRLLPSIRPSAPKERLRRPETSGRADAGGARVAGPGRPNSISWAAAASVRLWARRDSSSGQLLFVHEDHAYGCGSSPFGAHPTHTHFWHLRLAPPSHSFPAREGDRGLPRKVGKLWLLLSSLWPSSEYV

SEQ ID NO: 747720 - protein, 370 aa, Homo sapiens [sequence omitted]

SEQ ID NO: 747721 - protein, 315 aa, Homo sapiens
MEIVSTGNETITEFVLLGFYDIPELHFLFFIVFTAVYVFIIIGNMLIIVAVVSSQRLHKPMYIFLANLSFLDILYTSAVMPKMLEGFLQEATISVAGCLLQFFIFGSLATAECLLLAVMAYDRYLAICYPLHYPLLMGPRRYMGLVVTTWLSGFVVDGLVVALVAQLRFCGPNHIDQFYCDFMLFVGLACSDPRVAQVTTLILSVFCLTIPFGLILTSYARIVVAVLRVPAGASRRRAFSTCSSHLAVVTTFYGTLMIFYVAPSAVHSQLLSKVFSLLYTVVTPLFNPVIYTMRNKEVHQALRKILCIKQTETLD

SEQ ID NO: 747722 - protein, 318 aa, Homo sapiens
MADKVQTTLLFLAVGEFSVGILGNAFIGLVNCMDWVKKRKIASIDLILTSLAISRICLLCVILLDCFILVLYPDVYATGKEMRIIDFFWTLTNHLSIWFATCLSIYYFFKIGNFFHPLFLWMKWRIDRVISWILLGCVVLSVFISLPATENLNADFRFCVKAKRKTNLTWSCRVNKTQHASTKLFLNLATLLPFCVCLMSFFLLILSLRRHIRRMQLSATGCRDPSTEAHVRALKAVISFLLLFIAYYLSFLIATSSYFMPETELAVIFGESIALIYPSSHSFILILGNNKLRHASLKVIWKVMSILKGRKFQQHKQI

SEQ ID NO: 747723 - protein, 464 aa, Homo sapiens
VSWWGARSRGEMGVLGRVLLWLQLCALTQAVSKLWVPNTDFDVAANWSQNRTPCAGGAVEFPADKMVSVLVQEGHAVSDMLLPLDGELVLASGAGFGVSDVGSHLDCGAGEPAVFRDSDRFSWHDPHLWRSGDEAPGLFFVDAERVPCRHDDVFFPPSASFRVGLGPGASPVRVRSISALGRTFTRDEDLAVFLASRAGRLRFHGPGALSVGPEDCADPSGCVCGNAEAQPWICAALLQPLGGRCPQAACHFALRPQGQCCDLCGAVVLLTHGPAFDLERYRARILDTFLGLPQYHGLQVAVSKVPRSSRLREADTEIQVVLVENGPETGGAGRLARALLADVAENGEALGVLEATMRESGAHVWGSSAAGLAGGVAAAVLLALLVLLVAPPLLRRAGRLRWRRHEAAAPAGAPLGFRNPVFDVTASEELPLPRRLSLVPKAAADSTSHSYFVNPLFAGAEAEA

SEQ ID NO: 747724 - protein, 153 aa, Homo sapiens
SPGGVQGAEARWASWAGSCCGCSSAVSRDHTGAGPDGSGLSGPRAEVALGLEGEDLPRSGQGGLWRVGGVKLGPASLVWRVRSPEVRGQCIGRCGRGEEGLREPRPAPASGGSCPRGFSVCEMGAVPRTCREQRVCACGARQTASASRSPREH

SEQ ID NO: 747725 - protein, 158 aa, Homo sapiens
VAWRGVAWCGAALVPWSSGMCSGSGEPAVFRDSDRFSWHDPHLWRSGDEAPGLFFVDAERVPCRHDDVFFPPSASFRVGLGPGASPVRVTAPATVTSSTLCSPGPRPRPERPPDRRPWGSPPPLAPVELGASHLLVQPPNLPFLSPSSGGQGQGGLTQ

SEQ ID NO: 747726 - protein, 379 aa, Homo sapiens
VAWRGVAWCGAALVPWSSGMCSGSGEPAVFRDSDRFSWHDPHLWRSGDEAPGLFFVDAERVPCRHDDVFFPPSASFRVGLGPGASPVRVRSISALGRTFTRDEDLAVFLASRAGRLRFHGPGALSVGPEDCADPSGCVCGNAEAQPWICAALLQPLGGRCPQAACHFALRPQGQCCDLCGAVVLLTHGPAFDLERYRARILDTFLGLPQYHGLQVAVSKVPRSSRLREADTEIQVVLVENGPETGGAGRLARALLADVAENGEALGVLEATMRESGAHVWGSSAAGLAGGVAAAVLLALLVLLVAPPLLRRAGRLRWRRHEAAAPAGAPLGFRNPVFDVTASEELPLPRRLSLVPKAAADSTSHSYFVNPLFAGAEAEA

SEQ ID NO: 747727 - protein, 108 aa, Homo sapiens [sequence omitted]

SEQ ID NO: 747728 - protein, 520 aa, Homo sapiens
VSWWGARSRGEMGVLGRVLLWLQLCALTQAVSKLWVPNTDFDVAANWSQNRTPCAGGAVEFPADKMVSVLVQEGHAVSDMLLPLDGELVLASGAGFGVSDVGSHLDCGAGEPAVFRDSDRFSWHDPHLWRSGDEAPGLFFVDAERVPCRHDDVFFPPSASFRVGLGPGASPVRVRSISALGRTFTRDEDLAVFLASRAGRLRFHGPGALSVGPEDCADPSGCVCGNAEVSEAAVESRGPREGRDCARDRAAALPRSLAGLLLGGIALLAAVRSGLRADHRPSHQAQPWICAALLQPLGGRCPQAACHFALRPQGQCCDLCGAVVLLTHGPAFDLERYRARILDTFLGLPQYHGLQVAVSKVPRSSRLREADTEIQVVLVENGPETGGAGRLARALLADVAENGEALGVLEATMRESGAHVWGSSAAGLAGGVAAAVLLALLVLLVAPPLLRRAGRLRWRRHEAAAPAGAPLGFRNPVFDVTASEELPLPRRLSLVPKAAADSTSHSYFVNPLFAGAEAEA

SEQ ID NO: 747729 - protein, 108 aa, Homo sapiens [sequence omitted]

SEQ ID NO: 747730 - protein, 456 aa, Homo sapiens
VSWWGARSRGEMGVLGRVLLWLQLCALTQAVSKLWVPNTDFDVAANWSQNRTPCAGGAVEFPADKMVSVLVQEGHAVSDMLLPLDGELVLASGAGFGVSDVGSHLDCGAGEPAVFRDSDRFSWHDPHLWRSGDEAPGLFFVDAERVPCRHDDVFFPPSASFRVGLGPGASPVRVTFTRDEDLAVFLASRAGRLRFHGPGALSVGPEDCADPSGCVCGNAEAQPWICAALLQPLGGRCPQAACHFALRPQGQCCDLCGAVVLLTHGPAFDLERYRARILDTFLGLPQYHGLQVAVSKVPRSSRLREADTEIQVVLVENGPETGGAGRLARALLADVAENGEALGVLEATMRESGAHVWGSSAAGLAGGVAAAVLLALLVLLVAPPLLRRAGRLRWRRHEAAAPAGAPLGFRNPVFDVTASEELPLPRRLSLVPKAAADSTSHSYFVNPLFAGAEAEA

SEQ ID NO: 747731 - protein, 251 aa, Homo sapiens
VSWWGARSRGEMGVLGRVLLWLQLCALTQAVSKLWVPNTDFDVAANWSQNRTPCAGGAVEFPADKMVSVLVQEGHAVSDMLLPLDGELVLASGAGFGVSDVGSHLDCGAGEPAVFRDSDRFSWHDPHLWRSGDEAPGLFFVDAERVPCRHDDVFFPPSASFRVGLGPGASPVRVARPSASWRRPCGSRAHTSGAAPRLGWRAAWRLPCCWRCWSCWWRRRCCAARGGSGGGGTRRRPRLERPSASATRCST

SEQ ID NO: 747732 - protein, 348 aa, Homo sapiens
VSWWGARSRGEMGVLGRVLLWLQLCALTQAVSKLWVPNTDFDVAANWSQNRTPCAGGAVEFPADKMVSVLVQEGHAVSDMLLPLDGELVLASGAGFGVSDVGSHLDCGAGEPAVFRDSDRFSWHDPHLWRSGDEAPGLFFVDAERVPCRHDDVLRGPRRPGGDHAGVGRTRLGQLRGWAGGRRGGCRAAGAAGPAGGAAAAAPRGEAQVEEARGGGPGWSAPRLPQPGVRRDGLRGAGEGAGGGTGASSGPGLGADRRLTLSPRSPCRGGSAWFRRRPQTAPATVTSSTLCSPGPRPRPERPPDRRPWGSPPPLAPVELGASHLLVQPPNLPFLSPSSGGQGQGGLTQ

SEQ ID NO: 747733 - protein, 140 aa, Homo sapiens
HCIPAWATEQDFVSIKKESGMTAGSFRQSSFACHGRNPRQVELVKEGPRWKYIRYVAGQGQLAQKDRVPNPGRWTPQESSEAATPHVWLLSAALKFPQPARPSLGGLWWEEGVGTAPWLCSTLPVVHHELIFLINPVIIL

SEQ ID NO: 747734 - protein, 69 aa, Homo sapiens
LLLLNSRPVDEVAADTLGEEWKGYVVRISGGNDKQGFPMKQGVLTHGHVHLLLSKGHSCYRPRRTGERK

SEQ ID NO: 747735 - protein, 361 aa, Homo sapiens
MAPTEPWSPSPGSAPWDYSGLDGLEELELCPAGDLPYGYVYIPALYLAAFAVGLLGNAFVVWLLAGRRGPRRLVDTFVLHLAAADLGFVLTLPLWAAAAALGGRWPFGDGLCKLSSFALAGTRCAGALLLAGMSVDRYLAVVKLLEARPLRTPRCALASCCGVWAVALLAGLPSLVYRGLQPLPGGQDSQCGEEPSHAFQGLSLLLLLLTFVLPLVVTLFCYCRISRRLRRPPHVGRARRNSLRIIFAIESTFVGSWLPFSALRAVFHLARLGALPLPCPLLLALRWGLTIATCLAFVNSCANPLIYLLLDRSFRARALDGACGRTGRLARRISSASSLSRDDSSVFRCRAQAANTASASW

SEQ ID NO: 747736 - protein, 104 aa, Homo sapiens
MTEFPEQKGCRHHCSSSQQFPLQVPGRLGGLDQEEFPTAQRLMADLGQIASLRWEPDPTLLHQTGPPCGNFSNSSQGFTDRTLISLGWSPLRGGVATFSMVQWT

SEQ ID NO: 747737 - protein, 377 aa, Homo sapiens
AAVGAGLARACGSCRLSGRHVQTGRDTRGFRLLPHWKITPQASLAPSSELTGMVPREAPESAQCLCPSLTIPNAKDVLRKRHKRRSRQHQRFMARKALLQEQGLLSMPPEPGSSPLPTPFGAATATEAASSGKQCLRAGSGSAPCSRRPAPGKASGPLPSKCVAIDCEMVGTGPRGRVSELARCSIVSYHGDVLYDKYIRPEMPIADYRTRWSGITRQHMRKAVPFQVAQKEILKLLKGKVVVGHALHNDFQALKYVHPRSQTRDTTYVPNFLSEPGLHTRARVSLKDLALQLLHKKIQVGQHGHSSVEDATTAMELYRLVEVQWEQQEARSLWTCPEDREPDSSTDMEQYMEDQYWPDDLAHGSRGGAREAQDRRN

SEQ ID NO: 747738 - protein, 325 aa, Homo sapiens
MVPREAPESAQCLCPSLTIPNAKDVLRKRHKRRSRQHQRFMARKALLQEQGLLSMPPEPGSSPLPTPFGAATATEAASSGKQCLRAGSGSAPCSRRPAPGKASGPLPSKCVAIDCEMVGTGPRGRVSELARCSIVSYHGDVLYDKYIRPEMPIADYRTRWSGITRQHMRKAVPFQVAQKEILKLLKGKVVVGHALHNDFQALKYVHPRSQTRDTTYVPNFLSEPGLHTRARVSLKDLALQLLHKKIQVGQHGHSSVEDATTAMELYRLVEVQWEQQEARSLWTCPEDREPDSSTDMEQYMEDQYWPDDLAHGSRGGAREAQDRRN

SEQ ID NO: 747739 - protein, 325 aa, Homo sapiens; identical to SEQ ID NO: 747738

SEQ ID NO: 747740 - protein, 138 aa, Homo sapiens
MPRQPWSSTGWWRCSGNSRRPAASGPAPRTENLTAAQTWNSTWRTSTGPMTWPTAAEEEPGRHRTEGIEKGAGLPGWASGVAGRKWGPGEQRALLPGQGGAGCSEPAPGPEELGSSVTLTPSAHSIALSLSRAVGSFS

SEQ ID NO: 747741 - protein, 376 aa, Homo sapiens
AAVGAGLARACGSCRLSGRHVQTGRDTRGFRLLPHWKITPQASLAPSSELTGMVPREAPESAQCLCPSLTIPNAKDVLRKRHKRRSRQHQRFMARKALLQEQGLLSMPPEPGSSPLPTPFGAATATEAASSGKQCLRAGSGSAPCSRRPAPGKASGPLPSKCVAIDCEMVGTGPRGRVSELARCSIVSYHGDVLYDKYIRPEMPIADYRTRWSGITRQHMRKAVPFQVAQKEILKLLKGKVVVGHALHNDFQALKYVHPRSQTRDTTYVPNFLSEPGLHTRARVSLKDLALQLLHKKIQVGQHGHSSVEDATTAMELYRLVEVQWEQQEARSLWTCPEDREPDSSTDMEQYMEDQYWALKQKSEKQDSGLNSGAFV

SEQ ID NO: 747742 - protein, 271 aa, Homo sapiens
AAVGAGLARACGSCRLSGRHVQTGRDTRGFRLLPHWKITPQASLAPSSELTGMVPREAPESAQCLCPSLTIPNAKDVLRKRHKRRSRQHQRFMARKALLQEQGLLSMPPEPGSSPLPTPFGAATATEAASSGKQCLRAGSGSAPCSRRPAPGKASGPLPSKCVAIDCEMVGTGPRGRVSELARCSIVSYHGDVLYDKYIRPEMPIADYRTRWSGITRQHMRKAVPFQVAQKEILKLLKGKVVVGHALHNDFQALKYVHPRSQTRDTTVLGS

SEQ ID NO: 747743 - protein, 377 aa, Homo sapiens; identical to SEQ ID NO: 747737

SEQ ID NO: 747744 - protein, 293 aa, Homo sapiens
AAVGAGLARACGSCRLSGRHVQTGRDTRGFRLLPHWKITPQASLAPSSELTGMVPREAPESAQCLCPSLTIPNAKDVLRKRHKRRSRQHQRFMARKALLQEQGLLSMPPEPGSSPLPTPFGAATATEAASSGKQCLRAGSGSAPCSRRPAPGKASGPLPSKCVAIDCEMVGTGPRGRVSELARCSIVSYHGDVLYDKYIRPEMPIADYRTRWSGITRQHMRKAVPFQVAQKEILKLLKGKVVVGHALHNDFQALKYVHPRSQTRDTTVPQTWGHRLSSHWLPPCQHSTEEGAN

SEQ ID NO: 747745 - protein, 1070 aa, Homo sapiens
MYCCSAQDSKMDYKRRFLLGGSKQKVQQHQQYPMPELGRALSAPLASTATTAPLGSLTAAGSCHHAMPHTTPIADIQQGISKYLDALNVFCRASTFLTDLFSTVFRNSHYSKAATQLKDVQEHVMEAASRLTSAIKPEIAKMLMELSAGAANFTDQKEFSLQDIEVLGRCFLTVVQVHFQFLTHALQKVQPVAHSCFAEVIVPEKKNSGSGGGLSGMGHTPEVEEAVRSWRGAAEATSRLRERGCDGCLAGIEVQQLFCSQSAAIPEHQLKELNIKIDSALQAYKIALESLGHCEYAMKAGFHLNPKAIEASLQGCCSEAEAQQTGRRQTPPQPMQCELPTVPVQIGSHFLKGVSFNESAADNLKLKTHTMLQLMKEAGCYNGITSRDDFPVTEVLNQVCPSTWRGACKTAVQLLFGQAGLVVVDTAQIENKEAYAPQISLEGSRIVVQVPSTWCLKEDPATMSLLQRSLDPEKTLGLVDVLYTAVLDLNRWRAGREQALPCIQIQLQREICDFGNQADLPSGNGNKSSGGLQKTFSKLTSRFTKKASCTSSSSSTNYSIQNTPSKNIFIAGCSEEKAKMPGNIDTRLQSILNIGNFPRTTDPSQSAQNSSNTVANGFLMERRENFLHGDDGKDEKGMNLPTDQEMQEVIDFLSGFNMGQSHQGSPLVTRHNSAATAMVTEQKAGAMQPQQPSLPVPPPPRAPQAGAHTPLTPQPGLAPQQQSPKQQQPQVQYYQHLLQPIGPQQPPPQPRAPGKWVHGSSQQPAQAVGAGLSPLGQWPGISDLSSDLYSLGLVSSYMDNVMSEVLGQKPQGPRNNTWPNRDQSDGVFGMLGEILPFDPAVGSDPEFARYVAGVSQAMQQKRQAQHGRRPGNPRGNWPPMDDAHRTWPFPEFFTEGDGLHGGWSGAQGDSASSSDETSSANGDSLFSMFSGPDLVAAVKQRRKHSSGEQDTSTLPSPPLLTTVEDVNQDNKTKTWPPKAPWQHPSPLPSTLPSPSAPLYAVTSPGSQWNDTMQMLQSPVWAATNDCSAAAFSYVQTPPQPPPPPAHKAAPKGFKAFPGKGERRPAYLPQY

SEQ ID NO: 747746 - protein, 67 aa, Homo sapiens
FVPKPGLFLCPNAVGSDPEFARYVAGVSQAMQQKRQAQHGRRPGNPRGNWPPMDDAHRTWPCPPRGL

SEQ ID NO: 747747 - protein, 491 aa, Homo sapiens [sequence omitted]

SEQ ID NO: 747748 - protein, 1070 aa, Homo sapiens; identical to SEQ ID NO: 747745

SEQ ID NO: 747749 - protein, 1070 aa, Homo sapiens; identical to SEQ ID NO: 747745

SEQ ID NO: 747750 - protein, 1070 aa, Homo sapiens; identical to SEQ ID NO: 747745

SEQ ID NO: 747751 - protein, 842 aa, Homo sapiens
MYCCSAQDSKMDYKRRFLLGGSKQKVQQHQQYPMPELGRALSAPLASTATTAPLGSLTAAGSCHHAMPHTTPIADIQQGISKYLDALNVFCRASTFLTDLFSTVFRNSHYSKAATQLKDVQEHVMEAASRLTSAIKPEIAKMLMELSAGAANFTDQKEFSLQDIEVLGRCFLTVVQVHFQFLTHALQKVQPVAHSCFAEVIVPEKKNSGSGGGLSGMGHTPEVEEAVRSWRGAAEATSRLRERGCDGCLAGIEVQQLFCSQSAAIPEHQLKELNIKIDSALQAYKIALESLGHCEYAMKAGFHLNPKAIEASLQGCCSEAEAQQTGRRQTPPQPMQCELPTVPVQIGSHFLKGVSFNESAADNLKLKTHTMLQLMKEAGCYNGITSRDDFPVTEVLNQVCPSTWRGACKTAVQLLFGQAGLVVVDTAQIENKEAYAPQISLEGSRIVVQVPSTWCLKEDPATMSLLQRSLDPEKTLGLVDVLYTAVLDLNRWRAGREQALPCIQIQLQREICDFGNQADLPSGNGNKSSGGLQKTFSKLTSRFTKKASCTSSSSSTNYSIQNTPSKNIFIAGCSEEKAKMPGNIDTRLQSILNIGNFPRTTDPSQSAQNSSNTVANGFLMERRENFLHGDDGKDEKGMNLPTDQEMQEVIDFLSGFNMGQSHQGSPLVTRHNSAATAMVTEQKAGAMQPQQPSLPVPPPPRAPQAGAHTPLTPQPGLAPQQQSPKQQQPQVQYYQHLLQPIGPQQPPPQPRAPGKWVHGSSQQPAQAVGAGLSPLGQWPGISDLSSDLYSLGLVSSYMDNVMSEVLGQKPQGPRNNTWPNRDQSDGVFGMLGEILPFDPAGM

SEQ ID NO: 747752 - protein, 84 aa, Homo sapiens
NVSEECSYSDPSESQTELSEFVHEKEVVDLSQELKERVSEDDETQPEKGTELQFEHLNWDPEEVAEWISQLGFPQYKVYKNKMF

SEQ ID NO: 747753 - protein, 561 aa, Homo sapiens
MVLGPEQKMSDDSVSGDHGESASLGNINPAYSNPSLSQSPGDSEEYFATYFNEKISIPEEEYSCFSFRKLWAFTGPGFLMSIAYLDPGNIESDLQSGAVAGFKLLWILLLATLVGLLLQRLAARLGVVTGLHLAEVCHRQYPKVPRVILWLMVELAIIGSDMQEVIGSAIAINLLSVGRIPLWGGVLITIADTFVFLFLDKYGLRKLEAFFGFLITIMALTFGYEYVTVKPSQSQVLKGMFVPSCSGCRTPQIEQAVGIVGAVIMPHNMYLHSALVKSRQVNRNNKQEVREANKYFFIESCIALFVSFIINVFVVSVFAEAFFGKTNEQVVEVCTNTSSPHAGLFPKDNSTLAVDIYKGGVVLGCYFGPAALYIWAVGILAAGQSSTMTGTYSGQFVMEGFLNLKWSRFARVVLTRSIAIIPTLLVAVFQDVEHLTGMNDFLNVLQSLQLPFALIPILTFTSLRPVMSDFANGLGWRIAGGILVLIICSINMYFVVVYVRDLGHVALYVVAAVVSVAYLGFVFYLGWQCLIALGMSFLDCGHTVSISKGLLTEEATRGYVK

SEQ ID NO: 747754 - protein, 561 aa, Homo sapiens; identical to SEQ ID NO: 747753

SEQ ID NO: 747755 - protein, 561 aa, Homo sapiens; identical to SEQ ID NO: 747753

SEQ ID NO: 747756 - protein, 561 aa, Homo sapiens; identical to SEQ ID NO: 747753

SEQ ID NO: 747757 - protein, 557 aa, Homo sapiens [sequence omitted]

SEQ ID NO: 747758 - protein, 561 aa, Homo sapiens; identical to SEQ ID NO: 747753

SEQ ID NO: 747759 - protein, 482 aa, Homo sapiens
MSIAYLDPGNIESDLQSGAVAGFKLLWILLLATLVGLLLQRLAARLGVVTGLHLAEVCHRQYPKVPRVILWLMVELAIIGSDMQEVIGSAIAINLLSVGRIPLWGGVLITIADTFVFLFLDKYGLRKLEAFFGFLITIMALTFGYEYVTVKPSQSQVLKGMFVPSCSGCRTPQIEQAVGIVGAVIMPHNMYLHSALVKSRQVNRNNKQEVREANKYFFIESCIALFVSFIINVFVVSVFAEAFFGKTNEQVVEVCTNTSSPHAGLFPKDNSTLAVDIYKGGVVLGCYFGPAALYIWAVGILAAGQSSTMTGTYSGQFVMEGFLNLKWSRFARVVLTRSIAIIPTLLVAVFQDVEHLTGMNDFLNVLQSLQLPFALIPILTFTSLRPVMSDFANGLGWRIAGGILVLIICSINMYFVVVYVRDLGHVALYVVAAVVSVAYLGFVFYLGWQCLIALGMSFLDCGHTVSISKGLLTEEATRGYVK

SEQ ID NO: 747760 - protein, 569 aa, Homo sapiens
MVLGPEQKMSDDSVSGDHGESASLGNINPAYSNPSLSQSPGDSEEYFATYFNEKISIPEEENKRLMDLQYSCFSFRKLWAFTGPGFLMSIAYLDPGNIESDLQSGAVAGFKLLWILLLATLVGLLLQRLAARLGVVTGLHLAEVCHRQYPKVPRVILWLMVELAIIGSDMQEVIGSAIAINLLSVGRIPLWGGVLITIADTFVFLFLDKYGLRKLEAFFGFLITIMALTFGYEYVTVKPSQSQVLKGMFVPSCSGCRTPQIEQAVGIVGAVIMPHNMYLHSALVKSRQVNRNNKQEVREANKYFFIESCIALFVSFIINVFVVSVFAEAFFGKTNEQVVEVCTNTSSPHAGLFPKDNSTLAVDIYKGGVVLGCYFGPAALYIWAVGILAAGQSSTMTGTYSGQFVMEGFLNLKWSRFARVVLTRSIAIIPTLLVAVFQDVEHLTGMNDFLNVLQSLQLPFALIPILTFTSLRPVMSDFANGLGWRIAGGILVLIICSINMYFVVVYVRDLGHVALYVVAAVVSVAYLGFVFYLGWQCLIALGMSFLDCGHTVSISKGLLTEEATRGYVK

SEQ ID NO: 747761 - protein, 174 aa, Homo sapiens [sequence omitted]

SEQ ID NO: 747762 - protein, 561 aa, Homo sapiens; identical to SEQ ID NO: 747753

SEQ ID NO: 747763 - protein, 568 aa, Homo sapiens
MVLGPEQKMSDDSVSGDHGESASLGNINPAYSNPSLSQSPGDSEEYFATYFNEKISIPEEEYSCFSFRKLWAFTGPGFLMSIAYLDPGNIESDLQSGAVAGFKLLWILLLATLVGLLLQRLAARLGVVTGLHLAEVCHRQYPKVPRVILWLMVELAIIGSDMQEVIGSAIAINLLSVGRIPLWGGVLITIADTFVFLFLDKYGLRKLEAFFGFLITIMALTFGYEYVTVKPSQSQVLKGMFVPSCSGCRTPQIEQAVGIVGAVIMPHNMYLHSALVKSRQVNRNNKQEVREANKYFFIESCIALFVSFIINVFVVSVFAEAFFGKTNEQVVEVCTNTSSPHAGLFPKDNSTLAVDIYKGGVVLGCYFGPAALYIWAVGILAAGQSSTMTGTYSGQFVMEGFLNLKWSRFARVVLTRSIAIIPTLLVAVFQDVEHLTGMNDFLNVLQSLQLPFALIPILTFTSLRPVMSDFANGLGWRIAGGILVLIICSINMYFVVVYVRDLGHVALYVVAAVVSVAYLGFVFYLGWQCLIALGMSFLDCGHTCHLGLTAQPELYLLNTMDADSLVSR

SEQ ID NO: 747764 - protein, 308 aa, Homo sapiens
MVLGPEQKMSDDSVSGDHGESASLGNINPAYSNPSLSQSPGDSEEYFATYFNEKISIPEEEYSCFSFRKLWAFTGPGFLMSIAYLDPGNIESDLQSGAVAGFKLLWILLLATLVGLLLQRLAARLGVVTGLHLAEVCHRQYPKVPRVILWLMVELAIIGSDMQEVIGSAIAINLLSVGRIPLWGGVLITIADTFVFLFLDKYGLRKLEAFFGFLITIMALTFGYELTFTSLRPVMSDFANGLGWRIAGGILVLIICSINMYFVVVYVRDLGHVALYVVAAVVSVAYLGFVFYLVSLAWKSRGIGIRDG

SEQ ID NO: 747765 - protein, 594 aa, Homo sapiens
SSGTMRKKQLKTEAAPHCELKSYSKNSATQVSTMVLGPEQKMSDDSVSGDHGESASLGNINPAYSNPSLSQSPGDSEEYFATYFNEKISIPEEEYSCFSFRKLWAFTGPGFLMSIAYLDPGNIESDLQSGAVAGFKLLWILLLATLVGLLLQRLAARLGVVTGLHLAEVCHRQYPKVPRVILWLMVELAIIGSDMQEVIGSAIAINLLSVGRIPLWGGVLITIADTFVFLFLDKYGLRKLEAFFGFLITIMALTFGYEYVTVKPSQSQVLKGMFVPSCSGCRTPQIEQAVGIVGAVIMPHNMYLHSALVKSRQVNRNNKQEVREANKYFFIESCIALFVSFIINVFVVSVFAEAFFGKTNEQVVEVCTNTSSPHAGLFPKDNSTLAVDIYKGGVVLGCYFGPAALYIWAVGILAAGQSSTMTGTYSGQFVMEGFLNLKWSRFARVVLTRSIAIIPTLLVAVFQDVEHLTGMNDFLNVLQSLQLPFALIPILTFTSLRPVMSDFANGLGWRIAGGILVLIICSINMYFVVVYVRDLGHVALYVVAAVVSVAYLGFVFYLGWQCLIALGMSFLDCGHTVSISKGLLTEEATRGYVK

SEQ ID NO: 747766 - protein, 561 aa, Homo sapiens; identical to SEQ ID NO: 747753

SEQ ID NO: 747767 - protein, 561 aa, Homo sapiens; identical to SEQ ID NO: 747753

SEQ ID NO: 747768 - protein, 594 aa, Homo sapiens; identical to SEQ ID NO: 747765

SEQ ID NO: 747769 - protein, 576 aa, Homo sapiens
RTRGSTHASPGIWSPGRGGGVSGGCGAGKNHILRTQPLRYPPWCWVLNRRCQMSPGDSEEYFATYFNEKISIPEEEYSCFSFRKLWAFTGPGFLMSIAYLDPGNIESDLQSGAVAGFKLLWILLLATLVGLLLQRLAARLGVVTGLHLAEVCHRQYPKVPRVILWLMVELAIIGSDMQEVIGSAIAINLLSVGRIPLWGGVLITIADTFVFLFLDKYGLRKLEAFFGFLITIMALTFGYEYVTVKPSQSQVLKGMFVPSCSGCRTPQIEQAVGIVGAVIMPHNMYLHSALVKSRQVNRNNKQEVREANKYFFIESCIALFVSFIINVFVVSVFAEAFFGKTNEQVVEVCTNTSSPHAGLFPKDNSTLAVDIYKGGVVLGCYFGPAALYIWAVGILAAGQSSTMTGTYSGQFVMEGFLNLKWSRFARVVLTRSIAIIPTLLVAVFQDVEHLTGMNDFLNVLQSLQLPFALIPILTFTSLRPVMSDFANGLGWRIAGGILVLIICSINMYFVVVYVRDLGHVALYVVAAVVSVAYLGFVFYLGWQCLIALGMSFLDCGHTVSISKGLLTEEATRGYVK

SEQ ID NO: 747770 - protein, 329 aa, Homo sapiens
MVLGPEQKMSDDSVSGDHGESASLGNINPAYSNPSLSQSPGDSEEYFATYFNEKISIPEEEYSCFSFRKLWAFTGPGFLMSIAYLDPGNIESDLQSGAVAGFKLLWILLLATLVGLLLQRLAARLGVVTGLHLAEVCHRQYPKVPRVILWLMVELAIIGSDMQEVIGSAIAINLLSVGRIPLWGGVLITIADTFVFLFLDKYGLRKLEAFFGFLITIMALTFGYELTFTSLRPVMSDFANGLGWRIAGGILVLIICSINMYFVVVYVRDLGHVALYVVAAVVSVAYLGFVFYLGWQCLIALGMSFLDCGHTVSISKGLLTEEATRGYVK

SEQ ID NO: 747771 - protein, 568 aa, Homo sapiens; identical to SEQ ID NO: 747763

SEQ ID NO: 747772 - protein, 174 aa, Homo sapiens [sequence omitted]

SEQ ID NO: 747773 - protein, 561 aa, Homo sapiens; identical to SEQ ID NO: 747753

SEQ ID NO: 747774 - protein, 568 aa, Homo sapiens; identical to SEQ ID NO: 747763

SEQ ID NO: 747775 - protein, 118 aa, Homo sapiens
MVLGPEQKMSDDSVSGDHGESASLGNINPAYSNPSLSQSPGDSEEYFATYFNEKISIPEEEYSCFSFRKLWAFTGPGFLMSIAYLDPGNIESDLQSGAVAGFKLLWILLLPPRYSVQR

SEQ ID NO: 747776 - protein, 371 aa, Homo sapiens
MAATCEISNIFSNYFSAMYSSEDSTLASVPPAATFGADDLVLTLSNPQMSLEGTEKASWLGEQPQFWSKTQVLDWISYQVEKNKYDASAIDFSRCDMDGATLCNCALEELRLVFGPLGDQLHAQLRDLTSSSSDELSWIIELLEKDGMAFQEALDPGPFDQGSPFAQELLDDGQQASPYHPGSCGAGAPSPGSSDVSTAGTGASRSSHSSDSGGSDVDLDPTDGKLFPSDGFRDCKKGDPKHGKRKRGRPRKLSKEYWDCLEGKKSKHAPRGTHLWEFIRDILIHPELNEGLMKWENRHEGVFKFLRSEAVAQLWGQKKKNSNMTYEKLSRAMRYYYKREILERVDGRRLVYKFGKNSSGWKEEEVLQSRN

SEQ ID NO: 747777 - protein, 371 aa, Homo sapiens; identical to SEQ ID NO: 747776

SEQ ID NO: 747778 - protein, 371 aa, Homo sapiens; identical to SEQ ID NO: 747776

SEQ ID NO: 747779 - protein, 371 aa, Homo sapiens; identical to SEQ ID NO: 747776

SEQ ID NO: 747780 - protein, 389 aa, Homo sapiens
CVGDGACVVLGLRHSGSLMAATCEISNIFSNYFSAMYSSEDSTLASVPPAATFGADDLVLTLSNPQMSLEGTEKASWLGEQPQFWSKTQVLDWISYQVEKNKYDASAIDFSRCDMDGATLCNCALEELRLVFGPLGDQLHAQLRDLTSSSSDELSWIIELLEKDGMAFQEALDPGPFDQGSPFAQELLDDGQQASPYHPGSCGAGAPSPGSSDVSTAGTGASRSSHSSDSGGSDVDLDPTDGKLFPSDGFRDCKKGDPKHGKRKRGRPRKLSKEYWDCLEGKKSKHAPRGTHLWEFIRDILIHPELNEGLMKWENRHEGVFKFLRSEAVAQLWGQKKKNSNMTYEKLSRAMRYYYKREILERVDGRRLVYKFGKNSSGWKEEEVLQSRN

SEQ ID NO: 747781 - protein, 426 aa, Homo sapiens
MAATCEISNIFSNYFSAMYSSEDSTLASVPPAATFGADDLVLTLSNPQMSLEGTEKASWLGEQPQFWSKTQVLDWISYQVEKNKYDASAIDFSRCDMDGATLCNCALEELRLVFGPLGDQLHAQLRDLSESRPLEAGEQLHMLSPVEFSVAVGRPWSSGPAAQPERALEGGIRGVGPFLPSLSASSSSDELSWIIELLEKDGMAFQEALDPGPFDQGSPFAQELLDDGQQASPYHPGSCGAGAPSPGSSDVSTAGTGASRSSHSSDSGGSDVDLDPTDGKLFPSDGFRDCKKGDPKHGKRKRGRPRKLSKEYWDCLEGKKSKHAPRGTHLWEFIRDILIHPELNEGLMKWENRHEGVFKFLRSEAVAQLWGQKKKNSNMTYEKLSRAMRYYYKREILERVDGRRLVYKFGKNSSGWKEEEVLQSRN

SEQ ID NO: 747782 - protein, 344 aa, Homo sapiens
MAATCEISNIFSNYFSAMYSSEDSTLASVPPAATFGADDLVLTLSNPQMSLEGTEKASWLGEQPQFWSKTQVLDWISYQVEKNKYDASAIDFSRCDMDGATLCNCALEELRLVFGPLGDQLHAQLRDLTSSSSDELSWIIELLEKDGMAFQEALDPGPFDQGSPFAQELLDDGTGASRSSHSSDSGGSDVDLDPTDGKLFPSDGFRDCKKGDPKHGKRKRGRPRKLSKEYWDCLEGKKSKHAPRGTHLWEFIRDILIHPELNEGLMKWENRHEGVFKFLRSEAVAQLWGQKKKNSNMTYEKLSRAMRYYYKREILERVDGRRLVYKFGKNSSGWKEEEVLQSRN

SEQ ID NO: 747783 - protein, 493 aa, Homo sapiens
MAATCEISNIFSNYFSAMYSSEDSTLASVPPAATFGADDLVLTLSNPQMSLEGTEKASWLGEQPQFWSKTQVLDWISYQVEKNKYDASAIDFSRCDMDGATLCNCALEELRLVFGPLGDQLHAQLRDLSESRPLEAGEQLHMLSPVEFSVAVGRPWSSGPAAQPERALEGGIRGVGPFLPSLSASSSSDELSWIIELLEKDGMAFQEALDPGPFGENPFSPSFPSLSCPIPAPPQSARDDPSPDFFLPQLEKLQQVIRPMGSITCPGLSPEPSLSSHLLFPDQGSPFAQELLDDGQQASPYHPGSCGAGAPSPGSSDVSTAGTGASRSSHSSDSGGSDVDLDPTDGKLFPSDGFRDCKKGDPKHGKRKRGRPRKLSKEYWDCLEGKKSKHAPRGTHLWEFIRDILIHPELNEGLMKWENRHEGVFKFLRSEAVAQLWGQKKKNSNMTYEKLSRAMRYYYKREILERVDGRRLVYKFGKNSSGWKEEEVLQSRN

SEQ ID NO: 747784 - protein, 358 aa, Homo sapiens
MAATCEISNIFSNYFSAMYSSEDSTLASVPPAATFGADDLVLTLSNPQMSLEGTEKASWLGEQPQFWSKTQVLDWISYQVEKNKYDASAIDFSRCDMDGATLCNCALEELRLVFGPLGDQLHAQLRDLTSSSSDELSWIIELLEKDGMAFQEALDPGPFDQGSPFAQELLDDGQQASPYHPGSCGAGTGASRSSHSSDSGGSDVDLDPTDGKLFPSDGFRDCKKGDPKHGKRKRGRPRKLSKEYWDCLEGKKSKHAPRGTHLWEFIRDILIHPELNEGLMKWENRHEGVFKFLRSEAVAQLWGQKKKNSNMTYEKLSRAMRYYYKREILERVDGRRLVYKFGKNSSGWKEEEVLQSRN

SEQ ID NO: 747785 - protein, 371 aa, Homo sapiens; identical to SEQ ID NO: 747776

SEQ ID NO: 747786 - protein, 187 aa, Homo sapiens
PVLGIPLLAVTKTIAGTGASRSSHSSDSGGSDVDLDPTDGKLFPSDGFRDCKKGDPKHGKRKRGRPRKLSKEYWDCLEGKKSKHAPRGTHLWEFIRDILIHPELNEGLMKWENRHEGVFKFLRSEAVAQLWGQKKKNSNMTYEKLSRAMRYYYKREILERVDGRRLVYKFGKNSSGWKEEEVLQSRN

SEQ ID NO: 747787 - protein, 119 aa, Homo sapiens
GERGHLDGKLMEAGLAAPRGTHLWEFIRDILIHPELNEGLMKWENRHEGVFKFLRSEAVAQLWGQKKKNSNMTYEKLSRAMRYYYKREILERVDGRRLVYKFGKNSSGWKEEEVLQSRN

SEQ ID NO: 747788 - protein, 371 aa, Homo sapiens; identical to SEQ ID NO: 747776

SEQ ID NO: 747789 - protein, 277 aa, Homo sapiens
MAATCEISNIFSNYFSAMYSSEDSTLASVPPAATFGADDLVLTLSNPQMSLEGTEKASWLGEQPQFWSKTQVLDWISYQVEKNKYDASAIDFSRCDMDGATLCNCALEELRLVFGPLGDQLHAQLRDLTSSSSDELSWIIELLEKDGMAFQEALDPGPFDQGSPFAQELLDDGQQASPYHPGSCGAGAPSPGSSDVSTAGTGASRSSHSSDSGGSDVDLDPTDGKLFPSDGFRDCKKGDPKHGKRKRGRPRKLSKEYWDCLEGKKSKHEPGLVVLER

SEQ ID NO: 747790 - protein, 237 aa, Homo sapiens
MAATCEISNIFSNYFSAMYSSEDSTLASVPPAATFGADDLVLTLSNPQMSLEGTEKASWLGEQPQFWSKTQVLDWISYQVEKNKYDASAIDFSRCDMDGATLCNCALEELRLVFGPLGDQLHAQLRDLTSSSSDELSWIIELLEKDGMAFQEALDPGPFDQGSPFAQELLDDGQQASPYHPGSCGAGAPSPGSSDVSTAGTGASRSSHSSDSGGSDVDLDPTDGKLFPSVPPPPKKA

SEQ ID NO: 747791 - protein, 136 aa, Homo sapiens
MAATCEISNIFSNYFSAMYSSEDSTLASVPPAATFGADDLVLTLSNPQMSLEGTEKASWLGEQPQFWSKTQVLDWISYQVEKNKYDASAIDFSRCDMDGATLCNCALEELRLVFGPLGDQLHAQLRDLTFTSHYLE

SEQ ID NO: 747792 - protein, 371 aa, Homo sapiens; identical to SEQ ID NO: 747776

SEQ ID NO: 747793 - protein, 419 aa, Homo sapiens
MAATCEISNIFSNYFSAMYSSEDSTLASVPPAATFGADDLVLTLSNPQMSLEGTEKASWLGEQPQFWSKTQVLDWISYQVEKNKYDASAIDFSRCDMDGATLCNCALEELRLVFGPLGDQLHAQLRDLTSSSSDELSWIIELLEKDGMAFQEALDPGPFDQGSPFAQELLDDGQQASPYHPGSCGAGAPSPGSSDVSTAGTGASRSSHSSDSGGSDVDLDPTDGKLFPSGESREVPKRASHLQCTGGPALPAAFSCRGATLPNSPLAPPGPSTTVPTDGFRDCKKGDPKHGKRKRGRPRKLSKEYWDCLEGKKSKHAPRGTHLWEFIRDILIHPELNEGLMKWENRHEGVFKFLRSEAVAQLWGQKKKNSNMTYEKLSRAMRYYYKREILERVDGRRLVYKFGKNSSGWKEEEVLQSRN

SEQ ID NO: 747794 - protein, 382 aa, Homo sapiens
HALVRIRHCSLMAATCEISNIFSNYFSAMYSSEDSTLASVPPAATFGADDLVLTLSNPQMSLEGTEKASWLGEQPQFWSKTQVLDWISYQVEKNKYDASAIDFSRCDMDGATLCNCALEELRLVFGPLGDQLHAQLRDLTSSSSDELSWIIELLEKDGMAFQEALDPGPFDQGSPFAQELLDDGQQASPYHPGSCGAGAPSPGSSDVSTAGTGASRSSHSSDSGGSDVDLDPTDGKLFPSDGFRDCKKGDPKHGKRKRGRPRKLSKEYWDCLEGKKSKHAPRGTHLWEFIRDILIHPELNEGLMKWENRHEGVFKFLRSEAVAQLWGQKKKNSNMTYEKLSRAMRYYYKREILERVDGRRLVYKFGKNSSGWKEEEVLQSRN

SEQ ID NO: 747795 - protein, 224 aa, Homo sapiens
MAFQEALDPGPFDQGSPFAQELLDDGQQASPYHPGSCGAGAPSPGSSDVSTAGTGASRSSHSSDSGGSDVDLDPTDGKLFPSDGFRDCKKGDPKHGKRKRGRPRKLSKEYWDCLEGKKSKHAPRGTHLWEFIRDILIHPELNEGLMKWENRHEGVFKFLRSEAVAQLWGQKKKNSNMTYEKLSRAMRYYYKREILERVDGRRLVYKFGKNSSGWKEEEVLQSRN

SEQ ID NO: 747796 - protein, 450 aa, Homo sapiens
MAATCEISNIFSNYFSAMYSSEDSTLASVPPAATFGADDLVLTLSNPQMSLEGTEKASWLGEQPQFWSKTQVLDWISYQVEKNKYDASAIDFSRCDMDGATLCNCALEELRLVFGPLGDQLHAQLRDLTSSSSDELSWIIELLEKDGMAFQEALDPGPFDQGSPFAQELLDDGQQASPYHPGSCGAGAPSPGSSDVSTAGTGTGWEVCPESQQRGEQRVGRQGTYSDPAPRTGASRSSHSSDSGGSDVDLDPTDGKLFPSGESREVPKRASHLQCTGGPALPAAFSCRGATLPNSPLAPPGPSTTVPTDGFRDCKKGDPKHGKRKRGRPRKLSKEYWDCLEGKKSKHAPRGTHLWEFIRDILIHPELNEGLMKWENRHEGVFKFLRSEAVAQLWGQKKKNSNMTYEKLSRAMRYYYKREILERVDGRRLVYKFGKNSSGWKEEEVLQSRN

SEQ ID NO: 747797 - protein, 371 aa, Homo sapiens; identical to SEQ ID NO: 747776

SEQ ID NO: 747798 - protein, 109 aa, Homo sapiens
FLRIFSPPRGTHLWEFIRDILIHPELNEGLMKWENRHEGVFKFLRSEAVAQLWGQKKKNSNMTYEKLSRAMRYYYKREILERVDGRRLVYKFGKNSSGWKEEEVLQSRN

SEQ ID NO: 747799 - protein, 367 aa, Homo sapiens
MAATCEISNIFSNYFSAMYSSEDSTLASVPPAATFGADDLVLTLSNPQMSLEGTEKASWLGEQPQFWSKTQVLDWISYQVEKNKYDASAIDFSRCDMDGATLCNCALEELRLVFGPLGDQLHAQLRDLTSSSSDELSWIIELLEKDGMAFQEALDPGPFDQGSPFAQELLDDGQQASPYHPGSCGAGAPSPGSSDVSTAGTGASRSSHSSDSGGSDVDLDPTDGKLFPSDGFRDCKKGDPKHGKRKRGRPRKLSKEYWDCLEGKKSKHAPRGTHLWEFIRDILIHPELNEGLMKWENRHEGVFKFLRSEAVAQLWGQKKKNSNMTYEKLSRAMRMSRMNSHRWVPLGAAASLTLRGPRGRTVPIGIL

SEQ ID NO: 747800 - protein, 109 aa, Homo sapiens
ERERERELVSRSTRPRIRGRVDRRRRLYLEPGRGAQRPDTSALPGGTGFLSRLPACLPQPDSATPVASWLQPVRLATFLATTSVRCTARRTPPWPLFPLLPPLGPMTWY

SEQ ID NO: 747801 - protein, 138 aa, Homo sapiens
MRVFSLHLGPNSRHIRILPSLVFQIFAAIFVGVLVMSGRGKGGKGLGKGGAKRHRKVLRDNIQGITKPAIRRLARRGGVKRISGLIYEETRGVLKVFLENVIRDAVTYTEHAKRKTVTAMDVVYALKRQGRTLYGFGG

SEQ ID NO: 747802 - protein, 213 aa, Homo sapiens
MERVGRGAPKRPCGNPQTTLWGRGPKEGTENSTGGGSRSCGKPERGPKRVLKPPILLLKKFPNTTWVSKKFCSPSTVTITCGAVSQPGGENPGGNPFVHSPPSVGGASKEVRPRFGSKVPALTLPLVIRGGALCKTTQHKGRLTRKTIEKRGDAKKGPTEGRRLRYTRFLDKGRKKKELKQKQGGALQTAQGKRHRASGDNTSWEKRDPTEYS

SEQ ID NO: 747803 - protein, 315 aa, Homo sapiens
MEPEAGTNRTAVAEFILLGLVQTEEMQPVVFVLLLFAYLVTTGGNLSILAAVLVEPKLHAPMYFFLGNLSVLDVGCITVTVPAMLGRLLSHKSTISYDACLSQLFFFHLLAGMDCFLLTAMAYDRLLAICQPLTYSTRMSQTVQRMLVAASLACAFTNALTHTVAMSTLNFCGPNEVNHFYCDLPQLFQLSCSSTQLNELLLFAVGFIMAGTPLVLIITAYSHVAAAVLRIRSVEGRKKAFSTCGSHLTVVCLFFGRGIFNYMRLGSEEASDKDKGVGVFNTVINPMLNPLIYSLRNPDVQGALWQIFLGRRSLT

SEQ ID NO: 747804 - protein, 159 aa, Homo sapiens
GKDLSSKLTHQKNHEIKVQHSPFPSSLPCPGRLLRTLLGNSSVSFVLISFLLCFAVDLSSFSLTSLPQSLLMLNQDLRAGAHLSASIQRGLLTQPPLLEEDLAFSLPACPCAEEGCLSRVTPICLCCSFIPCLSNYLAMCSLGTQVFRSTDRPAGTLSC

SEQ ID NO: 747805 - protein, 96 aa, Homo sapiens
GEHGRCLVSPASAGRELLSGQGQVCWSGVRARVPGRGGGAWQASLERRGPCAGAGGRAEPQTPLAPARPRQPRAKESRGSPSCHHEPREGFRAAHA

SEQ ID NO: 747806 - protein, 191 aa, Homo sapiens
FSALQMFRHTDSLFPILLQTLSDESDEVILKDLEVLAEIASSPAGQTDDPGPLDGPDLQASHSELQVPTPGRAGLLNTSGTKGLECSPSTPTMNSYFYKFMINLLKRFSSERKLLEVRGPFIIRSALAARFLLFLPRPRLFTFTPFKCQSSHLLFPFSLLLFLTFGSVRNEEGCPFILVADASDMKQTGQC

SEQ ID NO: 747807 - protein, 138 aa, Homo sapiens
RVCSGLVSPLQKQLFCGPMVILKDLEVLAEIASSPAGQTDDPGPLDGPDLQASHSELQVPTPGRAGLLNTSGTKGLECSPSTPTMNSYFYKFMINLLKRFSSERKLLEVRGPFIIRNEEGCPFILVADASDMKQTGQC

SEQ ID NO: 747808 - protein, 782 aa, Homo sapiens
MNPEKDFAPLTPNIVRALNDKLYEKRKVAALEIEKLVREFVAQNNTVQIKHVIQTLSQEFALSQHPHSRKGGLIGLAACSIALGKDSGLYLKELIEPVLTCFNDADSRLRYYACEALYNIVKVARGAVLPHFNVLFDGLSKLAADPDPNVKSGSELLDRLLKDIVTESNKFDLVSFIPLLRERIYSNNQYARQFIISWILVLESVPDINLLDYLPEILDGLFQILGDNGKEIRKMCEVVLGEFLKEIKKNPSSVKFAEMANILVIHCQTTDDLIQLTAMCWMREFIQLAGRVMLPYSSGILTAVLPCLAYDDRKKSIKEVANVCNQSLMKLVTPEDDELDELRPGQRQAEPTPDDALPKQEGTASGGPDGSCDSSFSSGISVFTAASTERAPVTLHLDGIVQVLNCHLSDTAIGMMTRIAVLKWLYHLYIKTPRKMFRHTDSLFPILLQTLSDESDEVILKDLEVLAEIASSPAGQTDDPGPLDGPDLQASHSELQVPTPGRAGLLNTSGTKGLECSPSTPTMNSYFYKFMINLLKRFSSERKLLEVRGPFIIRQLCLLLNAENIFHSMADILLREEDLKFASTMVHALNTILLTSTELFQLRNQLKDLKTLESQNLFCCLYRSWCHNPVTTVSLCFLTQNYRHAYDLIQKFGDLEVTVDFLAEVDKLVQLIECPIFTYLRLQLLDVKNNPYLIKALYGLLMLLPQSSAFQLLSHRLQCVPNPELLQTEDSLKAAPKSQKADSPSIDYAELLQHFEKVQNKHLEVRHQRSGRGDHLDRRVVL

SEQ ID NO: 747809 - protein, 732 aa, Homo sapiens
MNPEKDFAPLTPNIVRALNDKLYEKRKVAALEIEEDSGLYLKELIEPVLTCFNDADSRLRYYACEALYNIVKVARGAVLPHFNVLFDGLSKLAADPDPNVKSGSELLDRLLKDIVTESNKFDLVSFIPLLRERIYSNNQYARQFIISWILVLESVPDINLLDYLPEILDGLFQILGDNGKEIRKMCEVVLGEFLKEIKKNPSSVKFAEMANILVIHCQTTDDLIQLTAMCWMREFIQLAGRVMLPYSSGILTAVLPCLAYDDRKKSIKEVANVCNQSLMKLVTPEDDELDELRPGQRQAEPTPDDALPKQEGTASGGPDGSCDSSFSSGISVFTAASTERAPVTLHLDGIVQVLNCHLSDTAIGMMTRIAVLKWLYHLYIKTPRKMFRHTDSLFPILLQTLSDESDEVILKDLEVLAEIASSPAGQTDDPGPLDGPDLQASHSELQVPTPGRAGLLNTSGTKGLECSPSTPTMNSYFYKFMINLLKRFSSERKLLEVRGPFIIRQLCLLLNAENIFHSMADILLREEDLKFASTMVHALNTILLTSTELFQLRNQLKDLKTLESQNLFCCLYRSWCHNPVTTVSLCFLTQNYRHAYDLIQKFGDLEVTVDFLAEVDKLVQLIECPIFTYLRLQLLDVKNNPYLIKALYGLLMLLPQSSAFQLLSHRLQCVPNPELLQTEDSLKAAPKSQKADSPSIDYAELLQHFEKVQNKHLEVRHQRSGRGDHLDRRVVL

SEQ ID NO: 747810 - protein, 548 aa, Homo sapiens
MCEVVLGEFLKEIKKNPSSVKFAEMANILVIHCQTTDDLIQLTAMCWMREFIQLAGRVMLPYSSGILTAVLPCLAYDDRKKSIKEVANVCNQSLMKLVTPEDDELDELRPGQRQAEPTPDDALPKQEGTASGGPDGSCDSSFSSGISVFTAASTERAPVTLHLDGIVQVLNCHLSDTAIGMMTRIAVLKWLYHLYIKTPRKMFRHTDSLFPILLQTLSDESDEVILKDLEVLAEIASSPAGQTDDPGPLDGPDLQASHSELQVPTPGRAGLLNTSGTKGLECSPSTPTMNSYFYKFMINLLKRFSSERKLLEVRGPFIIRQLCLLLNAENIFHSMADILLREEDLKFASTMVHALNTILLTSTELFQLRNQLKDLKTLESQNLFCCLYRSWCHNPVTTVSLCFLTQNYRHAYDLIQKFGDLEVTVDFLAEVDKLVQLIECPIFTYLRLQLLDVKNNPYLIKALYGLLMLLPQSSAFQLLSHRLQCVPNPELLQTEDSLKAAPKSQKADSPSIDYAELLQHFEKVQNKHLEVRHQRSGRGDHLDRRVVL

SEQ ID NO: 747811 - protein, 217 aa, Homo sapiens
ANSLVIRDCEKEDLKFASTMVHALNTILLTSTELFQLRNQLKDLKTLESQNLFCCLYRSWCHNPVTTVSLCFLTQNYRHAYDLIQKFGDLEVTVDFLAEVDKLVQLIECPIFTYLRLQLLDVKNNPYLIKALYGLLMLLPQSSAFQLLSHRLQCVPNPELLQTEDSLKAAPKSQKADSPSIDYAELLQHFEKVQNKHLEVRHQRSGRGDHLDRRVVL

SEQ ID NO: 747812 - protein, 176 aa, Homo sapiens [sequence omitted]

SEQ ID NO: 747813 - protein, 782 aa, Homo sapiens; identical to SEQ ID NO: 747808

SEQ ID NO: 747814 - protein, 782 aa, Homo sapiens; identical to SEQ ID NO: 747808

SEQ ID NO: 747815 - protein, 758 aa, Homo sapiens
MNPEKDFAPLTPNIVRALNDKLYEKRKVAALEIEKLVREFVAQNNTVQIKHVIQTLSQEFALSQHPHSRKGGLIGLAACSIALGKDSGLYLKELIEPVLTCFNDADSRLRYYACEALYNIVKVARGAVLPHFNVLFDGLSKLAADPDPNVKSGSELLDRLLKDIVTESNKFDLVSFIPLLRERIYSNNQYARQFIISWILVLESVPDINLLDYLPEILDGLFQILGDNGKEIRKMCEVVLGEFLKEIKKNPSSVKFAEMANILVIHCQTTDDLIQLTAMCWMREFIQLAGRVMLPYSSGILTAVLPCLAYDDRKKSIKEVANVCNQSLMKLVTPEDDELDELRPGQRQAEPTPDDALPKQEGTASGGPDGSCDSSFSSGISVFTAASTERAPVTLHLDGIVQVLNCHLSDTAIGMMTRIAVLKWLYHLYIKTPRKMFRHTDSLFPILLQTLSDESDEVILKDLEVLAEIASSPAGQTDDPGPLDGPDLQASHSELQVPTPGRAGLLNTSGTKGLECSPSTPTMNSYFYKFMINLLKRFSSERKLLEVRGPFIIRQLCLLLNAENIFHSMADILLREEDLKFASTMVHALNTILLTSTELFQLRNQLKDLKTLESQNLFCCLYRSWCHNPVTTVSLCFLTQNYRHAYDLIQKFGDLEVTVDFLAEVDKLVQLIECPIFTYLRLQLLDVKNNPYLIKALYGLLMLLPQSSAFQLLSHRLQCVPNPELLQTEDSLKAAPKSQKADSPWHSHRAGCPPSGGL

SEQ ID NO: 747816 - protein, 621 aa, Homo sapiens [sequence omitted]

SEQ ID NO: 747817 - protein, 511 aa, Homo sapiens
MNPEKDFAPLTPNIVRALNDKLYEKRKVAALEIEKLVREFVAQNNTVQIKHVIQTLSQEFALSQHPHSRKGGLIGLAACSIALGKDSGLYLKELIEPVLTCFNDADSRLRYYACEALYNIVKVARGAVLPHFNVLFDGLSKLAADPDPNVKSGSELLDRLLKDIVTESNKFDLVSFIPLLRERIYSNNQYARQFIISWILVLESVPDINLLDYLPEILDGLFQILGDNGKEIRKMCEVVLGEFLKEIKKNPSSVKFAEMANILVIHCQTTDDLIQLTAMCWMREFIQLAGRVMLPYSSGILTAVLPCLAYDDRKKSIKEVANVCNQSLMKLVTPEDDELDELRPGQRQAEPTPDDALPKQEGTASGGPDGSCDSSFSSGISVFTAASTERAPVTLHLDGIVQVLNCHLSDTAIGMMTRIAVLKWLYHLYIKTPRKMFRHTDSLFPILLQTLSDESDEVILKDLEVLAEIASSPAGQTDDPGPLDGPDLQASHSELQVPTPGRAGLLNTSEF

SEQ ID NO: 747818 - protein, 410 aa, Homo sapiens
MNPEKDFAPLTPNIVRALNDKLYEKRKVAALEIEKLVREFVAQNNTVQIKHVIQTLSQEFALSQHPHSRKGGLIGLAACSIALGKDSGLYLKELIEPVLTCFNDADSRLRYYACEALYNIVKVARGAVLPHFNVLFDGLSKLAADPDPNVKSGSELLDRLLKDIVTESNKFDLVSFIPLLRERIYSNNQYARQFIISWILVLESVPDINLLDYLPEILDGLFQILGDNGKEIRKMCEVVLGEFLKEIKKNPSSVKFAEMANILVIHCQTTDDLIQLTAMCWMREFIQLAGRVMLPYSSGILTAVLPCLAYDDRKKSIKEVANVCNQSLMKLVTPEDDELDELRPGQRQAEPTPDDALPKQEGTASGCTEAQHFRDIPPMMRNSLLVRKRETNPNGETFCRVTSASKVSSL

SEQ ID NO: 747819 - protein, 176 aa, Homo sapiens [sequence omitted]

SEQ ID NO: 747820 - protein, 152 aa, Homo sapiens
EALNSQTRTIARGRSHGARSVGRSAHIQATPGRAGLLNTSGTKGLECSPSTPTMNSYFYKFMINLLKRFSSERKLLEVRGPFIIRSALAARFLLFLPRPRLFTFTPFKCQSSHLLFPFSLLLFLTFGSVRNEEGCPFILVADASDMKQTGQC

SEQ ID NO: 747821 - protein, 129 aa, Homo sapiens
LRPGQRQAEPTPDDALPKQEGTASGEWTPSLHLTSCRGPREPDVIGVALGPHLSNQDYFMYVTHTIVAATQRSGSSGSPPFCRQDTGKLSTMATHSQLVKTGTGLEPRQAVSSSHDLNPSCLKDHEAFP

SEQ ID NO: 747822 - protein, 372 aa, Homo sapiens
RSLRRYGELANTPFGLFLPPCFCVPWECCCAYASGLFLELQWTGICDSTMGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGIMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 747823 - protein, 329 aa, Homo sapiens
MDPQCTMGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGIMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 747824 - protein, 672 aa, Homo sapiens
MESRKLISATDIQYSGSLLNSLNEQRGHGLFCDVTVIVEDRKFRAHKNILSASSTYFHQLFSVAGQVVELSFIRAEIFAEILNYIYSSKIVRVRSDLLDELIKSGQLLGVKFIAELGVPLSQVKSISGTAQDGNTEPLPPDSGDKNLVIQKSKDEAQDNGATIMPIITESFSLSAEDYEMKKIIVTDSDDDDDDVIFCSEILPTKETLPSNNTVAQVQSNPGPVAISDVAPSASNNSPPLTNITPTQKLPTPVNQATLSQTQGSEKLLVSSAPTHLTPNIILLNQTPLSTPPNVSSSLPNHMPSSINLLVQNQQTPNSAILTGNKANEEEEEEIIDDDDDTISSSPDSAVSNTSLVPQADTSQNTSFDGSLIQKMQIPTLLQEPLSNSLKISDIITRNTNDPGVGSKHLMEGQKIITLDTATEIEGLSTGCKVYANIGEDTYDIVIPVKDDPDEGEARLENEIPKTSGSEMANKRMKVKHDDHYELIVDGRVYYICIVCKRSYVCLTSLRRHFNIHSWEKKYPCRYCEKVFPLAEYRTKHEIHHTGERRYQCLACGKSFINYQFMSSHIKSVHSQDPSGDSKLYRLHPCRSLQIRQYAYLSDRSSTIPAMKDDGIGYKVDTGKEPPVGTTTSTQNKPMTWEDIFIQQENDSIFKQNVTDGSTEFEFIIPESY

SEQ ID NO: 747825 - protein, 672 aa, Homo sapiens; identical to SEQ ID NO: 747824

SEQ ID NO: 747826 - protein, 672 aa, Homo sapiens; identical to SEQ ID NO: 747824

SEQ ID NO: 747827 - protein, 112 aa, Homo sapiens
GYANDRRTENHNPSAVMASTSLFLEQAIFTRDVSKSTSNPSYLDLKWICSETSWPTPKKMLLHSEDARASHHPHCKSGSSARTQQGSLLSEGFVSCGRKSNIKNKNPGLDYP

SEQ ID NO: 747828 - protein, 112 aa, Homo sapiens; identical to SEQ ID NO: 747827

SEQ ID NO: 747829 - protein, 112 aa, Homo sapiens; identical to SEQ ID NO: 747827

SEQ ID NO: 747830 - protein, 112 aa, Homo sapiens; identical to SEQ ID NO: 747827

SEQ ID NO: 747831 - protein, 112 aa, Homo sapiens; identical to SEQ ID NO: 747827

SEQ ID NO: 747832 - protein, 112 aa, Homo sapiens; identical to SEQ ID NO: 747827

SEQ ID NO: 747833 - protein, 87 aa, Homo sapiens
TTRIRQQELKASPKIFQKTKCSICNSALELPSVHFLCGHSFHQHCFESYSESDADCPTCLPENRKVMDMIRAQEQKRDLHDQSSIRW

SEQ ID NO: 747834 - protein, 77 aa, Homo sapiens
MWHLKLCAVLMIFLLLLGQIDGSPIPEVSSAKRRPRRMTPFWRGVSLRPIGASCRDDSECITRLCRKRRCSLSVAQE

SEQ ID NO: 747835 - protein, 312 aa, Homo sapiens
MPSAIEAIYIILIAGELTIGIWGNGFIVLVNCIDWLKRRDISLIDIILISLAISRICLLCVISLDGFFMLLFPGTYGNSVLVSIVNVVWTFANNSSLWFTSCLSIFYLLKIANISHPFFFWLKLKINKVMLAILLGSFLISLIISVPKNDDMWYHLFKVSHEENITWKFKVSKIPGTFKQLTLNLGVMVPFILCLISFFLLLFSLVRHTKQIRLHATGFRDPSTEAHMRAIKAVIIFLLLLIVYYPVFLVMTSSALIPQGKLVLMIGDIVTVIFPSSHSFILIMGNSKLREAFLKMLRFVKCFLRRRKPFVP

SEQ ID NO: 747836 - protein, 246 aa, Homo sapiens
MAAAAATKILLCLPLLLLLSGWSRAGRADPHSLCYDITVIPKFRPGPRWCAVQGQVDEKTFLHYDCGNKTVTPVSPLGKKLNVTTAWKAQNPVLREVVDILTEQLRDIQLENYTPKEPLTLQARMSCEQKAEGHSSGSWQFSFDGQIFLLFDSEKRMWTTVHPGARKMKEKWENDKVVAMSFHYFSMGDCIGWLEDFLMGMDSTLEPSAGAPLAMSSGTTQLRATATTLILCCLLIILPCFILPGI

SEQ ID NO: 747837 - protein, 107 aa, Homo sapiens
LWNFSLKVILLHFYLLGFLFVTNSTPIISEDHDIIYQLLFLTHPNLDWFLPVLGVSLSPWALPTLLLCWISVFCVTSSFITLFWGSICMSKNVLTLDLIGYEILCWN

SEQ ID NO: 747838 - protein, 101 aa, Homo sapiens
RGRTPHPPRRGGPAAGTPSRNEALPGAFKFLSIPWTGDWRATHTRHFLPFRHKSIPVCVVAETQMRGSPSSFSRREEETEEETPGAESRFLLHGYDMPRML

SEQ ID NO: 747839 - protein, 103 aa, Homo sapiens [sequence omitted]

SEQ ID NO: 747840 - protein, 460 aa, Homo sapiens
RNMILLVLSVHHIRLASRPWPALRTLKQSVQGLGETCSPDGSSQDPGESWHGISVRTLRWAHEGERLPRIPAPKPRSGAHGGKSGLTVTSRWRRLRRQPSSSSSRPRSPAWSLPPAEWPAIAAGSWPPPPCSLGPAVASPEGRKGSSQELQSGALHPPTLPRDYQLLLPLAFPASAASRGHDNEEREPTPAPAPSIATEISIFRKESMAACTASGAPTGAPRSRKLLPRGLTTPWRRLERPIAETIDKRPAREDLLEETFGIRSAWISGLAEGVEVSKKCWHQGLSAGTLCPQFRGGIARGRVRVFMVAVGFMIAHFSVFRRFPISRGPSCALWFPAVTREFSTQRMEGIYTHTHPSPSPQLWNKHSKSSILVGEMGNSYLSLTFILQTTYSFSRHGTHLVLFGFFFGFVVVVSVWAWFCLFLETRSRSVAQGWSAVARSWLTEASTSRAQAILLPQPPG

SEQ ID NO: 747841 - protein, 351 aa, Homo sapiens
LRPSEKRPYSACLFLSGMKPPPRRRAAPARYLGEVTGPATWSAREKRQLVRLLQARQGQPEPDATELARELRGRSEAEIRVFLQQLKGRVAREAIQKVHPGGLQGPRRREAQPPAPIEVWTDLAEKITGPLEEALAVAFSQVLTIAATEPVTLLHSKPPKPTQARGKPLLLSAPGGQEDPAPEIPSSAPAAPSSAPRTPDPAPEKPSESSAGPSTEEDFAVDFEKIYKYLSSVSRSGRSPELSAAESAVVLDLLMSLPEELPLLPCTALVEHMTETYLRLTAPQPIPAGGSLGPAAEGDGAGSKAPEETPPATEKAEHSELKSPWQAAGICPLNPFLVPLELLGRAATPAR

SEQ ID NO: 747842 - protein, 351 aa, Homo sapiens; identical to SEQ ID NO: 747841

SEQ ID NO: 747843 - protein, 351 aa, Homo sapiens; identical to SEQ ID NO: 747841

SEQ ID NO: 747844 - protein, 312 aa, Homo sapiens
PRGNAWVRRGLNGRNELGVRCCRVRAKSNACCWTGYELEIRVFLQQLKGRVAREAIQKVHPGGLQGPRRREAQPPAPIEVWTDLAEKITGPLEEALAVAFSQVLTIAATEPVTLLHSKPPKPTQARGKPLLLSAPGGQEDPAPEIPSSAPAAPSSAPRTPDPAPEKPSESSAGPSTEEDFAVDFEKIYKYLSSVSRSGRSPELSAAESAVVLDLLMSLPEELPLLPCTALVEHMTETYLRLTAPQPIPAGGSLGPAAEGDGAGSKAPEETPPATEKAEHSELKSPWQAAGICPLNPFLVPLELLGRAATPAR

SEQ ID NO: 747845 - protein, 212 aa, Homo sapiens
MVLEGHMGQEPVTLLHSKPPKPTQARGKPLLLSAPGGQEDPAPEIPSSAPAAPSSAPRTPDPAPEKPSESSAGPSTEEDFAVDFEKIYKYLSSVSRSGRSPELSAAESAVVLDLLMSLPEELPLLPCTALVEHMTETYLRLTAPQPIPAGGSLGPAAEGDGAGSKAPEETPPATEKAEHSELKSPWQAAGICPLNPFLVPLELLGRAATPAR

SEQ ID NO: 747846 - protein, 234 aa, Homo sapiens
PRGNAWVRRGLNGRNELGVRCCRVRAKSNACCWTGYELEIRVFLQQLKGRVAREAIQKVHPGGLQGPRRREAQPPAPIEVEADEQAEKPSESSAGPSTEEDFAVDFEKIYKYLSSVSRSGRSPELSAAESAVVLDLLMSLPEELPLLPCTALVEHMTETYLRLTAPQPIPAGGSLGPAAEGDGAGSKAPEETPPATEKAEHSELKSPWQAAGICPLNPFLVPLELLGRAATPAR

SEQ ID NO: 747847 - protein, 344 aa, Homo sapiens
PRGNAWVRRGLNGRNELGVRCCRVRAKSNACCWTGYELEIRVFLQQLKGRVAREAIQKVHPGGLQGPRRREAQPPAPIEVWTDLAEKITGPLEEALAVAFSQVLTIAATEPVTLLHSKPPKPTQARGKPLLLSAPGGQEDPAPEIPSSAPAAPSSAPRTPDPAPEKPSESSAGPSTEEDFAVDFEKIYKYLSSVSRSGRSPELSAAGEKGEGGGRSRGIKGPWQQAGVSPYPSLHPSLESAVVLDLLMSLPEELPLLPCTALVEHMTETYLRLTAPQPIPAGGSLGPAAEGDGAGSKAPEETPPATEKAEHSELKSPWQAAGICPLNPFLVPLELLGRAATPAR

SEQ ID NO: 747848 - protein, 201 aa, Homo sapiens
TVADRLRPPAPGVMQLPPALCARLAAGPGAAEPLPVERDPAAGAAPFRFVARPVRFPREHQFFEDGDVQRHLYLQDVIMQVADVPEKPRVPAFACQVAGCCQVFDALDDYEHHYHTLHGNVCSFCKRAFPSGHLLDAHILEWHDSLFQILSERQDMYQCLVEGCTEKFKTSRDRKDHMPSLSRSPRGQWRAVRRGGHGNLL

SEQ ID NO: 747849 - protein, 265 aa, Homo sapiens
TVADRLRPPAPGVMQLPPALCARLAAGPGAAEPLPVERDPAAGAAPFRFVARPVRFPREHQFFEDGDVQRHLYLQDVIMQVADVPEKPRVPAFACQVAGCCQVFDALDDYEHHYHTLHGNVCSFCKRAFPSGHLLDAHILEWHDSLFQILSERQDMYQCLVEGCTEKFKTSRDRKDHMVRMHLYPADFRFDKPKKSRSPASAEAPGDSGERSEGEAMEICSEPVAASPAPAGERRIYRHRIPSTICFGQGAARGFKSNKKKTKQC

SEQ ID NO: 747850 - protein, 257 aa, Homo sapiens
TVADRLRPPAPGVMQLPPALCARLAAGPGAAEPLPVERDPAAGAAPFRFVARPVRFPREHQFFEDGDVQRHLYLQDVIMQVADVPEKPRVPAFACQVAGCCQVFDALDDYEHHYHTLHGNVCSFCKRAFPSGHLLDAHILEWHDSLFQILSERQDMYQCLVEGCTEKFKTSRDRKDHMVRMHLYPADFRFDKPKKSRSPASAEAPGDSGERSEGEAMEICSEPVAASPAPAGIPSTICFGQGAARGFKSNKKKTKQC

SEQ ID NO: 747851 - protein, 1148 aa, Homo sapiens
QHLTKETAEMLNQLHIKSSGCFLYLERVLDGVVENFIMLREIRDIPGTLNGLYLWLCQRLFVRKQFAKVQPILNVILAACRPLTITELYHAVWTKNMSLTLEDFQRKLDILSKLLVDGLGNTKILFHYSFAEWLLDVKHCTQKYLCNAAEGHRMLAMSYTCQAKNLTPLEAQEFALHLINSNLQLETAELALWMIWNGTPVRDSLSTLIPKEQEVLQLLVKAGAHVNSEDDRTSCIVRQALEREDSIRTLLDNGASVNQCDSNGRTLLANAAYSGSLDVVNLLVSRGADLEIEDAHGHTPLTLAARQGHTKVVNCLIGCGANINHTDQDGWTALRSAAWGGHTEVVSALLYAGVKVDCADADSRTALRAAAWGGHEDIVLNLLQHGAEVNKADNEGRTALIAAAYMGHREIVEHLLDHGAEVNHEDVDGRTALSVAALCVPASKGHASVVSLLIDRGAEVDHCDKDGMTPLLVAAYEGHVDVVDLLLEGGADVDHTDNNGRTPLLAAASMGHASVVNTLLFWGAAVDSIDSEGRTVLSIASAQGNVEVVRTLLDRGLDENHRDDAGWTPLHMAAFEGHRLICEALIEQGARTNEIDNDGRIPFILASQEGHYDCVQILLENKSNIDQRGYDGRNALRVAALEGHRDIVELLFSHGADVNCKDADGRPTLYILALENQLTMAEYFLENGANVEASDAEGRTALHVSCWQGHMEMVQVLIAYHADVNAADNEKRSALQSAAWQGHVKVVQLLIEHGAVVDHTCNQGATALCIAAQEGHIDVVQVLLEHGADPNHADQFGRTAMRVAAKNGHSQIIKLLEKYGASSLNGCSPSPVHTMEQKPLQSLSSKVQSLTIKSNSSGSTGGGDMQPSLRGLPNGPTHAFSSPSESPDSTVDRQKSSLSNNSLKSSKNSSLRTTSSTATAQTVPIDSFHNLSFTEQIQQHSLPRSRSRQSIVSPSSTTQSLGQSHNSPSSEFEWSQVKPSLKSTKASKGGKSENSAKSGSAGKKAKQSNSSQPKVLEYEMTQFDRRGPIAKSGTAAPPKQMPAESQCKIMIPSAQQEIGRSQQQFLIHQQSGEQKKRNGIMTNPNYHLQSNQVFLGRVSVPRTMQDRGHQEVLEGYPSSETELSLKQALKLQIEGSDPSFNYKKETPL

SEQ ID NO: 747852 - protein, 875 aa, Homo sapiens
ETSKLTTSSCHYMGADLEIEDAHGHTPLTLAARQGHTKVVNCLIGCGANINHTDQDGWTALRSAAWGGHTEVVSALLYAGVKVDCADADSRTALRAAAWGGHEDIVLNLLQHGAEVNKADNEGRTALIAAAYMGHREIVEHLLDHGAEVNHEDVDGRTALSVAALCVPASKGHASVVSLLIDRGAEVDHCDKDGMTPLLVAAYEGHVDVVDLLLEGGADVDHTDNNGRTPLLAAASMGHASVVNTLLFWGAAVDSIDSEGRTVLSIASAQGNVEVVRTLLDRGLDENHRDDAGWTPLHMAAFEGHRLICEALIEQGARTNEIDNDGRIPFILASQEGHYDCVQILLENKSNIDQRGYDGRNALRVAALEGHRDIVELLFSHGADVNCKDADGRPTLYILALENQLTMAEYFLENGANVEASDAEGRTALHVSCWQGHMEMVQVLIAYHADVNAADNEKRSALQSAAWQGHVKVVQLLIEHGAVVDHTCNQGATALCIAAQEGHIDVVQVLLEHGADPNHADQFGRTAMRVAAKNGHSQIIKLLEKYGASSLNGCSPSPVHTMEQKPLQSLSSKVQSLTIKSNSSGSTGGGDMQPSLRGLPNGPTHAFSSPSESPDSTVDRQKSSLSNNSLKSSKNSSLRTTSSTATAQTVPIDSFHNLSFTEQIQQHSLPRSRSRQSIVSPSSTTQSLGQSHNSPSSEFEWSQVKPSLKSTKASKGGKSENSAKSGSAGKKAKQSNSSQPKVLEYEMTQFDRRGPIAKSGTAAPPKQMPAESQCKIMIPSAQQEIGRSQQQFLIHQQSGEQKKRNGIMTNPNYHLQSNQVFLGRVSVPRTMQDRGHQEVLEGYPSSETELSLKQALKLQIEGSDPSFNYKKETPL

SEQ ID NO: 747853 - protein, 1148 aa, Homo sapiens; identical to SEQ ID NO: 747851

SEQ ID NO: 747854 - protein, 1148 aa, Homo sapiens; identical to SEQ ID NO: 747851

SEQ ID NO: 747855 - protein, 187 aa, Homo sapiens
KAYRTLSSAEMQPYDSQPSLKSTKASKGGKSENSAKSGSAGKKAKQSNSSQPKVLEYEMTQFDRRGPIAKSGTAAPPKQMPAESQCKIMIPSAQQEIGRSQQQFLIHQQSGEQKKRNGIMTNPNYHLQSNQVFLGRVSVPRTMQDRGHQEVLEGYPSSETELSLKQALKLQIEGSDPSFNYKKETPL

SEQ ID NO: 747856 - protein, 173 aa, Homo sapiens
VEGVLPCRCPGDRVPFTNHGALLRLLGDGVQGETKLLAAGGMRERAGPWAGEQSRPQAAPGHPGQPMHVGMPEYPLQTACAWTRHTRVCMCTATPPTPCSKNESGAASAGGATTTSAPKPGPQILSTLTEQLGSENTKGCRPRPARRATRPPSLSLTLCLMGPDSQQKLRGLG

SEQ ID NO: 747857 - protein, 96 aa, Homo sapiens
VEGVLPCRCPGDRVPFTNHGALLRLLGDGVQGETKLLAAGGMRERAGPWAGEQSRPQAAPGHPGQPMHVGMPEYPLPGERYTYIPLCVWSTHTLSG

SEQ ID NO: 747858 - protein, 79 aa, Homo sapiens
AIFTPSPLVLEIRHPDPVQLDLAQEDHAVSGKHWRRKRLKKGRPEKKYKSFRLGKDDSTVPFSVPVLLYWISSGLTMTT

SEQ ID NO: 747859 - protein, 129 aa, Homo sapiens
DHSSLLSQLPRLKQDSRLSLLNNWDHRHAPPHPTQFLRFFMEMGSHYVVKSSLELLGSSDPPQLPKVPALQARSSTPSLSFLFYSIYHFQIYFVIYLNMIYLFTMLLFSSSSAQNTIWHIVDNLYMFVK

SEQ ID NO: 747860 - protein, 318 aa, Homo sapiens
MQRANHSTVTQFILVGFSVFPHLQLMLFLLFLLMYLFTLLGNLLIMATVWSERSLHTPMYLFLCALSVSEILYTVAIIPRMLADLLSTQRSIAFLACASQMFFSFSFGFTHSFLLTVMGYDRYVAICHPLRYNVLMSPRGCACLVGCSWAGGLVMGMVVTSAIFHLAFCGHKEIHHFACHVPPLLKLACGDDVLVVAKGVGLVCITALLGCFLLILLSYAFIVAAILKIPSAEGRNKAFSTCASHLTVVVVHYGFASVIYLKPKSPQSLEGDTLMGITYTVLTPFLSPIIFSLRNKELKVAMKKTFFSKLYPEKNVMM

SEQ ID NO: 747861 - protein, 119 aa, Homo sapiens
MPFQCSVRGQRWGPRVQIEWDSCHCPACELKSVQSASGSDKEGSAGTASCFRRGDEVQAEVETTLHSPCIQWCPISCSLGSIPATCVMQLVPPIPRDSTLALLALAPSTEPLGPFSWPA

SEQ ID NO: 747862 - protein, 119 aa, Homo sapiens; identical to SEQ ID NO: 747861

SEQ ID NO: 747863 - protein, 320 aa, Homo sapiens
MDQSNYSSLHGFILLGFSNHPKMEMILSGVVAIFYLITLVGNTAIILASLLDSQLHTPMYFFLRNLSFLDLCFTTSIIPQMLVNLWGPDKTISYVGCIIQLYVYMWLGSVECLLLAVMSYDRFTAICKPLHYFVVMNPHLCLKMIIMIWSISLANSVVLCTLTLNLPTCGNNILDHFLCELPALVKIACVDTTTVEMSVFALGIIIVLTPLILILISYGYIAKAVLRTKSKASQRKAMNTCGSHLTVVSMFYGTIIYMYLQPGNRASKDQGKFLTLFYTVITPSLNPLIYTLRNKDMKDALKKLMRFHHKSTKIKRNCKS

SEQ ID NO: 747864 - protein, 104 aa, Homo sapiens
AAAEHFARSPASSPEFAESPGTSKGCAPRIGPEAGSPGRPGRAARREMAEKALLCPSSAGLGTWPWVLNSAWPVLPLAVDQGVDWRPRGPGVWANRLWRATDRL

SEQ ID NO: 747865 - protein, 233 aa, Homo sapiens
AAAEHFARSPASSPEFAESPGTSKGCAPRIGPEAGSPGRPGRAARREMAEKALLCPSSAGLGTWPWVLNSAWPVLPLAVDQGVDWRPRGPVSSDQIEQLHRRFKQLSGDQPTIRKENFNNVPDLELNPIRSKIVRAFFDNRNLRKGPSGLADEINFEDFLTIMSYFRPIDTTMDEEQVELSRKEKLRFLFHMYDSDSDGRITLEEYRNKWSRSCCRETLTSRRSPLAPSPTGP

SEQ ID NO: 747866 - protein, 157 aa, Homo sapiens
YLMMVRELEVLVTRFSSDQIEQLHRRFKQLSGDQPTIRKENFNNVPDLELNPIRSKIVRAFFDNRNLRKGPSGLADEINFEDFLTIMSYFRPIDTTMDEEQVELSRKEKLRFLFHMYDSDSDGRITLEEYRNKWSRSCCRETLTSRRSPLAPSPTGP

SEQ ID NO: 747867 - protein, 215 aa, Homo sapiens
MRPRSGPTRNPRLRAFAGVPTRGRTRGQSRRCAAEASAGPERDARPGAPAAGTMGAAHSASEEVRELEGKTGFSSDQIEQLHRRFKQLSGDQPTIRKENFNNVPDLELNPIRSKIVRAFFDNRNLRKGPSGLADEINFEDFLTIMSYFRPIDTTMDEEQVELSRKEKLRFLFHMYDSDSDGRITLEEYRNKWSRSCCRETLTSRRSPLAPSPTGP

SEQ ID NO: 747868 - protein, 188 aa, Homo sapiens
MRPRSGPTRNPRLRAFAGVPTRGRTRGQSRRCAAEASAGPERDARPGAPAAGTMGAAHSASEEVRELEGKTGFSSDQIEQLHRRFKQLSGDQPTIRKENFNNVPDLELNPIRSKIVRAFFDNRNLRKGPSGLADEINFEDFLTIMSYFRPIDTTMDEEQVELSRKEKLRSCGFLGLEGGCAVDVKQGP

SEQ ID NO: 747869 - protein, 175 aa, Homo sapiens
AAAEHFARSPASSPEFAESPGTSKGCAPRIGPEAGSPGRPGRAARREMAEKALLCPSSAGLGTWPWVLNSAWPVLPLAVDQGVDWRPRGPVSSDQIEQLHRRFKQLSGDQPTIRKENFNNVPDLELNPIRSKIVRAFFDNRYIAKARLRTLCLVGYGMWDFAVFISNKKKKRFVN

SEQ ID NO: 747870 - protein, 109 aa, Homo sapiens
MPIMRGSEGWVRSHSQPLAHRKRSLKSVSSSPSSMGCAIAGFLRPAPLCSGSRVGSVVVPAGQPHRSQAVPRVTSPFPVAFPMTPDIPLCPAPGQPPHQENVNMGLRYI

SEQ ID NO: 747871 - protein, 215 aa, Homo sapiens; identical to SEQ ID NO: 747867

SEQ ID NO: 747872 - protein, 114 aa, Homo sapiens
KTEWNPVPSPPFKSWFSEKGLRNLRKGPSGLADEINFEDFLTIMSYFRPIDTTMDEEQVELSRKEKLRFLFHMYDSDSDGRITLEEYRNKWSRSCCRETLTSRRSPLAPSPTGP

SEQ ID NO: 747873 - protein, 215 aa, Homo sapiens; identical to SEQ ID NO: 747867

SEQ ID NO: 747874 - protein, 31 aa, Homo sapiens
MAPFIEKKYLAHQRGAANLILIAKNIFYSPG

SEQ ID NO: 747875 - protein, 419 aa, Homo sapiens
MAASSLEQKLSRLEAKLKQENREARRRIDLNLDISPQRPRPTLQLPLANDGGSRSPSSESSPQHPTPPARPRHMLGLPSTLFTPRSMESIEIDQKLQEIMKQTGYLTIGGQRYQAEINDLENLGEMGSGTCGQVWKMRFRKTGHVIAVKQMRRSGNKEENKRILMDLDVVLKSHDCPYIVQCFGTFITNTDVFIAMELMGTCAEKLKKRMQGPIPERILGKMTVAIVKALYYLKEKHGVIHRDVKPSNILLDERGQIKLCDFGISGRLVDSKAKTRSAGCAAYMAPERIDPPDPTKPDYDIRADVWSLGISLVELATGQFPYKNCKTDFEVLTKVLQEEPPLLPGHMGFSGDFQSFVKDCLTKDHRKRPKYNKLLEHSFIKRYETLEVDVASWFKDVMAKTESPRTSGVLSQPHLPFFR

SEQ ID NO: 747876 - protein, 97 aa, Homo sapiens
RRRRCLSAGLTGGRAVRGGGGGGEDGGVLPGTEAVPPGSKAEAGEPGGPAEDRPQPGYQPPAAQAQDCLAPPSPGLGACQPRAATIYAHAHAWLGDT

SEQ ID NO: 747877 - protein, 352 aa, Homo sapiens
MAASSLEQKLSRLEAKLKQENREARRRIDLNLDISPQRPRPTLQLPLANDGGSRSPSSESSPQHPTPPARPRHMLGLPSTLFTPRSMESIEIDQKLQEIMKQTGYLTIGGQRYQAEINDLENLGEMGSGTCGQVWKMRFRKTGHVIAVKQMRRSGNKEENKRILMDLDVVLKSHDCPYIVQCFGTFITNTDVFIAMELMGTCAEKLKKRMQGPIPERILGKMTVAIVKALYYLKEKHGVIHRDVKPSNILLDERGQIKLCDFGISGRLVDSKAKTRSAGCAAYMAVSGGPPAGEGVGAGRPAPALEIRLLLPPLQPERIDPPDPTKPDYDIRADVWSLGISLVELGPPLFSS

SEQ ID NO: 747878 - protein, 346 aa, Homo sapiens
MLPLWATLFTPLSTESIEIDQKLQEIMKQTGYLTIGGQRYQAEINDLENLGEMGSGTCGQVWKMRFRKTGHVIAVKQMRRSGNKEENKRILMDLDVVLKSHDCPYIVQCFGTFITNTDVFIAMELMGTCAEKLKKRMQGPIPERILGKMTVAIVKALYYLKEKHGVIHRDVKPSNILLDERGQIKLCDFGISGRLVDSKAKTRSAGCAAYMAPERIDPPDPTKPDYDIRADVWSLGISLVELATGQFPYKNCKTDFEVLTKVLQEEPPLLPGHMGFSGDFQSFVKDCLTKDHRKRPKYNKLLEHSFIKRYETLEVDVASWFKDVMAKTESPRTSGVLSQPHLPFFR

SEQ ID NO: 747879 - protein, 445 aa, Homo sapiens
MAASSLEQKLSRLEAKLKQENREARRRIDLNLDISPQRPRPTLQLPLANDGGSRSPSSESSPQHPTPPARPRHMLGLPSTLFTPRSMESIEIDQKLQEIMKQTGYLTIGGQRYQAEINDLENLGEMGSGTCGQVWKMRFRKTGHVIAVKVSLGGYPGCAPHPRPVLRLPPVPACAQMRRSGNKEENKRILMDLDVVLKSHDCPYIVQCFGTFITNTDVFIAMELMGTCAEKLKKRMQGPIPERILGKMTVAIVKALYYLKEKHGVIHRDVKPSNILLDERGQIKLCDFGISGRLVDSKAKTRSAGCAAYMAPERIDPPDPTKPDYDIRADVWSLGISLVELATGQFPYKNCKTDFEVLTKVLQEEPPLLPGHMGFSGDFQSFVKDCLTKDHRKRPKYNKLLEHSFIKRYETLEVDVASWFKDVMAKTESPRTSGVLSQPHLPFFR

SEQ ID NO: 747880 - protein, 84 aa, Homo sapiens
MLPLSSSQGLSGAPLPRPGGLSAPCSDDLRTRARLARGHLRLLDHIEPLPISSDPRILPLALPVTVSEVGGREGVPSPPLGDSD

SEQ ID NO: 747881 - protein, 462 aa, Homo sapiens
MAASSLEQKLSRLEAKLKQENREARRRIDLNLDISPQRPRPTLQLPLANDGGSRSPSSESSPQHPTPPARPRHMLGLPSTLFTPRSMESIEIDQKLQEIMKQTGYLTIGGQVPPSLWRGEGGGPARLDPSWERQWGAGGGGRAPGTLQPSLSSQRYQAEINDLENLGEMGSGTCGQVWKMRFRKTGHVIAVKQMRRSGNKEENKRILMDLDVVLKSHDCPYIVQCFGTFITNTDVFIAMELMGTCAEKLKKRMQGPIPERILGKMTVAIVKALYYLKEKHGVIHRDVKPSNILLDERGQIKLCDFGISGRLVDSKAKTRSAGCAAYMAPERIDPPDPTKPDYDIRADVWSLGISLVELATGQFPYKNCKTDFEVLTKVLQEEPPLLPGHMGFSGDFQSFVKDCLTKDHRKRPKYNKLLEHSFIKRYETLEVDVASWFKDVMAKTESPRTSGVLSQPHLPFFR

SEQ ID NO: 747882 - protein, 308 aa, Homo sapiens
MAASSLEQKLSRLEAKLKQENREARRRIDLNLDISPQRPRPTLQLPLANDGGSRSPSSESSPQHPTPPARPRHMLGLPSTLFTPRSMESIEIDQKLQEIMKQTGYLTIGGQRYQAEINDLENLGEMGSGTCGQVWKMRFRKTGHVIAVKQMRRSGNKEENKRILMDLDVVLKSHDCPYIVQCFGTFITNTDVFIAMELMGTCAEKLKKRMQGPIPERILGKMTVAIVKALYYLKEKHGVIHRDVKPSNILLDERGQIKLCDFGISGRLVDSKAKTRSAGCAAYMAVSGGPPAGEGVGSYCGSILFGKT

SEQ ID NO: 747883 - protein, 322 aa, Homo sapiens
MAASSLEQKLSRLEAKLKQENREARRRIDLNLDISPQRPRPTLQLPLANDGGSRSPSSESSPQHPTPPARPRHMLGLPSTLFTPRSMESIEIDQKLQEIMKQTGYLTIGGQRYQAEINDLENLGEMGSGTCGQVWKMRFRKTGHVIAVKQMRRSGNKEENKRILMDLDVVLKSHDCPYIVQCFGTFITNTDVFIAMELMGTCAEKLKKRMQGPIPERILGKMTVAIVKALYYLKEKHGVIHRDVKPSNILLDERGQIKLCDFGISGRLVDSKAKTRSAGCAAYMAPERIDPPDPTKPDYDIRADVWSLGISLVELGPPLFSS

SEQ ID NO: 747884 - protein, 486 aa, Homo sapiens
MAASSLEQKLSRLEAKLKQENREARRRIDLNLDISPQRPRPTLQLPLANDGGSRSPSSESSPQHPTPPARPRHMLGLPSTLFTPRSMESIEIDQKLQEIMKQTGYLTIGGQRYQAEINDLENLGEMGSGTCGQVWKMRFRKTGHVIAVKVSLGGYPGCAPHPRPVLRLPPVPACAANAALREQGGEQAHPHGPGCGAEEPRLPLHRAVLWDVHHQREYLAAPCSVSSSLTPAPSREQSLWGVGRKTQLPRVPLSLQTDVFIAMELMGTCAEKLKKRMQGPIPERILGKMTVAIVKALYYLKEKHGVIHRDVKPSNILLDERGQIKLCDFGISGRLVDSKAKTRSAGCAAYMAPERIDPPDPTKPDYDIRADVWSLGISLVELATGQFPYKNCKTDFEVLTKVLQEEPPLLPGHMGFSGDFQSFVKDCLTKDHRKRPKYNKLLEHSFIKRYETLEVDVASWFKDVMAKTESPRTSGVLSQPHLPFFR

SEQ ID NO: 747885 - protein, 39 aa, Homo sapiens
RNELELDLKSSGNRHGYDWVTLSIVASQLALYPQQSNQV

SEQ ID NO: 747886 - protein, 252 aa, Homo sapiens
FHVILNKTKHTCIHTHSLTLKMQDEERYMTLNVQSKKRSSAQTSQLTFKDYSVTLHWYKILLGISGTVNGILTLTLISLILLVSQGVLLKCQKGSCSNATQYEDTGDLKVNNGTRRNISNKDLCASRSADQTVLCQSEWLKYQGKCYWFSNEMKSWSDSYVYCLERKSHLLIIHDQLEMAFIQKNLRQLNYVWIGLNFTSLKMTWTWVDGSPIDSKIFFIKGPAKENSCAAIKESKIFSETCSSVFKWICQY

SEQ ID NO: 747887 - protein, 202 aa, Homo sapiens
FHVILNKTKHTCIHTHSLTLKMQDEERYMTLNVQSKKRSSAQTSQLTFKDYSVTLHWYKILLGISGTVNGILTLTLISLILLVLCQSEWLKYQGKCYWFSNEMKSWSDSYVYCLERKSHLLIIHDQLEMAFIQKNLRQLNYVWIGLNFTSLKMTWTWVDGSPIDSKIFFIKGPAKENSCAAIKESKIFSETCSSVFKWICQY

SEQ ID NO: 747888 - protein, 64 aa, Homo sapiens
MQDEERYMTLNVQSKKRSSAQTSQLTFKDYSVTLHWYKILLGISGTVNGILTLTLISLILLDSS

SEQ ID NO: 747889 - protein, 202 aa, Homo sapiens
FHVILNKTKHTCIHTHSLTLKMQDEERYMTLNVQSKKRSSAQTSQLTFKDYSVTLHWYKILLGISGTVNGILTLTLISLILLVSQGVLLKCQKGSCSNATQYEDTGDLKVNNGTRRNISNKDLCASRSADQTVLCQSEWLKYQGKCYWFSNEMKSWSDSYVYCLERKSHLLIIHDQLEMSLVHILGFYTEKPKTIKLRMDWA

SEQ ID NO: 747890 - protein, 78 aa, Homo sapiens
MQDEERYMTLNVQSKKRSSAQTSQLTFKDYSVTLHWYKILLGISGTVNGILTLTLISLILLGFYTEKPKTIKLRMDWA

SEQ ID NO: 747891 - protein, 108 aa, Homo sapiens
MAALKEDRSYGLSCGRVSDGSKVSVFHVKLTDSALRAFESYLRQTGLGSVFLNSLKQKVVTLASSADVLSTVQSASQAMLQSGWSMLLPTAEKQARALCSPVLQSFRQ

SEQ ID NO: 747892 - protein, 406 aa, Homo sapiens
MAPPGPASALSTSAEPLSRSIFRKFLLMLCSLLTSLYVFYCLAERCQTLSGPVVGLSGGGEEAGAPGGGVLAGGPRELAVWPAAAQRKRLLQLPQWRRRRPPAPRDDGEEAAWEEESPGLSGGPGGSGAGSTVAEAPPGTLALLLDEGSKQLPQAIIIGVKKGGTRALLEFLRVHPDVRAVGAEPHFFDRSYDKGLAWYRDLMPRTLDGQITMEKTPSYFVTREAPARISAMSKDTKLIVVVRDPVTRAISDYTQTLSKRPDIPTFESLTFKNRTAGLIDTSWSAIQIGIYAKHLEHWLRHFPIRQMLFVSGERLISDPAGELGRVQDFLGLKRIITDKHFYFNKTKGFPCLKKAEGSSRPHCLGKTKGRTHPEIDREVVRRLREFYRPFNLKFYQMTGHDFGWDG

SEQ ID NO: 747893 - protein, 406 aa, Homo sapiens; identical to SEQ ID NO: 747892

SEQ ID NO: 747894 - protein, 405 aa, Homo sapiens [sequence omitted]

SEQ ID NO: 747895 - protein, 340 aa, Homo sapiens
MAPPGPASALSTSAEPLSRSIFRKFLLMLCSLLTSLYVFYCLAERCQTLSGPVVGLSGGGEEAGAPGGGVLAGGPRELAVWPAAAQRKRLLQLPQWRRRRPPAPRDDGEEAAWEEESPGLSGGPGGSGAGSTVAEAPPGTLALLLDEGSKQLPQAIIIGVKKGGTRALLEFLRVHPDVRAVGAEPHFFDRSYDKGLAWYRDLMPRTLDGQITMEKTPSYFVTREAPARISAMSKDTKLIVVVRDPVTRAISDYTQTLSKRPDIPTFESLTFKNRTAGLIDTSWSAIQIGIYAKHLEHWLRHFPIRQMLFVSGERLISDPAGELAEPTLPGLSLLIIGSDP

SEQ ID NO: 747896 - protein, 149 aa, Homo sapiens
CLFAFLRDLMPRTLDGQITMEKTPSYFVTREAPARISAMSKDTKLIVVVRDPVTRAISDYTQTLSKRPDIPTFESLTFKNRTAGLIDTSWSAIQIGIYAKHLEHWLRHFPIRQMLFVSGERLISDPAGELGRVQDFLGLKRIITDKHFY

SEQ ID NO: 747897 - protein, 346 aa, Homo sapiens
MDTGPDQSYFSGNHWFVFSVYLLTFLVGLPLNLLALVVFVGKLQRRPVAVDVLLLNLTASDLLLLLFLPFRMVEAANGMHWPLPFILCPLSGFIFFTTIYLTALFLAAVSIERFLSVAHPLWYKTRPRLGQAGLVSVACWLLASAHCSVVYVIEFSGDISHSQGTNGTCYLEFRKDQLAILLPVRLEMAVVLFVVPLIITSYCYSRLVWILGRGGSHRRQRRVAGLLAATLLNFLVCFGPYNVSHVVGYICGESPAWRIYVTLLSTLNSCVDPFVYYFSSSGFQADFHELLRRLCGLWGQWQQESSMELKEQKGGEEQRADRPAERKTSEHSQGCGTGGQVACAES

SEQ ID NO: 747898 - protein, 130 aa, Homo sapiens
MSGRGKQGGKARAKAKTRSSRAGLQFPVGRVHRLLRKGNYSERVGAGAPVYLAAVLEYLTAEILELAGNAARDNKKTRIIPRHLQLAIRNDEELNKLLGRVTIAQGGVLPNIQAVLLPKKTESHHKAKGK

SEQ ID NO: 747899 - protein, 266 aa, Homo sapiens
SDPILSSFLLWGWGNSQAGAPAAQLNLATRSPLSSPRPSLLIALYSFAPVERMTPQPSGAPTVQVTRETERSFPRASEDEVTCPTSAPPSPTRTRGNCAEAEEGGCRGAPRKLRARRGGRSRPKSELALSKQRRSRRKKANDRERNRMHNLNSALDALRGVLPTFPDDAKLTKIETLRFAHNYIWALTQTLRIADHSLYALEPPAPHCGELGSPGGSPGDWGSLYSPVSQAGSLSPAASLEERPGLLGATFSACLSPGSLAFSDFL

SEQ ID NO: 747900 - protein, 109 aa, Homo sapiens
MGHSQAITPGPPSQAGGGWQPRGRQGLGGRVGSKAKAALWPPVSQDDLSPGLAPEQVGSLLGPVDLFSCFVSVDVESPKCFPSPATLVRLNPQSQSPLQISVGLGLNFR

SEQ ID NO: 747901 - protein, 728 aa, Homo sapiens
MEETQPPPQPKLPLCDSLMIWLQTFNTASPCQDVKQLTSGVAMAQVLHQIDAAWFNESWLSRIKEDVGDNWRIKASNVKKVLQGIMSYYHEFLGQQISEALIPDLNQITECSDPVELGRLLQLILGCAINCEKKQEHIQNIMTLEESVQHVVMTAIQELMSKEILSSPPNDAVGELEQQLKRALEELQEALAEKEELRQRCEELDMQVTTLQDEKNSLVSENEMMNEKLDQLDGSFDDPNTVVAKKYFHAQLQLEQLQEENFRLEAAKDDYRVHCEELEKQLIEFQHRNDELTSLAEETRALKDEIDVLRATSDKANKLESTVEIYRQKLQDLNDLRKQVKTLQETNMMYMHNTVSLEEELKKANAARTQLETYKRQVQDLHVKLSSESKRADTLAFEMKRLEEKHEALLKEKERLIEQRDTLKETNEELRCSQVQQDHLNQTDASATKSYENLAAEIMPVEYREVFIRLQHENKMLRLQQEGSENERIEELQEQLEQKHRKMNELETEQRLSKERIRELQQQIEDLQKSLQEQGSKSEGESSSKLKQKLEAHMEKLTEVHEELQKKQELIEDLQPDINQNVQKINELEAALQKKDEDMKAMEERYKMYLEKARNVIKTLDPKLNPASAEIMLLRKQLAEKERRIEILESECKVAKFRDYEEKLIVSAWYNKSLAFQKLGMESRLVSGGGACSDTGACTPARSFLAQQRHITNTRRNLSVKVPATTSD

SEQ ID NO: 747902 - protein, 554 aa, Homo sapiens
MEETQPPPQPKLPLCDSLMIWLQTFNTASPCQDVKQLTSGVAMAQVLHQIDAAWFNESWLSRIKEDVGDNWRIKASNVKKVLQGIMSYYHEFLGQQISEALIPDLNQITECSDPVELGRLLQLILGCAINCEKKQEHIQNIMTLEESVQHVVMTAIQELMSKEILSSPPNDAVGELEQQLKRALEELQEALAEKEELRQRCEELDMQVTTLQDEKNSLVSENEMMNEKLDQLDGSFDDPNTVVAKKYFHAQLQLEQLQEENFRLEAAKDDYRVHCEELEKQLIEFQHRNDELTSLAEETRALKDEIDVLRATSDKANKLESTVEIYRQKLQDLNDLRKQVKTLQETNMMYMHNTVSLEEELKKANAARTQLETYKRQVQDLHVKLSSESKRADTLAFEMKRLEEKHEALLKEKERLIEQRDTLKETNEELRCSQVQQDHLNQTDASATKSYENLAAEIMPVEYREVFIRLQHENKMLRLQQEGSENERIEELQEQLEQKHRKMNELETEQRLSKERIRELQQQIEDLQKSLQEQGSKSEGESSSKLKQKLEAHM

SEQ ID NO: 747903 - protein, 562 aa, Homo sapiens
MEETQPPPQPKLPLCDSLMIWLQTFNTASPCQDVKQLTSGVAMAQVLHQIIFFVVVFSDAAWFNESWLSRIKEDVGDNWRIKASNVKKVLQGIMSYYHEFLGQQISEALIPDLNQITECSDPVELGRLLQLILGCAINCEKKQEHIQNIMTLEESVQHVVMTAIQELMSKEILSSPPNDAVGELEQQLKRALEELQEALAEKEELRQRCEELDMQVTTLQDEKNSLVSENEMMNEKLDQLDGSFDDPNTVVAKKYFHAQLQLEQLQEENFRLEAAKDDYRVHCEELEKQLIEFQHRNDELTSLAEETRALKDEIDVLRATSDKANKLESTVEIYRQKLQDLNDLRKQVKTLQETNMMYMHNTVSLEEELKKANAARTQLETYKRQVQDLHVKLSSESKRADTLAFEMKRLEEKHEALLKEKERLIEQRDTLKETNEELRCSQVQQDHLNQTDASATKSYENLAAEIMPVEYREVFIRLQHENKMLRLQQEGSENERIEELQEQLEQKHRKMNELETEQRLSKERIRELQQQIEDLQKSLQEQGSKSEGESSSKLKQKLEAHM

SEQ ID NO: 747904 - protein, 511 aa, Homo sapiens
MEETQPPPQPKLPLCDSLMIWLQTFNTASPCQDVKQLTSGVAMAQVLHQIDAAWFNESWLSRIKEDVGDNWRIKASNVKKVLQGIMSYYHEFLGQQISEALIPDLNQITECSDPVELGRLLQLILGCAINCEKKQEHIQNIMTLEESVQHVVMTAIQELMSKEILSSPPNDAVGELEQQLKRALEELQEALAEKEELRQRCEELDMQVTTLQDEKNSLVSENEMMNEKLDQLDGSFDDPNTVVAKKYFHAQLQLEQLQEENFRLEAAKDDYRVHCEELEKQLIEFQHRNDELTSLAEETRALKDEIDVLRATSDKANKLESTVEIYRQKLQDLNDLRKQVKTLQETNMMYMHNTVSLEEELKKANAARTQLETYKRQVQDLHVKLSSESKRADTLAFEMKRLEEKHEALLKEKERLIEQRDTLKETNEELRCSQVQQDHLNQTDASATKSYENLAAEIMPVEYREVFIRLQHENKMLRLQQEGSENERIEELQEQLEQKHRKMNELETEQR

SEQ ID NO: 747905 - protein, 559 aa, Homo sapiens
MEETQPPPQPKLPLCDSLMIWLQTFNTASPCQDVKQLTSGVAMAQVLHQIDAAWFNESWLSRIKEDVGDNWRIKASNVKKVLQGIMSYYHEFLGQQISEALIPDLNQITECSDPVELGRLLQLILGCAINCEKKQEHIQNIMTLEESVQHVVMTAIQELMSKEILSSPPNDAVGELEQQLKRALEELQEALAEKEELRQRCEELDMQVTTLQDEKNSLVSENEMMNEKLDQLDGSFDDPNTVVAKKYFHAQLQLEQLQEENFRLEAAKDDYRVHCEELEKQLIEFQHRNDELTSLAEETRALKDEIDVLRATSDKANKLESTVEIYRQKLQDLNDLRKQVKTLQETNMMYMHNTVSLEEELKKANAARTQLETYKRQVQDLHVKLSSESKRADTLAFEMKRLEEKHEALLKEKERLIEQRDTLKETNEELRCSQVQQDHLNQTDASATKSYENLAAEIMPVEYREVFIRLQHENKMLRLQQEGSENERIEELQEQLEQKHRKMNELETEQRLSKERIRELQQQIEDLQKSLQEQGSKSEGESKSSHAWRHLICAYIRYC

SEQ ID NO: 747906 - protein, 46 aa, Homo sapiens
VKLSSESKRADTLAFEMKRLEEKHEALLKEKEVNIDIIDKEYFIVL

SEQ ID NO: 747907 - protein, 334 aa, Homo sapiens
MNEDLKVNLSGLPRDYLDAAAAENISAAVSSRVPAVEPEPELVVNPWDIVLCTSGTLISCENAIVVLIIFHNPSLRAPMFLLIGSLALADLLAGIGLITNFVFAYLLQSEATKLVTIGLIVASFSASVCSLLAITVDRYLSLYYALTYHSERTVTFTYVMLVMLWGTSICLGLLPVMGWNCLRDESTCSVVRPLTKNNAAILSVSFLFMFALMLQLYIQICKIVMRHAHQIALQHHFLATSHYVTTRKGVSTLAIILGTFAACWMPFTLYSLIADYTYPSIYTYATLLPATYNSIINPVIYAFRNQEIQKALCLICCGCIPSSLAQRARSPSDV

SEQ ID NO: 747908 - protein, 409 aa, Homo sapiens
MKVFCEVLEELYKKVLLGATLENDSHDYIFYLNPAVSDQDCSTATSLEWANTCGIQGRHQPISVGVAPIAVAPVCLKTNSQMSGSREVMLLQLTVIKVMTTRILSVKTEFHAKEQYRDVIKILLESAKVDSKLICMFQNSDKLLSHMAAQCLALLLYFQLREKITLSNSWIAFCQKNLSEYSESNKAIYCLWTLTAIIKEIFKDSCSQKTEILKQFLTHFDTIFEVFYNSLFSQHFENCRDTSKIVNILMCFLDLLELLIASRIHLKLHFTCQRILFLKPSCMLEVITWPIQAFVKRKVIIFLKKCLLCKVGEDLCRGSVPALMPPDHHVAVDMLALANAVLQAVNSGLLKTLSVYEKHSFFGGDEVQPECELITSPDHVILRAASLVIMKSLEIKFQNYSSASEMKGA

SEQ ID NO: 747909 - protein, 409 aa, Homo sapiens; identical to SEQ ID NO: 747908

SEQ ID NO: 747910 - protein, 270 aa, Homo sapiens
MKVFCEVLEELYKKVLLGATLENDSHDYIFYLNPAVSDQDCSTATSLEWANTCGIQGRHQPISVGVAPIAVAPVCLKTNSQMSGSREVMLLQLTVIKVMTTRILSVKTEFHAKEQYRDVIKILLESAKVDSKLICMFQNSDKLLSHMAAQCLALLLYFQLREKITLSNSWIAFCQKNLSEYSESNKAIYCLWTLTAIIKEIFKDSCSQKTEILKQFLTHFDTIFEVFYNSLFSQHFENCRDTSKIVNILMCFLDLLELLIASRIHLKLTI

SEQ ID NO: 747911 - protein, 409 aa, Homo sapiens; identical to SEQ ID NO: 747908

SEQ ID NO: 747912 - protein, 436 aa, Homo sapiens [sequence omitted]

SEQ ID NO: 747913 - protein, 409 aa, Homo sapiens; identical to SEQ ID NO: 747908

SEQ ID NO: 747914 - protein, 577 aa, Homo sapiens
MKVFCEVLEELYKKVLLGATLENDSHDYIFYLNPAVSDQDCSTATSLEWANTCGIQGRHQPISVGVAPIAVAPVCLKTNSQMSGSREVMLLQLTVIKVMTTRILSVKTEFHAKEQYRDVIKILLESAKVDSKLICMFQNSDKLLSHMAAQCLALLLYFQLREKITLSNSWIAFCQKNLSEYSESNKAIYCLWTLTAIIKEIFKDSCSQKTEILKQFLTHFDTIFEVFYNSLFSQHFENCRDTSKIVNILMCFLDLLELLIASRIHLKLHFTCQRILFLKPSCMLEVITWPIQAFVKRKVIIFLKKCLLCKVGEDLCRGSVPALMPPDHHVAVDMLALANAVLQAVNSGLLKTLSVYEKHSFFGGDEVQPECELITSPDHVILRAASLVIMKSLEIKFQNYSSASEMKVDLQRFMSELLTFLKPHLQPSLQLHNPCKWLSRVFIEQDDDMLEAAKASLGIYLTLTRGCEATESLTQGKEMWDHHTHENGYNPHCIFLFFLKNIGFDSTVLLDFLISSETCFLEYFVRYLKLLQKDWDNFFTICNNFDATESKYDISICGLCPLTCPRTKAPTKQYPIV

SEQ ID NO: 747915 - protein, 195 aa, Homo sapiens
MGQIEWAMWANEQALASGLILITGGIVATAGRFTQWYFGAYSIVAGVFVCLLEYPRGKRKKGSTMERWGQKHMTAVVKLFGPFTRNYYVRAVLHLLLSVPAGFLLATILGTACLAIASGIYLLAAVRGEQWTPIEPKPRERPQIGGTIKQPPSNPPPRPPAEARKKPSEEEAAAAAGGPPGGPQVNPIPVTDEVV

SEQ ID NO: 747916 - protein, 195 aa, Homo sapiens; identical to SEQ ID NO: 747915

SEQ ID NO: 747917 - protein, 195 aa, Homo sapiens; identical to SEQ ID NO: 747915

SEQ ID NO: 747918 - protein, 195 aa, Homo sapiens; identical to SEQ ID NO: 747915

SEQ ID NO: 747919 - protein, 195 aa, Homo sapiens; identical to SEQ ID NO: 747915

SEQ ID NO: 747920 - protein, 208 aa, Homo sapiens
SQINRTSSRVRVAMGQIEWAMWANEQALASGLILITGGIVATAGRFTQWYFGAYSIVAGVFVCLLEYPRGKRKKGSTMERWGQKHMTAVVKLFGPFTRNYYVRAVLHLLLSVPAGFLLATILGTACLAIASGIYLLAAVRGEQWTPIEPKPRERPQIGGTIKQPPSNPPPRPPAEARKKPSEEEAAAAAGGPPGGPQVNPIPVTDEVV

SEQ ID NO: 747921 - protein, 128 aa, Homo sapiens [sequence omitted]

SEQ ID NO: 747922 - protein, 210 aa, Homo sapiens
MGQIEWAMWANEQALASGLILITGGIVATAGRFTQWYFGAYSIVAGVFVCLLEYPRGKRKKGSTMERWGQKHMTAVVKLFGPFTRNYYVRAVLHLLLSVPAGFLLATILGTACLAIASGIYLLSQVPPARRGNCPPLAVRLLVCVRGKGAALSVYAFRVWKWSSVSSLTDLPPAELSFRTPSCCQVLIWAVALFSGGHPHPPRLPAATHS

SEQ ID NO: 747923 - protein, 362 aa, Homo sapiens
MGQIEWAMWANEQALASGLSECTSGTVEAAAWRGVPRPQPGPRATYRVGKWGARRARPGRGQARRVRGTGAGPSGRGLEGGVLRPPVIPLQTLRSAAPLPHSLLSVPRLREGGSCSAGEEAVQPRWFPGSPPRSPRVGAPAWASGEAPLPLGSQLAWRSLSLGLGWGMGSCPGAQPFSSGVCAGGGLRFHKAPKPPSDGPAQPSCTGTLLLGWDGTAPITLLCICSEVLVRAADSIWKWTLSGPGPGSVWPSTVLITGGIVATAGRFTQWYFGAYSIVAGVFVCLLEYPRGKRKKGSTMERWGQKHMTAVVKLFGPFTRNYYVRAVLHLLLSVPAGFLLATILGTACLAIASGIYLLVSGAL

SEQ ID NO: 747924 - protein, 156 aa, Homo sapiens
MGQIEWAMWANEQALASGLILITGGIVATAGRFTQWYFGAYSIVAGVFVCLLEYPRGKRKKGSTMERWGQKHMTAVVKLFGPFTRNYYVRAVLHLLACVCCLVCRICKDPLQIRGAPIRRQGLGLSVPAGFLLATILGTACLAIASGIYLLVSGAL

SEQ ID NO: 747925 - protein, 524 aa, Homo sapiens
MGQIEWAMWANEQALASGLSECTSGTVEAAAWRGVPRPQPGPRATYRVGKWGARRARPGRGQARRVRGTGAGPSGRGLEGGVLRPPVIPLQTLRSAAPLPHSLLSVPRLREGGSCSAGEEAVQPRWFPGSPPRSPRVGAPAWASGEAPLPLGSQLAWRSLSLGLGWGMGSCPGAQPFSSGVCAGGGLRFHKAPKPPSDGPAQPSCTGTLLLGWDGTAPITLLCICSEVLVRAADSIWKWTLSGPGPGSVWPSTVLITGGIVATAGRFTQWYFGAYSIVAGVFVCLLEYPRGKRKKGSTMERWGQKHMTAVVKLFGPFTRNYYVRAVLHLLACVCCLVCRICKDPLQIRGAPIRRQGLGLSMHCWGVLPGLPGRVEGSVLCVCWLLPAEARTPTRGCFLRASAPEPLVSTSRLRTPRTETSPGPRTSPGSAVCLVLRLCGLGPQTWGSVPLSECPSVSLPLTRCPPALGARRLPAGHHPWDRLPGHCERHLPTGEWRPLRSAPATPIPSPCPDTLGHAWPLKPAL

SEQ ID NO: 747926 - protein, 183 aa, Homo sapiens
RLPLDVYRCHWVFIDATGVYRCHVQVTPVAASALRCKEIVQPRPDLLSLLRLNRRALGDGPRNFRRKPHGQLWVVLITGGIVATAGRFTQWYFGAYSIVAGVFVCLLEYPRGKRKKGSTMERWGQKHMTAVVKLFGPFTRNYYVRAVLHLLLSVPAGFLLATILGTACLAIASGIYLLVSGAL

SEQ ID NO: 747927 - protein, 390 aa, Homo sapiens
SQINRTSSRVRVAMGQIEWAMWANEQALASGLILITGGIVATAGRFTQWYFGAYSIVAGVFVCLLEYPRGKRKKGSTMERWESPPALGSLRGLRGPGRAHRVGWSLVSHLEAPEPTLWCLWVNQGRCLPGVFCGRKEAWVPWGGQQGSKGVPSGRGPAAPSRLPPSPRGQKHMTAVVKLFGPFTRNYYVRAVLHLLACVCCLVCRICKDPLQIRGAPIRRQGLGLSMHCWGVLPGLPGRVEGSVLCVCWLLPAEARTPTRGCFLRASAPEPLVSTSRLRTPRTETSPGPRTSPGSAVCLVLRLCGLGPQTWGSVPLSECPSVSLPLTRCPPALGARRLPAGHHPWDRLPGHCERHLPTGEWRPLRSAPATPIPSPCPDTLGHAWPLKPAL

SEQ ID NO: 747928 - protein, 128 aa, Homo sapiens [sequence omitted]

SEQ ID NO: 747929 - protein, 122 aa, Homo sapiens
MRGSTMERWGQKHMTAVVKLFGPFTRNYYVRAVLHLLLSVPAGFLLEYPRGKRKKGSTMERWGQKHMTAVVKLFGPFTRNYYVRAVLHLLLSVPAGFLLATILGTACLAIASGIYLLVSGAL

SEQ ID NO: 747930 - protein, 133 aa, Homo sapiens
KPLTVAFFPSPPLLPPKVFHSTSWPCGAWTRPSLTVDLSCWSFFSLELPVQILCPFFYCGFCIFLFLLFFLRWSLAPSPRLECSGVISAHCNLRLLGSSNSPASASRVAGTTGTCHHAWLIFGIFSRDGVSPR

SEQ ID NO: 747931 - protein, 429 aa, Homo sapiens
MGQIEWAMWANEQALASGLSECTSGTVEAAAWRGVPRPQPGPRATYRVGKWGARRARPGRGQARRVRGTGAGPSGRGLEGGVLRPPVIPLQTLRSAAPLPHSLLSVPRLREGGSCSAGEEAVQPRWFPGSPPRSPRVGAPAWASGEAPLPLGSQLAWRSLSLGLGWGMGSCPGAQPFSSGVCAGGGLRFHKAPKPPSDGPAQPSCTGTLLLGWDGTAPITLLCICSEVLVRAADSIWKWTLSGPGPGSVWPSTVLITGGIVATAGRFTQWYFGAYSIVAGVFVCLLEYPRGKRKKGSTMERWGQKHMTAVVKLFGPFTRNYYVRAVLHLLLSVPAGFLLATILGTACLAIASGIYLLAAVRGEQWTPIEPKPRERPQIGGTIKQPPSNPPPRPPAEARKKPSEEEAAAAAGGPPGGPQVNPIPVTDEVV

SEQ ID NO: 747932 - protein, 393 aa, Homo sapiens
MGQIEWAMWANEQALASGLSECTSGTVEAAAWRGVPRPQPGPRATYRVGKWGARRARPGRGQARRVRGTGAGPSGRGLEGGVLRPPVIPLQTLRSAAPLPHSLLSVPRLREGGSCSAGEEAVQPRWFPGSPPRSPRVGAPAWASGEAPLPLGSQLAWRSLSLGLGWGMGSCPGAQPFSSGVCAGGGLRFHKAPKPPSDGPAQPSCTGTLLLGWDGTAPITLLCICSEVLVRAADSIWKWTLSGPGPGSVWPSTGEAGLRRGLRAEAPLQQLQEGPAPGEECLGRAWGLRVRRRGPLPPLPWGSERPPCCLEGAWQLEWEQRPQGGRAGGRGPAACPVPRKVTACFESAAKKSVGQFRQLSPELPRETHPACPALPTGSRRTEGTQLGARRPGL

SEQ ID NO: 747933 - protein, 128 aa, Homo sapiens [sequence omitted]

SEQ ID NO: 747934 - protein, 393 aa, Homo sapiens; identical to SEQ ID NO: 747932

SEQ ID NO: 747935 - protein, 137 aa, Homo sapiens
MGQIEWAMWANEQALASGLILITGGIVATAGRFTQWYFGAYSIVAGVFVCLLEYPRGKRKKGSTMERWGQKHMTAVVKLFGPFTRNYYVRAVLHLLLSVPAGFLLATILGTACLAIASGIYLLRLLMVPRSAPLPIV

SEQ ID NO: 747936 - protein, 189 aa, Homo sapiens
MRGSTMERWGQKHMTAVVKLFGPFTRNYYVRAVLHLLLSVPAGFLLEYPRGKRKKGSTMERWGQKHMTAVVKLFGPFTRNYYVRAVLHLLLSVPAGFLLATILGTACLAIASGIYLLAAVRGEQWTPIEPKPRERPQIGGTIKQPPSNPPPRPPAEARKKPSEEEAAAAAGGPPGGPQVNPIPVTDEVV

SEQ ID NO: 747937 - protein, 295 aa, Homo sapiens
SQINRTSSRVRVAMGQIEWAMWANEQALASGLILITGGIVATAGRFTQWYFGAYSIVAGVFVCLLEYPRGKRKKGSTMERWESPPALGSLRGLRGPGRAHRVGWSLVSHLEAPEPTLWCLWVNQGRCLPGVFCGRKEAWVPWGGQQGSKGVPSGRGPAAPSRLPPSPRGQKHMTAVVKLFGPFTRNYYVRAVLHLLLSVPAGFLLATILGTACLAIASGIYLLAAVRGEQWTPIEPKPRERPQIGGTIKQPPSNPPPRPPAEARKKPSEEEAAAAAGGPPGGPQVNPIPVTDEVV

SEQ ID NO: 747938 - protein, 405 aa, Homo sapiens
MGQIEWAMWANEQALASGLSECTSGTVEAAAWRGVPRPQPGPRATYRVGKWGARRARPGRGQARRVRGTGAGPSGRGLEGGVLRPPVIPLQTLRSAAPLPHSLLSVPRLREGGSCSAGEEAVQPRWFPGSPPRSPRVGAPAWASGEAPLPLGSQLAWRSLSLGLGWGMGSCPGAQPFSSGVCAGGGLRFHKAPKPPSDGPAQPSCTGTLLLGWDGTAPITLLCICSEVLVRAADSIWKWTLSGPGPGSVWPSTVLITGGIVATAGRFTQWYFGAYSIVAGVFVCLLEYPRGKRKKGSTMERWGQKHMTAVVKLFGPFTRNYYVRAVLHLLACVCCLVCRICKDPLQIRGAPIRRQGLGSACTAGGSCLGFLVGWRVPCCVSAGYCRLRPGHPHVAASSEQVHQSR

SEQ ID NO: 747939 - protein, 405 aa, Homo sapiens; identical to SEQ ID NO: 747938

SEQ ID NO: 747940 - protein, 180 aa, Homo sapiens
SQINRTSSRVRVAMGQIEWAMWANEQALASGLILITGGIVATAGRFTQWYFGAYSIVAGVFVCLLEYPRGKRKKGSTMERWLSVPAGFLLATILGTACLAIASGIYLLAAVRGEQWTPIEPKPRERPQIGGTIKQPPSNPPPRPPAEARKKPSEEEAAAAAGGPPGGPQVNPIPVTDEVV

SEQ ID NO: 747941 - protein, 342 aa, Homo sapiens
MGQIEWAMWANEQALASGLSECTSGTVEAAAWRGVPRPQPGPRATYRVGKWGARRARPGRGQARRVRGTGAGPSGRGLEGGVLRPPVIPLQTLRSAAPLPHSLLSVPRLREGGSCSAGEEAVQPRWFPGSPPRSPRVGAPAWASGEAPLPLGSQLAWRSLSLGLGWGMGSCPGAQPFSSGVCAGGGLRFHKAPKPPSDGPAQPSCTGTLLLGWDGTAPITLLCICSEVLVRAADSIWKWTLSGPGPGSVWPSTVLITGGIVATAGRFTQWYFGAYSIVAGVFVCLLEYPRGKRKKGSTMERWGQKHMTAVVKLFGPFTRNYYVRAVLHLLLGSLYINLSISA

SEQ ID NO: 747942 - protein, 119 aa, Homo sapiens
AVVKLFGPFTRNYYVRAVLHLLVSPRPAPPLGLRRAWSRPSPLSHRPGCLDRSHPPLTSVFFQTKIRVPGSGRACVCCLVCRICKDPLQIRGAPIRRQGLGSACTAGGSCLGFLVGWRV

SEQ ID NO: 747943 - protein, 84 aa, Homo sapiens
ARGAGRKSLFTQTAHRLGNNAVKEVSRLGLTAPTSCSHTHQRGKKKRSERKKKRGKNQDLITRATDRLQTPVSMESRGLSPGSS

SEQ ID NO: 747944 - protein, 407 aa, Homo sapiens
MESAITLWQFLLQLLLDQKHEHLICWTSNDGEFKLLKAEEVAKLWGLRKNKTNMNYDKLSRALRYYYDKNIIKKVIGQKFVYKFVSFPEILKMDPHAVEISRESLLLQDSDCKASPEGREAHKHGLAALRSTSRNEYIHSGLYSSFTINSLQNPPDAFKAIKTEKLEEPPEDSPPVEEVRTVIRFVTNKTDKHVTRPVVSLPSTSEAAAASAFLASSVSAKISSLMLPNAASISSASPFSSRSPSLSPNSPLPSEHRSLFLEAACHDSDSLEPLNLSSGSKTKSPSLPPKAKKPKGLEISAPPLVLSGTDIGSIALNSPALPSGSLTPAFFTAQTPNGLLLTPSPLLSSIHFWSSLSPVAPLSPARLQGPSTLFQFPTLLNGHMPVPIPSLDRAASPVLLSSNSQKS

SEQ ID NO: 747945 - protein, 407 aa, Homo sapiens; identical to SEQ ID NO: 747944

SEQ ID NO: 747946 - protein, 380 aa, Homo sapiens
MESAITLWQFLLQLLLDQKHEHLICWTSNDGEFKLLKAEEVAKLWGLRKNKTNMNYDKLSRALRYYYDKNIIKKVIGQKFVYKFVSFPEILKMDPHAVEISRESLLLQDSDCKASPEGREAHKHGLAALRSTSRNEYIHSGLYSSFTINSLQNPPDAFKAIKTEKLEEPPEDSPPVEEVRTVIRFVTNKTDKHVTRPVVSLPSTSEAAAASAFLASSVSAKISSLMLPNAASISSASPFSSRSPSLSPNSPLPSEHRSLFLEAACHDSDSLEPLNLSSGSKTKSPSLPPKAKKPKGLEISAPPLVLSGTDIGSIALNSPALPSGSLTPAFFTAQTPNGLLLTPSPLLSSIHFWSSLSPVAPLSPARLQGPSTLFQVSVWK

SEQ ID NO: 747947 - protein, 306 aa, Homo sapiens
MVTEFLLLGFSHLADLQGLLFSVFLTIYLLTVAGNFLIVVLVSTDAALQSPMYFFLRTLSALEIGYTSVTVPLLLHHLLTGRRHISRSGCALQMFFFLFFGATECCLLAAMAYDRYAAICEPLRYPLLLSHRVCLQLAGSAWACGVLVGLGHTPFIFSLPFCGPNTIPQFFCEIQPVLQLVCGDTSLNELQIILATALLILCPFGLILGSYGRILVTIFRIPSVAGRRKAFSTCSSHLIVVSLFYGTALFIYIRPKASYDPATDPLVSLFYAVVTPILNPIIYSLRNTEVKAALKRTIQKTVPMEI

SEQ ID NO: 747948 - protein, 703 aa, Homo sapiens
MSARATRPRSRRGRHAPPGELDPVAESSEEVEAASGSSKPSFAPPPVSSGLEQLGPMEEVSGQGLGSRTDKKMDGGSGRELASAPEVPHKPAVEAHQAPEAALQYKETVPPGNGAPDVFQTLQHTLSSLEAAAAAWRHQPPSHSGPMEFEGTSEGGAGSLGKQEGAGSCQREAARLAERNAWLRLALSSREDELVRTQASLEAIRAEKETLQKEVQELQDSLLRLEPCPHLSHNQAGGSGSGSSSSEADREPWETQDSFSLAHPLLRRLRSHSSTQILGSLPNQPLSPEMHIMEAQMEQLRGSIEKLKCFNRLLSAVLQGYKGRCEGLSMQLGQREAEATALHLALQYSEHCEEAYRVLLALREADSGAGDEAPMSDLQAAEKEAWRLLAQEEAAMDAGTQQNPQPSPEGSSVDKPTPQEVAFQLRSYVQRLQERRSLVKILSEPGPTLAPMPIVPRAEAMVQAILGTQAGPALPRLEKTQIQQDLVAAREALADLMLRLQLVRREKRGLELREAALRALGPAHVLLLEQLRWERAELQAGGANSSGGHSSGGGSSGDEEEWYQGLPAVPGGTSGIDGGQVGRAWDPEKLAQELAASLTRTLDLQEQLQSLRRELEQVAQKGRARRSQSAELNRDLCKAHSALVLAFRGAHRKQEEQRRKLEQQMALMEAQQAEEVAVLEATARALGKPRPPLPPPQLGDTFL

SEQ ID NO: 747949 - protein, 804 aa, Homo sapiens
MSARATRPRSRRGRHAPPGELDPVAESSEEVEAASGSSKPSFAPPPVSSGLEQLGPMEEVSGQGLGSRTDKKMDGGSGRELASAPEVPHKPAVEAHQAPEAALQYKETVPPGNGAPDVFQTLQHTLSSLEAAAAAWRHQPPSHSGPMEFEGTSEGGAGSLGKQEGAGSCQREAARLAERNAWLRLALSSREDELVRTQASLEAIRAEKETLQKEVQELQDSLLRLEPCPHLSHNQAGGSGSGSSSSEADREPWETQDSFSLAHPLLRRLRSHSSTQILGSLPNQPLSPEMHIMEAQMEQLRGSIEKLKCFNRLLSAVLQGYKGRCEGLSMQLGQREAEATALHLALQYRVLLCHPGWSAVVPSWLTATSASPVQVILLPQPPEYAGTTGAYHHTLLIFVFLVETGFHHVGQAGLELLTSGNPPKVLGLQVRAIAPAELSVLKHSEPVSHSEHCEEAYRVLLALREADSGAGDEAPMSDLQAAEKEAWRLLAQEEAAMDAGTQQNPQPSPEGSSVDKPTPQEVAFQLRSYVQRLQERRSLVKILSEPGPTLAPMPIVPRAEAMVQAILGTQAGPALPRLEKTQIQQDLVAAREALADLMLRLQLVRREKRGLELREAALRALGPAHVLLLEQLRWERAELQAGGANSSGGHSSGGGSSGDEEEWYQGLPAVPGGTSGIDGGQVGRAWDPEKLAQELAASLTRTLDLQEQLQSLRRELEQVAQKGRARRSQSAELNRDLCKAHSALVLAFRGAHRKQEEQRRKLEQQMALMEAQQAEEVAVLEATARALGKPRPPLPPPQLGDTFL

SEQ ID NO: 747950 - protein, 732 aa, Homo sapiens
MDGGSGRELASAPEVPHKPAVEAHQAPEAALQYKETVPPGNGAPDVFQTLQHTLSSLEAAAAAWRHQPPSHSGPMEFEGTSEGGAGSLGKQEGAGSCQREAARLAERNAWLRLALSSREDELVRTQASLEAIRAEKETLQKEVQELQDSLLRLEPCPHLSHNQAGGSGSGSSSSEADREPWETQDSFSLAHPLLRRLRSHSSTQILGSLPNQPLSPEMHIMEAQMEQLRGSIEKLKCFNRLLSAVLQGYKGRCEGLSMQLGQREAEATALHLALQYRVLLCHPGWSAVVPSWLTATSASPVQVILLPQPPEYAGTTGAYHHTLLIFVFLVETGFHHVGQAGLELLTSGNPPKVLGLQVRAIAPAELSVLKHSEPVSHSEHCEEAYRVLLALREADSGAGDEAPMSDLQAAEKEAWRLLAQEEAAMDAGTQQNPQPSPEGSSVDKPTPQEVAFQLRSYVQRLQERRSLVKILSEPGPTLAPMPIVPRAEAMVQAILGTQAGPALPRLEKTQIQQDLVAAREALADLMLRLQLVRREKRGLELREAALRALGPAHVLLLEQLRWERAELQAGGANSSGGHSSGGGSSGDEEEWYQGLPAVPGGTSGIDGGQVGRAWDPEKLAQELAASLTRTLDLQEQLQSLRRELEQVAQKGRARRSQSAELNRDLCKAHSALVLAFRGAHRKQEEQRRKLEQQMALMEAQQAEEVAVLEATARALGKPRPPLPPPQLGDTFL

SEQ ID NO: 747951 - protein, 307 aa, Homo sapiens
RLLEDKKITVLLDEVAEDMGKCHLTKGKQALEIRSSLSEKRALTDPIQGTEYSAESLVRNLQWAKAHELPESMCLKFDCGVQIQLGFAAEFSNVMIIYTSIVYKPPEIIMCDAYVTDFPLDLDIDPKDANKGTPEETGSYLVSKDLPKHCLYTRLSSLQKLKEHLVFTVCLSYQYSGLEDTVEDKQEVNVGKPLIAKLDMHRGLGRKTCFQTCLMSNGPYQSSAATSGGAGHYHSLQDPFHGVYHSHPGNPSNVTPADSCHCSRTPDAFISSFAHHASCHFSRSNVPVETTDEIPFSFSDRLRISEK

SEQ ID NO: 747952 - protein, 307 aa, Homo sapiens; identical to SEQ ID NO: 747951

SEQ ID NO: 747953 - protein, 307 aa, Homo sapiens; identical to SEQ ID NO: 747951

SEQ ID NO: 747954 - protein, 307 aa, Homo sapiens; identical to SEQ ID NO: 747951

SEQ ID NO: 747955 - protein, 779 aa, Homo sapiens
MRIEERKSQHLTGLTDEKVKAYLSLHPQVLDEFVSESVSAETVEKWLKRKNNKSEDESAPKEVSRYQDTNMQGVVYELNSYIEQRLDTGGDNQLLLYELSSIIKIATKADGFALYFLGECNNSLCIFTPPGIKEGKPRLIPAGPITQGTTVSAYVAKSRKTLLVEDILGDERFPRGTGLESGTRIQSVLCLPIVTAIGDLIGILELYRHWGKEAFCLSHQEVATANLAWASVAIHQVQVCRGLAKQTELNDFLLDVSKTYFDNIVAIDSLLEHIMIYAKNLVNADRCALFQVDHKNKELYSDLFDIGEEKEGKPVFKKTKEIRFSIEKGIAGQVARTGEVLNIPDAYADPRFNREVDLYTGYTTRNILCMPIVSRGSVIGVVQMVNKISGSAFSKTDENNFKMFAVFCALALHCANMYHRIRHSECIYRVTMEKLSYHSICTSEEWQGLMQFTLPVRLCKEIELFHFDIGPFENMWPGIFVYMVHRSCGTSCFELEKLCRFIMSVKKNYRRVPYHNWKHAVTVAHCMYAILQNNHTLFTDLERKGLLIACLCHDLDHRGFSNSYLQKFDHPLAALYSTSTMEQHHFSQTVSILQLEGHNIFSTLSSSEYEQVLEIIRKAIIATDLALYFGNRKQLEEMYQTGSLNLNNQSHRDRVIGLMMTACDLCSVTKLWPVTKLTANDIYAEFWAEGDEMKKLGIQPIPMMDRDKKDEVPQGQLGFYNAVAIPCYTTLTQILPPTEPLLKACRDNLSQWEKVIRGEETATWISSPSVAQKAAASED

SEQ ID NO: 747956 - protein, 820 aa, Homo sapiens
EFRAAAAKLRGVPRAPAFALAAAAALLFGSDMEDGPSNNASCFRRLTECFLSPSLTDEKVKAYLSLHPQVLDEFVSESVSAETVEKWLKRKNNKSEDESAPKEVSRYQDTNMQGVVYELNSYIEQRLDTGGDNQLLLYELSSIIKIATKADGFALYFLGECNNSLCIFTPPGIKEGKPRLIPAGPITQGTTVSAYVAKSRKTLLVEDILGDERFPRGTGLESGTRIQSVLCLPIVTAIGDLIGILELYRHWGKEAFCLSHQEVATANLAWASVAIHQVQVCRGLAKQTELNDFLLDVSKTYFDNIVAIDSLLEHIMIYAKNLVNADRCALFQVDHKNKELYSDLFDIGEEKEGKPVFKKTKEIRFSIEKGIAGQVARTGEVLNIPDAYADPRFNREVDLYTGYTTRNILCMPIVSRGSVIGVVQMVNKISGSAFSKTDENNFKMFAVFCALALHCANMYHRIRHSECIYRVTMEKLSYHSICTSEEWQGLMQFTLPVRLCKEIELFHFDIGPFENMWPGIFVYMVHRSCGTSCFELEKLCRFIMSVKKNYRRVPYHNWKHAVTVAHCMYAILQNNHTLFTDLERKGLLIACLCHDLDHRGFSNSYLQKFDHPLAALYSTSTMEQHHFSQTVSILQLEGHNIFSTLSSSEYEQVLEIIRKAIIATDLALYFGNRKQLEEMYQTGSLNLNNQSHRDRVIGLMMTACDLCSVTKLWPVTKLTANDIYAEFWAEGDEMKKLGIQPIPMMDRDKKDEVPQGQLGFYNAVAIPCYTTLTQILPPTEPLLKACRDNLSQWEKVIRGEETATWISSPSVAQKAAASED

SEQ ID NO: 747957 - protein, 363 aa, Homo sapiens
MYHRIRHSECIYRVTMEKLSYHSICTSEEWQGLMQFTLPVRLCKEIELFHFDIGPFENMWPGIFVYMVHRSCGTSCFELEKLCRFIMSVKKNYRRVPYHNWKHAVTVAHCMYAILQNNHTLFTDLERKGLLIACLCHDLDHRGFSNSYLQKFDHPLAALYSTSTMEQHHFSQTVSILQLEGHNIFSTLSSSEYEQVLEIIRKAIIATDLALYFGNRKQLEEMYQTGSLNLNNQSHRDRVIGLMMTACDLCSVTKLWPVTKLTANDIYAEFWAEGDEMKKLGIQPIPMMDRDKKDEVPQGQLGFYNAVAIPCYTTLTQILPPTEPLLKACRDNLSQWEKVIRGEETATWISSPSVAQKAAASED

SEQ ID NO: 747958 - protein, 831 aa, Homo sapiens
MRIEERKSQHLTGLTDEKVKAYLSLHPQVLDEFVSESVSAETVEKWLKRKNNKSEDESAPKEVSRYQDTNMQGVVYELNSYIEQRLDTGGDNQLLLYELSSIIKIATKADGFALYFLGECNNSLCIFTPPGIKEGKPRLIPAGPITQGTTVSAYVAKSRKTLLVEDILGDERFPRGTGLESGTRIQSVLCLPIVTAIGDLIGILELYRHWGKEAFCLSHQEVATANLAWASVAIHQVQVCRGLAKQTELNDFLLDVSKTYFDNIVAIDSLLEHIMIYAKNLVNADRCALFQVDHKNKELYSDLFDIGEEKEGKPVFKKTKEIRFSIEKGIAGQVARTGEVLNIPDAYADPRFNREVDLYTGYTTRNILCMPIVSRGSVIGVVQMVNKISGSAFSKTDENNFKMFAVFCALALHCANMYHRIRHSECIYRVTMEKLSYHSICTSEEWQGLMQFTLPVRLCKEIELFHFDIGPFENMWPGIFVYMVHRSCGTSCFELEKLCRFIMSVKKNYRRVPYHNWKHAVTVAHCMYAILQNNHTLFTDLEVHHDDTAAYNMETTPKQNDTNNIINSVILRMPELGVLESLDLDPPPTQTTTLRKGLLIACLCHDLDHRGFSNSYLQKFDHPLAALYSTSTMEQHHFSQTVSILQLEGHNIFSTLSSSEYEQVLEIIRKAIIATDLALYFGNRKQLEEMYQTGSLNLNNQSHRDRVIGLMMTACDLCSVTKLWPVTKLTANDIYAEFWAEGDEMKKLGIQPIPMMDRDKKDEVPQGQLGFYNAVAIPCYTTLTQILPPTEPLLKACRDNLSQWEKVIRGEETATWISSPSVAQKAAASED

SEQ ID NO: 747959 - protein, 704 aa, Homo sapiens
MRIEERKSQHLTGLTDEKVKAYLSLHPQVLDEFVSESVSAETVEKWLKRKNNKSEDESAPKEVSRYQDTNMQGVVYELNSYIEQRLDTGGDNQLLLYELSSIIKIATKADGFALYFLGECNNSLCIFTPPGIKEGKPRLIPAGPITQGTTVSAYVAKSRKTLLVEDILGDERFPRGTGLESGTRIQSVLCLPIVTAIGDLIGILELYRHWGKEAFCLSHQEVATANLAWASVAIHQVQVCRGLAKQTELNDFLLDVSKTYFDNIVAIDSLLEHIMIYAKNLVNADRCALFQVDHKNKELYSDLFDIGEEKEGKPVFKKTKEIRFSIEKGIAGQVARTGEVLNIPDAYADPRFNREVDLYTGYTTRNILCMPIVSRGSVIGVVQMVNKISGSAFSKTDENNFKMFAVFCALALHCANMYHRIRHSECIYRVTMEKLSYHSICTSEEWQGLMQFTLPVRLCKEIELFHFDIGPFENMWPGIFVYMVHRSCGTSCFELEKLCRFIMSVKKNYRRVPYHNWKHAVTVAHCMYAILQNNHTLFTDLEVHHDDTAAYNMETTPKQNDTNNIINSVILRMPELGVLESLDLDPPPTQTTTLRKGLLIACLCHDLDHRGFSNSYLQKFDHPLAALYSTSTMEQHHFSQTVSILQLEGHNIFSTLSSSEYEQVLEIIRKAIIATDLALYFGNRKQLEEMYQTGSLNLNNQSHR

SEQ ID NO: 747960 - protein, 84 aa, Homo sapiens
EFRAAAAKLRGVPRAPAFALAAAAALLFGSDMEDGPSNNASCFRRLTECFLSPKANGIDIEVIHRDVTVEEMGVEKTLKEKNVE

SEQ ID NO: 747961 - protein, 85 aa, Homo sapiens
QTAKMAAPFSPRELIPGRIQISVSLRAPAGVAAGPSWEVPPSEEEWIGDPLKEAVWPHFGRAAVLRGGSLLPSVGLGSQKPNRLE

SEQ ID NO: 747962 - protein, 121 aa, Homo sapiens
MGVWLVEGRLLIGLKSNLGGRTDQNWGLMGGAGWSQDDAQISGSGFWVERSVIYREGEPRGGAGLEECSERVSCQSGGPTADPEAPAWDLWSQTNLRVNLGSNYKVMAEAEDREGEQRLQR

SEQ ID NO: 747963 - protein, 127 aa, Homo sapiens
NYSARYEAWVVLRFAAAYGFRNIQNMILKLKKGKFPFHFVEVLACAGGCLNGRGQAQTPDGHADKALLRQMEGIYADIPVRRPESSAHVQELYQEWLEGINSPKAREVLHTTYQSQERGTHSLDIKW

SEQ ID NO: 747964 - protein, 456 aa, Homo sapiens
MKCEHCTRKECSKKTKTDDQENVSADAPSPAQENGEKGEFHKLADAKIFLSDCLACDSCMTAEEGVQLSQQNAKDFFRVLNLNKKCDTSKHKVLVVSVCPQSLPYFAAKFNLSVTDASRRLCGFLKSLGVHYVFDTTIAADFSILESQKEFVRRYRQHSEEERTLPMLTSACPGWVRYAERVLGRPITAHLCTAKSPQQVMGSLVKDYFARQQNLSPEKIFHVIVAPCYDKKLEALQESLPPALHGSRGADCVLTSGEIAQIMEQGDLSVRDAAVDTLFGDLKEDKVTRHDGASSDGHLAHIFRHAAKELFNEDVEEVTYRALRNKDFQEVTLEKNGEVVLRFAAAYGFRNIQNMILKLKKGKFPFHFVEVLACAGGCLNGRGQAQTPDGHADKALLRQMEGIYADIPVRRPESSAHVQELYQEWLEGINSPKAREVLHTTYQSQERGTHSLDIKW

SEQ ID NO: 747965 - protein, 278 aa, Homo sapiens
MKCEHCTRKECSKKTKTDDQENVSADAPSPAQENGEKGEFHKLADAKIFLSDCLACDSCMTAEEGVQLSQQNAKDFFRVLNLNKKCDTSKHKVLVVSVCPQSLPYFAAKFNLSVTDASRRLCGFLKSLGVHYVFDTTIAADFSILESQKEFVRRYRQHSEEERTLPMLTSACPGWVRYAERVLGRPITAHLCTAKSPQQVMGSLVKDYFARQQNLSPEKIFHVIVAPCYDKKLEALQESLPPALHGSRGADCVLTSGEIAQIMEQGDLSVRDAAVDTL

SEQ ID NO: 747966 - protein, 502 aa, Homo sapiens
MKCEHCTRKECSKKTKTDDQENVSADAPSPAQENGEKGEFHKLADAKIFLSDCLACDSCMTAEEGVQLSQQNAKDFFRVLNLNKKCDTSKHKVLVVSVCPQSLPYFAAKFNLSVTDASRRLCGFLKSLGVHYVFDTTIAADFSILESQKEFVRRYRQHSEEERTLPMLTSACPGWVRYAERVLGRPITAHLCTAKSPQQVMGSLVKDYFARQQNLSPEKIFHVIVAPCYDKKLEALQESLPPALHGSRGADCVLTSEISQAWWCTPVITATREAAARESLEPGRQRLQRDKIAPLDSSLGGGGEIAQIMEQGDLSVRDAAVDTLFGDLKEDKVTRHDGASSDGHLAHIFRHAAKELFNEDVEEVTYRALRNKDFQEVTLEKNGEVVLRFAAAYGFRNIQNMILKLKKGKFPFHFVEVLACAGGCLNGRGQAQTPDGHADKALLRQMEGIYADIPVRRPESSAHVQELYQEWLEGINSPKAREVLHTTYQSQERGTHSLDIKW

SEQ ID NO: 747967 - protein, 410 aa, Homo sapiens
MKCEHCTRKECSKKTKTDDQENVSADAPSPAQENGEKGEFHKLADAKIFLSDCLACDSCMTAEEGVQLSQQNAKDFFRVLNLNKKCDTSKHKVLVVSVCPQSLPYFAAKFNLSVTDASRRLCGFLKSLGVHYVFDTTIAADFSILESQKEFVRRYRQHSEEERTLPMLTSACPGWVRYAERVLGRPITAHLCTAKSPQQVMGSLVKDYFARQQNLSPEKIFHVIVAPCYDKKLEALQESLPPALHGSRGADCVLTSGEIAQIMEQGDLSVRDAAVDTLNKDFQEVTLEKNGEVVLRFAAAYGFRNIQNMILKLKKGKFPFHFVEVLACAGGCLNGRGQAQTPDGHADKALLRQMEGIYADIPVRRPESSAHVQELYQEWLEGINSPKAREVLHTTYQSQERGTHSLDIKW

SEQ ID NO: 747968 - protein, 278 aa, Homo sapiens; identical to SEQ ID NO: 747965

SEQ ID NO: 747969 - protein, 278 aa, Homo sapiens; identical to SEQ ID NO: 747965

SEQ ID NO: 747970 - protein, 397 aa, Homo sapiens
MTAEEGVQLSQQNAKDFFRVLNLNKKCDTSKHKVLVVSVCPQSLPYFAAKFNLSVTDASRRLCGFLKSLGVHYVFDTTIAADFSILESQKEFVRRYRQHSEEERTLPMLTSACPGWVRYAERVLGRPITAHLCTAKSPQQVMGSLVKDYFARQQNLSPEKIFHVIVAPCYDKKLEALQESLPPALHGSRGADCVLTSGEIAQIMEQGDLSVRDAAVDTLFGDLKEDKVTRHDGASSDGHLAHIFRHAAKELFNEDVEEVTYRALRNKDFQEVTLEKNGEVVLRFAAAYGFRNIQNMILKLKKGKFPFHFVEVLACAGGCLNGRGQAQTPDGHADKALLRQMEGIYADIPVRRPESSAHVQELYQEWLEGINSPKAREVLHTTYQSQERGTHSLDIKW

SEQ ID NO: 747971 - protein, 434 aa, Homo sapiens
MGQMDRVRFQENGEKGEFHKLADAKIFLSDCLACDSCMTAEEGVQLSQQNAKDFFRVLNLNKKCDTSKHKVLVVSVCPQSLPYFAAKFNLSVTDASRRLCGFLKSLGVHYVFDTTIAADFSILESQKEFVRRYRQHSEEERTLPMLTSACPGWVRYAERVLGRPITAHLCTAKSPQQVMGSLVKDYFARQQNLSPEKIFHVIVAPCYDKKLEALQESLPPALHGSRGADCVLTSGEIAQIMEQGDLSVRDAAVDTLFGDLKEDKVTRHDGASSDGHLAHIFRHAAKELFNEDVEEVTYRALRNKDFQEVTLEKNGEVVLRFAAAYGFRNIQNMILKLKKGKFPFHFVEVLACAGGCLNGRGQAQTPDGHADKALLRQMEGIYADIPVRRPESSAHVQELYQEWLEGINSPKAREVLHTTYQSQERGTHSLDIKW

SEQ ID NO: 747972 - protein, 290 aa, Homo sapiens [sequence omitted]

SEQ ID NO: 747973 - protein, 302 aa, Homo sapiens
MKCEHCTRKECSKKTKTDDQENVSADAPSPAQENGEKGEFHKLADAKIFLSDCLACDSCMTAEEGVQLSQQNAKDFFRVLNLNKKCDTSKHKVLVVSVCPQSLPYFAAKFNLSVTDASRRLCGFLKSLGVHYVFDTTIAADFSILESQKEFVRRYRQHSEEERTLPMLTSACPGWVRYAERVLGRPITAHLCTAKSPQQVMGSLVKDYFARQQNLSPEKIFHVIVAPCYDKKLEALQESLPPVRQMEGIYADIPVRRPESSAHVQELYQEWLEGINSPKAREVLHTTYQSQERGTHSLDIKW

SEQ ID NO: 747974 - protein, 189 aa, Homo sapiens
MKDLYFLCLVRFGDLKEDKVTRHDGASSDGHLAHIFRHAAKELFNEDVEEVTYRALRNKDFQEVTLEKNGEVVLRFAAAYGFRNIQNMILKLKKGKFPFHFVEVLACAGGCLNGRGQAQTPDGHADKALLRQMEGIYADIPVRRPESSAHVQELYQEWLEGINSPKAREVLHTTYQSQERGTHSLDIKW

SEQ ID NO: 747975 - protein, 226 aa, Homo sapiens
MKCEHCTRKECSKKTKTDDQENVSADAPSPAQENGEKGEFHKLADAKIFLSDCLACDSCMTAEEGVQLSQQNAKDFFRVLNLNKKCDTSKHKVLVVSVCPQSLPYFAAKFNLSVTDASRRLCGFLKSLGVHYVFDTTIAADFSILERCLNGRGQAQTPDGHADKALLRQMEGIYADIPVRRPESSAHVQELYQEWLEGINSPKAREVLHTTYQSQERGTHSLDIKW

SEQ ID NO: 747976 - protein, 167 aa, Homo sapiens
MKCEHCTRKECSKKTKTDDQENVSADAPSPAQENGEKGEFHKLADAKIFLSDCLACDSCMTAEEGVQLSQQNAKDFFRVLNLNKKKKKKKKKKRCVGGLGPLEKVFEDPLVWGGGAPMLVLSGTGGQRGGSLEGTPGTRDTRAGGFLHNIKKSPGGTRIRFGTNSQM

SEQ ID NO: 747977 - protein, 127 aa, Homo sapiens; identical to SEQ ID NO: 747963

SEQ ID NO: 747978 - protein, 456 aa, Homo sapiens; identical to SEQ ID NO: 747964

SEQ ID NO: 747979 - protein, 456 aa, Homo sapiens; identical to SEQ ID NO: 747964

SEQ ID NO: 747980 - protein, 278 aa, Homo sapiens; identical to SEQ ID NO: 747965

SEQ ID NO: 747981 - protein, 487 aa, Homo sapiens
MKCEHCTRKECSKKTKTDDQENVSADAPSPAQENGEKGEFHKLADAKIFLSDCLACDSCMTAEEGVQLSQQNAKDFFRVLNLNKKCDTSKHKVLVVSVCPQSLPYFAAKFNLSVTDASRRLCGFLKSLGVHYVFDTTIAADFSILESQKEFVRRYRQHSEEERTLPMLTSACPGWVRYAERVLGRPITAHLCTAKSPQQVMGSLVKDYFARQQNLSPEKIFHVIVAPCYDKKLEALQESLPPALHGSRGADCVLTSEISQAWWCTPVITATREAAARESLEPGRQRLQRDKIAPLDSSLGGGGEIAQIMEQGDLSVRDAAVDTLFGDLKEDKVTRHDGASSDGHLAHIFRHAAKELFNEDVEEVTYRALRNKDFQEVTLEKNGEVVLRFAAAYGFRNIQNMILKLKKGCLNGRGQAQTPDGHADKALLRQMEGIYADIPVRRPESSAHVQELYQEWLEGINSPKAREVLHTTYQSQERGTHSLDIKW

SEQ ID NO: 747982 - protein, 524 aa, Homo sapiens
AAEVGGPGPRSLASGLFKAPPASAPWAARRGGGRRGVPASAGRVRSSRFSLNLSIFPTPAKRKRTETEPLVPRTTVRECSKKTKTDDQENVSADAPSPAQENGEKGEFHKLADAKIFLSDCLACDSCMTAEEGVQLSQQNAKDFFRVLNLNKKCDTSKHKVLVVSVCPQSLPYFAAKFNLSVTDASRRLCGFLKSLGVHYVFDTTIAADFSILESQKEFVRRYRQHSEEERTLPMLTSACPGWVRYAERVLGRPITAHLCTAKSPQQVMGSLVKDYFARQQNLSPEKIFHVIVAPCYDKKLEALQESLPPALHGSRGADCVLTSGEIAQIMEQGDLSVRDAAVDTLFGDLKEDKVTRHDGASSDGHLAHIFRHAAKELFNEDVEEVTYRALRNKDFQEVTLEKNGEVVLRFAAAYGFRNIQNMILKLKKGKFPFHFVEVLACAGGCLNGRGQAQTPDGHADKALLRQMEGIYADIPVRRPESSAHVQELYQEWLEGINSPKAREVLHTTYQSQERGTHSLDIKW

SEQ ID NO: 747983 - protein, 408 aa, Homo sapiens
MKCEHCTRKECSKKTKTDDQENVSADAPSPAQENGEKCDTSKHKVLVVSVCPQSLPYFAAKFNLSVTDASRRLCGFLKSLGVHYVFDTTIAADFSILESQKEFVRRYRQHSEEERTLPMLTSACPGWVRYAERVLGRPITAHLCTAKSPQQVMGSLVKDYFARQQNLSPEKIFHVIVAPCYDKKLEALQESLPPALHGSRGADCVLTSGEIAQIMEQGDLSVRDAAVDTLFGDLKEDKVTRHDGASSDGHLAHIFRHAAKELFNEDVEEVTYRALRNKDFQEVTLEKNGEVVLRFAAAYGFRNIQNMILKLKKGKFPFHFVEVLACAGGCLNGRGQAQTPDGHADKALLRQMEGIYADIPVRRPESSAHVQELYQEWLEGINSPKAREVLHTTYQSQERGTHSLDIKW

SEQ ID NO: 747984 - protein, 338 aa, Homo sapiens
RHEEDFFRVLRVHYVFDTTIAADFSILESQKEFVRRYRQHSEEERTLPMLTSACPGWVRYAERVLGRPITAHLCTAKSPQQVMGSLVKDYFARQQNLSPEKIFHVIVAPCYDKKLEALQESLPPALHGSRGADCVLTSGEIAQIMEQGDLSVRDAAVDTLFGDLKEDKVTRHDGASSDGHLAHIFRHAAKELFNEDVEEVTYRALRNKDFQEVTLEKNGEVVLRFAAAYGFRNIQNMILKLKKGKFPFHFVEVLACAGGCLNGRGQAQTPDGHADKALLRQMEGIYADIPVRRPESSAHVQELYQEWLEGINSPKAREVLHTTYQSQERGTHSLDIKW

SEQ ID NO: 747985 - protein, 188 aa, Homo sapiens
MKCEHCTRKECSKKTKTDDQENVSADAPSPAQENGEKGEFHKLADAKIFLSDCLACDSCMTAEEGVQLSQQNAKDFFRVLNLNKKCDTSKHKVLVVSVCPQSLPYFAAKFNLSVTDASRRLCGFLKSLGVHYVFDTTIAADFSILESQKEFVRRYRQHSEEERTLPMLTSACPGMLPFPSSLQACRFP

SEQ ID NO: 747986 - protein, 167 aa, Homo sapiens; identical to SEQ ID NO: 747976

SEQ ID NO: 747987 - protein, 577 aa, Homo sapiens
MLTPAFDLSQDPDFLTIAIRVPYARVSEFDVYFEGSDFKFYAKPYFLRLTLPGRIVENGSEQGSYDADKGIFTIRLPKETPGQHFEGLNMLTALLAPRKSRTAKPLVEEIGASEIPEEVVDDEEFDWEIEQTPCEEVSESALNPQCHYGFGNLRSGVLQRLQDELSDVIDIKDPDFTPAAERRQKRLAAELAKFDPDHYLADFFEDEAIEQILKYNPWWTDKYSKMMAFLEKSQEQENHATLVSFSEEEKYQLRKFVNKSYLLDKRACRQVCYSLIDILLAYCYETRVTEGEKNVESAWNIRKLSPTLCWFETWTNVHDIMVSFGRRVLCYPLYRHFKLVMKAYRDTIKILQLGKSAVLKCLLDIHKIFQENDPAYILNDLYISDYCVWIQKVKSKKLAALAEALKEVSLTKAQLGLELEELEAAALLVQEEETALKAAHSVSGQQTLCSSSEASDSEDSDSSVSSGNEDSGSDSEQDELKDSPSETVSSLQGPFLEESSAFLIADGGVRRNTAIQESDASQGKPLASSWPLGVSGPLIEELGEQLKTTVQVSEPKGTTAVNRSNIQERDGCQTPNN

SEQ ID NO: 747988 - protein, 577 aa, Homo sapiens; identical to SEQ ID NO: 747987

SEQ ID NO: 747989 - protein, 388 aa, Homo sapiens
MLTPAFDLSQDPDFLTIAIRVPYARVSEFDVYFEGSDFKFYAKPYFLRLTLPGRIVENGSEQGSYDADKGIFTIRLPKETPGQHFEGLNMLTALLAPRKSRTAKPLVEEIGASEIPEEVVDDEEFDWEIEQTPCEEVSESALNPQCHYGFGNLRSGVLQRLQDELSDVIDIKDPDFTPAAERRQKRLAAELAKFDPDHYLADFFEDEAIEQILKYNPWWTDKYSKMMAFLEKSQEQENHATLVSFSEEEKYQLRKFVNKSYLLDKRACRQVCYSLIDILLAYCYETRVTEGEKNVESAWNIRKLSPTLCWFETWTNVHDIMVSFGRRVLCYPLYRHFKLVMKAYRDTIKILQLGKILLYLQIWEGKSCKFLVCEDIIMIFAFLLYINK

SEQ ID NO: 747990 - protein, 194 aa, Homo sapiens
MLTPAFDLSQDPDFLTIAIRVPYARVSEFDVYFEGSDFKFYAKPYFLRLTLPGRIVENGSEQGSYDADKGIFTIRLPKETPGQHFEGLNMLTALLAPRKSRTAKPLVEEIGASEIPEEVVDDEEFDWEIEQTPCEEVSESALNPQCHYGFGNLRSGVLQRLQDELSDVIDIKDPDFTPAAQRPGASVFVQLQST

SEQ ID NO: 747991 - protein, 257 aa, Homo sapiens
MVSFGRRVLCYPLYRHFKLVMKAYRDTIKILQLGKSAVLKCLLDIHKIFQENDPAYILNDLYISDYCVWIQKVKSKKLAALAEALKEVSLTKAQLGLELEELEAAALLVQEEETALKAAHSVSGQQTLCSSSEASDSEDSDSSVSSGNEDSGSDSEQDELKDSPSETVSSLQGPFLEESSAFLIADGGVRRNTAIQESDASQGKPLASSWPLGVSGPLIEELGEQLKTTVQVSEPKGTTAVNRSNIQERDGCQTPNN

SEQ ID NO: 747992 - protein, 116 aa, Homo sapiens
MLTPAFDLSQDPDFLTIAIRVPYARVSEFDVYFEGSDFKFYAKPYFLRRVRGAWPQERRIREIAALEGECKVERAVLDCANAFSRRFRSFSWCQGTALFQGCVLDAAEALFLLELS

SEQ ID NO: 747993 - protein, 894 aa, Homo sapiens
MESTLSASNMQDPSSSPLEKCLGSANGNGDLDSEEGSSLEETGFNWGEYLEETGASAAPHTSFKHVEISIQSNFQPGMKLEVANKNNPDTYWVATIITTCGQLLLLRYCGYGEDRRADFWCDVVIADLHPVGWCTQNNKVLMPPDAIKEKYTDWTEFLIRDLTGSRTAPANLLEGPLRGKGPIDLITVGSLIELQDSQNPFQYWIVSVIENVGGRLRLRYVGLEDTESYDQWLFYLDYRLRPVGWCQENKYRMDPPSEIYPLKMASEWKCTLEKSLIDAAKFPLPMEVFKDHADLRSHFFTVGMKLETVNMCEPFYISPASVTKVFNNHFFQVTIDDLRPEPSKLSMLCHADSLGILPVQWCLKNGVSLTPPKGYSGQDFDWADYHKQHGAQEAPPFCFRNTSFSRGFTKNMKLEAVNPRNPGELCVASVVSVKGRLMWLHLEGLQTPVPEVIVDVESMDIFPVGWCEANSYPLTAPHKTVSQKKRKIAVVQPEKQLPPTVPVKKIPHDLCLFPHLDTTGTVNGKYCCPQLFINHRCFSGPYLNKGRIAELPQSVGPGKCVLVLKEVLSMIINAAYKPGRVLRELQLVEDPHWNFQEETLKAKYRGKTYRAVVKIVRTSDQVANFCRRVCAKLECCPNLFSPVLISENCPENCSIHTKTKYTYYYGKRKKISKPPIGESNPDSGHPKPARRRKRRKSIFVQKKRRSSAVDFTAGSGEESEEEDADAMDDDTASEETGSELRDDQTDTSSAEVPSARPRRAVTLRSGSEPVRRPPPERTRRGRGAPAASSAEEGEKCPPTKPEGTEDTKQEEEERLVLESNPLEWTVTDVVRFIKLTDCAPLAKIFQEQDIDGQALLLLTLPTVQECMELKLGPAIKLCHQIERVKVAFYAQYAN

SEQ ID NO: 747994 - protein, 177 aa, Homo sapiens
MQDPSSSPLEKCLGSANGNGDLDSEEGSSLEETGFNWGEYLEETGASAAPHTSFKHVEISIQSNFQPGMKLEVANKNNPDTYWVATIITTCGQLLLLRYCGYGEDRRADFWCDVVIADLHPVGWCTQNNKVLMPPDAIKEKYTDWTEFLIRDLTGSRTAPANLLEGVCIVVIHLMYL

SEQ ID NO: 747995 - protein, 151 aa, Homo sapiens
RPLRNTAITSTTQQILSSRFRDRAPVFCPVCLLYIACSGQSLSSCSGTKYTHPFPKRRAQGLREGWEPSRPGHTMGSLFTLVITHPCRPHFARVRLLGPLRPSPAAPRSAATARPGALPVSLSLSLSSFPPPSPGAGKPGANQPSTAAHAQ

SEQ ID NO: 747996 - protein, 110 aa, Homo sapiens
RSFLFTCAPPLMCPTPVQGQHLPPITQARDTVGTMDFSLPLLPISKLSSHTAQIHSKWPIFYGPVTPHLVGVARTEFLGLWLRLRATHLSPLHCCWSQLPRTLMLSSHFP

SEQ ID NO: 747997 - protein, 159 aa, Homo sapiens
MADVPGAQRAVPGDGPEPRDPLDCWACAVLVTAQNLLVAAFNLLLLVLVLGTILLPAVTMLGFGFLCHSQFLRSQAPPCTAHLRDPGFTALLVTGFLLLVPLLVLALASYRRLCLRLRLADCLVPYSRALYRRRRAPQPRQIRASPGSQAVPTSGKVWV

SEQ ID NO: 747998 - protein, 126 aa, Homo sapiens
MADVPGAQRAVPGDGPEPRDPLDCWACAVLVTAQNLLVAAFNLLLLVLVLGTILLPAVTMLGFGFLCHSQDLKPGIFRPALPPPLPERSPSIPLGAAASVDPVLRKAPTSRKTHFPFTTHISILNI

SEQ ID NO: 747999 - protein, 629 aa, Homo sapiens
MAVPPGHGPFSGFPGPQEHTQVLPDVRLLPRRLPLAFRDATSAPLRKLSVDLIKTYKHINEVYYAKKKRRAQQAPPQDSSNKKEKKVLNHGYDDDNHDYIVRSGERWLERYEIDSLIGKGSFGQVVKAYDHQTQELVAIKIIKNKKAFLNQAQIELRLLELMNQHDTEMKYYIVHLKRHFMFRNHLCLVFELLSYNLYDLLRNTHFRGVSLNLTRKLAQQLCTALLFLATPELSIIHCDLKPENILLCNPKRSAIKIVDFGSSCQLGQRIYQYIQSRFYRSPEVLLGTPYDLAIDMWSLGCILVEMHTGEPLFSGSNEVDQMNRIVEVLGIPPAAMLDQAPKARKYFERLPGGGWTLRRTKELRKDYQGPGTRRLQEVLGVQTGGPGGRRAGEPGHSPADYLRFQDLVLRMLEYEPAARISPLGALQHGFFRRTADEATNTGPAGSSASTSPAPLDTCPSSSTASSISSSGGSSGSSSDNRTYRYSNRYCGGPGPPITDCEMNSPQVPPSQPLRPWAGGDVPHKTHQAPASASSLPGTGAQLPPQPRYLGRPPSPTSPPPPELMDVSLVGGPADCSPPHPAPAPQHPAASALRTRMTGGRPPLPPPDDPATLGPHLGLRGVPQSTAASS

SEQ ID NO: 748000 - protein, 629 aa, Homo sapiens; identical to SEQ ID NO: 747999

SEQ ID NO: 748001 - protein, 601 aa, Homo sapiens
MAVPPGHGPFSGFPGPQEHTQVLPDVRLLPRRLPLAFRDATSAPLRKLSVDLIKTYKHINEVYYAKKKRRAQQAPPQDSSNKKEKKVLNHGYDDDNHDYIVRSGERWLERYEIDSLIGKGSFGQVVKAYDHQTQELVAIKIIKNKKAFLNQAQIELRLLELMNQHDTEMKYYIVHLKRHFMFRNHLCLVFELLSYNLYDLLRNTHFRGVSLNLTRKLAQQLCTALLFLATPELSIIHCDLKPENILLCNPKRSAIKIVDFGSSCQLGQRIYQYIQSRFYRSPEVLLGTPYDLAIDMWSLGCILVEMHTGEPLFSGSNEVDQMNRIVEVLGIPPAAMLDQAPKARKYFERLPGGGWTLRRTKELRKDYQGPGTRRLQEDLVLRMLEYEPAARISPLGALQHGFFRRTADEATNTGPAGSSASTSPAPLDTCPSSSTASSISSSGGSSGSSSDNRTYRYSNRYCGGPGPPITDCEMNSPQVPPSQPLRPWAGGDVPHKTHQAPASASSLPGTGAQLPPQPRYLGRPPSPTSPPPPELMDVSLVGGPADCSPPHPAPAPQHPAASALRTRMTGGRPPLPPPDDPATLGPHLGLRGVPQSTAASS

SEQ ID NO: 748002 - protein, 688 aa, Homo sapiens
LAARPPHWGPHRAPAPRGPRASPDPGLSGGGSRGAGCKKAPPGRAPAPGLAPLRPSEPTMAVPPGHGPFSGFPGPQEHTQVLPDVRLLPRRLPLAFRDATSAPLRKLSVDLIKTYKHINEVYYAKKKRRAQQAPPQDSSNKKEKKVLNHGYDDDNHDYIVRSGERWLERYEIDSLIGKGSFGQVVKAYDHQTQELVAIKIIKNKKAFLNQAQIELRLLELMNQHDTEMKYYIVHLKRHFMFRNHLCLVFELLSYNLYDLLRNTHFRGVSLNLTRKLAQQLCTALLFLATPELSIIHCDLKPENILLCNPKRSAIKIVDFGSSCQLGQRIYQYIQSRFYRSPEVLLGTPYDLAIDMWSLGCILVEMHTGEPLFSGSNEVDQMNRIVEVLGIPPAAMLDQAPKARKYFERLPGGGWTLRRTKELRKDYQGPGTRRLQEVLGVQTGGPGGRRAGEPGHSPADYLRFQDLVLRMLEYEPAARISPLGALQHGFFRRTADEATNTGPAGSSASTSPAPLDTCPSSSTASSISSSGGSSGSSSDNRTYRYSNRYCGGPGPPITDCEMNSPQVPPSQPLRPWAGGDVPHKTHQAPASASSLPGTGAQLPPQPRYLGRPPSPTSPPPPELMDVSLVGGPADCSPPHPAPAPQHPAASALRTRMTGGRPPLPPPDDPATLGPHLGLRGVPQSTAASS

SEQ ID NO: 748003 - protein, 543 aa, Homo sapiens
SCEVCIVFLVGLLAWREKNGAWLCPAPTPFFVTCPAPKVVKAYDHQTQELVAIKIIKNKKAFLNQAQIELRLLELMNQHDTEMKYYIVHLKRHFMFRNHLCLVFELLSYNLYDLLRNTHFRGVSLNLTRKLAQQLCTALLFLATPELSIIHCDLKPENILLCNPKRSAIKIVDFGSSCQLGQRIYQYIQSRFYRSPEVLLGTPYDLAIDMWSLGCILVEMHTGEPLFSGSNEVDQMNRIVEVLGIPPAAMLDQAPKARKYFERLPGGGWTLRRTKELRKDYQGPGTRRLQEVLGVQTGGPGGRRAGEPGHSPADYLRFQDLVLRMLEYEPAARISPLGALQHGFFRRTADEATNTGPAGSSASTSPAPLDTCPSSSTASSISSSGGSSGSSSDNRTYRYSNRYCGGPGPPITDCEMNSPQVPPSQPLRPWAGGDVPHKTHQAPASASSLPGTGAQLPPQPRYLGRPPSPTSPPPPELMDVSLVGGPADCSPPHPAPAPQHPAASALRTRMTGGRPPLPPPDDPATLGPHLGLRGVPQSTAASS

SEQ ID NO: 748004 - protein, 589 aa, Homo sapiens
MAVPPGHGPFSGFPGPQEHTQVLPDVRLLPRRLPLAFRDATSAPLRKLSVDLIKTYKHINEVYYAKKKRRAQQAPPQDSSNKKEKKVLNHGYDDDNHDYIVRSGERWLERYEIDSLIGKGSFGQVVKAYDHQTQELVAIKIIKNKKAFLNQAQIELRLLELMNQHDTEMKYYIVHLKRHFMFRNHLCLVFELLSYNLYDLLRNTHFRGVSLNLTRKLAQQLCTALLFLATPELSIIHCDLKPENILLCNPKRSAIKIVDFGSSCQLGQRIYQYIQSRFYRSPEVLLGTPYDLAIDMWSLGCILVEMHTGEPLFSGSNEVDQMNRIVEVLGIPPAAMLDQAPKARKYFERLPGGGWTLRRTKELRKDLVLRMLEYEPAARISPLGALQHGFFRRTADEATNTGPAGSSASTSPAPLDTCPSSSTASSISSSGGSSGSSSDNRTYRYSNRYCGGPGPPITDCEMNSPQVPPSQPLRPWAGGDVPHKTHQAPASASSLPGTGAQLPPQPRYLGRPPSPTSPPPPELMDVSLVGGPADCSPPHPAPAPQHPAASALRTRMTGGRPPLPPPDDPATLGPHLGLRGVPQSTAASS

SEQ ID NO: 748005 - protein, 675 aa, Homo sapiens
AFRSQQAQEGLLGLSGGGSRGAGCKKAPPGRAPAPGLAPLRPSEPTMAVPPGHGPFSGFPGPQEHTQVLPDVRLLPRRLPLAFRDATSAPLRKLSVDLIKTYKHINEVYYAKKKRRAQQAPPQDSSNKKEKKVLNHGYDDDNHDYIVRSGERWLERYEIDSLIGKGSFGQVVKAYDHQTQELVAIKIIKNKKAFLNQAQIELRLLELMNQHDTEMKYYIVHLKRHFMFRNHLCLVFELLSYNLYDLLRNTHFRGVSLNLTRKLAQQLCTALLFLATPELSIIHCDLKPENILLCNPKRSAIKIVDFGSSCQLGQRIYQYIQSRFYRSPEVLLGTPYDLAIDMWSLGCILVEMHTGEPLFSGSNEVDQMNRIVEVLGIPPAAMLDQAPKARKYFERLPGGGWTLRRTKELRKDYQGPGTRRLQEVLGVQTGGPGGRRAGEPGHSPADYLRFQDLVLRMLEYEPAARISPLGALQHGFFRRTADEATNTGPAGSSASTSPAPLDTCPSSSTASSISSSGGSSGSSSDNRTYRYSNRYCGGPGPPITDCEMNSPQVPPSQPLRPWAGGDVPHKTHQAPASASSLPGTGAQLPPQPRYLGRPPSPTSPPPPELMDVSLVGGPADCSPPHPAPAPQHPAASALRTRMTGGRPPLPPPDDPATLGPHLGLRGVPQSTAASS

SEQ ID NO: 748006 - protein, 629 aa, Homo sapiens; identical to SEQ ID NO: 747999

SEQ ID NO: 748007 - protein, 1265 aa, Homo sapiens
MWRPNNNLSKEKTEWHVEKSSGKLQAAMASVIVRPSSSTKTDSMPAMQLASKDRVSERSSAGAHKTDCLKLAEAGETGRIILPNVNSDSVHTKSEKNFQAVSQGSVPSSVMSAVNTMCNTKTDVITSAADTTSVSSWGGSEVISSLSNTILASTSSECVSSKSVSQPVAQKQECKVSTTAPVTLASSKTGSVVQPSSGFSGTTDFIHLKKHKAALAAAQYKSSNASETEPNAIKNQTLSASLPLDSTVICSTINKANSVGNGQASQTSQPNYHTKLKKAWLTRHSEEDKNTNKMENSGNSVSEIIKPCSVNLIASTSSDIQNSVDSKIIVDKYVKDDKVNRRKAKRTYESGSESGDSDESESKSEQRTKRQPKPTYKKKQNDLQKRKGEIEEDLKPNGVLSRSAKERSKLKLQSNSNTGIPRSVLKDWRKVKKLKQTGESFLQDDSCCEIGPNLQKCRECRLIRSKKGEEPAHSPVFCRFYYFRRLSFSKNGVVRIDGFSSPDQYDDEAMSLWTHENFEDDELDIETSKYILDIIGDKFCQLVTSEKTALSWVKKDAKIAWKRAVRGVREMCDACEATLFNIHWVCQKCGFVVCLDCYKAKERKSSRDKELYAWMKCVKGQPHDHKHLMPTQIIPGSVLTDLLDAMHTLREKYGIKSHCHCTNKQNLQVGNFPTMNGVSQVLQNVLNHSNKISLCMPESQQQNTPPKSEKNGGSSPESDVGTDNKLTPPESQSPLHWLADLAEQKAREEKKENKELTLENQIKEEREQDNSESPNGRTSPLVSQNNEQGSTLRDLLTTTAGKLRVGSTDAGIAFAPVYSMGAPSSKSGRTMPNILDDIIASVVENKIPPSKTSKINVKPELKEEPEESIISAVENNKLYSDIPHSWICEKHILWLKDYKNSSNWKLFKECWKQGQPAVVSGVHKKMNISLWKAESISLDFGDHQADLLNCKDSIISNANVKEFWDGFEEVSKRQKNKSGETVVLKLKDWPSGEDFKTMMPARYEDLLKSLPLPEYCNPEGKFNLASHLPGFFVRPDLGPRLCSAYGVVAAKDHDIGTTNLHIEVSDVVNILVYVGIAKGNGILSKAGILKKFEEEDLDDILRKRLKDSSEIPGALWHIYAGKDVDKIREFLQKISKEQGLEVLPEHDPIRDQSWYVNKKLRQRLLEEYGVRTCTLIQFLGDAIVLPAGALHQVQNFHSCIQVTEDFVSPEHLVESFHLTQELRLLKEEINYDDKLQVKNILYHAVKEMVRALKIHEDEVEDMEEN

SEQ ID NO: 748008 - protein, 1236 aa, Homo sapiens
MWRPNNNLSKEKTEWHVEKSSGKLQAAMASVIVRPSSSTKTDSMPAMQLASKDRVSERSSAGAHKTDCLKLAEAGETGRIILPNVNSDSVHTKSEKNFQAVSQGSVPSSVMSAVNTMCNTKTDVITSAADTTSVSSWGGSEVISSLSNTILASTSSECVSSKSVSQPVAQKQECKVSTTAPVTLASSKTGSVVQPSSGFSGTTDFIHLKKHKAALAAAQYKSSNASETEPNAIKNQTLSASLPLDSTVICSTINKANSVGNGQASQTSQPNYHTKLKKAWLTRHSEEDKNTNKMENSGNSVSEIIKPCSVNLIASTSSDIQNSVDSKIIVDKYVKDDKVNRRKAKRTYESGSESGDSDESESKSEQRTKRQPKPTYKKKQNDLQKRKGEIEEDLKPNGVLSRSAKERSKLKLQSNSNTGIPRSVLKDWRKVKKLKQTGESFLQDDSCCEIGPNLQKCRECRLIRSKKGEEPAHSPVFCRFYYFRRLSFSKNGVVRIDGFSSPDQYDDEAMSLWTHENFEDDELDIETSKYILDIIGDKFCQLVTSEKTALSWVKKDAKIAWKRAVRGVREMCDACEATLFNIHWVCQKCGFVVCLDCYKAKERKSSRDKELYAWMKCVKGQPHDHKHLMPTQIIPGSVLTDLLDAMHTLREKYGIKSHCHCTNKQNLQVGNFPTMNGVSQVLQNVLNHSNKISLCMPESQQQNTPPKSEKNGGSSPESDVGTDNKLTPPESQSPLHWLADLAEQKAREEKKENKELTLENQIKEEREQDNSESPNGRTSPLVSQNNEQGSTLRDLLTTTAGKLRVGSTDAGIAFAPVYSMGAPSSKSGRTMPNILDDIIASVVENKIPPSKTSKINVKPELKEEPEESIISAVENNKLYSDIPHSWICEKHILWLKDYKNSSNWKLFKECWKQGQPAVVSGVHKKMNISLWKAESISLDFGDHQADLLNCKDSIISNANVKEFWDGFEEVSKRQKNKSGETVVLKLKDWPSGEDFKTMMPARYEDLLKSLPLPEYCNPEGKFNLASHLPGFFVRPDLGPRLCSAYGVVAAKDHDIGTTNLHIEVSDVVNILVYVGIAKGNGILSKAGILKKFEEEDLDDILRKRLKDSSEIPGALWHIYAGKDVDKIREFLQKISKEQGLEVLPEHDPIRDQSWYVNKKLRQRLLEEYGVRTCTLIQFLGDAIVLPAGALHQVQNFHSCIQVTEDFVSPEHLVESFHLTQELRLLKEEINYDDKLQ

SEQ ID NO: 748009 - protein, 288 aa, Homo sapiens
MKPSGEDQAALAAGPWEECFQAAVQLALRAGQIIRKALTEEKRVSTKTSAADLVTETDHLVEDLIISELRERFPSHRFIAEEAAASGAKCVLTHSPTWIIDPIDGTCNFVHRFPTVAVSIGFAVRQELEFGVIYHCTEERLYTGRRGRGAFCNGQRLRVSGETDLSKALVLTEIGPKRDPATLKLFLSNMERLLHAKAHGVRVIGSSTLALCHLASGAADAYYQFGLHCWDLAAATVIIREAGGIVIDTSGGPLDLMACRVVAASTREMAMLIAQALQTINYGRDDEK

SEQ ID NO: 748010 - protein, 342 aa, Homo sapiens
MKPSGEDQAALAAGPWEECFQAAVQLALRAGQIIRKALTEEKRVSTKTSAADLVTETDHLVEDLIISELRERFPSHRFIAEEAAASGAKCVLTHSPTWIIDPIDGTCNFVHRFPTVAVSIGFAVRQELEFGVIYHCTEERLYTGRRGRGAFCNGQRLRVSGETEMESHHLAQAGLELMASDLFKGPWVLDRQLVGQKRGPVQTLEGCSMSDIGAGCCIAKASSGVRVDWKLPFGLLASLAQGARCILFTRCAELLESGGCPESSIRKKRADSVIKTFGCCPLDHGASTVVWDTPRKRESHKESVTRTLGGGGKYVCHESHTPRELTHKCHVLHNYASARTII

SEQ ID NO: 748011 - protein, 263 aa, Homo sapiens
EAERAGQIIRKALTEEKRVSTKTSAADLVTETDHLVEDLIISELRERFPSHRFIAEEAAASGAKCVLTHSPTWIIDPIDGTCNFVHRFPTVAVSIGFAVRQELEFGVIYHCTEERLYTGRRGRGAFCNGQRLRVSGETDLSKALVLTEIGPKRDPATLKLFLSNMERLLHAKAHGVRVIGSSTLALCHLASGAADAYYQFGLHCWDLAAATVIIREAGGIVIDTSGGPLDLMACRVVAASTREMAMLIAQALQTINYGRDDEK

SEQ ID NO: 748012 - protein, 264 aa, Homo sapiens
MDIVDQLPIIRKALTEEKRVSTKTSAADLVTETDHLVEDLIISELRERFPSHRFIAEEAAASGAKCVLTHSPTWIIDPIDGTCNFVHRFPTVAVSIGFAVRQELEFGVIYHCTEERLYTGRRGRGAFCNGQRLRVSGETDLSKALVLTEIGPKRDPATLKLFLSNMERLLHAKAHGVRVIGSSTLALCHLASGAADAYYQFGLHCWDLAAATVIIREAGGIVIDTSGGPLDLMACRVVAASTREMAMLIAQALQTINYGRDDEK

SEQ ID NO: 748013 - protein, 257 aa, Homo sapiens
MIIRKALTEEKRVSTKTSAADLVTETDHLVEDLIISELRERFPSHRFIAEEAAASGAKCVLTHSPTWIIDPIDGTCNFVHRFPTVAVSIGFAVRQELEFGVIYHCTEERLYTGRRGRGAFCNGQRLRVSGETDLSKALVLTEIGPKRDPATLKLFLSNMERLLHAKAHGVRVIGSSTLALCHLASGAADAYYQFGLHCWDLAAATVIIREAGGIVIDTSGGPLDLMACRVVAASTREMAMLIAQALQTINYGRDDEK

SEQ ID NO: 748014 - protein, 116 aa, Homo sapiens
MKPSGEDQAALAAGPWEECFQAAVQLALRAGQIIRKALTEEKRVSTKTSAADLVTETDHLVEDLIISELRERFPSHRFIAEEAAASGAKCVLTHSPTWIIDPIDGTCNFVHSLNSE

SEQ ID NO: 748015 - protein, 163 aa, Homo sapiens
QHLRCSVARSAGSCHGTRHLRLAEAVWLVAPGPIFSLQSFGRSAVLHFSLGKMPSRGTSLKSACTPQKRLHSRLHLSSLPSPQGPSDWKLHIGTLPPGLRGRGCLLPVWPALLGSGGCHSHHQRSRRHRDRHFGWTPRPHGLQSGCGQHPGDGDAHSSGLTDD

SEQ ID NO: 748016 - protein, 93 aa, Homo sapiens
LEDPSGLYQGSSTLALCHLASGAADAYYQFGLHCWDLAAATVIIREAGGIVIDTSGGPLDLMACRVVAASTREMAMLIAQALQTINYGRDDEK

SEQ ID NO: 748017 - protein, 134 aa, Homo sapiens
RSSLFFDPENAFGRCKQRPAPQGPACRRFIAEEAAASGAKCVLTHSPTWIIDPIDGTCNFVHSGVAVARSVGRLLGAEAAGVRVIGRSTIGDSGELAVRGRGAAYVATFCGLWAAVGSGLAAGKSVYSCRRHGG

SEQ ID NO: 748018 - protein, 356 aa, Homo sapiens
SVFGLGVCDYVHMMLAWMHVHMGCCLTPWLAVDCAVDPGGEPGSPCRLCGGLECWTWCPVLIGRRVESQSWLSDHAAALAAGPWEECFQAAVQLALRAGQIIRKALTEEKRVSTKTSAADLVTETDHLVEDLIISELRERFPSHRFIAEEAAASGAKCVLTHSPTWIIDPIDGTCNFVHRFPTVAVSIGFAVRQELEFGVIYHCTEERLYTGRRGRGAFCNGQRLRVSGETDLSKALVLTEIGPKRDPATLKLFLSNMERLLHAKAHGVRVIGSSTLALCHLASGAADAYYQFGLHCWDLAAATVIIREAGGIVIDTSGGPLDLMACRVVAASTREMAMLIAQALQTINYGRDDEK

SEQ ID NO: 748019 - protein, 288 aa, Homo sapiens; identical to SEQ ID NO: 748009

SEQ ID NO: 748020 - protein, 288 aa, Homo sapiens; identical to SEQ ID NO: 748009

SEQ ID NO: 748021 - protein, 301 aa, Homo sapiens
MKPSGEDQAALAAGPWEECFQAAVQLALRAGQIIRKALTEEKRVSTKTSAADLVTETDHLVEDLIISELRERFPSHRFIAEEAAASGAKCVLTHSPTWIIDPIDGTCNFVHRFPTVAVSIGFAVRQELEFGVIYHCTEERLYTGRRGRGAFCNGQRLRVSGETDLSKALVLTEIGPKRDPATLKLFLSNMERLLHAKAHGVRVIGSSTLALCHLASGAADAYYQFGLHCWDLAAATVIIREAGGIVIDTSGGPLDLMACRVVAASTREMAMLIAQALQTINYGLLNRRLSHQDLVFSCFSL

SEQ ID NO: 748022 - protein, 128 aa, Homo sapiens
GDEGDSAQLWAAAVSQAVQTQWSCLWKSRTNLLGHKASSILPGCPSSQQPHEEGALPILWTRRQTQLGQVACPGSHRSAVEDPGPLASVFGSSCLLQAVLPVSRHMAWQSGRTSAWGLDWRKEWLPLP

SEQ ID NO: 748023 - protein, 484 aa, Homo sapiens
AGVRGAARGVQVAAVARVLAGAGGTGGDRRGLPQGRRSPLGPRARLTAPPAPAPPRPAPGARGPPALGTRRPPGIGAERSVPAPVPPPPPSGRPPGLAAAAASGPRVPAAGGAGGVGGCRAPPPVRLESTSRARRPASMEEKYLPELMAEKDSLDPSFTHALRLVNQEIEKFQKGEGKDEEKYIDVVINKNMKLGQKVLIPVKQFPKFNFVGKLLGPRGNSLKRLQEETLTKMSILGKGSMRDKAKEEELRKSGEAKYFHLNDDLHVLIEVFAPPAEAYARMGHALEEIKKFLIPDYNDEIRQAQLQELTYLNGGSENADVPVVRGKPTLRTRGVPAPAITRGRGGVTARPVGVVVPRGTPTPRGVLSTRGPVSRGRGLLTPRARGVPPTGYRPPPPPPTQETYGEYDYDDGYGTAYDEQSYDSYDNSYSTPAQSGADYYDYGHGLSEETYDSYGQEEWTNSRHKAPSARTAKGVYRDQPYGRY

SEQ ID NO: 748024 - protein, 409 aa, Homo sapiens
AGVRGAARGVQVAAVARVLAGAGGTGGDRRGLPQGRRSPLGPRARLTAPPAPAPPRPAPGARGPPALGTRRPPGIGAERSVPAPVPPPPPSGRPPGLAAAAASGPRVPAAGGAGGVGGCRAPPPVRLESTSRARRPASMEEKYLPELMAEKDSLDPSFTHALRLVNQEIEKFQKGEGKDEEKYIDVVINKNMKLGQKVLIPVKQFPKFNFVGKLLGPRGNSLKRLQEETLTKMSILGKGSMRDKAKEEELRKSGEAKYFHLNDDLHVLIEVFAPPAEAYARMGHALEEIKKFLIPDYNDEIRQAQLQELTYLNGGSENADVPVVRGKPTLRTRGVPAPAITRGRGGVTARPVGVVVPRGTPTPRGVLSTRGPVSRGRGLLTPRARGVPPTGYRPPPPPPTQETYGEYWC

SEQ ID NO: 748025 - protein, 357 aa, Homo sapiens
SSEEGWRLLKIDKEYLAKNGHRGGGGSSSSSFTHALRLVNKIEKFQKGEGKDEEKYIDVVINKNMKLGQKVLIPVKQFPKFNFVGKLLGPRGNSLKRLQEETLTKMSILGKGSMRDKAKEEELRKSGEAKYFHLNDDLHVLIEVFAPPAEAYARMGHALEEIKKFLIPDYNDEIRQAQLQELTYLNGGSENADVPVVRGKPTLRTRGVPAPAITRGRGGVTARPVGVVVPRGTPTPRGVLSTRGPVSRGRGLLTPRARGVPPTGYRPPPPPPTQETYGEYDYDDGYGTAYDEQSYDSYDNSYSTPAQSGADYYDYGHGLSEETYDSYGQEEWTNSRHKAPSARTAKGVYRDQPYGRY

SEQ ID NO: 748026 - protein, 318 aa, Homo sapiens
MEIEKFQKGEGKDEEKYIDVVINKNMKLGQKVLIPVKQFPKFNFVGKLLGPRGNSLKRLQEETLTKMSILGKGSMRDKAKEEELRKSGEAKYFHLNDDLHVLIEVFAPPAEAYARMGHALEEIKKFLIPDYNDEIRQAQLQELTYLNGGSENADVPVVRGKPTLRTRGVPAPAITRGRGGVTARPVGVVVPRGTPTPRGVLSTRGPVSRGRGLLTPRARGVPPTGYRPPPPPPTQETYGEYDYDDGYGTAYDEQSYDSYDNSYSTPAQSGADYYDYGHGLSEETYDSYGQEEWTNSRHKAPSARTAKGVYRDQPYGRY

SEQ ID NO: 748027 - protein, 341 aa, Homo sapiens
AGVRGAARGVQVAAVARVLAGAGGTGGDRRGLPQGRRSPLGPRARLTAPPAPAPPPVRLESTSRARRPASMEEKYLPELMAEKDSLDPSFTHALRLVNQEIEKFQKGEGKDEEKYIDVVINKNMKLGQKVLIPVKQFPKFNFVGKLLGPRGNSLKRLQEETLTKMSILGKGSMRDKAKEEELRKSGEAKYFHLNDDLHVLIEVFAPPAEAYARMGHALEEIKKFLIPDYNDEIRQAQLQELTYLNGGSENADVPVVRGKPTLRTRGVPAPAITRGRGGVTARPVGVVVPRGTPTPRGVLSTRGPVSRGRGLLTPRARGVPPTGYRPPPPPPTQETYGEYWC

SEQ ID NO: 748028 - protein, 100 aa, Homo sapiens
TETLPHGHTVTWTHWHIHMDGHTDIRRNPHGHTTTLSQGHTDTRRHHMDTPPHYHRDTQTHKRHHYTVTWTHHHRNTQTHCHMDTATHRHTATLSHGHTS

SEQ ID NO: 748029 - protein, 78 aa, Homo sapiens
MRTDSSKMTDVESGVANFASSARAGRRNALPDIQSSAATDGTSDLPLKLEALSVKEDAKEKDEKTTQDQLEKPQNEEK

SEQ ID NO: 748030 - protein, 137 aa, Homo sapiens
KKATVARAPGSDAVARFARRAGHRLGSRARSLGAGRGGRSLRPRVAATAWLRPSPELRRGRIPVDCRGGSELEPESQLRAAERWASASARAPAGQAAARGWSHAILKRHFIKITLGEAENPVPGTGKIGERKFIRIF

SEQ ID NO: 748031 - protein, 128 aa, Homo sapiens
MDLHLDALRSHESASNSSSGSSSRGDQKGHYLCMNNNGNQDTMLGSPDVAMRTDSSKMTDVESGVANFASSARAGRRNALPDIQSSAATDGTSDLPLKLEALSVKEDAKEKDEKTTQDQLEKPQNEEK

SEQ ID NO: 748032 - protein, 137 aa, Homo sapiens; identical to SEQ ID NO: 748030

SEQ ID NO: 748033 - protein, 132 aa, Homo sapiens
KKATVARAPGSDAVARFARRAGHRLGSRARSLGAGRGGRSLRPRVAATAWLRPSPELRRGRIPVDCRGGSELEPESQLRAAERWASASARAPAGQAAARGWSHAILKRHFIKITLGEAENPVPGTGKIGMLL

SEQ ID NO: 748034 - protein, 487 aa, Homo sapiens
MLKREGKVQPYTKTLDGGWGWMIVIHFFLVNVFVMGMTKTFAIFFVVFQEEFEGTSEQIGWIGSIMSSLRFCAGPLVAIICDILGEKTTSILGAFVVTGGYLISSWATSIPFLCVTMGLLPGLGSAFLYQVAAVVTTKYFKKRLALSTAIARSGMGLTFLLAPFTKFLIDLYDWTGALILFGAIALNLVPSSMLLRPIHIKSENNSGIKDKGSSLSAHGPEAHATETHCHETEESTIKDSTTQKAGLPSKNLTVSQNQSEEFYNGPNRNRLLLKSDEESDKVISWSCKQLFDISLFRNPFFYIFTWSFLLSQLAYFIPTFHLVARAKTLGIDIMDASYLVSVAGILETVSQIISGWVADQNWIKKYHYHKSYLILCGITNLLAPLATTFPLLMTYTICFAIFAGGYLALILPVLVDLCRNSTVNRFLGLASFFAGMAVLSGPPIAGWLYDYTQTYNGSFYFSGICYLLSSVSFFFVPLAERWKNSLT

SEQ ID NO: 748035 - protein, 425 aa, Homo sapiens
MGMDDCDSFFPGPLVAIICDILGEKTTSILGAFVVTGGYLISSWATSIPFLCVTMGLLPGLGSAFLYQVAAVVTTKYFKKRLALSTAIARSGMGLTFLLAPFTKFLIDLYDWTGALILFGAIALNLVPSSMLLRPIHIKSENNSGIKDKGSSLSAHGPEAHATETHCHETEESTIKDSTTQKAGLPSKNLTVSQNQSEEFYNGPNRNRLLLKSDEESDKVISWSCKQLFDISLFRNPFFYIFTWSFLLSQLAYFIPTFHLVARAKTLGIDIMDASYLVSVAGILETVSQIISGWVADQNWIKKYHYHKSYLILCGITNLLAPLATTFPLLMTYTICFAIFAGGYLALILPVLVDLCRNSTVNRFLGLASFFAGMAVLSGPPIAGWLYDYTQTYNGSFYFSGICYLLSSVSFFFVPLAERWKNSLT

SEQ ID NO: 748036 - protein, 377 aa, Homo sapiens
MGMDDCDSFFPGLGSAFLYQVAAVVTTKYFKKRLALSTAIARSGMGLTFLLAPFTKFLIDLYDWTGALILFGAIALNLVPSSMLLRPIHIKSENNSGIKDKGSSLSAHGPEAHATETHCHETEESTIKDSTTQKAGLPSKNLTVSQNQSEEFYNGPNRNRLLLKSDEESDKVISWSCKQLFDISLFRNPFFYIFTWSFLLSQLAYFIPTFHLVARAKTLGIDIMDASYLVSVAGILETVSQIISGWVADQNWIKKYHYHKSYLILCGITNLLAPLATTFPLLMTYTICFAIFAGGYLALILPVLVDLCRNSTVNRFLGLASFFAGMAVLSGPPIAGWLYDYTQTYNGSFYFSGICYLLSSVSFFFVPLAERWKNSLT

SEQ ID NO: 748037 - protein, 345 aa, Homo sapiens
EDPSGEQSLWIWMGLTFLLAPFTKFLIDLYDWTGALILFGAIALNLVPSSMLLRPIHIKSENNSGIKDKGSSLSAHGPEAHATETHCHETEESTIKDSTTQKAGLPSKNLTVSQNQSEEFYNGPNRNRLLLKSDEESDKVISWSCKQLFDISLFRNPFFYIFTWSFLLSQLAYFIPTFHLVARAKTLGIDIMDASYLVSVAGILETVSQIISGWVADQNWIKKYHYHKSYLILCGITNLLAPLATTFPLLMTYTICFAIFAGGYLALILPVLVDLCRNSTVNRFLGLASFFAGMAVLSGPPIAGWLYDYTQTYNGSFYFSGICYLLSSVSFFFVPLAERWKNSLT

SEQ ID NO: 748038 - protein, 257 aa, Homo sapiens
MGMDDCDSFFPGPLVAIICDILGEKTTSILGAFVVTGGYLISSWATSIPFLCVTMGLLPGLGSAFLYQVAAVVTTKYFKKRLALSTAIARSGMGLTFLLAPFTKFLIDLYDWTGILETVSQIISGWVADQNWIKKYHYHKSYLILCGITNLLAPLATTFPLLMTYTICFAIFAGGYLALILPVLVDLCRNSTVNRFLGLASFFAGMAVLSGPPIAGWLYDYTQTYNGSFYFSGICYLLSSVSFFFVPLAERWKNSLT

SEQ ID NO: 748039 - protein, 452 aa, Homo sapiens
MLKREGKVQPYTKTLDGGWGWMIVIHFFLVNVFVMGMTKTFAIFFVVFQEEFEGTSEQIGWIGSIMSSLRFCAGPLVAIICDILGEKTTSILGAFVVTGGYLISSWATSIPFLCVTMGLLPGLGSAFLYQVAAVVTTKYFKKRLALSTAIARSGMGLTFLLAPFTKFLIDLYDWTGALILFGAIALNLVPSSMLLRPIHIKSENNSGIKDKGSSLSAHGPEAHATETHCHETEESTIKDSTTQKAGLPSKNLTVSQNQSEEFYNGPNRNRLLLKSDEESDKVISWSCKQLFDISLFRNPFFYIFTWSFLLSQLAYFIPTFHLVARAKTLGIDIMDASYLVSVAGILETVSQIISGWVADQNWIKKYHYHKSYLILCGITNLLAPLATTFPLLMTYTICFAIFAGGYLALILPVLVDLCRNSTVNRFLGLASFFAGMAVLSGPPIAGNTFTTF

SEQ ID NO: 748040 - protein, 170 aa, Homo sapiens
MLKREGKVQPYTKTLDGGWGWMIVIHFFLVNVFVMGMTKTFAIFFVVFQEEFEGTSEQIGWIGSIMSSLRFCAGPLVAIICDILGEKTTSILGAFVVTGGYLISSWATSIPFLCVTMGLLPGLGSAFLYQVAAVVTTKYFKKRLALSTAIARSGMGLTFLLAPFTKFLTS

SEQ ID NO: 748041 - protein, 179 aa, Homo sapiens
MLKREGKVQPYTKTLDGGWGWMIVIHFFLVNVFVMGMTKTFAIFFVVFQEEFEGTSEQIGWIGSIMSSLRFCAGPLVAIICDILGEKTTSILGAFVVTGGYLISSWATSIPFLCVTMGLLPGLGSAFLYQVAAVVTTKYFKKRLALSTAIARSGMGLTFLLAPFTKFLIDLYDWTGTSF

SEQ ID NO: 748042 - protein, 110 aa, Homo sapiens
WSFLLSQLAYFIPTFHLVARAKTLGIDIMDASYLVSVAGKKAYISLLPKRKDQLNFTSLLHFNKKLKKNKRGIVEGPEKVKFLRLDGAPGHFPGRDLCHCTQAPLLDSGP

SEQ ID NO: 748043 - protein, 228 aa, Homo sapiens
CQPSTRSTLQAKAQKFLEVVYQNLLCETLLNWLHQGEISSPRRVLLIVSSRKHLQRLAFQAKVSSMMLPLQGAQMLQMLEKSLRKSLPASLKVYGTVFHINHGNPFNLKAVVDKWPDFNTVVVCPQEQDMTDDLDHYTNTYQIYSKDPQNCQEFLGSPELINWKQHLQIQSSQPSLNEAIQNLAAIKSFKVKQTQRILYMAAETAKELTPFLLKSKILSPSGGKPKAM

SEQ ID NO: 748044 - protein, 361 aa, Homo sapiens
CQPSTRSTLQAKAQKFLEVVYQNLLCETLLNWLHQGEISSPRRVLLIVSSRKHLQRLAFQAKVSSMMLPLQGAQMLQMLEKSLRKSLPASLKVYGTVFHINHGNPFNLKAVVDKWPDFNTVVVCPQEQDMTDDLDHYTNTYQIYSKDPQNCQEFLGSPELINWKQHLQIQSSQPSLNEAIQNLAAIKSFKVKQTQRILYMAAETAKELTPFLLKSKILSPSGGKPKAINQEMFKLSSMDVTHAHLVNKFWHFGGNERSQRFIERCIQTFPTCCLLGPEGTPVCWDLMDQTGEMRMAGTLPEYRLHGLVTYVIYSHAQKLGKLGFPVYSHVDYSNEAMQKMSYTLQHVPIPRSWNQWNCVPL

SEQ ID NO: 748045 - protein, 295 aa, Homo sapiens
MLPLQGAQMLQMLEKSLRKSLPASLKVYGTVFHINHGNPFNLKAVVDKWPDFNTVVVCPQEQDMTDDLDHYTNTYQIYSKDPQNCQEFLGSPELINWKQHLQIQSSQPSLNEAIQNLAAIKSFKVKQTQRILYMAAETAKELTPFLLKSKILSPSGGKPKAINQEMFKLSSMDVTHAHLVNKFWHFGGNERSQRFIERCIQTFPTCCLLGPEGTPVCWDLMDQTGEMRMAGTLPEYRLHGLVTYVIYSHAQKLGKLGFPVYSHVDYSNEAMQKMSYTLQHVPIPRSWNQWNCVPL

SEQ ID NO: 748046 - protein, 243 aa, Homo sapiens
CQPSTRSTLQAKAQKFLEVVYQNLLCETLLNWLHQGEISSPRRVLLIVSSRKHLQRLAFQAKVSSMMLPLQGAQMLQMLEKSLRKSLPASLKVYGTVFHINHGNPFNLKAVVDKWPDFNTVVVCPQEQDMTDDLDHYTNTYQIYSKDPQNCQEFLGSPELINWKQHLQIQSSQPSLNEAIQNLAAIKSFKVKQTQRILYMAAETAKELTPFLLKSKILSPSGGKPKAIGSLVKNPSFFPIPTL

SEQ ID NO: 748047 - protein, 160 aa, Homo sapiens
CQPSTRSTLQAKAQKFLEVVYQNLLCETLLNWLHQGEISSPRRVLLIVSSRKHLQRLAFQAKVSSMMLPLQGAQMLQMLEKSLRKSLPASLKVYGTVFHINHGNPFNLKAVVDKWPDFNTVVVCPQEQDMTDDLDHYTNTYQIYSKDPLQIQSSQPSLNE

SEQ ID NO: 748048 - protein, 122 aa, Homo sapiens
CQPSTRSTLQAKAQKFLEVVYQNLLCETLLNWLHQGEISSPRRVLLIVSSRKHLQRLAFQAKVSSMMLPLQGAQMLQMLEKSLRKSLPASLKVIMENSERSKEDKLDVKEEGKGLIFMMHLF

SEQ ID NO: 748049 - protein, 70 aa, Homo sapiens
CQPSTRSTLQAKAQKFLEVVYQNLLCETLLNWLHQGEISSPRRVLLIVSSRKHLQRLAFQVRTHYKVSDT

SEQ ID NO: 748050 - protein, 228 aa, Homo sapiens; identical to SEQ ID NO: 748043

SEQ ID NO: 748051 - protein, 343 aa, Homo sapiens
CQPSTRSTLQAKAQKFLEVVYQNLLCETLLNWLHQGEISSPRRVLLIVSSRKHLQRLAFQAKVSSMMLPLQGAQMLQMLEKSLRKSLPASLKVYGTVFHINHGNPFNLKAVVDKWPDFNTVVVCPQEQDMTDDLDHYTNTYQIYSKDPQNCQEFLGSPELINWKQHLQIQSSQPSLNEAIHMAAETAKELTPFLLKSKILSPSGGKPKAINQEMFKLSSMDVTHAHLVNKFWHFGGNERSQRFIERCIQTFPTCCLLGPEGTPVCWDLMDQTGEMRMAGTLPEYRLHGLVTYVIYSHAQKLGKLGFPVYSHVDYSNEAMQKMSYTLQHVPIPRSWNQWNCVPL

SEQ ID NO: 748052 - protein, 319 aa, Homo sapiens
MPFPNCSAPSTVVATAVGVLLGLECGLGLLGNAVALWTFLFRVRVWKPYAVYLLNLALADLLLAACLPFLAAFYLSLQAWHLGRVGCWALHFLLDLSRSVGMAFLAAVALDRYLRVVHPRLKVNLLSPQAALGVSGLVWLLMVALTCPGLLISEAAQNSTRCHSFYSRADGSFSIIWQEALSCLQFVLPFGLIVFCNAGIIRALQKRLREPEKQPKLQRAQALVTLVVVLFALCFLPCFLARVLMHIFQNLGSCRALCAVAHTSDVTGSLTYLHSVLNPVVYCFSSPTFRSSYRRVFHTLRGKGQAAEPPDFNPRDSYS

SEQ ID NO: 748053 - protein, 973 aa, Homo sapiens
MAQLYYKKVNYSPYRDRIPLQIVRAETELSAEEKAFLNAVEKGDYATVKQALQEAEIYYNVNINCMDPLGRSALLIAIENENLEIMELLLNHSVYVGDALLYAIRKEVVGAVELLLSYRRPSGEKQVPTLMMDTQFSEFTPDITPIMLAAHTNNYEIIKLLVQKRVTIPRPHQIRCNCVECVSSSEVDSLRHSRSRLNIYKALASPSLIALSSEDPILTAFRLGWELKELSKVENEFKAEYEELSQQCKLFAKDLLDQARSSRELEIILNHRDDHSEELDPQKYHDLAKLKVAIKYHQKEFVAQPNCQQLLATLWYDGFPGWRRKHWVVKLLTCMTIGFLFPMLSIAYLISPRSNLGLFIKKPFIKFICHTASYLTFLFMLLLASQHIVRTDLHVQGPPPTVVEWMILPWVLGFIWGEIKEMWDGGFTEYIHDWWNLMDFAMNSLYLATISLKIVAYVKYNGSRPREEWEMWHPTLIAEALFAISNILSSLRLISLFTANSHLGPLQISLGRMLLDILKFLFIYCLVLLAFANGLNQLYFYYETRAIDEPNNCKGIRCEKQNNAFSTLFETLQSLFWSVFGLLNLYVTNVKARHEFTEFVGATMFGTYNVISLVVLLNMLIAMMNNSYQLIADHADIEWKFARTKLWMSYFDEGGTLPPPFNIIPSPKSFLYLGNWFNNTFCPKRDPDGRRRRRNLRSFTERNADSLIQNQHYQEVIRNLVKRYVAAMIRNSKTHEGLTEENFKELKQDISSFRYEVLDLLGNRKHPRSFSTSSTELSQRDDNNDGSGGARAKSKSVSFNLGCKKKTCHGPPLIRTMPRSSGAQGKSKAESSSKRSFMGPSLKKLGLLFSKFNGHMSEPSSEPMYTISDGIVQQHCMWQDIRYSQMEKGKAEACSQSEINLSEVELGEVQGAAQSSECPLACSSSLHCASSICSSNSKLLDSSEDVFETWGEACDLLMHKWGDGQEEQVTTRL

SEQ ID NO: 748054 - protein, 320 aa, Homo sapiens
LGVAVMLGLNHTSMSEFILVGFSAFPHLQLMLFLLFLLMYLFTLLGNLLIMATVWSERSLHTPMYLFLCVLSVSEILYTVAIIPRMLADLLSTQRSIAFLACASQMFFSFSFGFTHSFLLTVMGYDRYVAICHPLRYNVLMSPRGCACLVGCSWAGGSVMGMVVTSAIFQLTFCGSHEIQHFLCHVPPLLKLACGNNVPAVALGVGLVCIMALLGCFLLILLSYAFIVADILKIPSAEGRNKAFSTCASHLIVVIVHYGFASVIYLKPKGPHSQEGDTLMATTYAVLTPFLSPIIFSLRNKELKVAMKRTFLSTLYSSGT

SEQ ID NO: 748055 - protein, 442 aa, Homo sapiens
GPLRAAPEEVPGPGGAVRPSWSCGSRTVRGVEGRGRARCQPRCSRPGSMALVTVSRSPPGSGASTPVGPWDQAVQRRSRLQRRQSFAVLRGAVLGLQDGGDNDDAAEASSEPTEKAPSEEELHGDQTDFGQGSQSPQKQEEQRQHLHLMVQLLRPQDDIRLAAQLEAPRPPRLRYLLVVSTREGEGLSQDETVLLGVDFPDSSSPSCTLGLVLPLWSDTQVYLDGDGGFSVTSGGQSRIFKPISIQTMWATLQVLHQACEAALGSGLVPGGSALTWASHYQERLNSEQSCLNEWTAMADLESLRPPSAEPGGSSEQEQMEQAIRAELWKVLDLESTSETSDMPEVFSSHESSHEEPLQPFPQLARTKGGQQVDRGPQPALKSRQSVVTLQGSAVVANRTQAFQEQEQGQGQGQGEPCISSTPRFRKVVRQASVHDSGEEGEA

SEQ ID NO: 748056 - protein, 392 aa, Homo sapiens
GPLRAAPEEVPGPGGAVRPSWSCGSRTVRGVEGRGRARCQPRCSRPGSMALVTVSRSPPGSGASTPVGPWDQAVQRRSRLQRRQSFAVLRGAVLGLQDGGDNDDAAEASSEPTAPSFILNSSPAHSPMAREIDNFYPERFTYHNVRLWDEESAQLLPHWKETHRFIEAARAQGTHVLVHCKMGVSRSAATVLAYAMKQYECSLEQALRHVQELRPIARPNPGFLRQLQIYQGILTASEGGGEEKVVGMEESQAAPKEEPGPRPRINLRGVMRSISLLEPSLELESTSETSDMPEVFSSHESSHEEPLQPFPQLARTKGGQQVDRGPQPALKSRQSVVTLQGSAVVANRTQAFQEQEQGQGQGQGEPCISSTPRFRKVVRQASVHDSGEEGEA

SEQ ID NO: 748057 - protein, 91 aa, Homo sapiens
ASPNSRIPERGEGTALPALTLPWGCSLGRTRRSSEGVDSSEGRALRCSVGLSWDVFAAVPRPPVTPRQITGHQARDSLLFVLSGLWLVSFS

SEQ ID NO: 748058 - protein, 707 aa, Homo sapiens
GPLRAAPEEVPGPGGAVRPSWSCGSRTVRGVEGRGRARCQPRCSRPGSMALVTVSRSPPGSGASTPVGPWDQAVQRRSRLQRRQSFAVLRGAVLGLQDGGDNDDAAEASSEPTEKAPSEEELHGDQTDFGQGSQSPQKQEEQRQHLHLMVQLLRPQDDIRLAAQLEAPRPPRLRYLLVVSTREGEGLSQDETVLLGVDFPDSSSPSCTLGLVLPLWSDTQVYLDGDGGFSVTSGGQSRIFKPISIQTMWATLQVLHQACEAALGSGLVPGGSALTWASHYQERLNSEQSCLNEWTAMADLESLRPPSAEPGGSSEQEQMEQAIRAELWKVLDVSDLESVTSKEIRQALELRLGLPLQQYRDFIDNQMLLLVAQRDRASRIFPHLYLGSEWNAANLEELQRNRVTHILNMAREIDNFYPERFTYHNVRLWDEESAQLLPHWKETHRFIEAARAQGTHVLVHCKMGVSRSAATVLAYAMKQYECSLEQALRHVQELRPIARPNPGFLRQLQIYQGILTASRQSHVWEQKVGGVSPEEHPAPEVSTPFPPLPPEPEGGGEEKVVGMEESQAAPKEEPGPRPRINLRGVMRSISLLEPSLELESTSETSDMPEVFSSHESSHEEPLQPFPQLARTKGGQQVDRGPQPALKSRQSVVTLQGSAVVANRTQAFQEQEQGQGQGQGEPCISSTPRFRKVVRQASVHDSGEEGEA

SEQ ID NO: 748059 - protein, 666 aa, Homo sapiens
ASPNSRIPERGGGDSPPRPHPALGLLSRQDQAVQRRSRLQRRQSFAVLRGAVLGLQDGGDNDDAAEASSEPTEKAPSEEELHGDQTDFGQGSQSPQKQEEQRQHLHLMVQLLRPQDDIRLAAQLEAPRPPRLRYLLVVSTREGEGLSQDETVLLGVDFPDSSSPSCTLGLVLPLWSDTQVYLDGDGGFSVTSGGQSRIFKPISIQTMWATLQVLHQACEAALGSGLVPGGSALTWASHYQERLNSEQSCLNEWTAMADLESLRPPSAEPGGSSEQEQMEQAIRAELWKVLDVSDLESVTSKEIRQALELRLGLPLQQYRDFIDNQMLLLVAQRDRASRIFPHLYLGSEWNAANLEELQRNRVTHILNMAREIDNFYPERFTYHNVRLWDEESAQLLPHWKETHRFIEAARAQGTHVLVHCKMGVSRSAATVLAYAMKQYECSLEQALRHVQELRPIARPNPGFLRQLQIYQGILTASRQSHVWEQKVGGVSPEEHPAPEVSTPFPPLPPEPEGGGEEKVVGMEESQAAPKEEPGPRPRINLRGVMRSISLLEPSLELESTSETSDMPEVFSSHESSHEEPLQPFPQLARTKGGQQVDRGPQPALKSRQSVVTLQGSAVVANRTQAFQEQEQGQGQGQGEPCISSTPRFRKVVRQASVHDSGEEGEA

SEQ ID NO: 748060 - protein, 498 aa, Homo sapiens
MLVGLGLIGEARCLIWRRGFSVTSGGQSRIFKPISIQTMWATLQVLHQACEAALGSGLVPGGSALTWASHYQERLNSEQSCLNEWTAMADLESLRPPSAEPGGSSEQEQMEQAIRAELWKVLDVSDLESVTSKEIRQALELRLGLPLQQYRDFIDNQMLLLVAQRDRASRIFPHLYLGSEWNAANLEELQRNRVTHILNMAREIDNFYPERFTYHNVRLWDEESAQLLPHWKETHRFIEAARAQGTHVLVHCKMGVSRSAATVLAYAMKQYECSLEQALRHVQELRPIARPNPGFLRQLQIYQGILTASRQSHVWEQKVGGVSPEEHPAPEVSTPFPPLPPEPEGGGEEKVVGMEESQAAPKEEPGPRPRINLRGVMRSISLLEPSLELESTSETSDMPEVFSSHESSHEEPLQPFPQLARTKGGQQVDRGPQPALKSRQSVVTLQGSAVVANRTQAFQEQEQGQGQGQGEPCISSTPRFRKVVRQASVHDSGEEGEA

SEQ ID NO: 748061 - protein, 673 aa, Homo sapiens
GPLRAAPEEVPGPGGAVRPSWSCGSRTVRGVEGRGRARCQPRCSRPGSMALVTVSRSPPGSGASTPVGPWDQAVQRRSRLQRRQSFAVLRGAVLGLQDGGDNDDAAEASSEPTEKAPSEEELHGDQTDFGQGSQSPQKQEEQRQHLHLMVQLLRPQDDIRLAAQLEAPRPPRLRYLLVVSTREGEGLSQDETVLLGVDFPDSSSPSCTLGLVLPLWSDTQVYLDGDGGFSVTSGGQSRIFKPISIQTMWATLQVLHQACEAALGSGLVPGGSALTWASHYQERLNSEQSCLNEWTAMADLESLRPPSAEPGGSSEQEQMEQAIRAELWKVLDVSDLESVTSKEIRQALELRLGLPLQQYRDFIDNQMLLLVAQRDRASRIFPHLYLGSEWNAANLEELQRNRVTHILNMAREIDNFYPERFTYHNVRLWDEESAQLLPHWKETHRFIEAARAQGTHVLVHCKMGVSRSAATVLAYAMKQYECSLEQALRHVQELRPIARPNPGFLRQLQIYQGILTASEGGGEEKVVGMEESQAAPKEEPGPRPRINLRGVMRSISLLEPSLELESTSETSDMPEVFSSHESSHEEPLQPFPQLARTKGGQQVDRGPQPALKSRQSVVTLQGSAVVANRTQAFQEQEQGQGQGQGEPCISSTPRFRKVVRQASVHDSGEEGEA

SEQ ID NO: 748062 - protein, 658 aa, Homo sapiens
GPLRAAPEEVPGPGGAVRPSWSCGSRTVRGVEGRGRARCQPRCSRPGSMALVTVSRSPPGSGASTPVGPWDQAVQRRSRLQRRQSFAVLRGAVLGLQDGGDNDDAAEASSEPTEKAPSEEELHGDQTDFGQGSQSPQKQEEQRQHLHLMVQLLRPQDDIRLAAQLEAPRPPRLRYLLVVSTREGEGLSQDETVLLGVDFPDSSSPSCTLGLVLPLWSDTQVYLDGDGGFSVTSGGQSRIFKPISIQTMWATLQVLHQACEAALGSGLVPGGSALTWASHYQERLNSEQSCLNEWTAMADLESLRPPSAEPGGSSEQEQMEQAIRAELWKVLDVSDLESVTSKEIRQALELRLGLPLQQYRDFIDNQMLLLVAQRDRASRIFPHLYLGSEWNAANLEELQRNRAQGTHVLVHCKMGVSRSAATVLAYAMKQYECSLEQALRHVQELRPIARPNPGFLRQLQIYQGILTASRQSHVWEQKVGGVSPEEHPAPEVSTPFPPLPPEPEGGGEEKVVGMEESQAAPKEEPGPRPRINLRGVMRSISLLEPSLELESTSETSDMPEVFSSHESSHEEPLQPFPQLARTKGGQQVDRGPQPALKSRQSVVTLQGSAVVANRTQAFQEQEQGQGQGQGEPCISSTPRFRKVVRQASVHDSGEEGEA

SEQ ID NO: 748063 - protein, 707 aa, Homo sapiens; identical to SEQ ID NO: 748058

SEQ ID NO: 748064 - protein, 304 aa, Homo sapiens
MYEAGWYSAEGHFYPERFTYHNVRLWDEESAQLLPHWKETHRFIEAARAQGTHVLVHCKMGVSRSAATVLAYAMKQYECSLEQALRHVQELRPIARPNPGFLRQLQIYQGILTASRQSHVWEQKVGGVSPEEHPAPEVSTPFPPLPPEPEGGGEEKVVGMEESQAAPKEEPGPRPRINLRGVMRSISLLEPSLELESTSETSDMPEVFSSHESSHEEPLQPFPQLARTKGGQQVDRGPQPALKSRQSVVTLQGSAVVANRTQAFQEQEQGQGQGQGEPCISSTPRFRKVVRQASVHDSGEEGEA

SEQ ID NO: 748065 - protein, 426 aa, Homo sapiens
GPLRAAPEEVPGPGGAVRPSWSCGSRTVRGVEGRGRARCQPRCSRPGSMALVTVSRSPPGSGASTPVGPWDQAVQRRSRLQRRQSFAVLRGAVLGLQDGGDNDDAAEASSEPTAPSFILNSSPAHSPMAREIDNFYPERFTYHNVRLWDEESAQLLPHWKETHRFIEAARAQGTHVLVHCKMGVSRSAATVLAYAMKQYECSLEQALRHVQELRPIARPNPGFLRQLQIYQGILTASRQSHVWEQKVGGVSPEEHPAPEVSTPFPPLPPEPEGGGEEKVVGMEESQAAPKEEPGPRPRINLRGVMRSISLLEPSLELESTSETSDMPEVFSSHESSHEEPLQPFPQLARTKGGQQVDRGPQPALKSRQSVVTLQGSAVVANRTQAFQEQEQGQGQGQGEPCISSTPRFRKVVRQASVHDSGEEGEA

SEQ ID NO: 748066 - protein, 707 aa, Homo sapiens; identical to SEQ ID NO: 748058

SEQ ID NO: 748067 - protein, 106 aa, Homo sapiens
MKTELPVQKGSRLPPPPPPCTSCPLPVHSWNQPGQATSGPQRQAGSSGPSRGRLEGLADRFPHPPPPVQVFAAVPRPPVTPRQITGHQARDSLLFVLSGLWLVSFS

SEQ ID NO: 748068 - protein, 670 aa, Homo sapiens
GPLRAAPEEVPGPGGAVRPSWSCGSRTVRGVEGRGRARCQPRCSRPGSMALVTVSRSPPGSGASTPVGPWDQAVQRRSRLQRRQSFAVLRGAVLGLQDGGDNDDAAEASSEPTEKAPSEEELHGDQTDFGQGSQSPQKQEEQRQHLHLMVQLLRPQDDIRLAAQLEAPRPPRLRYLLVVSTREGEGLSQDETVLLGVDFPDSSSPSCTLGLVLPLWSDTQVYLDGDGGFSVTSGGQSRIFKPISIQTMWATLQVLHQACEAALGSGLVPGGSALTWASHYQERLNSEQSCLNEWTAMADLESLRPPSAEPGGSSEQEQMEQAIRAELWKVLDVSDLESVTSKEIRQALELRLGLPLQQYRDFIDNQMLLLVAQRDRASRIFPHLYLGSEWNAANLEELQRNRVTHILNMAREIDNFYPERFTYHNVRLWDEESAQLLPHWKETHRFIEAARAQGTHVLVHCKMGVSRSAATVLAYAMKQYECSLEQALRHVQELRPIARPNPGFLRQLQIYQGILTASRQSHVWEQKVGGVSPEEHPAPEVSTPFPPLPPEPEGGGEEKVVGMEESQAAPKEEPGPRPRINLRGVMRSISLLEPSLELESTSETSDMPEVFSSHESSHEGLADRFPHPPPPVQVFAAVPRPPVTPRQITGHQARDSLLFVLSGLWLVSFS

SEQ ID NO: 748069 - protein, 636 aa, Homo sapiens
GPLRAAPEEVPGPGGAVRPSWSCGSRTVRGVEGRGRARCQPRCSRPGSMALVTVSRSPPGSGASTPVGPWDQAVQRRSRLQRRQSFAVLRGAVLGLQDGGDNDDAAEASSEPTEKAPSEEELHGDQTDFGQGSQSPQKQEEQRQHLHLMVQLLRPQDDIRLAAQLEAPRPPRLRYLLVVSTREGEGLSQDETVLLGVDFPDSSSPSCTLGLVLPLWSDTQVYLDGDGGFSVTSGGQSRIFKPISIQTMWATLQVLHQACEAALGSGLVPGGSALTWASHYQERLNSEQSCLNEWTAMADLESLRPPSAEPGGSSEQEQMEQAIRAELWKVLDVSDLESVTSKEIRQALELRLGLPLQQYRDFIDNQMLLLVAQRDRASRIFPHLYLGSEWNAANLEELQRNRVTHILNMAREIDNFYPERFTYHNVRLWDEESAQLLPHWKETHRFIEAARAQGTHVLVHCKMGVSRSAATVLAYAMKQYECSLEQALRHVQELRPIARPNPGFLRQLQIYQGILTASEGGGEEKVVGMEESQAAPKEEPGPRPRINLRGVMRSISLLEPSLELESTSETSDMPEVFSSHESSHEGLADRFPHPPPPVQVFAAVPRPPVTPRQITGHQARDSLLFVLSGLWLVSFS

SEQ ID NO: 748070 - protein, 598 aa, Homo sapiens
GPLRAAPEEVPGPGGAVRPSWSCGSRTVRGVEGRGRARCQPRCSRPGSMALVTVSRSPPGSGASTPVGPWDQAVQRRSRLQRRQSFAVLRGAVLGLQDGGDNDDAAEASSEPTEKAPSEEELHGDQTDFGQGSQSPQKQEEQRQHLHLMVQLLRPQDDIRLAAQLEAPRPPRLRYLLVVSTREGEGLSQDETVLLGVDFPDSSSPSCTLGLVLPLWSDTQVYLDGDGGFSVTSGGQSRIFKPISIQTMWATLQVLHQACEAALGSGLVPGGSALTWASHYQERLNSEQSCLNEWTAMADLESLRPPSAEPGGSSEQEQMEQAIRAELWKVLDVSDLESVTSKEIRQALELRLGLPLQQYRDFIDNQMLLLVAQRDRASRIFPHLYLGSEWNAANLEELQRNRVTHILNMAREIDNFYPERFTYHNVRLWDEESAQLLPHWKETHRFIEAARAQGTHVLVHCKMGVSRSAATVLAYAMKQYECSLEQALRHVQELRPIARPNPGFLRQLQIYQGILTASRQSHVWEQKVGGVSPEEHPAPEVSTPFPPLPPEPVGGGPAPNSPLFEFDYKKLARFLQTFCLGKPWGLRNILEFGPISSF

SEQ ID NO: 748071 - protein, 243 aa, Homo sapiens
GPLRAAPEEVPGPGGAVRPSWSCGSRTVRGVEGRGRARCQPRCSRPGSMALVTVSRSPPGSGASTPVGPWDQAVQRRSRLQRRQSFAVLRGAVLGLQDGGDNDDAAEASSEPTEKAPSEEELHGDQTDFGQGSQSPQKQEEQRQHLHLMVQLLRPQDDIRLAAQLEAPRPPRLRYLLVVSTREGEGLSQDETVLLGVDFPDSRFEQGEERRGKEVRDRGDNGFPSVPCQLPQLHPGPGLAPLE

SEQ ID NO: 748072 - protein, 518 aa, Homo sapiens
MIPEVPGLLDLCDSGSSGAFRGVLGPLERGISSNGGGCSSRNNSHNIGSRSSSGGGGGDGGSSLPDSDPHSHRPVPEGGRRGGGSDGSDGSGGRGDSGAYDGSGACGGSDACDGSGDSSGDSWTKQVTCRYFKYGICKEGDNCRYSHDLSDRLCGVVCKYFQRGCCVYGDRCRCEHSKPLKQEEATATELTTKSSLAASSSLSSIVGPLVEMNTNEAESRNSNFATVVAGSEDWANAIEFVPGQPYCGRTVPSCTEAPLQGSVTKEESEEEQTAVETKKQLCPYAAVGQCRYGENCVYLHGDLCDMCGLQVLHPMDAAQRSQHIQACIEAHEKDMEFSFAVQRSKDKVCGICMEVVYEKANPNEHRFGILSNCNHTFCLKCIRKWRSAKEFESRIVKSCPQCRITSNFVIPSEYWVEEKEEKQKLIQKYKEAMSNKACKYFDEGRGSCPFGENCFYKHMYPDGRREEPQRQQVGTSSRNPGQQRNHFWEFFEEGANSNPFDDEEEAVTFELGEMLLML

SEQ ID NO: 748073 - protein, 36 aa, Homo sapiens
MAKPQDERSCIFESPLEKGLSKWICRDVFSNTPLLS

SEQ ID NO: 748074 - protein, 153 aa, Homo sapiens
GIEAQQVVLLLEDYQFVHPTFLEMINSLLSSGEVPGLYTLEELEPLLLPLKDQASQDGFFGPVFNYFTYRIQQNLHIVLIMDSANSNFMINCESNPALHKKCQVLWMEGWSNSSMKKIPEMLFSETGGGEKYNDKKRKEEKKKNSGSILIKSV

SEQ ID NO: 748075 - protein, 143 aa, Homo sapiens
GLENRAHSEQFNAFFRLPKGESLKEVHECFLWVPFSHFNTHGKMCISENYICFASQDGNQCSVIIPLREVLAIDKTNDSSKSVIISIKGKTAFRFHEVKDFEQLVAKLRLRCGAASTQYHDISTEVINYTAIKSFGKKGVCLV

SEQ ID NO: 748076 - protein, 176 aa, Homo sapiens
GLENRAHSEQFNAFFRLPKGESLKEVHECFLWVPFSHFNTHGKMCISENYICFASQDGNQCSVIIPLREVLAIDKTNDSSKSVIISIKGKTAFRFHEVKDFEQLVAKLRLRCGAASTQYHDISTELAISSESTEPSDNFEVQSLTSQRECSKTVNTEALMTVFHPQNLETLNSKMV

SEQ ID NO: 748077 - protein, 231 aa, Homo sapiens
MFLVGLTGGIASGKSSVIQVFQQLGCAVIDVDVMARHVVQPGYPAHRRIVEVFGTEVLLENGDINRKVLGDLIFNQPDRRQLLNAITHPEIRKEMMKETFKYFLRGYRYVILDIPLLFETKKLLKYMKHTVVVYCDRDTQLARLMRRNSLNRKDAEARINAQLPLTDKARMARHVLDNSGEWSVTKRQVILLHTELERSLEYLPLRFGVLTGLAAIASLLYLLTHYLLPYA

SEQ ID NO: 748078 - protein, 231 aa, Homo sapiens; identical to SEQ ID NO: 748077

SEQ ID NO: 748079 - protein, 231 aa, Homo sapiens; identical to SEQ ID NO: 748077

SEQ ID NO: 748080 - protein, 231 aa, Homo sapiens; identical to SEQ ID NO: 748077

SEQ ID NO: 748081 - protein, 737 aa, Homo sapiens
MRSFSGPLIREDVHKVDIMTFCQQKAAQSCKSETLGSRDSALLWQLLVLLCRQNGSMVGSDIAELLMQDCKKLEKYKRQPPVANLINLTDEDWPVLSSGTPNLLTGEIPPSVETPAQIVEKFTRLLYYGRKKEALEWAMKNHLWGHALFLSSKMDPQTYSWVMSGFTSTLALNDPLQTLFQLMSGRIPQAATCCGEKQWGDWRPHLAVILSNQAGDPELYQRAIVAIGDTLAGKGLVEAAHFCYLMAHVPFGHYTVKTDHLVLLGSSHSQEFLKFATTEAIQRTEIFEYCQMLGRPKSFIPSFQVYKLLYASRLADYGLVSQALHYCEAIGAAVLSQGESSHPVLLVELIKLAEKLKLSDPLVLERRSGDRDLEPDWLAQLRRQLEQKVAGDIGDPHPTRSDISGAGGTTTENTFYQDFSGCQGYSEAPGYRSALWLTPEQTCLLQPSPQQPFPLQPGSYPAGGGAGQTGTPRPFYSVPETHLPGTGSSVAVTEATGGTVWEEMLQTHLGPGENTVSQETSQPPDGQEVISKPQTPLAARPRSISESSASSAKEDEKESSDEADKNSPRNTAQRGKLGDGKEHTKSSGFGWFSWFRSKPTKNASPAGDEDSSDSPDSEETPRASSPHQAGLGLSLTPSPESPPLPDVSAFSRGRGGGEGRGSASSGGAAAGAGVGGLSGPESVSFELCSNPGVLLPPPALKGAVPLYNPSQVPQLPTATSLNRPNRLAQRRYPTQPC

SEQ ID NO: 748082 - protein, 614 aa, Homo sapiens
MELWAPQRLPQTRGKATAPSKDPDRGFRRDGHHRPVPHSWHNGERFHQWQDNRGSPQPQQEPRADHQQQPHYASRPGDWHQPVSGVDYYEGGYRNQLYSRPGYENSYQSYQSPTMREEYAYGSYYYHGHPQWLQEERVPRQRSPYIWHEDYREQKYLDEHHYENQHSPFGTNSETHFQSNSRNPCKDSPASNSGQEWPGELFPGSLLAEAQKNKPSLASESNLLQQRESGLSSSSYELSQYIRDAPERDDPPASAAWSPVQAEDVSSAGPKAPMKFYIPHVPVSFGPGGQLVHVGPSSPTDGQAALVELHSMEVILNDSEEQEEMRSFSGPLIREDVHKVDIMTFCQQKAAQSCKSETLGSRDSALLWQLLVLLCRQNGSMVGSDIAELLMQDCKKLEKYKRQPPVANLINLTDEDWPVLSSGTPNLLTGEIPPSVETPAQIVEKFTRLLYYGRKKEALEWAMKNHLWGHALFLSSKMDPQTYSWVMSGFTSTLALNDPLQTLFQLMSGRIPQAATCCGEKQWGDWRPHLAVILSNQAGDPELYQRAIVAIGDTLAGKGLVEAAHFCYLMAHVPFGHYTVKTDHLVLLGSSHRYATWEKGNSKDIFQGTVLALC

SEQ ID NO: 748083 - protein, 144 aa, Homo sapiens
LQRGPTGSSRGRLVSAAVEAGRTGPELPRRGWVVAARARRQEASRAALPLSRGWAALSGSSCRALATPPRPSLGLALAAVLCRQCLPRAWVCRRAGQGSGRHYRAAICAELKKPLTIEEVAPAPSGLTRSELMSISVELTLVIF

SEQ ID NO: 748084 - protein, 1061 aa, Homo sapiens
MELWAPQRLPQTRGKATAPSKDPDRGFRRDGHHRPVPHSWHNGERFHQWQDNRGSPQPQQEPRADHQQQPHYASRPGDWHQPVSGVDYYEGGYRNQLYSRPGYENSYQSYQSPTMREEYAYGSYYYHGHPQWLQEERVPRQRSPYIWHEDYREQKYLDEHHYENQHSPFGTNSETHFQSNSRNPCKDSPASNSGQEWPGELFPGSLLAEAQKNKPSLASESNLLQQRESGLSSSSYELSQYIRDAPERDDPPASAAWSPVQAEDVSSAGPKAPMKFYIPHVPVSFGPGGQLVHVGPSSPTDGQAALVELHSMEVILNDSEEQEEMRSFSGPLIREDVHKVDIMTFCQQKAAQSCKSETLGSRDSALLWQLLVLLCRQNGSMVGSDIAELLMQDCKKLEKYKRQPPVANLINLTDEDWPVLSSGTPNLLTGEIPPSVETPAQIVEKFTRLLYYGRKKEALEWAMKNHLWGHALFLSSKMDPQTYSWVMSGFTSTLALNDPLQTLFQLMSGRIPQAATCCGEKQWGDWRPHLAVILSNQAGDPELYQRAIVAIGDTLAGKGLVEAAHFCYLMAHVPFGHYTVKTDHLVLLGSSHSQEFLKFATTEAIQRTEIFEYCQMLGRPKSFIPSFQVYKLLYASRLADYGLVSQALHYCEAIGAAVLSQGESSHPVLLVELIKLAEKLKLSDPLVLERRSGDRDLEPDWLAQLRRQLEQKVAGDIGDPHPTRSDISGAGGTTTENTFYQDFSGCQGYSEAPGYRSALWLTPEQTCLLQPSPQQPFPLQPGSYPAGGGAGQTGTPRPFYSVPETHLPGTGSSVAVTEATGGTVWEEMLQTHLGPGENTVSQETSQPPDGQEVISKPQTPLAARPRSISESSASSAKEDEKESSDEADKNSPRNTAQRGKLGDGKEHTKSSGFGWFSWFRSKPTKNASPAGDEDSSDSPDSEETPRASSPHQAGLGLSLTPSPESPPLPDVSAFSRGRGGGEGRGSASSGGAAAGAGVGGLSGPESVSFELCSNPGVLLPPPALKGAVPLYNPSQVPQLPTATSLNRPNRLAQRRYPTQPC

SEQ ID NO: 748085 - protein, 1061 aa, Homo sapiens; identical to SEQ ID NO: 748084

SEQ ID NO: 748086 - protein, 1061 aa, Homo sapiens; identical to SEQ ID NO: 748084

SEQ ID NO: 748087 - protein, 942 aa, Homo sapiens
MEVTLTMSICVCWSEDVSSAGPKAPMKFYIPHVPVSFGPGGQLVHVGPSSPTDGQAALVELHSMEVKKTQCPWNAGTLLTQLLLTCLPCFPVPEPGHLQEWDALAGNWAMYPLDWRVQEWVGLFSERIDATVVFFLRCQCLIFSNKIHFFSFCFLHKALSHILAPRPWGLTLDLTERGLGWPQSSTQNLIVLFQVILNDSEEQEEMRSFSGPLIREDVHKVDIMTFCQQKAAQSCKSETLGSRDSALLWQLLVLLCRQNGSMVGSDIAELLMQDCKKLEKYKRQPPVANLINLTDEDWPVLSSGTPNLLTGEIPPSVETPAQIVEKFTRLLYYGRKKEALEWAMKNHLWGHALFLSSKMDPQTYSWVMSGFTSTLALNDPLQTLFQLMSGRIPQAATCCGEKQWGDWRPHLAVILSNQAGDPELYQRAIVAIGDTLAGKGLVEAAHFCYLMAHVPFGHYTVKTDHLVLLGSSHSQEFLKFATTEAIQRTEIFEYCQMLGRPKSFIPSFQVYKLLYASRLADYGLVSQALHYCEAIGAAVLSQGESSHPVLLVELIKLAEKLKLSDPLVLERRSGDRDLEPDWLAQLRRQLEQKVAGDIGDPHPTRSDISGAGGTTTENTFYQDFSGCQGYSEAPGYRSALWLTPEQTCLLQPSPQQPFPLQPGSYPAGGGAGQTGTPRPFYSVPETHLPGTGSSVAVTEATGGTVWEEMLQTHLGPGENTVSQETSQPPDGQEVISKPQTPLAARPRSISESSASSAKEDEKESSDEADKNSPRNTAQRGKLGDGKEHTKSSGFGWFSWFRSKPTKNASPAGDEDSSDSPDSEETPRASSPHQAGLGLSLTPSPESPPLPDVSAFSRGRGGGEGRGSASSGGAAAGAGVGGLSGPESVSFELCSNPGVLLPPPALKGAVPLYNPSQVPQLPTATSLNRPNRLAQRRYPTQPC

SEQ ID NO: 748088 - protein, 737 aa, Homo sapiens; identical to SEQ ID NO: 748081

SEQ ID NO: 748089 - protein, 737 aa, Homo sapiens; identical to SEQ ID NO: 748081

SEQ ID NO: 748090 - protein, 681 aa, Homo sapiens
MVGSDIAELLMQDCKKLEKYKRQPPVANLINLTDEDWPVLSSGTPNLLTGEIPPSVETPAQIVEKFTRLLYYGRKKEALEWAMKNHLWGHALFLSSKMDPQTYSWVMSGFTSTLALNDPLQTLFQLMSGRIPQAATCCGEKQWGDWRPHLAVILSNQAGDPELYQRAIVAIGDTLAGKGLVEAAHFCYLMAHVPFGHYTVKTDHLVLLGSSHSQEFLKFATTEAIQRTEIFEYCQMLGRPKSFIPSFQVYKLLYASRLADYGLVSQALHYCEAIGAAVLSQGESSHPVLLVELIKLAEKLKLSDPLVLERRSGDRDLEPDWLAQLRRQLEQKVAGDIGDPHPTRSDISGAGGTTTENTFYQDFSGCQGYSEAPGYRSALWLTPEQTCLLQPSPQQPFPLQPGSYPAGGGAGQTGTPRPFYSVPETHLPGTGSSVAVTEATGGTVWEEMLQTHLGPGENTVSQETSQPPDGQEVISKPQTPLAARPRSISESSASSAKEDEKESSDEADKNSPRNTAQRGKLGDGKEHTKSSGFGWFSWFRSKPTKNASPAGDEDSSDSPDSEETPRASSPHQAGLGLSLTPSPESPPLPDVSAFSRGRGGGEGRGSASSGGAAAGAGVGGLSGPESVSFELCSNPGVLLPPPALKGAVPLYNPSQVPQLPTATSLNRPNRLAQRRYPTQPC

SEQ ID NO: 748091 - protein, 737 aa, Homo sapiens; identical to SEQ ID NO: 748081

SEQ ID NO: 748092 - protein, 265 aa, Homo sapiens
MELWAPQRLPQTRGKATAPSKDPDRGFRRDGHHRPVPHSWHNGERFHQWQDNRGSPQPQQEPRADHQQQPHYASRPGDWHQPVSGVDYYEGGYRNQLYSRPGYENSYQSYQSPTMREEYAYGSYYYHGHPQWLQEERVPRQRSPYIWHEDYREQKYLDEHHYENQHSPFGTNSETHFQSNSRNPCKDSPASNSGQEWPGELFPGSLLAEAQKNKPSLASESNLLQQRESGLSSSSYELSQYIRDAPERDDPPASAAWSPVQAGGF

SEQ ID NO: 748093 - protein, 942 aa, Homo sapiens; identical to SEQ ID NO: 748087

SEQ ID NO: 748094 - protein, 144 aa, Homo sapiens; identical to SEQ ID NO: 748083

SEQ ID NO: 748095 - protein, 144 aa, Homo sapiens; identical to SEQ ID NO: 748083

SEQ ID NO: 748096 - protein, 171 aa, Homo sapiens
MKTGHEGEEKAVKEDMPMSSNDKAEDWEVKMDEEEWRSRQLMIEAPGVWGWMQVGIFWEHWAWLNENQTVSPRGIHLFVLTGLSSRQRESTPIISIKRGHDSSWRRQDGVIHYKDMNFPVFSKSLSSVLQYCQQGCIQLYVRMVFKLDEVNDAFLHVIQGKSVGKVLLALK

SEQ ID NO: 748097 - protein, 144 aa, Homo sapiens; identical to SEQ ID NO: 748083

SEQ ID NO: 748098 - protein, 88 aa, Homo sapiens
VRWGAPFLGHVLDNQISCVLDAGNIAAAGSDEKCKLAMQRGAQSSVNYSQGSLKDAVRKLVGEGGVNVAIDMVGGDICLEALRRCMGW

SEQ ID NO: 748099 - protein, 130 aa, Homo sapiens
MGGGTHKRLDGRNTPTGTSRPSTGETMRSLARAVRKETGRRVAQIQRKTISLLVPPSAESYFQSIKPWTNSPSLRVIKFFRYIKARTLGYRKPSVLATRQGGLIELTNTSCLWTAKLKEHSVTHTHWGFS

SEQ ID NO: 748100 - protein, 129 aa, Homo sapiens
MRCDTMIQYGRCLTFHLAGYSIDSVQSRHRTLRSIYNLSYPIGHFLCLVILVYCAEYINEAAAMNWRLFSKYQYFDSRGMFISIVFSAPLLVNAMIIVVMWVWKTLNVMTDLKNAQERRKEKKRRRKED

SEQ ID NO: 748101 - protein, 137 aa, Homo sapiens
MVKHWSITHVSLPSILSHDIVALPFSPNKRSPAEQAMRCDTMIQYGRCLTFHLAGYSIDSVQSRHRTLRSIYNLTLPDRALSVSVILVYCAEYINEAAAMNWRLFSKYQYFDSRGMFISIVFSAPLLVNAMIIVVRR

SEQ ID NO: 748102 - protein, 129 aa, Homo sapiens; identical to SEQ ID NO: 748100

SEQ ID NO: 748103 - protein, 129 aa, Homo sapiens; identical to SEQ ID NO: 748100

SEQ ID NO: 748104 - protein, 129 aa, Homo sapiens; identical to SEQ ID NO: 748100

SEQ ID NO: 748105 - protein, 137 aa, Homo sapiens; identical to SEQ ID NO: 748101

SEQ ID NO: 748106 - protein, 941 aa, Homo sapiens
MAAYLQWRRFVFFDKELVKEPLSNDGAAPGATPASGSAASKFLCLPPGITVCDSGRGSLVFGDMEGQIWFLPRSLQLTGFQAYKLRVTHLYQLKQHNILASVGEDEEGINPLVKIWNLEKRDGGNPLCTRIFPAIPGTEPTVVSCLTVHENLNFMAIGFTDGSVTLNKGDITRDRHSKTQILHKGNYPVTGLAFRQAGKTTHLFVVTTENVQSYIVSGKDYPRVELDTHGCGLRCSALSDPSQDLQFIVAGDECVYLYQPDERGPCFAFEGHKLIAHWFRGYLIIVSRDRKVSPKSEFTSRDSQSSDKQILNIYDLCNKFIAYSTVFEDVVDVLAEWGSLYVLTRDGRVHALQEKDTQTKLEMLFKKNLFEMAINLAKSQHLDSDGLAQIFMQYGDHLYSKGNHDGAVQQYIRTIGKLEPSYVIRKFLDAQRIHNLTAYLQTLHRQSLANADHTTLLLNCYTKLKDSSKLEEFIKKKSESEVHFDVETAIKVLRQAGYYSHALYLAENHAHHEWYLKIQLEDIKNYQEALRYIGKLPFEQAESNMKRYGKILMHHIPEQTTQLLKGLCTDYRPSLEGRSDREAPGCRANSEEFIPIFANNPRELKAFLEHMSEVQPDSPQGIYDTLLELRLQNWAHEKDPQVKEKLHAEAISLLKSGRFCDVFDKALVLCQMHDFQDGVLYLYEQGKLFQQIMHYHMQHEQYRQVISVCERHGEQDPSLWEQALSYFARKEEDCKEYVAAVLKHIENKNLMPPLLVVQTLAHNSTATLSVIRDYLVQKLQKQSQQIAQDELRVRRYREETTRIRQEIQELKASPKIFQKTKCSICNSALELPSVHFLCGHSFHQHCFESYSESDADCPTCLPENRKVMDMIRAQEQKRDLHDQFQHQLKCSNDSFSVIADYFGRGVFNKLTLLTDPPTARLTSSLEAGLQRDLLMHSRRGT

SEQ ID NO: 748107 - protein, 716 aa, Homo sapiens
TENVQSYIASGALSDPSQDLQFIVAGDECVYLYQPDERGPCFAFEGHKLIAHWFRGYLIIVSRDRKVSPKSEFTSRDSQSSDKQILNIYDLCNKFIAYSTVFEDVVDVLAEWGSLYVLTRDGRVHALQEKDTQTKLEMLFKKNLFEMAINLAKSQHLDSDGLAQIFMQYGDHLYSKGNHDGAVQQYIRTIGKLEPSYVIRKFLDAQRIHNLTAYLQTLHRQSLANADHTTLLLNCYTKLKDSSKLEEFIKKKSESEVHFDVETAIKVLRQAGYYSHALYLAENHAHHEWYLKIQLEDIKNYQEALRYIGKLPFEQAESNMKRYGKILMHHIPEQTTQLLKGLCTDYRPSLEGRSDREAPGCRANSEEFIPIFANNPRELKAFLEHMSEVQPDSPQGIYDTLLELRLQNWAHEKDPQVKEKLHAEAISLLKSGRFCDVFDKALVLCQMHDFQDGVLYLYEQGKLFQQIMHYHMQHEQYRQVISVCERHGEQDPSLWEQALSYFARKEEDCKEYVAAVLKHIENKNLMPPLLVVQTLAHNSTATLSVIRDYLVQKLQKQSQQIAQDELRVRRYREETTRIRQEIQELKASPKIFQKTKCSICNSALELPSVHFLCGHSFHQHCFESYSESDADCPTCLPENRKVMDMIRAQEQKRDLHDQFQHQLKCSNDSFSVIADYFGRGVFNKLTLLTDPPTARLTSSLEAGLQRDLLMHSRRGT

SEQ ID NO: 748108 - protein, 588 aa, Homo sapiens
MAAYLQWRRFVFFDKELVKEPLSNDGAAPGATPASGSAASKFLCLPPGITVCDSGRGSLVFGDMEGQIWFLPRSLQLTGFQAYKLRVTHLYQLKQHNILASVGEDEEGINPLVKIWNLEKRDGGNPLCTRIFPAIPGTEPTVVSCLTVHENLNFMAIGFTDGSVTLNKGDITRDRHSKTQILHKGNYPVTGLAFRQAGKTTHLFVVTTENVQSYIVSGKDYPRVELDTHGCGLRCSALSDPSQDLQFIVAGDECVYLYQPDERGPCFAFEGHKLIAHWFRGYLIIVSRDRKVSPKSEFTSRDSQSSDKQILNIYDLCNKFIAYSTVFEDVVDVLAEWGSLYVLTRDGRVHALQEKDTQTKLEMLFKKNLFEMAINLAKSQHLDSDGLAQIFMQYGDHLYSKGNHDGAVQQYIRTIGKLEPSYVIRKFLDAQRIHNLTAYLQTLHRQSLANADHTTLLLNCYTKLKDSSKLEEFIKKKSESEVHFDVETAIKVLRQAGYYSHALYLAENHAHHEWYLKIQLEDIKNYQEALRYIGKLPFEQAESNMKRYGKILMHHIPEQTTQLLLFTSSVDHSRSVGEGTSATSECGQ

SEQ ID NO: 748109 - protein, 43 aa, Homo sapiens
LWEQALSYFARKEEDCKEYVAAVLKHIENKNLMPPLLGTWEDR

SEQ ID NO: 748110 - protein, 89 aa, Homo sapiens
RWEPWAKMAAYLQWRRFVFFDKELVKEPLSNDGAAPGATPASGSAASKFLCLPPGITVCDSGRGSLVFGDILRLELSFPSRDPEEIELG

SEQ ID NO: 748111 - protein, 579 aa, Homo sapiens
MLFKKNLFEMAINLAKSQHLDSDGLAQIFMQYGDHLYSKGNHDGAVQQYIRTIGKLEPSYVIRKFLDAQRIHNLTAYLQTLHRQSLANADHTTLLLNCYTKLKDSSKLEEFIKKKSESEVHFDVETAIKVLRQAGYYSHALYLAENHAHHEWYLKIQLEDIKNYQEALRYIGKLPFEQAESNMKRYGKILMHHIPEQTTQLLKGLCTDYRPSLEGRSDREAPGCRANSEEFIPIFANNPRELKAFLEHMSEVQPDSPQGIYDTLLELRLQNWAHEKDPQVKEKLHAEAISLLKSGRFCDVFDKALVLCQMHDFQDGVLYLYEQGKLFQQIMHYHMQHEQYRQVISVCERHGEQDPSLWEQALSYFARKEEDCKEYVAAVLKHIENKNLMPPLLVVQTLAHNSTATLSVIRDYLVQKLQKQSQQIAQDELRVRRYREETTRIRQEIQELKASPKIFQKTKCSICNSALELPSVHFLCGHSFHQHCFESYSESDADCPTCLPENRKVMDMIRAQEQKRDLHDQFQHQLKCSNDSFSVIADYFGRGVFNKLTLLTDPPTARLTSSLEAGLQRDLLMHSRRGT

SEQ ID NO: 748112 - protein, 706 aa, Homo sapiens
MAAYLQWRRFVFFDKELVKEPLSNDGAAPGATPASGSAASKFLCLPPGITVCDSGRGSLVFGDMEGQIWFLPRSLQLTGFQAYKLRVTHLYQLKQHNILASVGEDEEGINPLVKIWNLEKRDGGNPLCTRIFPAIPGTEPTVVSCLTVHENLNFMAIGFTDGSVTLNKGDITRDRHSKTQILHKGNYPVTGLAFRQAGKTTHLFVVTTENVQSYIVSGKDYPRVELDTHGCGLRCSALSDPSQDLQFIVAGDECVYLYQPDERGPCFAFEGHKLIAHWFRGYLIIVSRDRKVSPKSEFTSRDSQSSDKQILNIYDLCNKFIAYSTVFEDVVDVLAEWGSLYVLTRDGRVHALQEKDTQTKLEMLFKKNLFEMAINLAKSQHLDSDGLAQIFMQYGDHLYSKGNHDGAVQQYIRTIGKLEPSYVIRKFLDAQRIHNLTAYLQTLHRQSLANADHTTLLLNCYTKLKDSSKLEEFIKKKSESEVHFDVETAIKVLRQAGYYSHALYLAENHAHHEWYLKIQLEDIKNYQEALRYIGKLPFEQAESNMKRYGKILMHHIPEQTTQLLKGLCTDYRPSLEGRSDREAPGCRANSEEFIPIFANNPRELKAFLEHMSEVQPDSPQGIYDTLLELRLQNWAHEKDPQVKEKLHAEAISLLKSGRFCDVFDKAWSCARCTTSRMVSFTFMSRGSCSSRCCGSTGRIKKKKGKK

SEQ ID NO: 748113 - protein, 127 aa, Homo sapiens
KLHAEAISLLKSGRFCDVFDKALVLCQMHDFQDGVLYLYEQGKLEEFGEFQGKGKNPSHFPETATEVCPCPGRRFQQIMHYHMQHEQYRQVISVCERHGEQDPSLWEQALSYFARKEEDCKEYVAAV

SEQ ID NO: 748114 - protein, 299 aa, Homo sapiens
MKKILKSRIERDKDFSHQRRHYKEFRFDLTQIPHGEAVTAAEFRIYKDRSNNRFENETIKISIYQIIKEYTNRDADLFLLDTRKAQALDVGWLVFDITVTSNHWVINPQNNLGLQLCAETGDGRSINVKSAGLVGRQGPQSKQPFMVAFFKASEVLLRSVRAANKRKNQNRNKSSSHQDSSRMSSVGDYNTSEQKQACKKHELYVSFRDLGWQDWIIAPEGYAAFYCDGECSFPLNAHMNATNHAIVQTLVHLMFPDHVPKPCCAPTKLNAISVLYFDDSSNVILKKYRNMVVRSCGCH

SEQ ID NO: 748115 - protein, 454 aa, Homo sapiens
MHLTVFLLKGIVGFLWSCWVLVGYAKGGLGDNHVHSSFIYRRLRNHERREIQREILSILGLPHRPRPFSPGKQASSAPLFMLDLYNAMTNEENPEESEYSVRASLAEETRGARKGYPASPNGYPRRIQLSRTTPLTTQSPPLASLHDTNFLNDADMVMSFVNLVERDKDFSHQRRHYKEFRFDLTQIPHGEAVTAAEFRIYKDRSNNRFENETIKISIYQIIKEYTNRDADLFLLDTRKAQALDVGWLVFDITVTSNHWVINPQNNLGLQLCAETGDGRSINVKSAGLVGRQGPQSKQPFMVAFFKASEVLLRSVRAANKRKNQNRNKSSSHQDSSRMSSVGDYNTSEQKQACKKHELYVSFRDLGWQDWIIAPEGYAAFYCDGECSFPLNAHMNATNHAIVQTLVHLMFPDHVPKPCCAPTKLNAISVLYFDDSSNVILKKYRNMVVRSCGCH

SEQ ID NO: 748116 - protein, 379 aa, Homo sapiens
MHLTVFLLKGIVGFLWSCWVLVGYAKGGLGDNHVHSSFIYRRLRNHERREIQREILSILGLPHRPRPFSPGKQASSAPLFMLDLYNAMTNEENPEESEYSVRASLAEETRGARKGYPASPNGYPRRIQLSRTTPLTTQSPPLASLHDTNFLNDADMVMSFVNLVERDKDFSHQRRHYKEFRFDLTQIPHGEAVTAAEFRIYKDRSNNRFENETIKISIYQIIKEYTNRDADLFLLDTRKAQALDVGWLVFDITVTSNHWVINPQNNLGLQLCAETGDGRSINVKSAGLVGRQGPQSKQPFMVAFFKASEVLLRSVRAANKRKNQNRNKSSSHQDSSRMSSVGGKNKPEQQLCTESYGVVCCKSSSHNKFTLYVYLRMVH

SEQ ID NO: 748117 - protein, 1123 aa, Homo sapiens
MPEPTKKEENEVPAPAPPPEEPSKEKEAGTTPAKDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIAQ

SEQ ID NO: 748118 - protein, 117 aa, Homo sapiens
MPEPTKKEENEVPAPAPPPEEPSKEKEAGTTPAKDEEEVSPPSALPPGLGSRALERKDSGERKPREGILDLILIQSLMSSFLEAVIDSNPCLIQIVVFTAIFHYVSSYKKTNVLRNN

SEQ ID NO: 748119 - protein, 1148 aa, Homo sapiens
MPEPTKKEENEVPAPAPPPEEPSKEKEAGTTPAKDEEEVSPPSALPPGLGSRALERKDSDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIAQ

SEQ ID NO: 748120 - protein, 1099 aa, Homo sapiens
MNPFPPFCSSDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIAQ

SEQ ID NO: 748121 - protein, 1097 aa, Homo sapiens
MPEPTKKEDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIAQ

SEQ ID NO: 748122 - protein, 870 aa, Homo sapiens
HINLKNEAGEAHASIKVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIAQ

SEQ ID NO: 748123 - protein, 1177 aa, Homo sapiens
MPEPTKKEENEVPAPAPPPEEPSKEKEAGTTPAKDEEEVSPPSALPPGLGSRALERKDSDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKGGLSFCRLLLQGVPPNIIDSYLRDLHSSNPEEY

SEQ ID NO: 748124 - protein, 486 aa, Homo sapiens
MNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIAQ

SEQ ID NO: 748125 - protein, 809 aa, Homo sapiens
MPEPTKKEENEVPAPAPPPEEPSKEKEAGTTPAKDEEEVSPPSALPPGLGSRALERKDSDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGRGDSCKCLFESYLHHPSSKLNLVL

SEQ ID NO: 748126 - protein, 435 aa, Homo sapiens
MPEPTKKEENEVPAPAPPPEEPSKEKEAGTTPAKDEEEVSPPSALPPGLGSRALERKDSDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKSKF

SEQ ID NO: 748127 - protein, 390 aa, Homo sapiens
MPEPTKKEENEVPAPAPPPEEPSKEKEAGTTPAKDEEEVSPPSALPPGLGSRALERKDSDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVRGKNEISYCGHQELLASSPRDNDQSESN

SEQ ID NO: 748128 - protein, 222 aa, Homo sapiens
MPEPTKKEENEVPAPAPPPEEPSKEKEAGTTPAKDEEEVSPPSALPPGLGSRALERKDSDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRR

SEQ ID NO: 748129 - protein, 138 aa, Homo sapiens
MPEPTKKEENEVPAPAPPPEEPSKEKEAGTTPAKDEEEVSPPSALPPGLGSRALERKDSDWTLVETPPGEEQAKQNANSQLSILFIEKPQGGTVKVANIAQPGWEQPRESPHHAHHPLWHWLHPLPIPFHPPLLLNKF

SEQ ID NO: 748130 - protein, 1141 aa, Homo sapiens
MPEPTKKEENEVPAPAPPPEEPSKEKEAGTTPAKDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGSTSAKQSDENGEAAYDLPAEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIAQ

SEQ ID NO: 748131 - protein, 1171 aa, Homo sapiens
MPEPTKKEENEVPAPAPPPEEPSKEKEAGTTPAKDEEEVSPPSALPPGLGSRALERKDSDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIYQGVNTPGQPVFLEGQQQSLHNKDF

SEQ ID NO: 748132 - protein, 1109 aa, Homo sapiens
MPEPTKKEENEVPAPAPPPEDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIAQ

SEQ ID NO: 748133 - protein, 808 aa, Homo sapiens
MTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIAQ

SEQ ID NO: 748134 - protein, 166 aa, Homo sapiens
MEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIAQ

SEQ ID NO: 748135 - protein, 283 aa, Homo sapiens
AVFSFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIAQ

SEQ ID NO: 748136 - protein, 260 aa, Homo sapiens
GPQFRRKMAGSPELVVLDPPWDKELAAGTESQALVSATPREDFRVRCTSKRAVTEMLQLCGRFVQKLGDALPEEIREPALRDAQWTFESAVQENISINGQAWQEASDNCFMDSDIKVLEDQFDEIIVDIATKRKQYPRKILECVIKTIKAKQEILKQYHPVVHPLDLKYDPDPAPHMENLKCRGETVAKEISEAMKSLPALIEQGEGFSQVLRMQPVIHLQRIHQEVFPVVIGNQMLNLRTFTQIEPTTETGSRKPLTGY

SEQ ID NO: 748137 - protein, 238 aa, Homo sapiens
GPQFRRKMAGSPELVVLDPPWDKELAAGTESQALVSATPREDFRVRCTSKRAVTEMLQLCGRFVQKLGDALPEEIREPALRDAQWTFESAVQENISINGQAWQEASDNCFMDSDIKVLEDQFDEIIVDIATKRKQYPRKILECVIKTIKAKQEILKQYHPVVHPLDLKYDPDPESLPALIEQGEGFSQVLRMQPVIHLQRIHQEVFPVVIGNQMLNLRTFTQIEPTTETGSRKPLTGY

SEQ ID NO: 748138 - protein, 160 aa, Homo sapiens
GPQFRRKMAGSPELVVLDPPWDKELAAGTESQALVSATPREDFRVRCTSKRAVTEMLQLCGRFVQKLGDALPEEIREPALRDAQWTFESAVQENISINGQAWQEASDNCFMDSDIKVLEDQFDEIIVDIATKRKQYPRKILECVIKTIKAKQEILSPCLH

SEQ ID NO: 748139 - protein, 161 aa, Homo sapiens
GPQFRRKMAGSPELVVLDPPWDKELAAGTESQALVSATPREDFRVRCTSKRAVTEMLQLCGRFVQKLGDALPEEIREPALRDAQWTFESAVQENISINGQAWQEASDNCFMDSDIKVLEDQFDEIIVDIATKRKQYPRKILECVIKTIKAKQEILPLIWKI

SEQ ID NO: 748140 - protein, 147 aa, Homo sapiens
GPQFRRKMAGSPELVVLDPPWDKELAAGTESQALVSATPREDFRVRCTSKRAVTEMLQLCGRFVQKLGDALPEEIREPALRDAQWTFESAVQENISINGQAWQEASDNCFMDSDIKVLEDQFDEIIVDITQIEPTTETGSRKPLTGY

SEQ ID NO: 748141 - protein, 278 aa, Homo sapiens
GPQFRRKMAGSPELVVLDPPWDKELAAGTESQALVSATPREDFRVRCTSKRAVTEMLQLCGRFVQKLGDALPEEIREPALRDAQWTFESAVQENISINGQAWQEASDNCFMDSDIKVLEDQFDEIIVDIATKRKQYPRKILECVIKTIKAKQEILKQYHPVVHPLDLKYDPDPVEYNRVVHPLDLKYDPDPAPHMENLKCRGETVAKEISEAMKSLPALIEQGEGFSQVLRMQPVIHLQRIHQEVFPVVIGNQMLNLRTFTQIEPTTETGSRKPLTGY

SEQ ID NO: 748142 - protein, 519 aa, Homo sapiens
MAAPSRLLIRGGRVVNDDFSEVADVLVEDGVVRALGHDLLPPGGAPAGLRVLDAAGKLVLPGGIDTHTHMQFPFMGSRSIDDFHQGTKAALSGGTTMIIDFAIPQKGGSLIEAFETWRSWADPKVCCDYSLHVAVTWWSDQVKEEMKILVQDKGVNSFKMFMAYKDLYMVTDLELYEAFSRCKEIGAIAQVHAENGDLIAEGAKKMLALGITGPEGHELCRPEAVEAEATLRAITIASAVNCPLYIVHVMSKSAAKVIADARRDGKVVYGEPIAASLGTDGTHYWNKEWHHAAHHVMGPPLRPDPSTPDFLMNLLANDDLTTTGTDNCTFNTCQKALGKDDFTKIPNGVNGVEDRMSVIWEKGVHSGKMDENRFVAVTSTNAAKIFNLYPRKGRIAVGSDADIVIWDPKGTRTISAKTHHQAVNFNIFEGMVCHGVPLVTISRGKVVYEAGVFSVTAGDGKFIPRKPFAEYIYKRIKQRDRTCTPTPVERAPYKGEVATLKSRVTKEDATAGTRKQAHP

SEQ ID NO: 748143 - protein, 72 aa, Homo sapiens
MRSKWQMENSNLDLSHFKGHTVDHYNVLVWVVKMRPTIICYLSVCMCVCVCVCVCVCVCVISKLCSSTDSSR

SEQ ID NO: 748144 - protein, 501 aa, Homo sapiens
MAAPSRLLIRGGRVVNDDFSEVADVLVEDGVVRALGHDLLPPGGAPAGLRVLDAAGKLVLPGGIDTHTHMQFPFMGSRSIDDFHQGTKAALSGGTTMIIDFAIPQKGGSLIEAFETWRSWADPKVCCDYSLHVAVTWWSDQVKEEMKILVQDKGVNSFKMFMAYKDLYMVTDLELYEAFSRCKEIGAIAQVHAEGPEGHELCRPEAVEAEATLRAITIASAVNCPLYIVHVMSKSAAKVIADARRDGKVVYGEPIAASLGTDGTHYWNKEWHHAAHHVMGPPLRPDPSTPDFLMNLLANDDLTTTGTDNCTFNTCQKALGKDDFTKIPNGVNGVEDRMSVIWEKGVHSGKMDENRFVAVTSTNAAKIFNLYPRKGRIAVGSDADIVIWDPKGTRTISAKTHHQAVNFNIFEGMVCHGVPLVTISRGKVVYEAGVFSVTAGDGKFIPRKPFAEYIYKRIKQRDRTCTPTPVERAPYKGEVATLKSRVTKEDATAGTRKQAHP

SEQ ID NO: 748145 - protein, 333 aa, Homo sapiens
MVTDLELYEAFSRCKEIGAIAQVHAEGPEGHELCRPEAVEAEATLRAITIASAVNCPLYIVHVMSKSAAKVIADARRDGKVVYGEPIAASLGTDGTHYWNKEWHHAAHHVMGPPLRPDPSTPDFLMNLLANDDLTTTGTDNCTFNTCQKALGKDDFTKIPNGVNGVEDRMSVIWEKGVHSGKMDENRFVAVTSTNAAKIFNLYPRKGRIAVGSDADIVIWDPKGTRTISAKTHHQAVNFNIFEGMVCHGVPLVTISRGKVVYEAGVFSVTAGDGKFIPRKPFAEYIYKRIKQRDRTCTPTPVERAPYKGEVATLKSRVTKEDATAGTRKQAHP

SEQ ID NO: 748146 - protein, 416 aa, Homo sapiens
MAAPSRLLIRGGRVVNDDFSEVADVLVEDGVVRALGHDLLPPGGAPAGLRVLDAAGKLVLPGGIDTHTHMQFPFMGSRSIDDFHQGTKAALSGGTTMIIDFAIPQKGGSLIEAFETWRSWADPKVCCDYSLHVAVTWWSDQVKEEMKILVQDKGVNSFKMFMAYKDLYMVTDLELYEAFSRCKEIGAIAQVHAENGDLIAEGAKKMLALGITGPEGHELCRPEAVEAEATLRAITIASAVNCPLYIVHVMSKSAAKVIADARRDGKVVYGEPIAASLGTDGTHYWNKEWHHAAHHVMGPPLRPDPSTPDFLMNLLANDDLTTTGTDNCTFNTCQKALGKDDFTKIPNGVNGVEDRMSVIWEKGVHSGKMDENRFVAVTSTNAAKIFNLYPRKGRIAVGSDADIVIWDPKGTRGCPL

SEQ ID NO: 748147 - protein, 157 aa, Homo sapiens
CRNWHEIWDPKGTRGCRSCVAFSDNGSVYKTNMNLPLQCLANARVHMEERTISAKTHHQAVNFNIFEGMVCHGVPLVTISRGKVVYEAGVFSVTAGDGKFIPRKPFAEYIYKRIKQRDRTCTPTPVERAPYKGEVATLKSRVTKEDATAGTRKQAHP

SEQ ID NO: 748148 - protein, 129 aa, Homo sapiens
KGLPRCALEASCLRGGGTSWKGTISAKTHHQAVNFNIFEGMVCHGVPLVTISRGKVVYEAGVFSVTAGDGKFIPRKPFAEYIYKRIKQRDRTCTPTPVERAPYKGEVATLKSRVTKEDATAGTRKQAHP

SEQ ID NO: 748149 - protein, 510 aa, Homo sapiens
MAAPSRLLIRGGRVVNDDFSEVADVLVEDGVVRALGHDLLPPGGAPAGLRVLDAAGKLVLPGGIDTHTHMQFPFMGSRSIDDFHQGTKAALSGGTTMIIDFAIPQKGGSLIEAFETWRSWADPKVCCDYSLHVAVTWWSDQVKEEMKILVQDKGVNSFKMFMAYKDLYMVTDLELYEAFSRCKEIGAIAQVHAENGDLIAEGAKKMLALGITGPEGHELCRPEAVEAEATLRAITIASAVNCPLYIVHVMSKSAAKVIADARRDGKVVYGEPIAASLGTDGTHYWNKEWHHAAHHVMGPPLRPDPSTPDFLMNLLANDDLTTTGTDNCTFNTCQKALGKDDFTKIPNGVNGVEDRMSVIWEKGVHSGKMDENRFVAVTSTNAAKIFNLYPRKGRIAVGSDADIVIWDPKGTRTISAKTHHQAVNFNIFEGMVCHGVPLVTISRGKVVYEAGVFSVTAGDGKFIPRKPFAEYIYKRIKQRDRVKKSEERRLPFPSQPNIVNPWRSRPYSTP

SEQ ID NO: 748150 - protein, 519 aa, Homo sapiens; identical to SEQ ID NO: 748142

SEQ ID NO: 748151 - protein, 317 aa, Homo sapiens
MAAPSRLLIRGGRVVNDDFSEVADVLVEDGVVRALGHDLLPPGGAPAGLRVLDAAGKLVLPGGIDTHTHMQFPFMGSRSIDDFHQGTKAALSGGTTMIIDFAIPQKGGSLIEAFETWRSWADPKVCCDYSLHVAVTWWSDQVKEEMKILVQDKGVNSFKMFMAYKDLYMVTDLELYEAFSRCKEIGAIAQVHAENGDLIAEGAKKMLALGITGPEGHELCRPEAVEAEATLRAITIASAVNCPLYIVHVMSKSAAKVIADARRDGKVVYGEPIAASLGTDGTHYWNKEWHHAAHHVMGPPLRPDPSTPDFLMNLLAK

SEQ ID NO: 748152 - protein, 485 aa, Homo sapiens
MGEPGFFVTGDRAGGRSWCLRRVGMSAGWLLLEDGCEVTVGRGFGVTYQLVSKICPLMISRNHCVLKQNPEGQWTIMDNKSLNGVWLNRARLEPLRVYSIHQGDYIQLGVPLENKENAEYEYEVTEEDWETIYPCLSPKNDQMIEKNKELRTKRKFSLDELAGPGAEGPSNLKSKINKVSCESGQPVKSQGKGEVASTPSDNLDPKLTALEPSKTTGAPIYPGFPKVTEVHHEQKASNSSASQRSLQMFKVTMSRILRLKIQMQEKHEAVMNVKKQTQKGNSKKVVQMEQELQDLQSQLCAEQAQQQARVEQLEKTFQEEEQHLQGLEIAQGEKDLKQQLAQALQEHWALMEELNRSKKDFEAIIQAKNKELEQTKEEKEKMQAQKEEVLSHMNDVLENELQCIICSEYFIEAVTLNCAHSFCSYCINEWMKRKIECPICRKDIKSKTYSLVLDNCINKMVNNLSSEVKERRIVLIRERKAKRLF

SEQ ID NO: 748153 - protein, 86 aa, Homo sapiens
MGEPGFFVTGDRAGGRSWCLRRVGMSAGWLLLEDGCEVRGKGSCGAEGRGWRERGSGEGGRCLAGLNEWQRGGGHQEEERSVCGGG

SEQ ID NO: 748154 - protein, 485 aa, Homo sapiens; identical to SEQ ID NO: 748152

SEQ ID NO: 748155 - protein, 485 aa, Homo sapiens; identical to SEQ ID NO: 748152

SEQ ID NO: 748156 - protein, 455 aa, Homo sapiens
MGEPGFFVTGDRAGGRSWCLRRVGMSAGWLLLEDGCEVTVGRGFGVTYQLVSKICPLMISRNHCVLKQNPEGQWTIMDNKSLNGVWLNRARLEPLRVYSIHQGDYIQLGVPLENKENAEYEYEVTEEDWETIYPCLSPKNDQMIEKNKELRTKRKFSLDELAGPGAEGPSNLKSKINKVSCESGQPVKSQGKGEVASTPSDNLDPKLTALEPSKTTGAPIYPGFPKVTEVHHEQKASNSSASQRSLQMFKVTMSRILRLKIQMQEKHEAVMNVKKQTQKGNSKKVVQMEQELQDLQSQLCAEQAQQQARVEQLEKTFQEEEQHLQGLEIAQGEKDLKQQLAQALQEEEKEKMQAQKEEVLSHMNDVLENELQCIICSEYFIEAVTLNCAHSFCSYCINEWMKRKIECPICRKDIKSKTYSLVLDNCINKMVNNLSSEVKERRIVLIRERKAKRLF

SEQ ID NO: 748157 - protein, 485 aa, Homo sapiens; identical to SEQ ID NO: 748152

SEQ ID NO: 748158 - protein, 428 aa, Homo sapiens
MISRNHCVLKQNPEGQWTIMDNKSLNGVWLNRARLEPLRVYSIHQGDYIQLGVPLENKENAEYEYEVTEEDWETIYPCLSPKNDQMIEKNKELRTKRKFSLDELAGPGAEGPSNLKSKINKVSCESGQPVKSQGKGEVASTPSDNLDPKLTALEPSKTTGAPIYPGFPKVTEVHHEQKASNSSASQRSLQMFKVTMSRILRLKIQMQEKHEAVMNVKKQTQKGNSKKVVQMEQELQDLQSQLCAEQAQQQARVEQLEKTFQEEEQHLQGLEIAQGEKDLKQQLAQALQEHWALMEELNRSKKDFEAIIQAKNKELEQTKEEKEKMQAQKEEVLSHMNDVLENELQCIICSEYFIEAVTLNCAHSFCSYCINEWMKRKIECPICRKDIKSKTYSLVLDNCINKMVNNLSSEVKERRIVLIRERKAKRLF

SEQ ID NO: 748159 - protein, 448 aa, Homo sapiens
MGEPGFFVTGDRAGGRSWCLRRVGMSAGWLLLEDGCEVTVGRGFGVTYQLVSKICPLMISRNHCVLKQNPEGQWTIMDNKSLNGVWLNRARLEPLRVYSIHQGDYIQLGVPLENKENAEYEYEVTEEDWETIYPCLSPKNDQMIEKNKELRTKRKFSLDELAGPGAEGPSNLKSKINKVSCESGQPVKSQGKGEVASTPSDNLDPKLTALEPSKTTGAPIYPGFPKVTEVHHEQKASNSSASQRSLQMFKVTMSRILRLKIQMQEKHEAVMNVKKQTQKGNSKKVVQMEQELQDLQSQLCAEQAQQQARVEQLEKTFQEEEQHLQGLEIAQGEKDLKQQLAQALQEHWALMEELNRSKKDFEAIIQAKNKELEQTKEEKEKMQAQKEEVLSHMNDVLENELQCIICSEYFIEQRDCSEDRALRAFERLPGSASLRWSGGFSLAVTPLL

SEQ ID NO: 748160 - protein, 96 aa, Homo sapiens
FLRWSLALSPRLVCSGTILAHRNLCPLGSSNSPASASQVAGTTGTDYHTSLIFVFLVETGFHHVGQAGLEFLTSSNLPTSASQNAGITGVSHWAWP

SEQ ID NO: 748161 - protein, 167 aa, Homo sapiens
VLGFRCEPVHPATNLVLKTTQIDCLWLCICRSQSSRALSELKWQWQGCIPIWRLQGEDLPCTLHSPGLAAPSPPPKQQCWAESICCRPPLNTSASSSTFKNTWEYTGLTHTIQDNLPLQILSLHLQSPLHLGRPHSPTSAGSCVDTLKSRLRLLVCTSMLFLCLFFP

SEQ ID NO: 748162 - protein, 69 aa, Homo sapiens
NPNHWPKFHPLPQTSSPLQHHGCSPYQQLAEGLPGISSPPWNQIQVPLTATAPHLIPGLLVVKPRPFLL

SEQ ID NO: 748163 - protein, 106 aa, Homo sapiens
ETTPGEVCHGPQETGDGFPGPPRKTKEEKFTFIEHQMFAHHCCGLWWGKGWFNSVITPTWQCYEGHIITILQTGKLRLKHEGSKVIQQVSGRGRICFAPGPHPPGS

SEQ ID NO: 748164 - protein, 133 aa, Homo sapiens
SQPSKSTARPVGPRDLHSLNGTRRNVHFQATILRHRTQFSPQVSDSRPCSWCSEPTKPAVLPHSFVSRGQLICFFSHYSSNPAPPSTHTLLDTGLQTNHMACAPENACLKAQGVQTLADENGRKEAKPEARKQ

SEQ ID NO: 748165 - protein, 1014 aa, Homo sapiens
AVTSLSVSFPMLFHPLLPHLISPPLDPGTLAGNQRLQQVMHAADPLEIQADVHWTHIREREEEERMAPASESSASGAPLDENDLEEDVDSEPAEIEGEAAEDGDPGDTGAELDDDQHWSDSPSDADRELRLPCPAEGEAELELRVSEDEEKLPASPKHQERGPSQATSPIRSPQESALLFIPVHSPSTEGPQLPPVPAATQEKSPEERLFPEPLLPKEKPKADAPSDLKAVHSPIRSQPVTLPEARTPVSPGSPQPQPPVAASTPPPSPLPICSQPQPSTEATVPSPTQSPIRFQPAPAKTSTPLAPLPVQSQSDTKDRLGSPLAVDEALRRSDLVEEFWMKSAEIRRSLGLTPVDRSKGPEPSFPTPAFRPVSLKSYSVEKSPQDEGLHLLKPLSIPKRLGLPKPEGEPLSLPTPRSPSDRELRSAQEERRELSSSSGLGLHGSSSNMKTLGSQSFNTSDSAMLTPPSSPPPPPPPGEEPATLRRKLREAEPNASVVPPPLPATWMRPPREPAQPPREEVRKSFVESVEEIPFADDVEDTYDDKTEDSSLQEKFFTPPSCWPRPEKPRHPPLAKENGRLPALEGTLQPQKRGLPLVSAEAKELAEERMRAREKSVKSQALRDAMARQLSRMQQMELASGAPRPRKASSAPSQGKERRPDSPTRPTLRGSEEPTLKHEATSEEVLSPPSDSGGPDGSFTSSEGSSGKSKKRSSLFSPRRNKKEKKSKGEGRPPEKPSSNLLEEAAAKPKSLWKSVFSGYKKDKKKKADDKSCPSTPSSGATVDSGKHRVLPVVRAELQLRRQLSFSEDSDLSSDDVLEKSSQKSRREPRTYTEEELNAKLTRRVQKAARRQAKQEELKRLHRAQIIQRQLQQVEERQRRLEERGVAVEKALRGEAGMGKKDDPKLMQEWFKLVQEKNAMVRYESELMIFARELELEDRQSRLQQELRERMAVEDHLKTEEELSEEKQILNEMLEVVEQRDSLVALLEEQRLREREEDKDLEAAMLSKGFSLNWS

SEQ ID NO: 748166 - protein, 126 aa, Homo sapiens
AVTSLSVSFPMLFHPLLPHLISPPLDPGTLAGNQRLQQVMHAADPLEIQADVHWTHIREREEEERMAPASESSASGGKHSQPQAAVCPEHHPPAASVATGGLSVRAEPPMRSHTGARRIPLCCCQL

SEQ ID NO: 748167 - protein, 1025 aa, Homo sapiens
QCPHLQPLFSSHLAPSIEKCPPPVFGGPGPPPAPMLRVESPLGLAASPLSWGLHGSALRKAVPLAPVKMQPAVCPPFLPSFEPFCFAAPLDENDLEEDVDSEPAEIEGEAAEDGDPGDTGAELDDDQHWSDSPSDADRELRLPCPAEGEAELELRVSEDEEKLPASPKHQERGPSQATSPIRSPQESALLFIPVHSPSTEGPQLPPVPAATQEKSPEERLFPEPLLPKEKPKADAPSDLKAVHSPIRSQPVTLPEARTPVSPGSPQPQPPVAASTPPPSPLPICSQPQPSTEATVPSPTQSPIRFQPAPAKTSTPLAPLPVQSQSDTKDRLGSPLAVDEALRRSDLVEEFWMKSAEIRRSLGLTPVDRSKGPEPSFPTPAFRPVSLKSYSVEKSPQDEGLHLLKPLSIPKRLGLPKPEGEPLSLPTPRSPSDRELRSAQEERRELSSSSGLGLHGSSSNMKTLGSQSFNTSDSAMLTPPSSPPPPPPPGEEPATLRRKLREAEPNASVVPPPLPATWMRPPREPAQPPREEVRKSFVESVEEIPFADDVEDTYDDKTEDSSLQEKFFTPPSCWPRPEKPRHPPLAKENGRLPALEGTLQPQKRGLPLVSAEAKELAEERMRAREKSVKSQALRDAMARQLSRMQQMELASGAPRPRKASSAPSQGKERRPDSPTRPTLRGSEEPTLKHEATSEEVLSPPSDSGGPDGSFTSSEGSSGKSKKRSSLFSPRRNKKEKKSKGEGRPPEKPSSNLLEEAAAKPKSLWKSVFSGYKKDKKKKADDKSCPSTPSSGATVDSGKHRVLPVVRAELQLRRQLSFSEDSDLSSDDVLEKSSQKSRREPRTYTEEELNAKLTRRVQKAARRQAKQEELKRLHRAQIIQRQLQQVEERQRRLEERGVAVEKALRGEAGMGKKDDPKLMQEWFKLVQEKNAMVRYESELMIFARELELEDRQSRLQQELRERMAVEDHLKTEEELSEEKQILNEMLEVVEQRDSLVALLEEQRLREREEDKDLEAAMLSKGFSLNWS

SEQ ID NO: 748168 - protein, 929 aa, Homo sapiens
MSKWRGCSQVEKELASLRVCTHFCPFPLPDQHWSDSPSDADRELRLPCPAEGEAELELRVSEDEEKLPASPKHQERGPSQATSPIRSPQESALLFIPVHSPSTEGPQLPPVPAATQEKSPEERLFPEPLLPKEKPKADAPSDLKAVHSPIRSQPVTLPEARTPVSPGSPQPQPPVAASTPPPSPLPICSQPQPSTEATVPSPTQSPIRFQPAPAKTSTPLAPLPVQSQSDTKDRLGSPLAVDEALRRSDLVEEFWMKSAEIRRSLGLTPVDRSKGPEPSFPTPAFRPVSLKSYSVEKSPQDEGLHLLKPLSIPKRLGLPKPEGEPLSLPTPRSPSDRELRSAQEERRELSSSSGLGLHGSSSNMKTLGSQSFNTSDSAMLTPPSSPPPPPPPGEEPATLRRKLREAEPNASVVPPPLPATWMRPPREPAQPPREEVRKSFVESVEEIPFADDVEDTYDDKTEDSSLQEKFFTPPSCWPRPEKPRHPPLAKENGRLPALEGTLQPQKRGLPLVSAEAKELAEERMRAREKSVKSQALRDAMARQLSRMQQMELASGAPRPRKASSAPSQGKERRPDSPTRPTLRGSEEPTLKHEATSEEVLSPPSDSGGPDGSFTSSEGSSGKSKKRSSLFSPRRNKKEKKSKGEGRPPEKPSSNLLEEAAAKPKSLWKSVFSGYKKDKKKKADDKSCPSTPSSGATVDSGKHRVLPVVRAELQLRRQLSFSEDSDLSSDDVLEKSSQKSRREPRTYTEEELNAKLTRRVQKAARRQAKQEELKRLHRAQIIQRQLQQVEERQRRLEERGVAVEKALRGEAGMGKKDDPKLMQEWFKLVQEKNAMVRYESELMIFARELELEDRQSRLQQELRERMAVEDHLKTEEELSEEKQILNEMLEVVEQRDSLVALLEEQRLREREEDKDLEAAMLSKGFSLNWS

SEQ ID NO: 748169 - protein, 1025 aa, Homo sapiens; identical to SEQ ID NO: 748167

SEQ ID NO: 748170 - protein, 1025 aa, Homo sapiens; identical to SEQ ID NO: 748167

SEQ ID NO: 748171 - protein, 1025 aa, Homo sapiens; identical to SEQ ID NO: 748167

SEQ ID NO: 748172 - protein, 1025 aa, Homo sapiens; identical to SEQ ID NO: 748167

SEQ ID NO: 748173 - protein, 1002 aa, Homo sapiens
QCPHLQPLFSSHLAPSIEKCPPPVFGGPGPPPAPMLRVESPLGLAASPLSWGLHGSALRKAVPLAPVKMQPAVCPPFLPSFEPFCFAAPLDENDLEEDVDSEPAEIEGEAAEDGDPGDTGAELDDDQHWSDSPSDADRELRLPCPAEGEAELELRVSEDEEKLPASPKHQERGPSQATSPIRSPQESALLFIPVHSPSTEGPQLPPVPAATQEKSPEERLFPEPLLPKEKPKADAPSDLKAVHSPIRSQPVTLPEARTPVSPGSPQPQPPVAASTPPPSPLPICSQPQPSTEATVPSPTQSPIRFQPAPAKTSTPLAPLPVQSQSDTKDRLGSPLAVDEALRRSDLVEEFWMKSAEIRRSLGLTPVDRSKGPEPSFPTPAFRPVSLKSYSVEKSPQDEGLHLLKPLSIPKRLGLPKPEGEPLSLPTPRSPSDRELRSAQEERRELSSSSGLGLHGSSSNMKTLGSQSFNTSDSAMLTPPSSPPPPPPPGEEPATLRRKLREAEPNASVVPPPLPATWMRPPREPAQPPREEVRKSFVESVEEIPFADDVEDTYDDKTEDSSLQEKFFTPPSCWPRPEKPRHPPLAKENGRLPALEGTLQPQKRGLPLVSAEAKELAEERMRAREKSVKSQALRDAMARQLSRMQQMELASGAPRPRKASSAPSQGKERRPDSPTRPTLRGSEEPTLKHEATSEEVLSPPSDSGGPDGSFTSSEGSSGKSKKRSSLFSPRRNKKEKKSKGEGRPPEKPSSNLLEEAAAKPKSLWKSVFSGYKKDKKKKADDKSCPSTPSSGATVDSGKHRVLPVVRAELQLRRQLSFSEDSDLSSDDVLEKSSQKSRREPRTYTEEELNAKLTRRVQKAARRQAKQEELKRLHRAQIIQRQLQQVEERQRRLEERGVAVEKALRGEADYWGESYYSDLIDLHLGGMYGSACADTNPADALSPPTLPSPCSQKQGEINPITKWQKHRPFSSSKQSSVLISPLPTCAPEEDLSLLLLPGVVFNFL

SEQ ID NO: 748174 - protein, 1052 aa, Homo sapiens
QCPHLQPLFSSHLAPSIEKCPPPVFGGPGPPPAPMLRVESPLGLAASPLSWGLHGSALRKAVPLAPVKMQPAVCPPFLPSFEPFCFAAPLDENDLEEDVDSEPAEIEGEAAEDGDPGDTGAELDDDQHWSDSPSDADRELRLPCPAEGEAELELRVSEDEEKLPASPKHQERGPSQATSPIRSPQESALLFIPVHSPSTEGPQLPPVPAATQEKSPEERLFPEPLLPKEKPKADAPSDLKAVHSPIRSQPVTLPEARTPVSPGSPQPQPPVAASTPPPSPLPICSQPQPSTEATVPSPTQSPIRFQPAPAKTSTPLAPLPVQSQSDTKDRLGSPLAVDEALRRSDLVEEFWMKSAEIRRSLGLTPVDRSKGPEPSFPTPAFRPVSLKSYSVEKSPQDEGLHLLKPLSIPKRLGLPKPEGEPLSLPTPRSPSDRELRSAQEERRELSSSSGLGLHGSSSNMKTLGSQSFNTSDSAMLTPPSSPPPPPPPGEEPATLRRKLREAEPNASVVPPPLPATWMRPPREPAQPPREEVRKSFVESVEEIPFADDVEDTYDDKTEDSSLQEKFFTPPSCWPRPEKPRHPPLAKENGRLPALEGTLQPQKRGLPLVSAEAKELAEERMRAREKSVKSQALRDAMARQLSRMQQMELASGAPRPRKASSAPSQGKERRPDSPTRPTLRGSEEPTLKHEATSEEVLSPPSDSGGPDGSFTSSEGSSGKSKKRSSLFSPRRNKKEKKSKGEGRPPEKPSSNLLEEAAAKPKSLWKSVFSGYKKDKKKKADDKSCPSTPSSGATVDSGKHRVLPVVRAELQLRRQLSFSEDSDLSSDDVLEKSSQKSRRESIYVPHALAFRRSCASKPRTYTEEELNAKLTRRVQKAARRQAKQEELKRLHRAQIIQRQLQQVEERQRRLEERGVAVEKALRGEADYWGESYYSDLIDLHLGGMGKKDDPKLMQEWFKLVQEKNAMVRYESELMIFAGAGAGNRRVTGASRTLRGILKGGGCKKRFRCGGGQTRAWARPKEEAGAPGLVPRFVRGVPAGAYGKPGIHPVSFPPL

SEQ ID NO: 748175 - protein, 539 aa, Homo sapiens
MGSPEDDLIGIPFPDHSSELLSCLNEQRQLGHLCDLTIRTQGLEYRTHRAVLAACSHYFKKLFTEGGGGAVMGAGGSGTATGGAGAGVCELDFVGPEALGALLEFAYTATLTTSSANMPAVLQAARLLEIPCVIAACMEILQGSGLEAPSPDEDDCERARQYLEAFATATASGVPNGEDSPPQVPLPPPPPPPPRPVARRSRKPRKAFLQTKGARANHLVPEVPTVPAHPLTYEEEEVAGRVGSSGGSGPGDSYSPPTGTASPPEGPQSYEPYEGEEEEEELVYPPAYGLAQGGGPPLSPEELGSDEDAIDPDLMAYLSSLHQDNLAPGLDSQDKLVRKRRSQMPQECPVCHKIIHGAGKLPRHMRTHTGEKPFACEVCGVRFTRNDKLKIHMRKHTGERPYSCPHCPARFLHSYDLKNHMHLHTGDRPYECHLCHKAFAKEDHLQRHLKGQNCLEVRTRRRRKDDAPPHYPPPSTAAASPAGLDLSNGHLDTFRLSLARFWEQSAPTGPPVSTPGPPDDDEEEGAPTTPQAEGAMESS

SEQ ID NO: 748176 - protein, 539 aa, Homo sapiens; identical to SEQ ID NO: 748175

SEQ ID NO: 748177 - protein, 539 aa, Homo sapiens; identical to SEQ ID NO: 748175

SEQ ID NO: 748178 - protein, 539 aa, Homo sapiens; identical to SEQ ID NO: 748175

SEQ ID NO: 748179 - protein, 404 aa, Homo sapiens
MGSPEDDLIGIPFPDHSSELLSCLNEQRQLGHLCDLTIRTQGLEYRTHRAVLAACSHATSAVARRSRKPRKAFLQTKGARANHLVPEVPTVPAHPLTYEEEEVAGRVGSSGGSGPGDSYSPPTGTASPPEGPQSYEPYEGEEEEEELVYPPAYGLAQGGGPPLSPEELGSDEDAIDPDLMAYLSSLHQDNLAPGLDSQDKLVRKRRSQMPQECPVCHKIIHGAGKLPRHMRTHTGEKPFACEVCGVRFTRNDKLKIHMRKHTGERPYSCPHCPARFLHSYDLKNHMHLHTGDRPYECHLCHKAFAKEDHLQRHLKGQNCLEVRTRRRRKDDAPPHYPPPSTAAASPAGLDLSNGHLDTFRLSLARFWEQSAPTGPPVSTPGPPDDDEEEGAPTTPQAEGAMESS

SEQ ID NO: 748180 - protein, 437 aa, Homo sapiens
MGSPEDDLIGIPFPDHSSELLSCLNEQRQLGHLCDLTIRTQGLEYRTHRAVLAACSHYFKKLFTEGGGGAVMGAGGSGTATGGAGAGVCELDFVGPEALGALLEFAYTATLTTSSANMPAVLQAARLLEIPCVIAACMEILQGSGLEAPSPDEDDCERARQYLEAFATATASGVPNGEDSPPQVPLPPPPPPPPRPVARRSRKPRKAFLQTKGARANHLVPEVPTVPAHPLTYEEEEVAGRVGSSGGSGPGDSYSPPTGTASPPEGPQSYEPYEGEEEEEELVYPPAYGLAQGGGPPLSPEELGSDEDAIDPDLMAYLSSLHQDNLAPGLDSQDKLVRKRRSQMPQECPVCHKIIHGAGKLPRHMRTHTGEKPFACEVCGVRFTRNDKLKIHMRKHTGERPYSCPHCPARFLHSYDLKNHMHLHTGDRPYECHRCRP

SEQ ID NO: 748181 - protein, 153 aa, Homo sapiens
MGGKQAGGQVRQQDRTGAGPQAPGPGGGRASSHTVSLSSSSQRTRRLRGAPEPGLGDLELGRDLTPTAPGSSQLPSPPSPFVACGLSSPPRPPGSEDVTAWSSSSLTPSCCSWRSLARPLSGSLAEPRGRGLGTWGGGALRACVPGPYLFSLL

SEQ ID NO: 748182 - protein, 252 aa, Homo sapiens
MGGLRPWSRYGLLVVAHLLALGLGAVVFQALEGPPACRLQAELRAELAAFQAEHRACLPPGALEELLGTALATQAHGVSTLGNSSEGRTWDLPSALLFAASILTTTGYGHMAPLSPGGKAFCMVYAALGLPASLALVATLRHCLLPVLSRPRAWVAVHWQLSPARAALLQAVALGLLVASSFVLLPALVLWGLQGDCSLLGAVYFCFSSLSTIGLEDLLPGRGRSLHPVIYHLGQLALLGGGTSLQGTAWEG

SEQ ID NO: 748183 - protein, 255 aa, Homo sapiens
MGGLRPWSRYGLLVVAHLLALGLGAVVFQALEGPPACRLQAELRAELAAFQAEHRACLPPGALEELLGTALATQAHGVSTLGNSSEGRTWDLPSALLFAASILTTTGYGHMAPLSPGGKAFCMVYAALGLPASLALVATLRHCLLPVLSRPRAWVAVHWQLSPARAALLQAVALGLLVASSFVLLPALVLWGLQGDCSLLGAVYFCFSSLSTIGLEDLLPGRGRSLHPVIYHLGQLALLVASRTLGHAAGSGDLL

SEQ ID NO: 748184 - protein, 257 aa, Homo sapiens
MGGLRPWSRYGLLVVAHLLALGLGAVVFQALEGPPACRLQAELRAELAAFQAEHRACLPPGALEELLGTALATQAHGVSTLGNSSEGRTWDLPSALLFAASILTTTGYGHMAPLSPGGKAFCMVYAALGLPASLALVATLRHCLLPVLSRPRAWVAVHWQLSPARAALLQAVALGLLVASSFVLLPALVLWGLQGDCSLLGAVYFCFSSLSTIGLEDLLPGRGRSLHPVIYHLGQLALLGKSSHLTACGGRGKRSLD

SEQ ID NO: 748185 - protein, 197 aa, Homo sapiens
DEEEQSQLEPGPGQFKATRGQPSAEGSIGVGRDPSRHGTQSSHCPLTLSSPGYGHMAPLSPGGKAFCMVYAALGLPASLALVATLRHCLLPVLSRPRAWVAVHWQLSPARAALLQAVALGLLVASSFVLLPALVLWGLQGDCSLLGAVYFCFSSLSTIGLEDLLPGRGRSLHPVIYHLGQLALLGGGTSLQGTAWEG

SEQ ID NO: 748186 - protein, 109 aa, Homo sapiens [sequence omitted]

SEQ ID NO: 748187 - protein, 521 aa, Homo sapiens
CAGEVASVLPGRSRSAPCRAQSLAPGCSDLVSARREQRESMEDPSEPDRLASADGGSPEEEEDGEREPLLPRIAWAHPRRGAPGSAVRLLDAAGEEGEAGDEELPLPPGDVGVSRSSPAELDRSRPAVSVTIGTSEMNAFLDDPEFADIMLRAEQAIEVGIFPERISQGSSGSYFVKDPKRKIIGVFKPKSEEPYGQLNPKWTKYVHKVCCPCCFGRGCLIPNQGYLSEAGAYLVDNKLHLSIVPKTKVVWLVSETFNYNAIDRAKSRGKKYALEKVPKVGRKFHRIGLPPKIGSFQLFVEGYKEAEYWLRKFEADPLPENIRKQFQSQFERLVILDYIIRNTDRGNDNWLVRYEKQKCEKEIDHKESKWIDDEEFLIKIAAIDNGLAFPFKHPDEWRAYPFHWAWLPQAKVPFSEEIRNLILPYISDMNFVQDLCEDLYELFKTDKGFDKATFESQMSVMRGQILNLTQALRDGKSPFQLVQIPCVIVERSQGGSQGRIVHLSNSFTQTVNCRKPFFSSW

SEQ ID NO: 748188 - protein, 521 aa, Homo sapiens; identical to SEQ ID NO: 748187

SEQ ID NO: 748189 - protein, 521 aa, Homo sapiens; identical to SEQ ID NO: 748187

SEQ ID NO: 748190 - protein, 521 aa, Homo sapiens; identical to SEQ ID NO: 748187

SEQ ID NO: 748191 - protein, 369 aa, Homo sapiens
CAGEVASVLPGRSRSAPCRAQSLAPGCSDLVSARREQRESMEDPSEPDRLASADGGSPEEEEDGEREPLLPRIAWAHPRRGAPGSAVRLLDAAGEEGEAGDEELPLPPGDVGVSRSSPAELDRSRPAVSVTIGTSEMNAFLDDPEFADIMLRAEQAIEVGIFPERISQGSSGSYFVKDPKRKIIGVFKPKSEEPYGQLNPKWTKYVHKVCCPCCFGRGCLIPNQGYLSEAGAYLVDNKLHLSIVPKTKVVWLVSETFNYNAIDRAKSRGKKYALEKVPKVGRKFHRIGLPPKIGSFQLFVEGYKEAEYWLRKFEADPLPENIRKQFQSQFERLVILDYIIRNTGIEVLSFVHVNLVHFQTIFLLSKSKR

SEQ ID NO: 748192 - protein, 305 aa, Homo sapiens
CAGEVASVLPGRSRSAPCRAQSLAPGCSDLVSARREQRESMEDPSEPDRLASADGGSPEEEEDGEREPLLPRIAWAHPRRGAPGSAVRLLDAAGEEGEAGDEELPLPPGDVGVSRSSPAELDRSRPAVSVTIGTSEMNAFLDDPEFADIMLRAEQAIEVGIFPERISQGSSGSYFVKDPKRKIIGVFKPKSEEPYGQLNPKWTKYVHKVCCPCCFGRGCLIPNQGYLSEAGAYLVDNKLHLSIVPKTKVVWLVSETFNYNAIDRAKSRGKKYALEKVPKVGRKFHRIGLPPKRVSLCCPSWSTVL

SEQ ID NO: 748193 - protein, 136 aa, Homo sapiens; identical to SEQ ID NO: 741065

SEQ ID NO: 748194 - protein, 1253 aa, Homo sapiens
MKIITYFCIWAVAWAIPVPQSKPLERHVEKSMNLHLLARSNVSVQDELNASGTIKESGVLVHEGDRGRQENTQDGHKGEGNGSKWAEVGGKSFSTYSTLANEEGNIEGWNGDTGKAETYGHDGIHGKEENITANGIQGQVSIIDNAGATNRSNTNGNTDKNTQNGDVGDAGHNEDVAVVQEDGPQVAGSNNSTDNEDEIIENSCRNEGNTSEITPQINSKRNGTKEAEVTPGTGEDAGLDNSDGSPSGNGADEDEDEGSGDDEDEEAGNGKDSSNNSKGQEGQDHGKEDDHDSSIGQNSDSKEYYDPEGKEDPHNEVDGDKTSKSEENSAGIPEDNGSQRIEDTQKLNHRESKRVENRITKESETHAVGKSQDKGIEIKGPSSGNRNITKEVGKGNEGKEDKGQHGMILGKGNVKTQGEVVNIEGPGQKSEPGNKVGHSNTGSDSNSDGYDSYDFDDKSMQGDDPNSSDESNGNDDANSESDNNSSSRGDASYNSDESKDNGNGSDSKGAEDDDSDSTSDTNNSDSNGNGNNGNDDNDKSDSGKGKSDSSDSDSSDSSNSSDSSDSSDSDSSDSNSSSDSDSSDSDSSDSSDSDSSDSSNSSDSSDSSDSSDSSDSSDSSDSKSDSSKSESDSSDSDSKSDSSDSNSSDSSDNSDSSDSSNSSNSSDSSDSSDSSDSSSSSDSSSSSDSSNSSDSSDSSDSSNSSESSDSSDSSDSDSSDSSDSSNSNSSDSDSSNSSDSSDSSDSSDSSNSSDSSDSSDSSNSSDSSDSSDSSDSSDSSNSSDSNDSSNSSDSSDSSNSSDSSNSSDSSDSSDSSDSDSSNSSDSSNSSDSSDSSNSSDSSDSSDSSDSSDSDSSNRSDSSNSSDSSDSSDSSNSSDSSDSSDSSDSNESSNSSDSSDSSNSSDSDSSDSSNSSDSSDSSNSSDSSESSNSSDNSNSSDSSNSSDSSDSSDSSNSSDSSNSGDSSNSSDSSDSNSSDSSDSSNSSDSSDSSDSSDSSDSSDSSNSSDSSDSSDSSDSSNSSDSSNSSDSSDSSDSSDSSDSSDSSNSSDSSDSSDSSDSSDSSGSSDSSDSSDSSDSSDSSDSSDSSDSSDSSESSDSSDSSDSSDSSDSSDSSDSSDSSDSSDSSDSSNSSDSSDSSDSSDSSDSSDSSDSSDSSDSSDSSDSSDSSDSSDSSDSSDSSDSNESSDSSDSSDSSDSSNSSDSSDSSDSSDSTSDSNDESDSQSKSGNGNNNGSDSDSDSEGSDSNHSTSDD

SEQ ID NO: 748195 - protein, 307 aa, Homo sapiens
MLRVVEGIFIFVVVSESVFGVLGNGFIGLVNCIDCAKNKLSTIGFILTGLAISRIFLIWIIITDGFIQIFSPNIYASGNLIEYISYFWVIGNQSSMWFATSLSIFYFLKIANFSNYIFLWLKSRTNMVLPFMIVFLLISSLLNFAYIAKILNDYKTKNDTVWDLNMYKSEYFIKQILLNLGVIFFFTLSLITCIFLIISLWRHNRQMQSNVTGLRDSNTEAHVKAMKVLISFIILFILYFIGMAIEISCFTVRENKLLLMFGMTTTAIYPWGHSFILILGNSKLKQASLRVLQQLKCCEKRKNLRVT

SEQ ID NO: 748196 - protein, 92 aa, Homo sapiens
SAASPEHGYICVRGCGPSGQGTAHDFGEATWCSRCCWLRLLQLRLGLFPGQRLLQFGFKKQSVTWAVFSSEWGLVRATSPPGPVCCQPKKGS

SEQ ID NO: 748197 - protein, 92 aa, Homo sapiens; identical to SEQ ID NO: 748196

SEQ ID NO: 748198 - protein, 483 aa, Homo sapiens
MAGFAELGLSSWLVEQCRQLGLKQPTPVQLGCIPAILEGRDCLGCAKTGSGKTAAFVLPILQKLSEDPYGIFCLVLTPTRELAYQIAEQFRVLGKPLGLKDCIIVGGMDMVAQALELSRKPHVVIATPGRLADHLRSSNTFSIKKIRFLVMDEADRLLEQGCTDFTVDLEAILAAVPARRQTLLFSATLTDTLRELQGLATNQPFFWEAQAPVSTVEQLDQRYLLVPEKVKDAYLVHLIQRFQDEHEDWSIIIFTNTCKTCQILCMMLRKFSFPTVALHSMMKQKERFAALAKFKSSIYRILIATDVASRGLDIPTVQVVINHNTPGLPKIYIHRVGRTARAGRQGQAITLVTQYDIHLVHAIEEQIKKKLEEFSVEEAEVLQILTQVNVVRRECEIKLEAAHFDEKKEINKRKQLILEGKDPDLEAKRKAELAKIKQKNRRFKEKVEETLKRQKAGRAGHKGRPPRTPSGSHSGPVPSQGLV

SEQ ID NO: 748199 - protein, 162 aa, Homo sapiens
MDEADRLLEQGCTDFTVDLEAILAAVPARRQTLLFSATLTDTLRELQGLATNQPFFWEAQAPVSTVEQLDQRYLLVPEKVKDAYLVHLIQRFQDEHEDWSIIIFTNTCKTCQILCMMLRKFSFPTVALHSMMKQLGRLRQENCLNPGSGGCNEWRSHNCTPA

SEQ ID NO: 748200 - protein, 544 aa, Homo sapiens
MAGFAELGLSSWLVEQCRQLGLKQPTPVQLGCIPAILEGRDCLGCAKTGSGKTAAFVLPILQKLSEDPYGIFCLVLTPTRELAYQIAEQFRVLGKPLGLKDCIIVGGMDMVAQALELSRKPHVVIATPGRLADHLRSSNTFSIKKIRFLVMDEADRLLEQGCTDFTVDLEAILAAVPARRQTLLFSATLTDTLRELQGLATNQPFFWEAQAPVSTVEQLDQRYLLVPEKVKDAYLVHLIQRFQDEHEDWSIIIFTNTCKTCQILCMMLRKFSFPTVALHSMMKQKERFAALAKFKSSIYRILIATDVASRVSSPQSPAKGLPLLLQGPTDEKAGLRMSGSPSIPAELTLGESLPRFPHMDSGADQPPPASRGLDIPTVQVVINHNTPGLPKIYIHRVGRTARAGRQGQAITLVTQYDIHLVHAIEEQIKKKLEEFSVEEAEVLQILTQVNVVRRECEIKLEAAHFDEKKEINKRKQLILEGKDPDLEAKRKAELAKIKQKNRRFKEKVEETLKRQKAGRAGHKGRPPRTPSGSHSGPVPSQGLV

SEQ ID NO: 748201 - protein, 507 aa, Homo sapiens
MAGFAELGLSSWLVEQCRQLGLKQPTPVQLGCIPAILEGRDCLGCAKTGSGKTAAFVLPILQKLSEDPYGIFCLVLTPTRELAYQIAEQFRVLGKPLGLKDCIIVGGMDMVAQALELSRKPHVVIATPGRLADHLRSSNTFSIKKIRFLVMDEADRLLEQGCTDFTVDLEAILAAVPARRQTLLFSATLTDTLRELQGLATNQPFFWEAQAPVSTVEQLDQRYLLVPEKVKDAYLVHLIQRFQDEHEDWSIIIFTNTCKTCQILCMMLRKFSFPTVALHSMMKQKERFAALAKFKSSIYRILIATDVASRGLDIPTVQVVINHNTPGLPKIYIHRVGRTARAGRQGQAITLVTQYDIHLVHAIEEQIKKKLEEFSVEEAEVLQILTQVNVVRRECEIKLEAAHFDEKKEINKRKQLILEGKDPDLEAKRKAELAKIKQKNRRFKEKVEETLKRQKAGRAGHKGRPPRTPSGSHSGRGPTQCPTAEPVGARVVRALLLCPETTGWSLP

SEQ ID NO: 748202 - protein, 413 aa, Homo sapiens
MAGFAELGLSSWLVEQCRQLGLKQPTPVQLGCIPAILEGRDCLGCAKTGSGKTAAFVLPILQKLSEDPYGIFCLVLTPTRELAYQIAEQFRVLGKPLGLKDCIIVGGMDMVAQALELSRKPHVVIATPGRLADHLRSSNTFSIKKIRFLVMDEADRLLEQGCTDFTVDLEAILAAVPARRQTLLFSATLTDTLRELQGLATNQPFFWEAQAPVSTVEQLDQRYLLVPEKVKDAYLVHLIQRFQDEHEDWSIIIFTNTCKTCQILCMMLRKFSFPTVALHSMMKQKERFAALAKFKSSIYRILIATDVASRGLDIPTVQVVINHNTPGLPKIYIHPGHRLGPTQAQSPPRAWSEPHTAICPVLDSSMELRVGGTFLGGSSPSRGPTQCPTAEPVGARVVRALLLCPETTGWSLP

SEQ ID NO: 748203 - protein, 456 aa, Homo sapiens
MAGFAELGLSSWLVEQCRQLGLKQPTPVQLGCIPAILEGRDCLGCAKTGSGKTAAFVLPILQKLSEDPYGIFCLVLTPTRELAYQIAEQFRVLGKPLGLKDCIIVGGMDMVAQALELSRKPHVVIATPGRLADHLRSSNTFSIKKIRFLVMDEADRLLEQGCTDFTVDLEAILAAVPARRQTLLFSATLTDTLRELQGLATNQPFFWEAQAPVSTVEQLDQRYLLVPEKVKDAYLVHLIQRFQDEHEDWSIIIFTNTCKTCQILCMMLRKFSFPTVALHSMMKQKERFAALAKFKSSIYRILIATDVASRGLDIPTVQVVINHNTPGLPKIYIHRVGRTARAGGRVTASAGENSTDDSTLVATPIEGSTIHARTLAPLPPWDSRPEVAKILTRSRGAEQSVGITLGGGRLENRGFPTEPCSAGEAALRHPAVAQHEQPPAGRPAPRAPGTQRGQTP

SEQ ID NO: 748204 - protein, 376 aa, Homo sapiens
MDMVAQALELSRKPHVVIATPGRLADHLRSSNTFSIKKIRFLVMDEADRLLEQGCTDFTVDLEAILAAVPARRQTLLFSATLTDTLRELQGLATNQPFFWEAQAPVSTVEQLDQRYLLVPEKVKDAYLVHLIQRFQDEHEDWSIIIFTNTCKTCQILCMMLRKFSFPTVALHSMMKQKERFAALAKFKSSIYRILIATDVASRGLDIPTVQVVINHNTPGLPKIYIHRVGRTARAGRQGQAITLVTQYDIHLVHAIEEQIKKKLEEFSVEEAEVLQILTQVNVVRRECEIKLEAAHFDEKKEINKRKQLILEGKDPDLEAKRKAELAKIKQKNRRFKEKVEETLKRQKAGRAGHKGRPPRTPSGSHSGPVPSQGLV

SEQ ID NO: 748205 - protein, 217 aa, Homo sapiens
MLRKFSFPTVALHSMMKQKERFAALAKFKSSIYRILIATDVASRGLDIPTVQVVINHNTPGLPKIYIHRVGRTARAGRQGQAITLVTQYDIHLVHAIEEQIKKKLEEFSVEEAEVLQILTQVNVVRRECEIKLEAAHFDEKKEINKRKQLILEGKDPDLEAKRKAELAKIKQKNRRFKEKVEETLKRQKAGRAGHKGRPPRTPSGSHSGPVPSQGLV

SEQ ID NO: 748206 - protein, 333 aa, Homo sapiens [sequence omitted]

SEQ ID NO: 748207 - protein, 321 aa, Homo sapiens
MVAQALELSRKPHVVIATPGRLADHLRSSNTFSIKKIRFLVMDEADRLLEQGCTDFTVDLEAILAAVPARRQTLLFSATLTDTLRELQGLATNQPFLTCQILCMMLRKFSFPTVALHSMMKQKERFAALAKFKSSIYRILIATDVASRGLDIPTVQVVINHNTPGLPKIYIHRVGRTARAGRQGQAITLVTQYDIHLVHAIEEQIKKKLEEFSVEEAEVLQILTQVNVVRRECEIKLEAAHFDEKKEINKRKQLILEGKDPDLEAKRKAELAKIKQKNRRFKEKVEETLKRQKAGRAGHKGRPPRTPSGSHSGPVPSQGLV

SEQ ID NO: 748208 - protein, 113 aa, Homo sapiens
MVAQALELSRKPHVVIATPGRLADHLRSSNTFSIKKIRFLVSSPRPCRPQELGSEPPGPMSEPGAPSHPFRKRMSVRLSSKTLGTVTRTVQGPTRGGPVLAMLFGGRALLRLG

SEQ ID NO: 748209 - protein, 518 aa, Homo sapiens
MAGFAELGLSSWLVEQCRQLGLKQPTPVQLGCIPAILEGRDCLGCAKTGSGKTAAFVLPILQKLSEDPYGIFCLVLTPTRGPAELNKMAPVQWLTPVIPALWELQELAYQIAEQFRVLGKPLGLKDCIIVGGMDMVAQALELSRKPHVVIATPGRLADHLRSSNTFSIKKIRFLVMDEADRLLEQGCTDFTVDLEAILAAVPARRQTLLFSATLTDTLRELQGLATNQPFFWEAQAPVSTVEQLDQRYLLVPEKVKDAYLVHLIQRFQDEHEDWSIIIFTNTCKTCQILCMMLRKFSFPTVALHSMMKQKERFAALAKFKSSIYRILIATDVASRGADQPPPASRGLDIPTVQVVINHNTPGLPKIYIHRVGRTARAGRQGQAITLVTQYDIHLVHAIEEQIKKKLEEFSVEEAEVLQILTQVNVVRRECEIKLEAAHFDEKKEINKRKQLILEGKDPDLEAKRKAELAKIKQKNRRFKEKVEETLKRQKAGRAGHKGRPPRTPSGSHSGPVPSQGLV

SEQ ID NO: 748210 - protein, 483 aa, Homo sapiens; identical to SEQ ID NO: 748198

SEQ ID NO: 748211 - protein, 483 aa, Homo sapiens; identical to SEQ ID NO: 748198

SEQ ID NO: 748212 - protein, 265 aa, Homo sapiens
MAGFAELGLSSWLVEQCRQLGLKQPTPVQLGCIPAILEGRDCLGCAKTGSGKTAAFVLPILQKLSEDPYGIFCLVLTPTRELAYQIAEQFRVLGKPLGLKDCIIVGGMDMVAQALELSRKPHVVIATPGRLADHLRSSNTFSIKKIRFLVMDEADRLLEQGCTDFTVDLEAILAAVPARRQTLLFSATLTDTLRELQGLATNQPFFWEAQAPVSTVEQLDQRYLLVPEKVKDAYLVHLIQRFQDEHEDWSIIIFTNTCKKNALPP

SEQ ID NO: 748213 - protein, 508 aa, Homo sapiens
MAGFAELGLSSWLVEQCRQLGLKQPTPVQLGCIPAILEGRDCLGCAKTGSGKTAAFVLPILQKLSEDPYGIFCLVLTPTRGPAELNKMAPVQWLTPVIPALWELQELAYQIAEQFRVLGKPLGLKDCIIVGGMDMVAQALELSRKPHVVIATPGRLADHLRSSNTFSIKKIRFLVMDEADRLLEQGCTDFTVDLEAILAAVPARRQTLLFSATLTDTLRELQGLATNQPFFWEAQAPVSTVEQLDQRYLLVPEKVKDAYLVHLIQRFQDEHEDWSIIIFTNTCKTCQILCMMLRKFSFPTVALHSMMKQKERFAALAKFKSSIYRILIATDVASRGLDIPTVQVVINHNTPGLPKIYIHRVGRTARAGRQGQAITLVTQYDIHLVHAIEEQIKKKLEEFSVEEAEVLQILTQVNVVRRECEIKLEAAHFDEKKEINKRKQLILEGKDPDLEAKRKAELAKIKQKNRRFKEKVEETLKRQKAGRAGHKGRPPRTPSGSHSGPVPSQGLV

SEQ ID NO: 748214 - protein, 374 aa, Homo sapiens [sequence omitted]

SEQ ID NO: 748215 - protein, 217 aa, Homo sapiens; identical to SEQ ID NO: 748205

SEQ ID NO: 748216 - protein, 333 aa, Homo sapiens
RAAGSADHTGPYKGPLQAATRMAGFAELGLSSWLVEQCRQLGLKQPTPVQLGCIPAILEGRDCLGCAKTGSGKTAAFVLPILQKLSEDPYGIFCLVLTPTRELAYQIAEQFRVLGKPLGLKDCIIVGGMDMVAQALELSRKPHVVIATPGRLADHLRSSNTFSIKKIRFLVMDEADRLLEQGCTDFTVDLEAILAAVPARRQTLLFSATLTDTLRELQGLATNQPFFWEAQAPVSTVEQLDQRYLLVPEKVKDAYLVHLIQRFQDEHEDWSIIIFTNTCKTCQILCMMLRKFSFPTVALHSMMKQLGRLRQENCLNPGSGGCNEWRSHNCTPA

SEQ ID NO: 748217 - protein, 82 aa, Homo sapiens
QVPTKADAEGQVGWPPGLPPWPGSSLFLHGLQLHIPRAASSCLGSQRCCHLQPEEPARSSNLRGPRMQKDWPVLSRKEEEAS

SEQ ID NO: 748218 - protein, 197 aa, Homo sapiens
GDRTPPDCSNLNILNGEIGARKSGVGNEHRVADQNSGSGTPRRGSEARPAPRHQPGAAFLYQRGVASRSPKATQGARWTARPADWFSPGANEPGRLQVLWQRGVRAETHDGQGGRGVTGFRLVRYWVMLCAALRALGGHSRQGGRSVPEAAPEWQPQLAGQPAPPGLTGRGNGRLGAAFARALPKPGFHPCISGVTT

SEQ ID NO: 748219 - protein, 143 aa, Homo sapiens
GDRTPPDCSNLNILNGEIGARKSGVGNEHRVADQNSGSGTPRRGSEARPAPRHQPGAAFLYQRGVASRSPKATQGARWTARPADWFSPGANEPGRLQVLWQRGVRAETHDGQGGRNRISSCCPDCLNSWLQATLLPRPLKVLG

SEQ ID NO: 748220 - protein, 120 aa, Homo sapiens
QGSVRASKRFIRGYVGIGCQAWRAPDYCIFPTSKGPASGSCTNTLHLLLPSCSTCHICCLYPLGMSKALEFRLGFKFWLCQVRMEGYDSGQITHFLQAPVFWICEMRTVLRRFAISVIVG

SEQ ID NO: 748221 - protein, 311 aa, Homo sapiens
MIKKNASSEDFFILLGFSNWPQLEVVLFVVILIFYLMTLTGNLFIIILSYVDSHLHTPMYFFLSNLSFLDLCHTTSSIPQLLVNLRGPEKTISYAGCMVQLYFVLALGIAECVLLVVMSYDRYVAVCRPLHYTVLMHPRFCHLLAAASWVIGFTISALHSSFTFWVPLCGHRLVDHFFCEVPALLRLSCVDTHANELTLMVMSSIFVLIPLILILTAYGAIARAVLSMQSTTGLQKVFRTCGAHLMVVSLFFIPVMCMYLQPPSENSPDQGKFIALFYTVVTPSLNPLIYTLRNKHVKGAAKRLLGWEWGK

SEQ ID NO: 748222 - protein, 117 aa, Homo sapiens
ILTQLATADARFWKGPSEPHLAKLEEDVWPCPQFHQTKAASGPPFVCVFRGWGGGGAGAWTLVLPQLRVVTQPLPFVSTFQPANCFPSVISFHLHCHTWSEQDRAYHPVYQMRKWQF

SEQ ID NO: 748223 - protein, 80 aa, Homo sapiens
AAWLSIGQPVLGASWGLRGLHTSALTSALVATVSGSLVLSPFMGPCCSRLAGESSLLYLPGPGLPLRTESVGPWNPAELS

SEQ ID NO: 748224 - protein, 707 aa, Homo sapiens
MLGSLVLRRKALAPRLLLRLLRSPTLRGHGGASGRNVTTGSLGEPQWLRVATGGRPGTSPALFSGRGAATGGRQGGRFDTKCLAAATWGRLPGPEETLPGQDSWNGVPSRAGLGMCALAAALVVHCYSKSPSNKDAALLEAARANNMQEVSRLLSEGADVNAKHRLGWTALMVAAINRNNSVVQVLLAAGADPNLGDDFSSVYKTAKEQGIHSLEDGGQDGASRHITNQWTSALEFRRWLGLPAGVLITREDDFNNRLNNRASFKGCTALHYAVLADDYRTVKELLDGGANPLQRNEMGHTPLDYAREGEVMKLLRTSEAKYQEKQRKREAEERRRFPLEQRLKEHIIGQESAIATVGAAIRRKENGWYDEEHPLVFLFLGSSGIGKTELAKQTAKYMHKDAKKGFIRLDMSEFQERHEVAKFIGSPPGYVGHEEGGQLTKKLKQCPNAVVLFDEVDKAHPDVLTIMLQLFDEGRLTDGKGKTIDCKDAIFIMTSNVASDEIAQHALQLRQEALEMSRNRIAENLGDVQISDKITISKNFKENVIRPILKAHFRRDEFLGRINEIVYFLPFCHSELIQLVNKELNFWAKRAKQRHNITLLWDREVADVLVDGYNVHYGARSIKHEVERRVVNQLAAAYEQDLLPGGCTLRITVEDSDKQLLKSPELPSPQAEKRLPKLRLEIIDKDSKTRRLDIRAPLHPEKVCNTI

SEQ ID NO: 748225 - protein, 707 aa, Homo sapiens; identical to SEQ ID NO: 748224

SEQ ID NO: 748226 - protein, 677 aa, Homo sapiens
MLGSLVLRRKALAPRLLLRLLRSPTLRGHGGASGRNVTTGSLGEPQWLRVATGGRPGTSPALFSGRGAATGGRQGGRFDTKCLAAATWGRLPGPEETLPGQDSWNGVPSRAGLGMCALAAALVVHCYSKSPSNKDAALLEAARANNMQEVSRLLSEGADVNAKHRLGWTALMVAAINRNNSVVQVLLAAGADPNLGDDFSSVYKTAKEQGIHSLEVLITREDDFNNRLNNRASFKGCTALHYAVLADDYRTVKELLDGGANPLQRNEMGHTPLDYAREGEVMKLLRTSEAKYQEKQRKREAEERRRFPLEQRLKEHIIGQESAIATVGAAIRRKENGWYDEEHPLVFLFLGSSGIGKTELAKQTAKYMHKDAKKGFIRLDMSEFQERHEVAKFIGSPPGYVGHEEGGQLTKKLKQCPNAVVLFDEVDKAHPDVLTIMLQLFDEGRLTDGKGKTIDCKDAIFIMTSNVASDEIAQHALQLRQEALEMSRNRIAENLGDVQISDKITISKNFKENVIRPILKAHFRRDEFLGRINEIVYFLPFCHSELIQLVNKELNFWAKRAKQRHNITLLWDREVADVLVDGYNVHYGARSIKHEVERRVVNQLAAAYEQDLLPGGCTLRITVEDSDKQLLKSPELPSPQAEKRLPKLRLEIIDKDSKTRRLDIRAPLHPEKVCNTI

SEQ ID NO: 748227 - protein, 677 aa, Homo sapiens; identical to SEQ ID NO: 748226

SEQ ID NO: 748228 - protein, 677 aa, Homo sapiens; identical to SEQ ID NO: 748226

SEQ ID NO: 748229 - protein, 395 aa, Homo sapiens
MLGSLVLRRKALAPRLLLRLLRSPTLRGHGGASGRNVTTGSLGEPQWLRVATGGRPGTSPALFSGRGAATGGRQGGRFDTKCLAAATWGRLPGPEETLPGQDSWNGVPSRAGLGMCALAAALVVHCYSKSPSNKDAALLEAARANNMQEVSRLLSEGADVNAKHRLGWTALMVAAINRNNSVVQVLLAAGADPNLGDDFSSVYKTAKEQGIHSLEVLITREDDFNNRLNNRASFKGCTALHYAVLADDYRTVKELLDGGANPLQRNEMGHTPLDYAREGEVMKLLRTSEAKYQEKQRKREAEERRRFPLEQRLKEHIIGQESAIATVGAAIRRKENGWYDEEHPLVFLFLGSSGIGKTELAKQTAKYMHKDAKKGFIRLDMSEFQERHEVSDDSP

SEQ ID NO: 748230 - protein, 563 aa, Homo sapiens [sequence omitted]

SEQ ID NO: 748231 - protein, 648 aa, Homo sapiens
MLGSLVLRRKALAPRLLLRLLRSPTLRGHGGASGRNVTTGSLGEPQWLRVATGGRPGTSPALFSGRGAATGGRQGGRFDTKCLAAATWGRLPGPEETLPGQDSWNGVPSRAGLGMCALAAALVVHCYSKSPSNKDAALLEAARANNMQEVSSVVQVLLAAGADPNLGDDFSSVYKTAKEQGIHSLEVLITREDDFNNRLNNRASFKGCTALHYAVLADDYRTVKELLDGGANPLQRNEMGHTPLDYAREGEVMKLLRTSEAKYQEKQRKREAEERRRFPLEQRLKEHIIGQESAIATVGAAIRRKENGWYDEEHPLVFLFLGSSGIGKTELAKQTAKYMHKDAKKGFIRLDMSEFQERHEVAKFIGSPPGYVGHEEGGQLTKKLKQCPNAVVLFDEVDKAHPDVLTIMLQLFDEGRLTDGKGKTIDCKDAIFIMTSNVASDEIAQHALQLRQEALEMSRNRIAENLGDVQISDKITISKNFKENVIRPILKAHFRRDEFLGRINEIVYFLPFCHSELIQLVNKELNFWAKRAKQRHNITLLWDREVADVLVDGYNVHYGARSIKHEVERRVVNQLAAAYEQDLLPGGCTLRITVEDSDKQLLKSPELPSPQAEKRLPKLRLEIIDKDSKTRRLDIRAPLHPEKVCNTI

SEQ ID NO: 748232 - protein, 630 aa, Homo sapiens
MLGSLVLRRKALAPRLLLRLLRSPTLRGHGDAALLEAARANNMQEVSRLLSEGADVNAKHRLGWTALMVAAINRNNSVVQVLLAAGADPNLGDDFSSVYKTAKEQGIHSLEDGGQDGASRHITNQWTSALEFRRWLGLPAGVLITREDDFNNRLNNRASFKGCTALHYAVLADDYRTVKELLDGGSSRELSPHSPRHPSYTGINFSPRISNGANPLQRNEMGHTPLDYAREGEVMKLLRTSEAKYQEKQRKREAEERRRFPLEQRLKEHIIGQESAIATVGAAIRRKENGWYDEEHPLVFLFLGSSGIGKTELAKQTAKYMHKDAKKGFIRLDMSEFQERHEVAKFIGSPPGYVGHEEGGQLTKKLKQCPNAVVLFDEVDKAHPDVLTIMLQLFDEGRLTDGKGKTIDCKDAIFIMTSNVASDEIAQHALQLRQEALEMSRNRIAENLGDVQISDKITISKNFKENVIRPILKAHFRRDEFLGRINEIVYFLPFCHSELIQLVNKELNFWAKRAKQRHNITLLWDREVADVLVDGYNVHYGARSIKHEVERRVVNQLAAAYEQDLLPGGCTLRITVEDSDKQLLKSPELPSPQAEKRLPKLRLEIIDKDSKTRRLDIRAPLHPEKVCNTI

SEQ ID NO: 748233 - protein, 355 aa, Homo sapiens
MSAPFDGVLLKDRDQDLFPVVTPVSSTHRMPSGNVEWMDGWVDDVVIRTGEAGFIRLDMSEFQERHEVAKFIGSPPGYVGHEEGGQLTKKLKQCPNAVVLFDEVDKAHPDVLTIMLQLFDEGRLTDGKGKTIDCKDAIFIMTSNVASDEIAQHALQLRQEALEMSRNRIAENLGDVQISDKITISKNFKENVIRPILKAHFRRDEFLGRINEIVYFLPFCHSELIQLVNKELNFWAKRAKQRHNITLLWDREVADVLVDGYNVHYGARSIKHEVERRVVNQLAAAYEQDLLPGGCTLRITVEDSDKQLLKSPELPSPQAEKRLPKLRLEIIDKDSKTRRLDIRAPLHPEKVCNTI

SEQ ID NO: 748234 - protein, 277 aa, Homo sapiens
RSLCIEWHVIKKLKQCPNAVVLFDEVDKAHPDVLTIMLQLFDEGRLTDGKGKTIDCKDAIFIMTSNVASDEIAQHALQLRQEALEMSRNRIAENLGDVQISDKITISKNFKENVIRPILKAHFRRDEFLGRINEIVYFLPFCHSELIQLVNKELNFWAKRAKQRHNITLLWDREVADVLVDGYNVHYGARSIKHEVERRVVNQLAAAYEQDLLPGGCTLRITVEDSDKQLLKSPELPSPQAEKRLPKLRLEIIDKDSKTRRLDIRAPLHPEKVCNTI

SEQ ID NO: 748235 - protein, 174 aa, Homo sapiens
PCNPSSRKENVIRPILKAHFRRDEFLGRINEIVYFLPFCHSELIQLVNKELNFWAKRAKQRHNITLLWDREVADVLVDGYNVHYGARSIKHEVERRVVNQLAAAYEQDLLPGGCTLRITVEDSDKQLLKSPELPSPQAEKRLPKLRLEIIDKDSKTRRLDIRAPLHPEKVCNTI

SEQ ID NO: 748236 - protein, 193 aa, Homo sapiens
LSWGRAPLPTTPSSGPTLRTSPSLSTPENVIRPILKAHFRRDEFLGRINEIVYFLPFCHSELIQLVNKELNFWAKRAKQRHNITLLWDREVADVLVDGYNVHYGARSIKHEVERRVVNQLAAAYEQDLLPGGCTLRITVEDSDKQLLKSPELPSPQAEKRLPKLRLEIIDKDSKTRRLDIRAPLHPEKVCNTI

SEQ ID NO: 748237 - protein, 287 aa, Homo sapiens
CWYWSRVLGSGERLRAVDYLSREVVRNSTLFAASSNAPRQPCWTWSAQGPAPRGYRSSCQDAGVPGVEEKSTGATATPPAAQVPNAPGPWRCFRPECDYWESRGAAVAEGSHRGAPWNIAGLVLRTWGSHRGAPGRTLRYQMPRGCHLGTPSWSRRNTPRTGQLERGPQQGRTGHVRPGRSAGGSLLQQESVQQGCSPVGSCPCQQYARSQQKQMCFASFCCSTGVRVWKLTLADPGITCWLLRRAAGLRLSPFGRAFAEQQCWESTLPSPRGCHYHIPLSCQALII

SEQ ID NO: 748238 - protein, 197 aa, Homo sapiens
GRGRRGARRPRRGARRPGGASGGEWRTRRRAAVPACRCSAAVAAPVYPALGTAPGGETVPAMSAAMRERFDRFLHEKNCMTDLLAKLEAKTGVNRSFIALGVIGLVALYLVFGYGASLLCNLIGFGYPAYISIKAIESPNKEDDTQWLTYWVVYGVFSIAEFFSDIFLSWFPFYYMLKCGFLLWCMAPSPSNGAELL

SEQ ID NO: 748239 - protein, 106 aa, Homo sapiens
TWEAEVAVSRDRVIALQPGQKERNSVSKKEKTTPRLLPYNQPQASPSLIQGDQLPPQRWDLGVDPSLSRPLSTFDCTECAKTRSWLFWALADRRSSGVFQVHSWLE

SEQ ID NO: 748240 - protein, 321 aa, Homo sapiens
MERKNQTAITEFIILGFSNLNELQFLLFTIFFLTYFCTLGGNILIILTTVTDPHLHTPMYYFLGNLAFIDICYTTSNVPQMMVHLLSKKKSISYVGCVVQLFAFVFFVGSECLLLAAMAYDRYIAICNPLRYSVILSKVLCNQLAASCWAAGFLNSVVHTVLTFCLPFCGNNQINYFFCDIPPLLILSCGNTSVNELALLSTGVFIGWTPFLCIVLSYICIISTILRIQSSEGRRKAFSTCASHLAIVFLFYGSAIFTYVRPISTYSLKKDRLVSVLYSVVTPMLNPIIYTLRNKDIKEAVKTIGSKWQPPISSLDSKLTY

SEQ ID NO: 748241 - protein, 82 aa, Homo sapiens
RYIQESWLENHGQYPSLEFVALLYALHTCDQVSLFGFGEDNCKRWSHYWDDKYWFENTMQNFPAEYQIILKLQCERKIAVYG

SEQ ID NO: 748242 - protein, 376 aa, Homo sapiens
MRSCRTLSDRSLMEGSHPMERGPQHSRGLKPQWVLLRPPAPAWKGQVLPHLLSPKKSFGLTLRLWDVLILEGEQVLTAMAHASFKIHREHLMKLSWSTVWEFQERLSQSWALEDNSVLRNLQTSMKELTKKHWDLPSPGELERGSSRVSPGIRPLCEGDRLALPSPPAQLQGLMPSAPQDKSLVLPQPGLTGLSPWRRPRPSSTKGLPQNPGQQAALWVAQRIKMWPPCFPVRSGLVLHKNTCAGTLMPHLHTDLDAGIHGFLTTILNRATGPLSLQHVTWTALQPHDGPGPASPLGPRHQALPRLMTEEAGQETPQQQGSTCLRCPSVEERGMEGAQVAHAQLRRSPRWLLDLGSGPWKIPFSGAWSHQGLWREG

SEQ ID NO: 748243 - protein, 264 aa, Homo sapiens
HNMAFSNADSGFVDAQLVLTHKDLLSGSIMATDEPMQPIFCFIQEGPQEEASPVHALRLTMAGILLHVSDRQHQAILVLEVQALEPYLYVANGSGLKVPQGDQGTINMAELHLGTNLDIRSGDEVHYHITDSPVLGTVAPGHSASTAFAQKDLLVGAVLFGHNGSLSSRNTLAFSMDVGPSQWMWGLLNGCGASAHRQCTRCTLQVTIALEGPLAPLKLAWHKKIYIFLGEAAEIRRDQLETTEFIISEPLANLYSCGDQNTLM

SEQ ID NO: 748244 - protein, 377 aa, Homo sapiens
GRLLAAVGSARESAARAGGGDASLIGGTRMNMTQARVLVAAVVGLVAVLLYASIHKIEEGHLAVYYRGGALLTSPSGPGYHIMLPFITTFRSVQTTLQTDEVKNVPCGTSGGVMIYIDRIEVVNMLAPYAVFDIVRNYTADYDKTLIFNKIHHELNQFCSAHTLQEVYIELFDQIDENLKQALQKDLNLMAPGLTIQAVRVTKPKIPEAIRRNFELMEAEKTKLLIAAQKQKVVEKEAETERKKAVIEAEKIAQVAKIRFQQKVMEKETEKRISEIEDAAFLAREKAKADAEYYAAHKYATSNKHKLTPEYLELKKYQAIASNSKIYFGSNIPNMFVDSSCALKYSDIRTGRESSLPSKEALEPSGENVIQNKESTG

SEQ ID NO: 748245 - protein, 346 aa, Homo sapiens
MTQARVLVAAVVGLVAVLLYASIHKIEEGHLAVYYRGGALLTSPSGPGYHIMLPFITTFRSVQTTLQTDEVKNVPCGTSGGVMIYIDRIEVVNMLAPYAVFDIVRNYTADYDKTLIFNKIHHELNQFCSAHTLQEVYIELFDQIDENLKQALQKDLNLMAPGLTIQAVRVTKPKIPEAIRRNFELMEAEKTKLLIAAQKQKVVEKEAETERKKAVIEAEKIAQVAKIRFQQKVMEKETEKRISEIEDAAFLAREKAKADAEYYAAHKYATSNKHKLTPEYLELKKYQAIASNSKIYFGSNIPNMFVDSSCALKYSDIRTGRESSLPSKEALEPSGENVIQNKESTG

SEQ ID NO: 748246 - protein, 377 aa, Homo sapiens; identical to SEQ ID NO: 748244

SEQ ID NO: 748247 - protein, 377 aa, Homo sapiens; identical to SEQ ID NO: 748244

SEQ ID NO: 748248 - protein, 350 aa, Homo sapiens
MTQARVLVAAVVGLVAVLLYASIHKIEEGHLAVYYRGGALLTSPSGPGYHIMLPFITTFRSVQTTLQTDEVKNVPCGTSGGVMIYIDRIEVVNMLAPYAVFDIVRNYTADYDKTLIFNKIHHELNQFCSAHTLQEVYIELFDQIDENLKQALQKDLNLMAPGLTIQAVRVTKPKIPEAIRRNFELMEAEKTKLLIAAQKQKVVEKEAETERKKAVIEAEKIAQVAKIRFQQKVMEKETEKRISEIEDGCIPGPKTGKRMRQSWGHKSHRQKAEVDPGQWGAQKSTPRVKRVTIGDRTPQVRDPTVVVNTKSDRSEKRPPGGRAGDTHPQNSRDQQIAQTHGARGKTAIAA

SEQ ID NO: 748249 - protein, 256 aa, Homo sapiens
RPQSKRPRKDPPSAVGSGNAGGSGPRGKGAEGGGSSSGNVSGVAPAAPAGGSRSSSRNLGSSGGEKEEGKKVRRQWESWSTEDKNTFFEGLYEHGKDFEAIQNNIALKYKKKGKPASMVKNKEQVRHFYYRTWHKITKYIDFDHVFSRGLKKSSQELYGLICYGELRKKIGGCMDDKNATKLNELIQVGATTVRYKGRNLRIKAPMCRALKKLCDPDGLSDEEDQKPVRLPLKVPIELQPRNNHAWARVQSLAQNP

SEQ ID NO: 748250 - protein, 199 aa, Homo sapiens
RPQSKRPRKDPPSAVGSGNAGGSGPRGKGAEGGGSSSGNVSGVAPAAPAGGSRSSSRNLGSSGGEKEEGKKVRRQWESWSTEDKNTFFEGLYEHGKDFEAIQNNIALKYKKKGKPASMVKNKEQVRHFYYRTWHKITKYIDFDHVFSRGLKKSSQELYGLICYGELRKKIGGCEYADCGVAHGSSCPLSPLGFSAQSCF

SEQ ID NO: 748251 - protein, 233 aa, Homo sapiens
MLAPFLRAEGGGSSSGNVSGVAPAAPAGGSRSSSRNLGSSGGEKEEGKKVRRQWESWSTEDKNTFFEGLYEHGKDFEAIQNNIALKYKKKGKPASMVKNKEQVRHFYYRTWHKITKYIDFDHVFSRGLKKSSQELYGLICYGELRKKIGGCMDDKNATKLNELIQVGATTVRYKGRNLRIKAPMCRALKKLCDPDGLSDEEDQKPVRLPLKVPIELQPRNNHAWARVQSLAQN

SEQ ID NO: 748252 - protein, 44 aa, Homo sapiens
MASCARRLGAVSTLTVGLPTAPPVLCHLWALVLRVVSSFPLTFI

SEQ ID NO: 748253 - protein, 205 aa, Homo sapiens
MAAAAGGAASRRGAGRPCPFSIEHILSSLPERSLPARAACPPQPAGRQSPAKPEEPGAPEAAPCACCCCCGPRAAPCGPPEAAAGLGARLAWPLRLGPAVPLSLGAPAGGSGALPGAVGPGSQRRTRRHRTIFSEEQLQALEALFVQNQYPDVSTRERLAGRIRLREERVEVWFKNRRAKWRHQKRASASARLLPGVKKSPKGSC

SEQ ID NO: 748254 - protein, 199 aa, Homo sapiens
LVVFGQTSALSIEESCRPGDKVPPIKPNAGEESVTSLDKLRFADGRSIRTSELRLSMQKSTQNHAAVFRVGSLLQEGCGKISKLYGDLKHLKTFDRGMVWNTDLVETLELQNLMLCALQTVNGAEAGKESRGAHAGEDYKVRLLATPTCTCLFLPPGGTQPHPCIFSAFYVVSPKVYPKNAFFPLVTLIPGFSPFSGSL

SEQ ID NO: 748255 - protein, 160 aa, Homo sapiens
AVVQSQLTAASNSWAAQVIFPTQPSEQLGLQRQSFAMLPRLECSGVISAHCSLHLLGSSSPPTSTSLRAETTGVSHHAWLIFRDRVSPSCPGWSQTPGLKQSSCLSLPEYWDYRCEPLPEKRFLRQGRSYIIFKFFLMMSFLAVHSQRTTHHTQETVVLM

SEQ ID NO: 748256 - protein, 206 aa, Homo sapiens
LVVFGQTSALSIEESCRPGDKVPPIKPNAGEESVTSLDKLRFADGRSIRTSELRLSMQKSTQNHAAVFRVGSLLQEGCGKISKLYGDLKHLKTFDRGMVWNTDLVETLELQNLMLCALQTVNGAEAGKESRGAHAGEDYKVRIDEYDHSKPIQGQQKKPFEEHWRKHTLSYVDVSTGKVTVEYRPIIDKTLNEADCATVPPAIHSY

SEQ ID NO: 748257 - protein, 89 aa, Homo sapiens
GLARLRQPSTSASEELGLQEDYKVRIDEYDHSKPIQGQQKKPFEEHWRKHTLSYVDVSTGKVTVEYRPIIDKTLNEADCATVPPAIHSY

SEQ ID NO: 748258 - protein, 97 aa, Homo sapiens
NASYVTESRSVVPCRLAGADSKGTGRSLQYKDKNLKWLLWRTGVSGGSETEIDSEVISGLLKFAQPENNTSHTRNSCAHVMGASALGRSGLLAHAAA

SEQ ID NO: 748259 - protein, 499 aa, Homo sapiens
MVDRGPLLTSAIIFYLAIGAAIFEVLEEPHWKEAKKNYYTQKLHLLKEFPCLGQEGLDKILEVVSDAAGQGVAITGNQTFNNWNWPNAMIFAATVITTIGYGNVAPKTPAGRLFCVFYGLFGVPLCLTWISALGKFFGGRAKRLGQFLTKRGVSLRKAQITCTVIFIVWGVLVHLVIPPFVFMVTEGWNYIEGLYYSFITISTIGFGDFVAGVNPSANYHALYRYFVELWIYLGLAWLSLFVNWKVSMFVEVHKAIKKRRRRRKESFESSPHSRKALQVKGSTASKDVNIFSFLSKKEETYNDLIKQIGKKAMKTSGGGETGPGPGLGPQGGGLPALPPSLVPLVVYSKNRVPTLEEVSQTLRSKGHVSRSPDEEAVARAPEDSSPAPEVFMNQLDRISEECEPWDAQDYHPLIFQDASITFVNTEAGLSDEETSKSSLEDNLAGEESPQQGAEAKAPLNMGEFPSSSESTFTSTESELSVPYEQLMNEYNKANSPKGT

SEQ ID NO: 748260 - protein, 499 aa, Homo sapiens; identical to SEQ ID NO: 748259

SEQ ID NO: 748261 - protein, 499 aa, Homo sapiens; identical to SEQ ID NO: 748259

SEQ ID NO: 748262 - protein, 346 aa, Homo sapiens
MDTGPDQSYFSGNHWFVFSVYLLTFLVGLPLNLLALVVFVGKLRCRPVAVDVLLLNLTASDLLLLLFLPFRMVEAANGMHWPLPFILCPLSGFIFFTTIYLTALFLAAVSIERFLSVAHPLWYKTRPRLGQAGLVSVACWLLASAHCSVVYVIEFSGDISHSQGTNGTCYLEFWKDQLAILLPVRLEMAVVLFVVPLIITSYCYSRLVWILGRGGSHRRQRRVAGLVAATLLNFLVCFGPYNVSHVVGYICGESPVWRIYVTLLSTLNSCVDPFVYYFSSSGFQADFHELLRRLCGLWGQWQQESSMELKEQKGGEEQRADRPAERKTSEHSQGCGTGGQVACAEN

SEQ ID NO: 748263 - protein, 317 aa, Homo sapiens
MAVQGSQRRLLGSLNSTPTAIPQLGLAANQTGARCLEVSISDGLFLSLGLVSLVENALVVATIAKNRNLHSPMYCFICCLALSDLLVSGSNVLETAVILLLEAGALVARAAVLQQLDNVIDVITCSSMLSSLCFLGAIAVDRYISIFYALRYHSIVTLPRARRAVAAIWVASVVFSTLFIAYYDHVAVLLCLVVFFLAMLVLMAVLYVHMLARACQHAQGIARLHKRQRPVHQGFGLKGAVTLTILLGIFFLCWGPFFLHLTLIVLCPEHPTCGCIFKNFNLFLALIICNAIIDPLIYAFHSQELRRTLKEVLTCSW

SEQ ID NO: 748264 - protein, 317 aa, Homo sapiens; identical to SEQ ID NO: 748263

SEQ ID NO: 748265 - protein, 382 aa, Homo sapiens
MAVQGSQRRLLGSLNSTPTAIPQLGLAANQTGARCLEVSISDGLFLSLGLVSLVENALVVATIAKNRNLHSPMYCFICCLALSDLLVSGSNVLETAVILLLEAGALVARAAVLQQLDNVIDVITCSSMLSSLCFLGAIAVDRYISIFYALRYHSIVTLPRARRAVAAIWVASVVFSTLFIAYYDHVAVLLCLVVFFLAMLVLMAVLYVHMLARACQHAQGIARLHKRQRPVHQGFGLKGAVTLTILLGIFFLCWGPFFLHLTLIVLCPEHPTCGCIFKNFNLFLALIICNAIIDPLIYAFHSQELRRTLKEVLTCSCSQDRALVSWDVKSLGGSVCQELLPQQPQEKGLCDQKASSTALQRLLQKEVKSLPQAKGPGLQEPP

SEQ ID NO: 748266 - protein, 83 aa, Homo sapiens
PRVADAWANHASGGRVGSCWGPFFLHLTLIVLCPEHPTCGCIFKNFNLFLALIICNAIIDPLIYAFHSQELRRTLKEVLTCSW

SEQ ID NO: 748267 - protein, 69 aa, Homo sapiens
LCAHMLTDGCQPLGSFRTGLGTRRTQRDWRVRTFSYVCSGKLSSMAAAQSPRVSGYTAAVSSLLGGAKG

SEQ ID NO: 748268 - protein, 350 aa, Homo sapiens
FRSMDTIVGMLHNRSETPTFAKVQRGVQDMMRRRFEERNVGQIKTVYPASYRFRQERSVPTFKDGTRRSDYQLTIEPLLEQEADGAAPQLTASRLLQRRQIFSQKLVEHVKEHHKAFLASLSPAMVVPEDQLTRWHPRFNVDEVPDIEPAALPQPPATEKLTTAQEVLARARNLISPRMEKALSQLALRSAAPSSPGSPRPALPATPPATPPAASPSALKGVSQDLLERIRAKEAQKQLAQMTRCPEQEQRLQRLERLPELARVLRSVFVSERKPALSMEVACARMVGSCCTIMSPGEMEKHLLLLSELLPDWLSLHRIRTDTYVKLDKAADLAHITARLAHQTRAEEGL

SEQ ID NO: 748269 - protein, 350 aa, Homo sapiens; identical to SEQ ID NO: 748268

SEQ ID NO: 748270 - protein, 338 aa, Homo sapiens
FRSMDTIVGMLHNRSETPTFAKVQRGVQDMMRRRFEERNVGQIKTVYPASYRFRQERSVPTFKDGTRRSDYQLTIEPLLEQEADGAAPQLTASRLLQRRQIFSQKLVEHVKEHHKAFLASLSPAMVVPEDQLTRWHPRFNVDEVPDIEPAALPQPPATEKLTTAQEMEKALSQLALRSAAPSSPGSPRPALPATPPATPPAASPSALKGVSQDLLERIRAKEAQKQLAQMTRCPEQEQRLQRLERLPELARVLRSVFVSERKPALSMEVACARMVGSCCTIMSPGEMEKHLLLLSELLPDWLSLHRIRTDTYVKLDKAADLAHITARLAHQTRAEEGL

SEQ ID NO: 748271 - protein, 296 aa, Homo sapiens
MSDSKEPRVQQLGLLGCLGHGALVLQLLSFMLLAGVLVAILVQVSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVGELPEKSKLQEIYQELTRLKAAVGELPEKSKLQEIYQELTELKAAVGELPEKSKLQEIYQELTQLKAAVGELPDQSKQQQIYQELTDLKTAFERLCRHCPKDWTFFQGNCYFMSNSQRNWHDSVTACQEVRAQLVVIKTAEEQLPAVLEQWRTQQ

SEQ ID NO: 748272 - protein, 399 aa, Homo sapiens
MSDSKEPRVQQLGLLEEDPTTSGIRLFPRDFQFQQIHGHKSSTGCLGHGALVLQLLSFMLLAGVLVAILVQVSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVGELPEKSKLQEIYQELTRLKAAVGELPEKSKLQEIYQELTELKAAVGELPEKSKLQEIYQELTQLKAAVGELPDQSKQQQIYQELTDLKTAFERLCRHCPKDWTFFQGNCYFMSNSQRNWHDSVTACQEVRAQLVVIKTAEEQNFLQLQTSRSNRFSWMGLSDLNQEGTWQWVDGSPLSPSFQRYWNSGEPNNSGNEDCAEFSGSGWNDNRCDVDNYWICKKPAACFRDE

SEQ ID NO: 748273 - protein, 376 aa, Homo sapiens
MSDSKEPRVQQLGLLEEDPTTSGIRLFPRDFQFQQIHGHKSSTGCLGHGALVLQLLSFMLLAGVLVAILVQVSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVGELPEKSKLQEIYQELTELKAAVGELPEKSKLQEIYQELTQLKAAVGELPDQSKQQQIYQELTDLKTAFERLCRHCPKDWTFFQGNCYFMSNSQRNWHDSVTACQEVRAQLVVIKTAEEQNFLQLQTSRSNRFSWMGLSDLNQEGTWQWVDGSPLSPSFQRYWNSGEPNNSGNEDCAEFSGSGWNDNRCDVDNYWICKKPAACFRDE

SEQ ID NO: 748274 - protein, 216 aa, Homo sapiens
MSDSKEPRVQQLGLLVSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVGELPEKSKLQEIYQELTRLKAAVGELPEKSKLQEIYQELTELKAAVGELPEKSKLQEIYQELTQLKAAVGELPDQSKQQQIYQELTDLKTAFGEFLHIKGPWA

SEQ ID NO: 748275 - protein, 272 aa, Homo sapiens
MSDSKEPRVQQLGLLEEDPTTSGIRLFPRDFQFQQIHGHKSSTGCLGHGALVLQLLSFMLLAGVLVAILVQVSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVGELPEKSKLQEIYQELTRLKAAVGELPEKSKLQEIYQELTELKAAVGELPEKSKLQEIYQELTQLKAAVGELPDQSKQQQIYQELTDLKTAFGEFLHIKGPWA

SEQ ID NO: 748276 - protein, 272 aa, Homo sapiens; identical to SEQ ID NO: 748275

SEQ ID NO: 748277 - protein, 251 aa, Homo sapiens
MSDSKEPRVQQLGLLEEDPTTSGIRLFPRDFQFQQIHGHKSSTVPFLLGPVSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVGELPEKSKLQEIYQELTRLKAAVGELPEKSKLQEIYQELTELKAAVGELPEKSKLQEIYQELTQLKAAVGELPDQSKQQQIYQELTDLKTAFGEFLHIKGPWA

SEQ ID NO: 748278 - protein, 332 aa, Homo sapiens
MSDSKEPRVQQLGLLEEDPTTSGIRLFPRDFQFQQIHGHKSSTVPFLLGPVSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVGELPEKSKLQEIYQELTRLKAAVGELPEKSKLQEIYQELTELKAAVERLCRHCPKDWTFFQGNCYFMSNSQRNWHDSVTACQEVRAQLVVIKTAEEQNFLQLQTSRSNRFSWMGLSDLNQEGTWQWVDGSPLSPSFQRYWNSGEPNNSGNEDCAEFSGSGWNDNRCDVDNYWICKKPAACFRDE

SEQ ID NO: 748279 - protein, 263 aa, Homo sapiens
MSDSKEPRVQQLGLLEEDPTTSGIRLFPRDFQFQQIHGHKSSTVPFLLGPVSKVPSSLSQEQSEQDAIYQNLTQLKAAVGELSEKSKLQEIYQELTQLKAAVGELPEKSKLQEIYQELTRLKAAVERLCRHCPKDWTFFQGNCYFMSNSQRNWHDSVTACQEVRAQLVVIKTAEEQNFLQLQTSRSNRFSWMGLSDLNQEGTWQWVDGSPLSPSFQRYWNSGEPNNSGNEDCAEFSGSGWNDNRCDVDNYWICKKPAACFRDE

SEQ ID NO: 748280 - protein, 232 aa, Homo sapiens
MSDSKEPRVQQLGLLEEDPTTSGIRLFPRDFQFQQIHGHKSSTGCLGHGALVLQLLSFMLLAGVLVAILVQVSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVERLCRHCPKDWTFFQGNCYFMSNSQRNWHDSVTACQEVRAQLVVIKTAEEQLPAVLEQWRTQQ

SEQ ID NO: 748281 - protein, 272 aa, Homo sapiens; identical to SEQ ID NO: 748275

SEQ ID NO: 748282 - protein, 272 aa, Homo sapiens; identical to SEQ ID NO: 748275

SEQ ID NO: 748283 - protein, 371 aa, Homo sapiens
MSDSKEPRVQQLGLLEEDPTTSGIRLFPRDFQFQQIHGHKSSTVSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVGELPEKSKLQEIYQELTRLKAAVGELPEKSKLQEIYQELTELKAAVGELPEKSKLQEIYQELTQLKAAVGELPDQSKQQQIYQELTDLKTAFERLCRHCPKDWTFFQGNCYFMSNSQRNWHDSVTACQEVRAQLVVIKTAEEQNFLQLQTSRSNRFSWMGLSDLNQEGTWQWVDGSPLSPSFQRYWNSGEPNNSGNEDCAEFSGSGWNDNRCDVDNYWICKKPAACFRDE

SEQ ID NO: 748284 - protein, 831 aa, Homo sapiens
PGGREPAGGGGGGGGDAPRPAALGEPAPGARAAAMGTLGKAREAPRKPSHGCRAASKARLEAKPANSPFPSHPSLAHITQFRMMVSLGHLAKGASLDDLIDSCIQSFDADGNLCRSNQLLQVMLTMHRIVISSAELLQKVITLYKDALAKNSPGLCLKICYFVRYWITEFWVMFKMDASLTDTMEEFQELVKAKGEELHCRLIDTTQINARDWSRKLTQRIKSNTSKKRKVSLLFDHLEPEELSEHLTYLEFKSFRRISFSDYQNYLVNSCVKENPTMERSIALCNGISQWVQLMVLSRPTPQLRAEVFIKFIQVAQKLHQLQNFNTLMAVIGGLCHSSISRLKETSSHVPHEINKVLGEMTELLSSSRNYDNYRRAYGECTDFKIPILGVHLKDLISLYEAMPDYLGDGKVNVHKLLALYNHISELVQLQEVAPPLEANKDLVHLLTLSLDLYYTEDEIYELSYAREPRNHRAPPLTPSKPPVVVDWASGVSPKPDPKTISKHVQRMVDSVFKNYDHDQDGYISQEEFEKIAASFPFSFCVMDKDREGLISRDEITAYFMRASSIYSKLGLGFPHNFQETTYLKPTFCDNCAGFLWGVIKQGYRCKDCGMNCHKQCKDLVVFECKKRAKNPVAPTENNTSVGPVSNLCSLGAKDLLHAPEEGPFTFPNGEAVEHGEESKDRTIMLMGVSSQKISLRLKRAVAHKATQTESQPWIGSEGPSGPFVLSSPRKTAQDTLYVLPSPTSPCPSPVLVRKRAFVKWENKDSLIKSKEELRHLRLPTYQELEQEINTLKADNDALKIQLKYAQKKIESLQLEKSNHVLAQMEQGDCS

SEQ ID NO: 748285 - protein, 99 aa, Homo sapiens
RGSCGSAAGKGVPWEPLAQPVSRAEVEVDTHRKPSHGCRAASKARLEAKPANSPFPSHPSLAHITQFRMMVSLGHLAKGASLDDLIDSCIQSFGKLANC

SEQ ID NO: 748286 - protein, 848 aa, Homo sapiens
MKVVPTSPTPTDARRPRLGQIWITPVERTSTQAALVQGAGRRAQGTCLRPSPADGYLETPGHRKPSHGCRAASKARLEAKPANSPFPSHPSLAHITQFRMMVSLGHLAKGASLDDLIDSCIQSFDADGNLCRSNQLLQVMLTMHRIVISSAELLQKVITLYKDALAKNSPGLCLKICYFVRYWITEFWVMFKMDASLTDTMEEFQELVKAKGEELHCRLIDTTQINARDWSRKLTQRIKSNTSKKRKVSLLFDHLEPEELSEHLTYLEFKSFRRISFSDYQNYLVNSCVKENPTMERSIALCNGISQWVQLMVLSRPTPQLRAEVFIKFIQVAQKLHQLQNFNTLMAVIGGLCHSSISRLKETSSHVPHEINKVLGEMTELLSSSRNYDNYRRAYGECTDFKIPILGVHLKDLISLYEAMPDYLGDGKVNVHKLLALYNHISELVQLQEVAPPLEANKDLVHLLTLSLDLYYTEDEIYELSYAREPRNHRAPPLTPSKPPVVVDWASGVSPKPDPKTISKHVQRMVDSVFKNYDHDQDGYISQEEFEKIAASFPFSFCVMDKDREGLISRDEITAYFMRASSIYSKLGLGFPHNFQETTYLKPTFCDNCAGFLWGVIKQGYRCKDCGMNCHKQCKDLVVFECKKRAKNPVAPTENNTSVGPVSNLCSLGAKDLLHAPEEGPFTFPNGEAVEHGEESKDRTIMLMGVSSQKISLRLKRAVAHKATQTESQPWIGSEGPSGPFVLSSPRKTAQDTLYVLPSPTSPCPSPVLVRKRAFVKWENKDSLIKSKEELRHLRLPTYQELEQEINTLKADNDALKIQLKYAQKKIESLQLEKSNHVLAQMEQGDCS

SEQ ID NO: 748287 - protein, 114 aa, Homo sapiens
TKRWVRLLLLVMSGRGKGGKGLGKGGAKRHRKVLRDNIQGITKPAIRRLARRGGVKRISGLIYEETRGVLKVFLENVIRDAVTYTEHAKRKTVTAMDVVYALKRQGRTLYGFGG

SEQ ID NO: 748288 - protein, 131 aa, Homo sapiens [sequence omitted]

SEQ ID NO: 748289 - protein, 131 aa, Homo sapiens [sequence omitted]

SEQ ID NO: 748290 - protein, 131 aa, Homo sapiens [sequence omitted]

SEQ ID NO: 748291 - protein, 113 aa, Homo sapiens
MSLAQRVLLTWLFTLLFLIMLVLKLDEKAPWNWFLIFIPVWIFDTILLVLLIVKMAGRCKSGFDPRHGSHNIKNCAKLEQFTTMNLSYVFIPLWALLAGALTELGYNVFFVRD

SEQ ID NO: 748292 - protein, 637 aa, Homo sapiens
TPPPPREGATRAARRGQSERRGPRRRAAEGAQSQLRAPAPRAPARPREVSARKMAGGVDGPIGIPFPDHSSDILSGLNEQRTQGLLCDVVILVEGREFPTHRSVLAACSQYFKKLFTSGAVVDQQNVYEIDFVSAEALTALMDFAYTATLTVSTANVGDILSAARLLEIPAVSHVCADLLDRQILAADAGADAGQLDLVDQIDQRNLLRAKEYLEFFQSNPMNSLPPAAAAAAASFPWSAFGASDDDLDATKEAVAAAVAAVAAGDCNGLDFYGPGPPAERPPTGDGDEGDSNPGLWPERDEDAPTGGLFPPPVAPPAATQNGHYGRGGEEEAASLSEAAPEPGDSPGFLSGAAEGEDGDGPDVDGLAASTLLQQMMSSVGRAGAAAGDSDEESRADDKGVMDYYLKYFSGAHDGDVYPAWSQKVEKKIRAKAFQKCPICEKVIQGAGKLPRHIRTHTGEKPYECNICKVRFTRQDKLKVHMRKHTGEKPYLCQQCGAAFAHNYDLKNHMRVHTGLRPYQCDSCCKTFVRSDHLHRHLKKDGCNGVPSRRGRKPRVRGGAPDPSPGATATPGAPAQPSSPDARRNGQEKHFKDEDEDEDVASPDGLGRLNVAGAGGGGDSGGGPGAATDGNFTAGLA

SEQ ID NO: 748293 - protein, 637 aa, Homo sapiens; identical to SEQ ID NO: 748292

SEQ ID NO: 748294 - protein, 637 aa, Homo sapiens; identical to SEQ ID NO: 748292

SEQ ID NO: 748295 - protein, 156 aa, Homo sapiens [sequence omitted]

SEQ ID NO: 748296 - protein, 234 aa, Homo sapiens
DWGGLLISSHDGDVYPAWSQKVEKKIRAKAFQKCPICEKVIQGAGKLPRHIRTHTGEKPYECNICKVRFTRQDKLKVHMRKHTGEKPYLCQQCGAAFAHNYDLKNHMRVHTGLRPYQCDSCCKTFVRSDHLHRHLKKDGCNGVPSRRGRKPRVRGGAPDPSPGATATPGAPAQPSSPDARRNGQEKHFKDEDEDEDVASPDGLGRLNVAGAGGGGDSGGGPGAATDGNFTAGLA

SEQ ID NO: 748297 - protein, 637 aa, Homo sapiens; identical to SEQ ID NO: 748292

SEQ ID NO: 748298 - protein, 474 aa, Homo sapiens
TPPPPREGATRAARRGQSERRGPRRRAAEGAQSQLRAPAPRAPARPREVSARKMAGGVDGPIGIPFPDHSSDILSGLNEQRTQGLLCDVVILVEGREFPTHRSVLAACSQYFKKLFTSGAVVDQQNVYEIDFVSAEALTALMDFAYTATLTVSTANVGDILSAARLLEIPAVSHVCADLLDRQILAADAGADAGQLDLVDQIDQRNLLRAKEYLEFFQSNPMNSLPPAAAAAAASFPWSAFGASDDDLDATKEAVAAAVAAVAAGDCNGLDFYGPGPPAERPPTGDGDEGDSNPGLWPERDEDAPTGGLFPPPVAPPAATQNGHYGRGGEEEAASLSEAAPEPGDSPGFLSGAAEGEDGDGPDVDGLAASTLLQQMMSSVGRAGAAAGDSDEESRADDKGVMDYYLKYFSGAHDGDVYPAWSQKVEKKIRAKAFQKCPICEKVIQGAGKLPRHIRTHTGEKPYECNICKVRFTR

SEQ ID NO: 748299 - protein, 637 aa, Homo sapiens; identical to SEQ ID NO: 748292

SEQ ID NO: 748300 - protein, 637 aa, Homo sapiens; identical to SEQ ID NO: 748292

SEQ ID NO: 748301 - protein, 637 aa, Homo sapiens; identical to SEQ ID NO: 748292

SEQ ID NO: 748302 - protein, 106 aa, Homo sapiens
MARCKVWVVREREREREQKKFLKVDLFLYKIIKKKTHHKRRIHFCSPKSEKGGSGGSHRRGPGRRPEVFVLHPQTSASKAGLWGVRAVFPPLPLSVPFLGSDVKRS

SEQ ID NO: 748303 - protein, 138 aa, Homo sapiens
KPVNVKCRSSPAWHGCGPAARQARAGDTKVCPPTIVAMQSCHCLFASFRGGSPSLFQGLPLEVGGCREGGGQGSLHDSDPGAVAGAVTSQVVTLRQGPRGAPSRPATRMVGGKTERMKGKTEEKKILKTNKKSKNPIF

SEQ ID NO: 748304 - protein, 113 aa, Homo sapiens
MVLSQACQPLCSLVTKAALTGCQLVSGLQPPRHLLSYFPCSWGACKCQVLFGVHLCLVTQRRASSITTVDISKRGISTTFHSHWDLPCHLNTIIFGDCVKRLPNPHREHTVPS

SEQ ID NO: 748305 - protein, 113 aa, Homo sapiens
HIPHRENTFLTSKEDKTTSKQEGAAGGVLSRGCRADMRETRTPESNQCLGTTTNVFTSQTFRGSWAEPEPGLLTGLFGSHGVEILPSLNIQISYKYPDFQLLLENQKKTALNS

SEQ ID NO: 748306 - protein, 67 aa, Homo sapiens
NLDPNPPIRFLVRVERFEVPRRACLQGRDASSGNLCTEITQGICHMKMKAEFYKPRDAKDCQQTTRS

SEQ ID NO: 748307 - protein, 132 aa, Homo sapiens
DLKRKEFCDLDEATTPQHLLPTEVSQDSALCYKIQTMCKTVLKGYMAPKERKDETPTRAFIRMGRFNPIRDHGQGAMLAWSLNPSGCALSTFSFPHTGWVMGHLKFLNSQSFMGSSRGNKGRARDVLVPLLY

SEQ ID NO: 748308 - protein, 91 aa, Homo sapiens
MEIAHYAKVFTADGHLGCYILATMNYHSAKHCGSCLQSQLCKRLKQEDRLSPGFQGQLGQHSETSSLKTVIGPLAPSCHLADMKNWRWQQW

SEQ ID NO: 748309 - protein, 97 aa, Homo sapiens
MRIIALLAAILLVALQVRAGPLQARGDEAPGQEQRGPEDQDISISFAWDKSSALQVSGSTRGMVCSCRLVFCRRTELRVGNCLIGGVSFTYCCTRVD

SEQ ID NO: 748310 - protein, 1012 aa, Homo sapiens
MCLSESVDYGPVFVQEPDDIIFPTDSDEKKVALNCEVRGNPVPSYRWLRNGTEIDLESDYRYSLIDGTFIISNPSEAKDSGHYQCLATNTVGSILSREATLQFAYLGNFSGRTRSAVSVREGQGVVLMCSPPPHSPEIIYSWVFNEFPSFVAEDSRRFISQETGNLYISKVQTSDVGSYICLVKNTVTNARVLSPPTPLTLRNDGVMGEYEPKIEVHFPFTVTAAKGTTVKMECFALGNPVPTITWMKVNGYIPSKARLRKSQAVLEIPNVQLDDAGIYECRAENSRGKNSFRGQLQVYTYPHWVEKLNDTQLDSGSPLRWECKATGKPRPTYRWLKNGVPLSPQSRVEMVNGVLMIHNVNQSDAGMYQCLAENKYGAIYASAELKILASAPTFALNQLKKTIIVTKDQEVVIECKPQGSPKPTISWKKGDRAVRENKRIAILPDGSLRILNASKSDEGKYVCRGENVFGSAEIIASLSVKEPTRIELTPKRTELTVGESIVLNCKAIHDASLDVTFYWTLKGQPIDFEEEGGHFESIRAQASSADLMIRNILLMHAGRYGCRVQTTADSVSDEAELLVRGPPGPPGIVIVEEITESTATLSWSPAADNHSPISSYNLQARSPFSLGWQTVKTVPEIITGDMESAMAVDLNPWVEYEFRVVATNPIGTGDPSTPSRMIRTNEAVPKTAPTNVSGRSGRRHELVIAWEPVSEEFQNGEGFGYIVAFRPNGTRGWKEKMVTSSEASKFIYRDESVPPLTPFEVKVGVYNNKGDGPFSQIVVICSAEGEPSAAPTDVKATSVSVSEILVAWKHIKESLGRPQGFEVGYWKDMEQEDTAETVKTRGNESFVILTGLEGNTLYHFTVRAYNGAGYGPPSSEVSATTKKSPPSQAPSNLRWEQQGSQVSLGWEPVIPLANESEVVGYKVFYRQEGHSNSQVIETQKLQAVVPLPDAGVYIIEVRAYSEGGDGTASSQIRVPSYSGGKITSAQSTLHSLSTSSSSVTLLLALMIPSTSW

SEQ ID NO: 748311 - protein, 518 aa, Homo sapiens
MCLSEYSKSLPGLSTSYAALLRIKKSSSSSLFGSKTRPRYSSPSLGTLSASSPSWLGAAQNYYSPINLYHSSDAFKQDESVDYGPVFVQEPDDIIFPTDSDEKKVALNCEVRGNPVPSYRWLRNGTEIDLESDYRYSLIDGTFIISNPSEAKDSGHYQCLATNTVGSILSREATLQFAYLGNFSGRTRSAVSVREGQGVVLMCSPPPHSPEIIYSWVFNEFPSFVAEDSRRFISQETGNLYISKVQTSDVGSYICLVKNTVTNARVLSPPTPLTLRNDGVMGEYEPKIEVHFPFTVTAAKGTTVKMECFALGNPVPTITWMKVNGYIPSKARLRKSQAVLEIPNVQLDDAGIYECRAENSRGKNSFRGQLQVYTYPHWVEKLNDTQLDSGSPLRWECKATGKPRPTYRWLKNGVPLSPQSRVEMVNGVLMIHNVNQSDAGMYQCLAENKYGAIYASAELKILASAPTFALNQLKKTIIVTKDQEVVIECKPQGSPKPTISWKKGDRAVRENKRLESIL

SEQ ID NO: 748312 - protein, 1086 aa, Homo sapiens
MCLSEYSKSLPGLSTSYAALLRIKKSSSSSLFGSKTRPRYSSPSLGTLSASSPSWLGAAQNYYSPINLYHSSDAFKQDESVDYGPVFVQEPDDIIFPTDSDEKKVALNCEVRGNPVPSYRWLRNGTEIDLESDYRYSLIDGTFIISNPSEAKDSGHYQCLATNTVGSILSREATLQFAYLGNFSGRTRSAVSVREGQGVVLMCSPPPHSPEIIYSWVFNEFPSFVAEDSRRFISQETGNLYISKVQTSDVGSYICLVKNTVTNARVLSPPTPLTLRNDGVMGEYEPKIEVHFPFTVTAAKGTTVKMECFALGNPVPTITWMKVNGYIPSKARLRKSQAVLEIPNVQLDDAGIYECRAENSRGKNSFRGQLQVYTYPHWVEKLNDTQLDSGSPLRWECKATGKPRPTYRWLKNGVPLSPQSRVEMVNGVLMIHNVNQSDAGMYQCLAENKYGAIYASAELKILASAPTFALNQLKKTIIVTKDQEVVIECKPQGSPKPTISWKKGDRAVRENKRIAILPDGSLRILNASKSDEGKYVCRGENVFGSAEIIASLSVKEPTRIELTPKRTELTVGESIVLNCKAIHDASLDVTFYWTLKGQPIDFEEEGGHFESIRAQASSADLMIRNILLMHAGRYGCRVQTTADSVSDEAELLVRGPPGPPGIVIVEEITESTATLSWSPAADNHSPISSYNLQARSPFSLGWQTVKTVPEIITGDMESAMAVDLNPWVEYEFRVVATNPIGTGDPSTPSRMIRTNEAVPKTAPTNVSGRSGRRHELVIAWEPVSEEFQNGEGFGYIVAFRPNGTRGWKEKMVTSSEASKFIYRDESVPPLTPFEVKVGVYNNKGDGPFSQIVVICSAEGEPSAAPTDVKATSVSVSEILVAWKHIKESLGRPQGFEVGYWKDMEQEDTAETVKTRGNESFVILTGLEGNTLYHFTVRAYNGAGYGPPSSEVSATTKKSPPSQAPSNLRWEQQGSQVSLGWEPVIPLANESEVVGYKVFYRQEGHSNSQVIETQKLQAVVPLPDAGVYIIEVRAYSEGGDGTASSQIRVPSYSGGKITSAQSTLHSLSTSSSSVTLLLALMIPSTSW

SEQ ID NO: 748313 - protein, 350 aa, Homo sapiens
MCLSEYSKSLPGLSTSYAALLRIKKSSSSSLFGSKTRPRYSSPSLGTLSASSPSWLGAAQNYYSPINLYHSSDAFKQDESVDYGPVFVQEPDDIIFPTDSDEKKVALNCEVRGNPVPSYRWLRNGTEIDLESDYRYSLIDGTFIISNPSEAKDSGHYQCLATNTVGSILSREATLQFAYLGNFSGRTRSAVSVREGQGVVLMCSPPPHSPEIIYSWVFNEFPSFVAEDSRRFISQETGNLYISKVQTSDVGSYICLVKNTVTNARVLSPPTPLTLRNDGVMGEYEPKIEVHFPFTVTAAKGTTVKMECFALGNKYIKGSVKKTASLKKVSVYHLVSFLRNVTIMEKRNIL

SEQ ID NO: 748314 - protein, 112 aa, Homo sapiens
ANGSLWLNIVYHWRYSWYWKELEFHIDSVMEKVFWALAVLIQRTKDLSVMCGEPFPLVSLNAMGKAVGPVHSAGQLQSPRIGLANCHSLSSWQQQLKGQLVLICIFGCLCYL

SEQ ID NO: 748315 - protein, 194 aa, Homo sapiens
MDEDGLPLMGSGIDLTKVPAIQQKRTVAFLNQFVVHTVQFLNRFSTVCEEKLADLSLRIQQIETTLNILDAKLSSIPGLDDVTVEVSPLNVTSVTNGAHPEATSEQPQQNSTQDSGLQESEVSAENILTVAKDPRYARYLKMVQVGVPVMAIRNKMISEGLDPDLLERPDAPVPDGESEKTVEESSDSESSFSD

SEQ ID NO: 748316 - protein, 194 aa, Homo sapiens; identical to SEQ ID NO: 748315

SEQ ID NO: 748317 - protein, 93 aa, Homo sapiens
MDEDGLPLMGSGIDLTKVPAIQQKRTVAFLNQFVVHTVQFLNRFSTVCEEKLADLSLLANRGLVANRGLVANRGLVANRGLVANRDSSQPWTS

SEQ ID NO: 748318 - protein, 71 aa, Homo sapiens
LYCYLPSVRHPENGRHILVYCYHYHNAERGGGLSGSRRVISASYSTEKNGGFSKPICGAHCTVPQPLFYSL

SEQ ID NO: 748319 - protein, 145 aa, Homo sapiens
MKLADLSLRIQQIETTLNILDAKLSSIPGLDDVTVEVSPLNVTSVTNGAHPEATSEQPQQNSTQDSGLQESEVSAENILTVAKDPRYARYLKMVQVGVPVMAIRNKMISEGLDPDLLERPDAPVPDGESEKTVEESSDSESSFSD

SEQ ID NO: 748320 - protein, 175 aa, Homo sapiens
MDEDGLPLMGSGIDLTKASYSTEPLFYSFVRKLADLSLRIQQIETTLNILDAKLSSIPGLDDVTVEVSPLNVTSVTNGAHPEATSEQPQQNSTQDSGLQESEVSAENILTVAKDPRYARYLKMVQVGVPVMAIRNKMISEGLDPDLLERPDAPVPDGESEKTVEESSDSESSFSD

SEQ ID NO: 748321 - protein, 194 aa, Homo sapiens; identical to SEQ ID NO: 748315

SEQ ID NO: 748322 - protein, 174 aa, Homo sapiens
MDEDGLPLMGSGIDLTKVPAIQQKRTVAFLNQFVVHTVQFLNRFSTVCEEKLADLSLRIQQIETTLNILDAKLSSIPGLDDVTVEVSPLNVTSVTNGAHPEATSEQPQQNSTQDSGLQESEVSAENILTVAKDPRYARYLKMVQVGVPVMAIRNKMISEGLDPDLLEKIKKRKK

SEQ ID NO: 748323 - protein, 157 aa, Homo sapiens
MDEDGLPLMGSGIDLTKVPAIQQKRTVAFLNQFVVHTVQFLNRFSTVCEEKLADLSLRIQQIETTLNILDAKLSSIPGLDDVTVEVSPLNVTSVTNGAHPEATSEQPQGVPVMAIRNKMISEGLDPDLLERPDAPVPDGESEKTVEESSDSESSFSD

SEQ ID NO: 748324 - protein, 71 aa, Homo sapiens; identical to SEQ ID NO: 748318

SEQ ID NO: 748325 - protein, 202 aa, Homo sapiens
MKGNVEDFGLRDTLSIASTDSFASAAELAEHREVRHTYSLESLCHCPFYEEAMHLVEEGKIYSRVLRTEMLECLGDSDFLAKLHCIRQAFQVILSESANRIFLAESGRKILSALIVKARKNPKKFEDVFDEMIYFLEQTDHWGSTEMELAARGVKNLNFYDVVLDFILMDSFEDLENPPTSIQNVVNNRWLNSSFKETVSGG

SEQ ID NO: 748326 - protein, 200 aa, Homo sapiens
GIVSVETDLLQWCLESGSIPILCPIGETAARRSVLLDSLEVTASLAKALRPTKIIFLNNTGGLRDSSHKVLSNVNLPADLDLVCNAEWVSTKERQQMRLIVDVLSRLPHHSSAVITAASTLLTELFSNKGEGGGRAGDWVPGVSTGRGWVSAVRRSGFSSCPGAVGGGGGCHSNGSCCCRNPGEVREEETQCTGRELRRN

SEQ ID NO: 748327 - protein, 337 aa, Homo sapiens
GIVSVETDLLQWCLESGSIPILCPIGETAARRSVLLDSLEVTASLAKALRPTKIIFLNNTGGLRDSSHKVLSNVNLPADLDLVCNAEWVSTKERQQMRLIVDVLSRLPHHSSAVITAASTLLTELFSNKGSGTLFKNAERMLRVRSLDKLDQGRLVYLVNASFGKKLRDDYLASLRPRLHSIYVSEGYNAAAILTMEPVLGGTPYLDKFVVSSSRQGQGSGQMLWECLRRDLQTLFWRSRVTNPINPWYFKHSDGSFSNKQWIFFWFGLADIRDSYELVNHAKGLPDSFHKPASEPRQLTFTMDTTGPGMARVDQKPCQLGMTPGSQPQAEGGLLAE

SEQ ID NO: 748328 - protein, 317 aa, Homo sapiens
MVVMNSLRVILQASPGKLLWRKFQIPRFMPARPCSLYTCTYKTRNRALHPLWESVDLVPGGDRQSPINIRWRDSVYDPGLKPLTISYDPATCLHVWNNGYSFLVEFEDSTDKSVIKGGPLEHNYRLKQFHFHWGAIDAWGSEHTVDSKCFPAELHLVHWNAVKFENFEDAALEENGLAVIGVFLKLGKHHKELQKLVDTLPSIKHKDALVEFGSFDPSCLMPTCPDYWTYSGSLTTPPLSESVTWIIKKQPVEVDHDQLEQFRTLLFTSEGEKEKRMVDNFRPLQPLMNRTVRSSFRHDYVLNVQAKPKPATSQATP

SEQ ID NO: 748329 - protein, 184 aa, Homo sapiens [sequence omitted]

SEQ ID NO: 748330 - protein, 184 aa, Homo sapiens [sequence omitted]

SEQ ID NO: 748331 - protein, 184 aa, Homo sapiens [sequence omitted]

SEQ ID NO: 748332 - protein, 184 aa, Homo sapiens [sequence omitted]

SEQ ID NO: 748333 - protein, 184 aa, Homo sapiens [sequence omitted]

SEQ ID NO: 748334 - protein, 318 aa, Homo sapiens
EHMFSGPPVGCVTGHSHPYWLRINLFKYFTEFDSFRQHLVWPEKVHPLWESVDLVPGGDRQSPINIRWRDSVYDPGLKPLTISYDPATCLHVWNNGYSFLVEFEDSTDKSVIKGGPLEHNYRLKQFHFHWGAIDAWGSEHTVDSKCFPAELHLVHWNAVKFENFEDAALEENGLAVIGVFLKISETSGSPVSTGRPKPLARKLRPAQKHWVLQSRPFLSSQVQENCKVTYFHRKHWVRIRPLRTTPPSWDYTRICIQREMVPARIRVLREMVPEAWRCFPNRLPLLSNIRPDFSKAPLAYVKRWLWTARHPHSLSAAW

SEQ ID NO: 748335 - protein, 184 aa, Homo sapiens [sequence omitted]

SEQ ID NO: 748336 - protein, 184 aa, Homo sapiens [sequence omitted]

SEQ ID NO: 748337 - protein, 184 aa, Homo sapiens [sequence omitted]

SEQ ID NO: 748338 - protein, 89 aa, Homo sapiens
GQDWPEKRGVECMHPLWESVDLVPGGDRQSPINIRWRDSVYDPGLKPLTISYDPATCLHVWNNGYSFLVEFEDSTDKSAALSALERSQI

SEQ ID NO: 748339 - protein, 75 aa, Homo sapiens
LTSFLLVHPLWESVDLVPGGDRQSPINIRWRDSVYDPGLKPLTISYDPATCLHVWNNGYSFLVEFEDSTDKSGCT

SEQ ID NO: 748340 - protein, 89 aa, Homo sapiens; identical to SEQ ID NO: 748338

SEQ ID NO: 748341 - protein, 111 aa, Homo sapiens
SHCTRSNSLDNRLTSFLLVHPLWESVDLVPGGDRQSPINIRWRDSVYDPGLKPLTISYDPATCLHVWNNGYSFLVEFEDSTDKSGEGKIWWSCKELKKQCHVNRGHIKLSP

SEQ ID NO: 748342 - protein, 76 aa, Homo sapiens
WGSSGPPDTLSCMENSKGLLLICSVQHCLYFILMLLLVSLLGTLGTSLLTDPIPVKQVKCCQVGCSGVDPAVLGSH

SEQ ID NO: 748343 - protein, 94 aa, Homo sapiens
SVMGTEWTLWVFPPLKRLFLEKKLDTVGVFLDCEHGQISFYNVTEMSLIYNFSHCAFQGALRPVFSLCIPNGDTSPDSLTILQHGPSCDATVSP

SEQ ID NO: 748344 - protein, 101 aa, Homo sapiens
EAMHGLDWGAHRREPAGWARPVWGRAGGRQHAGGLARSAWSRSIQVVAVSQEGGTEASLGQGVWICGWIAGTLDSHSQENDIVGQSGHLAPGPVAASGLDM

SEQ ID NO: 748345 - protein, 332 aa, Homo sapiens
QLERGPPRRHLAQEESARESELRFSCCATRASGLGAEDRPGGGGKEAAGSEERLALEAADGTMSPGSGVKSEYMKRYQEPRWEEYGPCYRELLHYRLGRRLLEQAHAPWLWDDWGPAGSSEDSASSESSGAGGPAPRCAPPSPPPPVEPATQEEAERRARGAPEEQDAEAGDAEAEDAEDAALPALPVKDVEDKPEQQTRTRETDKSPTSTEPRQQPSALFARGNRKAVKSPQRSSSKIKENKHPFALYGWGEKQTDTGSQKTHNVCASAPVHEIHESALRAKNRRQVEKRKLVAQRQRAHSVDVEKNRKMKASSSENPWMTEYMRCYSARA

SEQ ID NO: 748346 - protein, 140 aa, Homo sapiens
MSPGSGVKSEYMKRYQEPRWEEYGPCYRELLHYRLGRRLLEQAHAPWLWDDWGPAGSSEDSASSESSGAGGPAPRCAPPSPPPPVEPATQEEAERRARGAPEEQDAEAGDAEAEDAEDAALPGTRPGGEREGPARRDGLL

SEQ ID NO: 748347 - protein, 181 aa, Homo sapiens
IKGATECGKPTQVPQFILDDFIQNAEQQSVNIVVTQPRRISAVSVAERVAFERGEEPGKSCGYSVRFESILPRPHASIMFCTVGVLLRKLEAGIRGISHVIVDEIHERDINTDFLLVVLRDVVQAYPEVRIVLMSATIDTSMFCEYFFNCPIIEVYGRTYPVQEYFLEDCIQMTHFVPPPK

SEQ ID NO: 748348 - protein, 487 aa, Homo sapiens
LWRGSIYKLLWRELLCFLGFYMALSAAYRFVLTEGQKRYFEKLVIYCDQYASLIPVSFVLGFYVTLVVNRWWSQYLCMPLPDALMCVVAGTVHGRDDRGRLYRRTLMRYAGLSAVLILRSVSTAVFKRFPTIDHVVEAGFMTREERKKFENLNSSYNKYWVPCVWFSNLAAQARREGRIRDNSALKLLLEELNVFRGKCGMLFHYDWISVPLVYTQVVTIALYSYFLACLIGRQFLDPAQGYKDHDLDLCVPIFTLLQFFFYAGWLKVAEQLINPFGEDDDDFETNFLIDRNFQVSMLAVDEMYDDLAVLEKDLYWDAAEARAPYTAATVFQLRQPSFQGSTFDITLAKEDMQFQRLDGLDGPMGGAPGDFLQRLLPAGAGMVAGGPLGRRLSFLLRKNSCVSEASTGASCSCAVVPEGAAPECSCGDPLLDPGLPEPEAPPPAGPEPLTLIPGPVEPFSIVTMPGPRGPAPPWLPSPIGEEEENLA

SEQ ID NO: 748349 - protein, 70 aa, Homo sapiens
MSNNMAKIAEARKTVEQLKLEVNIDRMKVSQAAAELLAFCETHAKDDPLVTPVPAAENPFRDKRLFCVLL

SEQ ID NO: 748350 - protein, 354 aa, Homo sapiens
MTTAILERLSTLSVSGQQLRRLPKILEDGLPKMPCTVPETDVPQLFREPYIRTGYRPTGHEWRYYFFSLFQKHNEVVNVWTHLLAALAVLLRFWAFAEAEALPWASTHSLPLLLFILSSITYLTCSLLAHLLQSKSELSHYTFYFVDYVGVSVYQYGSALAHFFYSSDQAWYDRFWLFFLPAAAFCGWLSCAGCCYAKYRYRRPYPVMRKICQVVPAGLAFILDISPVAHRVALCHLAGCQEQAAWYHTLQILFFLVSAYFFSCPVPEKYFPGSCDIVGHGHQIFHAFLSICTLSQLEAILLDYQGRQEIFLQRHGPLSVHMACLSFFFLAACSAATAALLRHKVKARLTKKDS

SEQ ID NO: 748351 - protein, 122 aa, Homo sapiens
FLTQYLILSPRLDCNGKILAHCSLDLSSSDPPTSASAPPPPQHPIRWDHRCMPPCPANFVYFEEMGFHHVTQAGLELLGSSNLPTSAQQSSGNTGVSHGARPINAFFFFNLKPPNSKLQGTR

SEQ ID NO: 748352 - protein, 595 aa, Homo sapiens
AGLRAGAAGRRRGPAPAGAGRRRGRASGQRPIAALGASSAGSGPRQPERGRGLEIHADSRRRRLCSAGSWRGSPPTAPGRRSAGPRPLPAAPLTMSETEFHHGAQAGLELLRSSNSPTSASQSAGMTVTDQAFVTLATNDIYCQGALVLGQSLRRHRLTRKLVVLITPQVSSLLRVILSKVFDEVIEVNLIDSADYIHLAFLKRPELGLTLTKLHCWTLTHYSKCVFLDADTLVLSNVDELFDRGEFSAAPDPGWPDCFNSGVFVFQPSLHTHKLLLQHAMEHGSFDGADQGLLNSFFRNWSTTDIHKHLPFIYNLSSNTMYTYSPAFKQFGSSAKVVHFLGSMKPWNYKYNPQSGSVLEQGSVSSSQHQAAFLHLWWTVYQNNVLPLYKSVQAGEARASPGHTLCHSDVGGPCADSASGVGEPCENSTPSAGVPCANSPLGSNQPAQGLPEPTQIVDETLSLPEGRRSEDMIACPETETPAVITCDPLSQPSPQPADFTETETILQPANKVESVSSEETFEPSQELPAEALRDPSLQDALEVDLAVSVSQISIEEKVKELSPEEERRKWEEGRIDYMGKDAFARIQEKLDRFLQ

SEQ ID NO: 748353 - protein, 399 aa, Homo sapiens
MSVTDQAFVTLATNDIYCQGALVLGQSLRRHRLTRKLVVLITPQVSSLLRVILSKVFDEVIEVNLIDSADYIHLAFLKRPELGLTLTKLHCWTLTHYSKCVFLDADTLVLSNVDELFDRGEFSAAPDPGWPDCFNSGVFVFQPSLHTHKLLLQHAMEHGSFDGADQGLLNSFFRNWSTTDIHKHLPFIYNLSSNTMYTYSPAFKQFGSSAKVVHFLGSMKPWNYKYNPQSGSVLEQGSVSSSQHQAAFLHLWWTVYQNNVLPLYKSVQAGEARASPGHTLCHSDVGGPCADSASGVGEPCENSTPSAGVPCANSPLGSNQPAQGLPEPTQIVDETLSLPEGRRSEDVDLAVSVSQISIEEKVKELSPEEERRKWEEGRIDYMGKDAFARIQEKLDRFLQ

SEQ ID NO: 748354 - protein, 471 aa, Homo sapiens
AGLRAGAAGRRRGPAPAGAGRRRGRASGQRPIAALGASSAGSGPRQPERGRGLEIHADSRRRRLCSAGSWRGSPPTAPGRRSAATNDIYCQGALVLGQSLRRHRLTRKLVVLITPQVSSLLRVILSKVFDEVIEVNLIDSADYIHLAFLKRPELGLTLTKLHCWTLTHYSKCVFLDADTLVLSNVDELFDRGEFSAAPDPGWPDCFNSGVFVFQPSLHTHKLLLQHAMEHGSFDGADQGLLNSFFRNWSTTDIHKHLPFIYNLSSNTMYTYSPAFKQFGSSAKVVHFLGSMKPWNYKYNPQSGSVLEQGSVSSSQHQAAFLHLWWTVYQNNVLPLYKSVQAGEARASPGHTLCHSDVGGPCADSASGVGEPCENSTPSAGVPCANSPLGSNQPAQGLPEPTQIVDETLSLPEGRRSEDVDLAVSVSQISIEEKVKELSPEEERRKWEEGRIDYMGKDAFARIQEKLDRFLQ

SEQ ID NO: 748355 - protein, 493 aa, Homo sapiens
AGLRAGAAGRRRGPAPAGAGRRRGRASGQRPIAALGASSAGSGPRQPERGRGLEIHADSRRRRLCSAGSWRGSPPTAPGRRSAGPRPLPAAPLTMSVTDQAFVTLATNDIYCQGALVLGQSLRRHRLTRKLVVLITPQVSSLLRVILSKVFDEVIEVNLIDSADYIHLAFLKRPELGLTLTKLHCWTLTHYSKCVFLDADTLVLSNVDELFDRGEFSAAPDPGWPDCFNSGVFVFQPSLHTHKLLLQHAMEHGSFDGADQGLLNSFFRNWSTTDIHKHLPFIYNLSSNTMYTYSPAFKQFGSSAKVVHFLGSMKPWNYKYNPQSGSVLEQGSVSSSQHQAAFLHLWWTVYQNNVLPLYKSVQAGEARASPGHTLCHSDVGGPCADSASGVGEPCENSTPSAGVPCANSPLGSNQPAQGLPEPTQIVDETLSLPEGRRSEDVDLAVSVSQISIEEKVKELSPEEERRKWEEGRIDYMGKDAFARIQEKLDRFLQ

SEQ ID NO: 748356 - protein, 532 aa, Homo sapiens
MGPGVAWMRVVHATMVLRPPLRPEKVDKDNEDFQKCIHSHRNSAGSWRGSPPTAPGRRSAGPRPLPAAPLTMSATNDIYCQGALVLGQSLRRHRLTRKLVVLITPQVSSLLRVILSKVFDEVIEVNLIDSADYIHLAFLKRPELGLTLTKLHCWTLTHYSKCVFLDADTLVLSNVDELFDRGEFSAAPDPGWPDCFNSGVFVFQPSLHTHKLLLQHAMEHGSFDGADQGLLNSFFRNWSTTDIHKHLPFIYNLSSNTMYTYSPAFKQFGSSAKVVHFLGSMKPWNYKYNPQSGSVLEQGSVSSSQHQAAFLHLWWTVYQNNVLPLYKSVQAGEARASPGHTLCHSDVGGPCADSASGVGEPCENSTPSAGVPCANSPLGSNQPAQGLPEPTQIVDETLSLPEGRRSEDMIACPETETPAVITCDPLSQPSPQPADFTETETILQPANKVESVSSEETFEPSQELPAEALRDPSLQDALEVDLAVSVSQISIEEKVKELSPEEERRKWEEGRIDYMGKDAFARIQEKLDRFLQ

SEQ ID NO: 748357 - protein, 564 aa, Homo sapiens
AGLRAGAAGRRRGPAPAGAGRRRGRASGQRPIAALGASSAGSGPRQPERGRGLEIHADSRRRRLCSAGSWRGSPPTAPGRRSAGPRPLPAAPLTMSVTDQAFVTLATNDIYCQGALVLGQSLRRHRLTRKLVVLITPQVSSLLRVILSKVFDEVIEVNLIDSADYIHLAFLKRPELGLTLTKLHCWTLTHYSKCVFLDADTLVLSNVDELFDRGEFSAAPDPGWPDCFNSGVFVFQPSLHTHKLLLQHAMEHGSFDGADQGLLNSFFRNWSTTDIHKHLPFIYNLSSNTMYTYSPAFKQFGSSAKVVHFLGSMKPWNYKYNPQSGSVLEQGSVSSSQHQAAFLHLWWTVYQNNVLPLYKSVQAGEARASPGHTLCHSDVGGPCADSASGVGEPCENSTPSAGVPCANSPLGSNQPAQGLPEPTQIVDETLSLPEGRRSEDMIACPETETPAVITCDPLSQPSPQPADFTETETILQPANKVESVSSEETFEPSQELPAEALRDPSLQDALEVDLAVSVSQISIEEKVKELSPEEERRKWEEGRIDYMGKDAFARIQEKLDRFLQ

SEQ ID NO: 748358 - protein, 334 aa, Homo sapiens
FIEHLREDDPEQAGHLRSDQHHQLHCWTLTHYSKCVFLDADTLVLSNVDELFDRGEFSAAPDPGWPDCFNSGVFVFQPSLHTHKLLLQHAMEHGSFDGADQGLLNSFFRNWSTTDIHKHLPFIYNLSSNTMYTYSPAFKQFGSSAKVVHFLGSMKPWNYKYNPQSGSVLEQGSVSSSQHQAAFLHLWWTVYQNNVLPLYKSVQAGEARASPGHTLCHSDVGGPCADSASGVGEPCENSTPSAGVPCANSPLGSNQPAQGLPEPTQIVDETLSLPEGRRSEDVDLAVSVSQISIEEKVKELSPEEERRKWEEGRIDYMGKDAFARIQEKLDRFLQ

SEQ ID NO: 748359 - protein, 434 aa, Homo sapiens
MSVTDQAFVTLATNDIYCQGALVLGQSLRRHRLTRKLVVLITPQVSSLLRVILSKVFDEVIEVNLIDSADYIHLAFLKRPELGLTLTKLHCWTLTHYSKCVFLDADTLVLSNVDELFDRGEFSAAPDPGWPDCFNSGVFVFQPSLHTHKLLLQHAMEHGSFDGADQGLLNSFFRNWSTTDIHKHLPFIYNLSSNTMYTYSPAFKQFGSSAKVVHFLGSMKPWNYKYNPQSGSVLEQGSVSSSQHQAAFLHLWWTVYQNNVLPLYKSVQAGEARASPGHTLCHSDVGGPCADSASGVGEPCENSTPSAGVPCANSPLGSNQPAQGLPEPTQIVDETLSLPEGRRSEDMIACPETETPAVITCDPLSQPSPQPADFTETETILVDLAVSVSQISIEEKVKELSPEEERRKWEEGRIDYMGKDAFARIQEKLDRFLQ

SEQ ID NO: 748360 - protein, 463 aa, Homo sapiens
MSVTDQAFVTLATNDIYCQGALVLGQSLRRHRLTRKLVVLITPQVSSLLRVILSKVFDEVIEVNLIDSADYIHLAFLKRPELGLTLTKLHCWTLTHYSKCVFLDADTLVLSNVDELFDRGEFSAAPDPGWPDCFNSGVFVFQPSLHTHKLLLQHAMEHGSFDGADQGLLNSFFRNWSTTDIHKHLPFIYNLSSNTMYTYSPAFKQFGSSAKVVHFLGSMKPWNYKYNPQSGSVLEQGSVSSSQHQAAFLHLWWTVYQNNVLPLYKSVQAGEARASPGHTLCHSDVGGPCADSASGVGEPCENSTPSAGVPCANSPLGSNQPAQGLPEPTQIVDETLSLPEGRRSEDMIACPETETPAVITCDPLSQPSPQPADFTETETILQPANKVESVSSEETFEPSQELPAEALRDPSLQDALEVVSKFFPLPKAPGGGHPPSLRSTACTQQLLIFQPHLTKNKNRLPSS

SEQ ID NO: 748361 - protein, 88 aa, Homo sapiens
PFPHLWGGTRPSLLDPARCRARASASLSSPCSAPSRGSPDAGTVCVQLDPFFSSIPFSFCYTTTHSVAAATMLSTQGAASRRCRGAGV

SEQ ID NO: 748362 - protein, 380 aa, Homo sapiens
MASLPVLQKESVFQSGAHAYRIPALLYLPGQQSLLAFAEQRASKKDEHAELIVLRRGDYDAPTHQVQWQAQEVVAQARLDGHRSMNPCPLYDAQTGTLFLFFIAIPGQVTEQQQLQTRANVTRLCQVTSTDHGRTWSSPRDLTDAAIGPAYREWSTFAVGPGHCLQLHDRARSLVVPAYAYRKLHPIQRPIPSAFCFLSHDHGRTWARGHFVAQDTLECQVAEVETGEQRVVTLNARSHLRARVQAQSTNDGLDFQESQLVKKLVEPPPQGCQGSVISFPSPRSGPGSPAQWLLYTHPTHSWQRADLGAYLNPRPPAPEAWSEPVLLAKGSCAYSDLQSMGTGPDGSPLFGCLYEANDYEEIVFLMFTLKQAFPAEYLPQ

SEQ ID NO: 748363 - protein, 904 aa, Homo sapiens
MRQTLPCIYFWGGLLPFGMLCASSTTKCTVSHEVADCSHLKLTQVPDDLPTNITVLNLTHNQLRRLPAANFTRYSQLTSLDVGFNTISKLEPELCQKLPMLKVLNLQHNELSQLSDKTFAFCTNLTELHLMSNSIQKIKNNPFVKQKNLITLDLSHNGLSSTKLGTQVQLENLQELLLSNNKIQALKSEELDIFANSSLKKLELSSNQIKEFSPGCFHAIGRLFGLFLNNVQLGPSLTEKLCLELANTSIRNLSLSNSQLSTTSNTTFLGLKWTNLTMLDLSYNNLNVVGNDSFAWLPQLEYFFLEYNNIQHLFSHSLHGLFNVRYLNLKRSFTKQSISLASLPKIDDFSFQWLKCLEHLNMEDNDIPGIKSNMFTGLINLKYLSLSNSFTSLRTLTNETFVSLAHSPLHILNLTKNKISKIESDAFSWLGHLEVLDLGLNEIGQELTGQEWRGLENIFEIYLSYNKYLQLTRNSFALVPSLQRLMLRRVALKNVDSSPSPFQPLRNLTILDLSNNNIANINDDMLEGLEKLEILDLQHNNLARLWKHANPGGPIYFLKGLSHLHILNLESNGFDEIPVEVFKDLFELKIIDLGLNNLNTLPASVFNNQVSLKSLNLQKNLITSVEKKVFGPAFRNLTELDMRFNPFDCTCESIAWFVNWINETHTNIPELSSHYLCNTPPHYHGFPVRLFDTSSCKDSAPFELFFMINTSILLIFIFIVLLIHFEGWRISFYWNVSVHRVLGFKEIDRQTEQFEYAAYIIHAYKDKDWVWEHFSSMEKEDQSLKFCLEERDFEAGVFELEAIVNSIKRSRKIIFVITHHLLKDPLCKRFKVHHAVQQAIEQNLDSIILVFLEEIPDYKLNHALCLRRGMFKSHCILNWPVQKERIGAFRHKLQVALGSKNSVH

SEQ ID NO: 748364 - protein, 904 aa, Homo sapiens; identical to SEQ ID NO: 748363

SEQ ID NO: 748365 - protein, 627 aa, Homo sapiens
MLDLSYNNLNVVGNDSFAWLPQLEYFFLEYNNIQHLFSHSLHGLFNVRYLNLKRSFTKQSISLASLPKIDDFSFQWLKCLEHLNMEDNDIPGIKSNMFTGLINLKYLSLSNSFTSLRTLTNETFVSLAHSPLHILNLTKNKISKIESDAFSWLGHLEVLDLGLNEIGQELTGQEWRGLENIFEIYLSYNKYLQLTRNSFALVPSLQRLMLRRVALKNVDSSPSPFQPLRNLTILDLSNNNIANINDDMLEGLEKLEILDLQHNNLARLWKHANPGGPIYFLKGLSHLHILNLESNGFDEIPVEVFKDLFELKIIDLGLNNLNTLPASVFNNQVSLKSLNLQKNLITSVEKKVFGPAFRNLTELDMRFNPFDCTCESIAWFVNWINETHTNIPELSSHYLCNTPPHYHGFPVRLFDTSSCKDSAPFELFFMINTSILLIFIFIVLLIHFEGWRISFYWNVSVHRVLGFKEIDRQTEQFEYAAYIIHAYKDKDWVWEHFSSMEKEDQSLKFCLEERDFEAGVFELEAIVNSIKRSRKIIFVITHHLLKDPLCKRFKVHHAVQQAIEQNLDSIILVFLEEIPDYKLNHALCLRRGMFKSHCILNWPVQKERIGAFRHKLQVALGSKNSVH

SEQ ID NO: 748366 - protein, 69 aa, Homo sapiens
MAIPTTPHPQPTSTSGGGSFSVASQELALQACVSSIEELADTGCCAPEALSFQKCQVLEQGAATITAPH

SEQ ID NO: 748367 - protein, 689 aa, Homo sapiens
MIEMAAEKEPFLVPAPPPPLKDESGGGGGPTVPPHQEAASGELRGGTERGPGRCAPSAGSPAAAVGRESPGAAATSSSGPQAQQHRGGGPQAQSHGEARLSDPPGRAAPPDVGEERRGGGGTELGPPAPPRPRNGYQPHRPPGGGGGKRRNSCNVGGGGGGFKHPAFKRRRRVNSDCDSVLPSNFLLGGNIFDPLNLNSLLDEEVSRTLNAETPKSSPLPAKGRDPVEILIPKDITDPLSLNTCTDEGHVVLASPLKTGRKRHRHRGQHHQQQQAAGGSESHPVPPTAPLTPLLHGEGASQQPRHRGQNRDAPQPYELNTAINCRDEVVSPLPSALQGPSGSLSAPPAASVISAPPSSSSRHRKRRRTSSKSEAGARGGGQGSKEKGRGSWGGRHHHHHPLPAAGFKKQQRKFQYGNYCKYYGYRNPSCEDGRLRVLKPEWFRGRDVLDLGCNVGHLTLSIACKWGPSRMVGLDIDSRLIHSARQNIRHYLSEELRLPPQTLEGDPGAEGEEGTTTVRKRSCFPASLTASRGPIAAPQVPLDGADTSVFPNNVVFVTGNYVLDRDDLVEAQTPEYDVVLCLSLTKWVHLNWGDEGLKRMFRRIYRHLRPGGILVLEPQPWSSYGKRKTLTETIYKNYYRIQLKPEQFSSYLTSPDVGFSSYELVATPHNTSKGFQRPVYLFHKARSPSH

SEQ ID NO: 748368 - protein, 689 aa, Homo sapiens; identical to SEQ ID NO: 748367

SEQ ID NO: 748369 - protein, 671 aa, Homo sapiens
MIEMAAEKEPFLVPAPPPPLKDESGGGGGPTVPPHQEAASGELRGGTERGPGRCAPSAGSPAAAVGRESPGAAATSSSGPQAQQHRGGGPQAQSHGEARLSDPPGRAAPPDVGEERRGGGGTELGPPAPPRPRNGYQPHRPPGGGGGKRRNSCNVGGGGGGFKHPAFKRRRRVNSDCDSVLPSNFLLGGNIFDPLNLNSLLDEEVSRTLNAETPKSSPLPAKGRDPVEILIPKDITDPLSLNTCTDEGHVVLASPLKTGRKRHRHRGQHHQQQQAAGGSESHPVPPTAPLTPLLHGEGASQQPRHRGQNRDAPQPYELNTAINCRDEVVSPLPSALQGPSGSLSAPPAASVISAPPSSSSRHRKRRRTSSKSEAGARGGGQGSKEKGRGSWGGRHHHHHPLPAAGFKKQQRKFQYGNYCKYYGYRNPSCEDGRLRVLKPEWFRGRDVLDLGCNVGHLTLSIACKWGPSRMVGLDIDSRLIHSARQRDPGAEGEEGTTTVRKRSCFPASLTASRGPIAAPQVPLDGADTSVFPNNVVFVTGNYVLDRDDLVEAQTPEYDVVLCLSLTKWVHLNWGDEGLKRMFRRIYRHLRPGGILVLEPQPWSSYGKRKTLTETIYKNYYRIQLKPEQFSSYLTSPDVGFSSYELVATPHNTSKGFQRPVYLFHKARSPSH

SEQ ID NO: 748370 - protein, 689 aa, Homo sapiens; identical to SEQ ID NO: 748367

SEQ ID NO: 748371 - protein, 689 aa, Homo sapiens; identical to SEQ ID NO: 748367

SEQ ID NO: 748372 - protein, 689 aa, Homo sapiens; identical to SEQ ID NO: 748367

SEQ ID NO: 748373 - protein, 220 aa, Homo sapiens
MVGLDIDSRLIHSARQNIRHYLSEELRLPPQTLEGDPGAEGEEGTTTVRKRSCFPASLTASRGPIAAPQVPLDGADTSVFPNNVVFVTGNYVLDRDDLVEAQTPEYDVVLCLSLTKWVHLNWGDEGLKRMFRRIYRHLRPGGILVLEPQPWSSYGKRKTLTETIYKNYYRIQLKPEQFSSYLTSPDVGFSSYELVATPHNTSKGFQRPVYLFHKARSPSH

SEQ ID NO: 748374 - protein, 220 aa, Homo sapiens; identical to SEQ ID NO: 748373

SEQ ID NO: 748375 - protein, 220 aa, Homo sapiens; identical to SEQ ID NO: 748373

SEQ ID NO: 748376 - protein, 815 aa, Homo sapiens
MIEMAAEKEPFLVPAPPPPLKDESGGGGGPTVPPHQEAASGELRGGTERGPGRCAPSAGSPAAAVGRESPGAAATSSSGPQAQQHRGGGPQAQSHGEARLSDPPGRAAPPDVGEERRGGGGTELGPPAPPRPRNGYQPHRPPGGGGGKRRNSCNVGGGGGGFKHPAFKRRRRVNSDCDSVLPSNFLLGGNIFDPLNLNSLLDEEVSRTLNAETPKSSPLPAKGRDPVEILIPKDITDPLSLNTCTDEGHVVLASPLKTGRKRHRHRGQHHQQQQAAGGSESHPVPPTAPLTPLLHGEGASQQPRHRGQNRDAPQPYELNTAINCRDEVVSPLPSALQGPSGSLSAPPAASVISAPPSSSSRHRKRRRTSSKSEAGARGGGQGSKEKGRGSWGGRHHHHHPLPAAGFKKQQRKFQYGNYCKYYGYRNPSCEDGRLRVLKPEWFRGRDVLDLGCNVGHLTLSIACKWGPSRMVGLDIDSRLIHSARQNIRHYLSEELRLPPQTLEGDPGAEGEEGTTTVRKRSCFPASLTASRGPIAAPQVPLDGADTSVFPNNVVFVTGNYVLDRDDLVEAQTPEYDVVLCLSLTKWVHLNWGDEGLKRMFRRIYRHLRPGGILVLEPQPWSSYGKRKTLTETIYKNYYRIQLKPEQFSSYLTSPDVGFSSYELVATPHNTSKGKAGLFCQGGWSWLKECRPPWGFLRCCQPLLITLSPLRLPASCVPVPQGPIPQPLSGPLNRKCEEAALAAHKDLGEEESVPRSFLSDSKNSFLSWICKESFSSVAASASSLCLWHLRSKAGCAGVTIIFLSPSLPGWMAWTVC

SEQ ID NO: 748377 - protein, 689 aa, Homo sapiens; identical to SEQ ID NO: 748367

SEQ ID NO: 748378 - protein, 689 aa, Homo sapiens; identical to SEQ ID NO: 748367

SEQ ID NO: 748379 - protein, 685 aa, Homo sapiens
MIEMAAEKEPFLVPAPPPPLKDESGGGGGPTVPPHQEAASGELRGGTERGPGRCAPSAGSPAAAVGRESPGAAATSSSGPQAQQHRGGGPQAQSHGEARLSDPPGRAAPPDVGEERRGGGGTELGPPAPPRPRNGYQPHRPPGGGGGKRRNSCNVGGGGGGFKHPAFKRRRRVNSDCDSVLPSNFLLGGNIFDPLNLNSLLDEEVSRTLNAETPKSSPLPAKGRDPVEILIPKDITDPLSLNTCTDEGHVVLASPLKTGRKRHRHRGQHHQQQQAAGGSESHPVPPTAPLTPLLHGEGASQQPRHRGQNRDAPQPYELNTAINCRDEVVSPLPSALQGPSGSLSAPPAASVISAPPSSSSRHRKRRRTSSKSEAGARGGGQGSKEKGRGSWGGRHHHHHPLPAAGFKKQQRKFQYGNYCKYYGYRNPSCEDGRLRVLKPEWFRGRDVLDLGCNVGHLTLSIACKWGPSRMVGLDIDSRLIHSARQNIRHYLSEELRLPPQTLEGDPGAEGEEGTTTVRKRSCFPASLTASRGPIAAPQVPLDGADTSVFPNNVVFVTGNYVLDRDDLVEAQTPEYDVVLCLSLTKWVHLNWGDEGLKRMFRRIYRHLRPGGILVLEPQPWSSYGKRKTLTETIYKNYYRIQLKPEQFSSYLTSPDVGFSSYELVATPHNTSKGFQRPATYEGSSD

SEQ ID NO: 748380 - protein, 164 aa, Homo sapiens
EEKDSYGNDLQELLPNPIEARAVFPNNVVFVTGNYVLDRDDLVEAQTPEYDVVLCLSLTKWVHLNWGDEGLKRMFRRIYRHLRPGGILVLEPQPWSSYGKRKTLTETIYKNYYRIQLKPEQFSSYLTSPDVGFSSYELVATPHNTSKGFQRPVYLFHKARSPSH

SEQ ID NO: 748381 - protein, 557 aa, Homo sapiens
MIEMAAEKEPFLVPAPPPPLKDESGGGGGPTVPPHQEAASGELRGGTERGPGRCAPSAGSPAAAVGRESPGAAATSSSGPQAQQHRGGGPQAQSHGEARLSDPPGRAAPPDVGEERRGGGGTELGPPAPPRPRNGYQPHRPPGGGGGKRRNSCNVGGGGGGFKHPAFKRRRRVNSDCDSVLPSNFLLGGNIFDPLNLNSLLDEEVSRTLNAETPKSSPLPAKGRDPVEILIPKDITDPLSLNTCTDEGHVVLASPLKTGRKRHRHRGQHHQQQQAAGGSESHPVPPTAPLTPLLHGEGASQQPRHRGQNRDAPQPYELNTAINCRDEVVSPLPSALQGPSGSLSAPPAASVISAPPSSSSRHRKRRRTSSKSEAGARGGGQGSKEKGRGSWGGRHHHHHPLPAAGFKKQQRKFQYGNYCKYYGYRNPSCEDGRLRVLKPEWFRGRDVLDLGCNVGHLTLSIACKWGPSRMVGLDIDSRLIHSARQNIRHYLSEELRLPPQTLEGDPGAEGEEGTTTVRKRSCFPASLTASRGPIAAPQVPLDGADTSVFPKKKKKKK

SEQ ID NO: 748382 - protein, 553 aa, Homo sapiens
MIEMAAEKEPFLVPAPPPPLKDESGGGGGPTVPPHQEAASGELRGGTERGPGRCAPSAGSPAAAVGRESPGAAATSSSGPQAQQHRGGGPQAQSHGEARLSDPPGRAAPPDVGEERRGGGGTELGPPAPPRPRNGYQPHRPPGGGGGKRRNSCNVGGGGGGFKHPAFKRRRRVNSDCDSVLPSNFLLGGNIFDPLNLNSLLDEEVSRTLNAETPKSSPLPAKGRDPVEILIPKDITDPLSLNTCTDEGHVVLASPLKTGRKRHRHRGQHHQQQQAAGGSESHPVPPTAPLTPLLHGEGASQQPRHRGQNRDAPQPYELNTAINCRDEVVSPLPSALQGPSGSLSAPPAASVISAPPSSSSRHRKRRRTSSKSEAGARGGGQGSKEKGRGSWGGRHHHHHPLPAAGFKKQQRKFQYGNYCKYYGYRNPSCEDGRLRVLKPEWFRGRDVLDLGCNVGHLTLSIACKWGPSRMVGLDIDSRLIHSARQNIRHYLSEELRLPPQTLEGDPGAEGEEGTTTVRKRSCFPASLTASRGPIAAPQVPLDGADWQGGTQVL

SEQ ID NO: 748383 - protein, 106 aa, Homo sapiens
MPFSRTEDGKIYQRAFGGHSLKFGKGRQAHRCCCVADRTGHSILHTSYGRSLRYDTSCFVEYFALDLLMENGECRGVFALCIQDGSIHRIRAKNTIVATGVKKLFF

SEQ ID NO: 748384 - protein, 402 aa, Homo sapiens
MPFSRTEDGKIYQRAFGGHSLKFGKGGQAHGCCCVADRTGHSILHTLYGRSLRYDTSCFVEYFALDLLMENGECRGVFALCIQDGSIHRIRAKNTIVATGLLAQLLELHVSHTSTSDGTAMITRAGLPCQDLEFVQFHPTGTYGAGCLITEGCRGEGGILINSQGERFMERYAPIAKDLASRDVVSRWMTLEIREGRGCGPEKDHVYLQLHHLPPEQLAMPLPGISETAMIFAGVDVTKEPIPVLPTVHYNMDGIPTSYEGQVLRHGNGQDQIVPGLYACGEAACASAHGVNASGQTRYWTWLSGQACALSIAESCRPGDKVPPIKPNAGEESVTNLDKLRFADGRSIRTSELRLSMQKSTQNHAAVFRVGSLLQEGCGKISKLYGDLKHLKTFDRGEQTVG

SEQ ID NO: 748385 - protein, 421 aa, Homo sapiens
MPFSRTEDGKIYQRAFGGHSLKFGKGGQAHGCCCVADRTGHSILHTLYGRSLRYDTSCFVEYFALDLLMENGECRGVFALCIQDGSIHRIRAKNTIVATGLLAQLLELHVSHTSTSDGTAMITRAGLPCQDLEFVQFHPTGTYGAGCLITEGCRGEGGILINSQGERFMERYAPIAKDLASRDVVSRWMTLEIREGRGCGPEKDHVYLQLHHLPPEQLAMPLPGISETAMIFAGVDVTKEPIPVLPTVHYNMDGIPTSYEGQVLRHGNGQDQIVPGLYACGEAACASAHGVNASGQTRYWTWLSGQACALSIAESCRPGDKVPPIKPNAGEESVTNLDKLRFADGRSIRTSELRLSMQKVRAWTRSGVSRLAAYLALHWFCFFKNRSRGMQVQLCVDVLGGGGVWAFHVPVTQVVCVVLSR

SEQ ID NO: 748386 - protein, 402 aa, Homo sapiens; identical to SEQ ID NO: 748384

SEQ ID NO: 748387 - protein, 402 aa, Homo sapiens; identical to SEQ ID NO: 748384

SEQ ID NO: 748388 - protein, 144 aa, Homo sapiens
MEEDNWRWHFYDTVKGSDWLGDQDAIHYVTEQAPTAMVEVENYGMPFSRTEDGKIYQRAFGGHSLKFGKGRQAHRCCCVADRTGHSILHTSYGRSLRYDTSCFVEYFALDLLMENGECRGVFALCIQDGSIHRIRAKNTIVATG

SEQ ID NO: 748389 - protein, 178 aa, Homo sapiens
MEEDNWRWHFYDTVKGSDWLGDQDAIHYVTEQAPTAMVAVMGGRLWVLWWSVSSTRVLEKMKAVEADVAAERMVENYGMPFSRTEDGKIYQRAFGGHSLKFGKGGQAHGCCCVADRTGHSILHTLYGRSLRYDTSCFVEYFALDLLMENGECRGVFALCIQDGSIHRIRAKNTIVATG

SEQ ID NO: 748390 - protein, 74 aa, Homo sapiens
RSLRRDWRDCAAATTDVSGVRGLSRLPSARRLALALAKAISAQYPVVDHEFDAVVVGAGGAGFASCIWPFRGRV

SEQ ID NO: 748391 - protein, 144 aa, Homo sapiens
RSLRRDWRDCAAATTDVSGVRGLSRLPSARRLALALAKAVENYGMPFSRTEDGKIYQRAFGGHSLKFGKGGQAHGCCCVADRTGHSILHTLYGRSLRYDTSCFVEYFALDLLMENGECRGVFALCIQDGSIHRIRAKNTIVATG

SEQ ID NO: 748392 - protein, 96 aa, Homo sapiens
AGITSVSHCMPDLLPSLSLTCSTDTLLREVGLWRNGHLDISPEIFLSTGPEAREWPGSDCARPVRLWGGRLCLCTWCQPPRGKLAIGPGCLVRHVP

SEQ ID NO: 748393 - protein, 280 aa, Homo sapiens
MGRAELLEGKMSTQDPSDLWSRSDGEAELLQDLGWYHGNLTRHAAEALLLSNGCDGSYLLRDSNETTGLYSLSVRAKDSVKHFHVEYTGYSFKFGFNEFSSLKDFVKHFANQPLIGSETGTLMVLKHPYPRKVEEPSIYESVRVHTAMQTGRTEDDLVPTAPSLGTKEGYLTKQGGLVKTWKTRWFTLHRNELKYFKDQMSPEPIRILDLTECSAVQFDYSQERVNCFCLVFPFRTFYLCAKTGVEADEWIKILRWKLSQIRKQLNQGEGTIRSRSFIFK

SEQ ID NO: 748394 - protein, 280 aa, Homo sapiens
MGRAELLEGKMSTQDPSDLWSRSDGEAELLQDLGWYHGNLTRHAAEALLLSNGCDGSYLLRDSNETTGLYSLSVRAKDSVKHFHVEYTGYSFKFGFNEFSSLKDFVKHFANQPLIGSETGTLMVLKHPYPRKVEEPSIYESVRVHTAMQTGRTEDDLVPTAPSLGTKEGYLTKQGGLVKTWKTRWFTLHRNELKYFKDQMSPEPIRILDLTECSAVQFDYSQERVNCFCLVFPFRTFYLCAKTGVEADEWIKILRWKLVKDKSCILSALCISPEEKTDHK

SEQ ID NO: 748395 - protein, 205 aa, Homo sapiens
MGRAELLEGKMSTQDPSDLWRAKDSVKHFHVEYTGYSFKFGFNEFSSLKDFVKHFANQPLIGSETGTLMVLKHPYPRKVEEPSIYESVRVHTAMQTGRTEDDLVPTAPSLGTKEGYLTKQGGLVKSPEPIRILDLTECSAVQFDYSQERVNCFCLVFPFRTFYLCAKTGVEADEWIKILRWKLSQIRKQLNQGEGTIRSRSFIFK

SEQ ID NO: 748396 - protein, 271 aa, Homo sapiens
SYTPASGTMASLWLLSCFSLVGAAFGCGVPAIHPVLSGLSRIVNGEDAVPGSWPWQVSLQDKTGFHFCGGSLISEDWVVTAAHCGVRTSDVVVAGEFDQGSDEENIQVLKIAKVFKNPKFSILTVNNDITLLKLATPARFSQTVSAVCLPSADDDFPAGTLCATTGWGKTKYNANKTPDKLQQAALPLLSNAECKKSWGRRITDVMICAGASGVSSCMGDSGGPLVCQKDGAWTLVGIVSWGSRTCSTTTPAVYARVTKLIPWVQKILAAN

SEQ ID NO: 748397 - protein, 149 aa, Homo sapiens
WGQKKTLAVFFSQGTSVPAGCCLGPKAPGREFSRRGVCQPNRVGARTKVTNANKTPDKLQQAALPLLSNAECKKSWGRRITDVMICAGASGVSSCMGDSGGPLVCQKDGAWTLVGIVSWGSRTCSTTTPAVYARVTKLIPWVQKILAAN

SEQ ID NO: 748398 - protein, 93 aa, Homo sapiens
HACERHGFLWLLSCFSLVGAAFGCGVPAIHPVLSGLSRIVNGEDAVPGSWPWQVSLQDKTGFHFCGGSLISEDWVVTAAHCGVRTPTWSWLGK

SEQ ID NO: 748399 - protein, 271 aa, Homo sapiens; identical to SEQ ID NO: 748396

SEQ ID NO: 748400 - protein, 263 aa, Homo sapiens
SYTPASGTMASLWLLSCFSLVGAAFGCGVPAIHPVLSGLSRIVNGEDAVPGSWPWQVSLQDKTGFHFCGGSLISEDWVVTAAHCGVRTSDVVVAGEFDQGSDEENIQVLKIAKVFKNPKFSILTVNNDITLLKLATPARFSQTVSAVCLPSADDDFPAGTLCATTGWGKTKYNANKTPDKLQQAALPLLSNAECKKSWGRRITDVMICAGGDSGGPLVCQKDGAWTLVGIVSWGSRTCSTTTPAVYARVTKLIPWVQKILAAN

SEQ ID NO: 748401 - protein, 171 aa, Homo sapiens
HACERHGFLWLLSCFSLVGAAFGCGVPAIHPVLSGLSRIVNGEDAVPGSWPWQVSLQDKTGFHFCGGSLISEDWVVTAAHCGVRTSDVVVAGEFDQGSDEENIQVLKIAKVFKNPKFSILTVNNDITLLKLATPARFSQTVSAVCLPSADDDFPAGTLCATTGWGKTKYNG

SEQ ID NO: 748402 - protein, 268 aa, Homo sapiens
HACERHGFLWLLSCFSLVGAAFGCGVPAIHPVLSGLSRIVNGEDAVPGSWPWQVSLQDKTGFHFCGGSLISEDWVVTAAHCGVRTSDVVVAGEFDQGSDEENIQVLKIAKVFKNPKFSILTVNNDITLLKLATPARFSQTVSAVCLPSADDDFPAGTLCATTGWGKTKYNANKTPDKLQQAALPLLSNAECKKSWGRRITDVMICAGASGVSSCMGDSGGPLVCQKDGAWTLVGIVSWGSRTCSTTTPAVYARVTKLIPWVQKILAAN

SEQ ID NO: 748403 - protein, 271 aa, Homo sapiens; identical to SEQ ID NO: 748396

SEQ ID NO: 748404 - protein, 174 aa, Homo sapiens
SYTPASGTMASLWLLSCFSLVGAAFGCGVPAIHPVLSGLSRIVNGEDAVPGSWPWQVSLQDKTGFHFCGGSLISEDWVVTAAHCGVRTSDVVVAGEFDQGSDEENIQVLKIAKVFKNPKFSILTVNNDITLLKLATPARFSQTVSAVCLPSADDDFPAGTLCATTGWGKTKYNG

SEQ ID NO: 748405 - protein, 282 aa, Homo sapiens
GTRRFSLPEQRPYTHRGMGLPGLFCLAVLAASSFSKAREEEITPVVSIAYKVLEVFPKGRWVLITCCAPQPPPPITYSLCGTKNIKVAKKVVKTHEPASFNLNVTLKSSPDLLTYFCRASSTSGAHVDSARLQMHWELWSKPVSELRANFISAGQRGRPRVEMICQASSGSPPITNSLIGKDGQVHLQQRPCHRQPANFSFLPSQTSDWFWCQAANNANVQHSALTVVPPGGDQKMEDWQGPLESPILALPLYRSTRRLSEEEFGGFRIGNGEVRGRKAAAM

SEQ ID NO: 748406 - protein, 90 aa, Homo sapiens
PPPRRVPQGTPPIVLVGSLASHCGPSPPRMLGWTHVGPGGDQKMEDWQGPLESPILALPLYRSTRRLSEEEFGGFRIGNGEVRGRKAAAM

SEQ ID NO: 748407 - protein, 252 aa, Homo sapiens
GKIFGPFPPFGCGESRCHERVCTEITPVVSIAYKVLEVFPKGRWVLITCCAPQPPPPITYSLCGTKNIKVAKKVVKTHEPASFNLNVTLKSSPDLLTYFCRASSTSGAHVDSARLQMHWELWSRQRGRPRVEMICQASSGSPPITNSLIGKDGQVHLQQRPCHRQPANFSFLPSQTSDWFWCQAANNANVQHSALTVVPPGGDQKMEDWQGPLESPILALPLYRSTRRLSEEEFGGFRIGNGEVRGRKAAAM

SEQ ID NO: 748408 - protein, 137 aa, Homo sapiens [sequence omitted]

SEQ ID NO: 748409 - protein, 563 aa, Homo sapiens
RHSHFSRSRSTMDTSSEMLVRFGRRCGRAKESTEIRNSEEDQVLYLPLLPSKVDLQQVTIIPHDEWKRIQDSLDRLTREAACLRAERKAKKEMHLRSQEVVKHWTNTYAGMKEQKLEAKKKRDEEIEAERQILDLEEEIYKQGKRKKAIENAKQYQFYQTERVKNFHSGLLLSRVMKERDAQIEFRKSKIKSDKKWEEQLKLNIEKAFKEEQEKAEKRHRERVALAKDHLKQIKEHEEEEERRKKYEEKDAEEIKRQNALYEIEMRKKLEKKREEMHESRRRFLEHMQDKHIIKAVEQQQQEEEDEKMRKFIKAKKRLIQMGKEKEAETHRLMEKRRERIHNFLSELLKEKLDNEDMIIARDIAEAEAEWEKREREKDEKNKAELKTIAEYRAIVMKNKEEEERQRKIEAKEQLLAVMKADQIFWEHEKEKKCKADKEHQEVQDAHIQQMAKNKFNAKQAKQAELDYCRLTEALVAEKEKEFQDYAREVIELESETTNKYIYPLVKAVQEGPGGGRGPVFVDRGGLRPSYQANDVTGVQLPFYNSQGPKYNFQKSKRRLGFTW

SEQ ID NO: 748410 - protein, 563 aa, Homo sapiens
RHSHFSRSRSTMDTSSEMLVRFGRRCGRAKESTVIMPISELLRRISLKLFPKVDLQQVTIIPHDEWKRIQDSLDRLTREAACLRAERKAKKEMHLRSQEVVKHWTNTYAGMKEQKLEAKKKRDEEIEAERQILDLEEEIYKQGKRKKAIENAKQYQFYQTERVKNFHSGLLLSRVMKERDAQIEFRKSKIKSDKKWEEQLKLNIEKAFKEEQEKAEKRHRERVALAKDHLKQIKEHEEEEERRKKYEEKDAEEIKRQNALYEIEMRKKLEKKREEMHESRRRFLEHMQDKHIIKAVEQQQQEEEDEKMRKFIKAKKRLIQMGKEKEAETHRLMEKRRERIHNFLSELLKEKLDNEDMIIARDIAEAEAEWEKREREKDEKNKAELKTIAEYRAIVMKNKEEEERQRKIEAKEQLLAVMKADQIFWEHEKEKKCKADKEHQEVQDAHIQQMAKNKFNAKQAKQAELDYCRLTEALVAEKEKEFQDYAREVIELESETTNKYIYPLVKAVQEGPGGGRGPVFVDRGGLRPSYQANDVTGVQLPFYNSQGPKYNFQKSKRRLGFTW

SEQ ID NO: 748411 - protein, 418 aa, Homo sapiens
RHSHFSRSRSTMDTSSEMLVRFGRRCGRAKESTEIRNSEEDQVLYLPLLPSKVDLQQVTIIPHDEWKRIQDSLDRLTREAACLRAERKAKKEMHLRSQEVVKHWTNTYAGMKEQKLEAKKKRDEEIEAERQILDLEEEIYKQGKRKKAIENAKQYQFYQTERVKNFHSGLLLSRVMKERDAQIEFRKSKIKSDKKWEEQLKLNIEKAFKEEQEKAEKRHRERVALAKDHLKQIKEHEEEEERRKKYEEKDAEEIKRQNALYEIEMRKKLEKKREEMHESRRRFLEHMQDKHIIKAVEQQQQEEEDEKMRKFIKAKKRLIQMGKEKEAETHRLMEKRRERIHNFLSELLKEKLDNEDMIIARDIAEAEAEWEKREREKDEKNKAELKTIAEYRAIVMKINEEAPAPLREGNPEPRSLTA

SEQ ID NO: 748412 - protein, 114 aa, Homo sapiens
MRLLILALLGICSLTAYIVEGVGSEVSHRRTCVSLTTQRLPVSRIKTYTITEGSLRAVIFITKRGLKVCADPQATWVRDVVRSMDRKSNTRNNMIQTKPTGTQQSTNTAVTLTG

SEQ ID NO: 748413 - protein, 72 aa, Homo sapiens
MELTAWLIKKTPHLHTQYPDPCEGPCRPFLSDISKATGITAVSMGMARKTTGLMTTLGSGGSNPNAKASLKI

SEQ ID NO: 748414 - protein, 398 aa, Homo sapiens
QRAGRALGGALCACVECPAAPSWRGTSLLQVASCVSKQANMDRDSYHHYFYDYDGGEDFYRSTTPSEDIWKKFELVPPPWDLGPAAGNPALSFGLLEPWPVGCAGDETESQDYWKAWDANYASLIRRDCMWSGFSTQEPLERAVSDLLAVGAPSGYSPKEFATPDYTPELEAGNLAPIFPCLLGEPKIQACSRSESPSDSEGEEIDVTVKKRQSLSTRKPVIIAVRADLLDPRMNLFHISIHQQQHNYAAPFPPESCFQEGAPKRMPPKEALEREAPGGKDDKEDEEIVSLPPVESEAAQSCQPKPIHYDTENWTKKKYHSYLERKRRNDQRSRFLALRDEVPALASCSRVSKVMILVKATEYLHELAEAEERMATEKRQLECQRRQLQKRIEYLSSY

SEQ ID NO: 748415 - protein, 169 aa, Homo sapiens
GSQPRSPAAAVRCSQGQQPAPCHPPQTLTEPVATTMTRDQNGTWEMESNENFEGYMKALDIDFATRKIAVRLTQTKVIDQDGDNFKTKTTSTFRNYDVDFTVGVEFDEYTKSLDNRHVKALVTWEGDVLVCVQKGEKENRGWKQWIEGDKLYLELTCGDQVCRQVFKKK

SEQ ID NO: 748416 - protein, 169 aa, Homo sapiens; identical to SEQ ID NO: 748415

SEQ ID NO: 748417 - protein, 521 aa, Homo sapiens
LYPTCLRSQGPRWIFSSTSAKPGGLFPSETMERDSHGNASPARTPSAGASPAQASPAGTPPGRASPAQASPAQASPAGTPPGRASPAQASPAGTPPGRASPGRASPAQASPAQASPARASPALASLSRSSSGRSSSARSASVTTSPTRVYLVRATPVGAVPIRSSPARSAPATRATRESPGTSLPKFTWREGQKQLPLIGCVLLLIALVVSLIILFQFWQGHTGIRYKEQRESCPKHAVRCDGVVDCKLKSDELGCVRFDWDKSLLKIYSGSSHQWLPICSSNWNDSYSEKTCQQLGFESAHRTTEVAHRDFANSFSILRYNSTIQESLHRSECPSQRYISLQCSHCGLRAMTGRIVGGALASDSKWPWQVSLHFGTTHICGGTLIDAQWVLTAAHCFFVTREKVLEGWKVYAGTSNLHQLPEAASIAEIIINSNYTDEEDDYDIALMRLSKPLTLSGEGICTPRSPAPQPQHPLQPSHLSASVNSYPGPKASAGQKSKTLKDPYMEHFCFIIRETEAQGL

SEQ ID NO: 748418 - protein, 611 aa, Homo sapiens
LYPTCLRSQGPRWIFSSTSAKPGGLFPSETMERDSHGNASPARTPSAGASPAQASPAGTPPGRASPAQASPAQASPAGTPPGRASPAQASPAGTPPGRASPGRASPAQASPARASPALASLSRSSSGRSSSARSASVTTSPTRVYLVRATPVGAVPIRSSPARSAPATRATRESPGTSLPKFTWREGQKQLPLIGCVLLLIALVVSLIILFQFWQGHTGIRYKEQRESCPKHAVRCDGVVDCKLKSDELGCVRFDWDKSLLKIYSGSSHQWLPICSSNWNDSYSEKTCQQLGFESAHRTTEVAHRDFANSFSILRYNSTIQESLHRSECPSQRYISLQCSHCGLRAMTGRIVGGALASDSKWPWQVSLHFGTTHICGGTLIDAQWVLTAAHCFFVTREKVLEGWKVYAGTSNLHQLPEAASIAEIIINSNYTDEEDDYDIALMRLSKPLTLSAHIHPACLPMHGQTFSLNETCWITGFGKTRETDDKTSPFLREVQVNLIDFKKCNDYLVYDSYLTPRMMCAGDLRGGRDSCQGDSGGPLVCEQNNRWYLAGVTSWGTGCGQRNKPGVYTKVTEVLPWIYSKMEVRSLQQDTAPSRLGTSSGGDPGGAPRL

SEQ ID NO: 748419 - protein, 466 aa, Homo sapiens
LYPTCLRSQGPRWIFSSTSAKPGGLFPSETMERDSHGNASPARTPSAGASPAQASPAGTPPGRASPAQASLSRSSSGRSSSARSASVTTSPTRVYLVRATPVGAVPIRSSPARSAPATRATRESPGTSLPKFTWREGQKQLPLIGCVLLLIALVVSLIILFQFWQGHTGIRYKEQRESCPKHAVRCDGVVDCKLKSDELGCVRFDWDKSLLKIYSGSSHQWLPICSSNWNDSYSEKTCQQLGFESAHRTTEVAHRDFANSFSILRYNSTIQESLHRSECPSQRYISLQCSHCGLRAMTGRIVGGALASDSKWPWQVSLHFGTTHICGGTLIDAQWVLTAAHCFFVTREKVLEGWKVYAGTSNLHQLPEAASIAEIIINSNYTDEEDDYDIALMRLSKPLTLSGEGICTPRSPAPQPQHPLQPSHLSASVNSYPGPKASAGQKSKTLKDPYMEHFCFIIRETEAQGL

SEQ ID NO: 748420 - protein, 104 aa, Homo sapiens
WGCHVSDSGDVMGGHRSVAGYWEFPLSFLSSLHPFSMGCLPRSRSPSSPSPQQWKKPVIDTAVGGRLCKSLTFGALEGFLHFIFTQAPAPHSSCPPLSFPPTSS

SEQ ID NO: 748421 - protein, 104 aa, Homo sapiens; identical to SEQ ID NO: 748420

SEQ ID NO: 748422 - protein, 98 aa, Homo sapiens
NHPLSRESRDYAPLSRDYAYHDYGHSSWDEHFSRGYSDCDGCGEVMLEIILNVQVEVLIEMHFRDRGPLMVHHLQECLCCLMVEAATMIIAINEIDMA

SEQ ID NO: 748423 - protein, 126 aa, Homo sapiens
GTPPGVRVAGPDDVAWQRPYRRCFPGNLAPPELIAAESRRVCASEPEPATAAVAARPAGARRGLCHGGVTRLHPLFRGSGETEETPRQGQRRRLVSPGMEEKYGGDVLAGPGGGGGLGRWTYPALD

SEQ ID NO: 748424 - protein, 765 aa, Homo sapiens
MEEKYGGDVLAGPGGGGGLGPVDVPSARLTKYIVLLCFTKFLKAVGLFESYDLLKAVHIVQFIFILKLGTAFFMVCFKSHFLLGKLLPNTSGSKYLNMQLLGAIISLLWFFGLTLCGPLRTLLLFEHSDIVVISLLSVLFTSSGGGPAKTRGAAFFIIAVICLLLFDNDDLMAKMAEHPEGHHDSALTHMLYTAIAFLGVADHKGGVLLLVLALCCKVGFHTASRKLSVDVGGAKRLQALSHLVSVLLLCPWVIVLSVTTESKVESWFSLIMPFATVIFFVMILDFYVDSICSVKMEVSKCARYGSFPIFISALLFGNFWTHPITDQLRAMNKAAHQESTEHVLSGGVVVSAIFFILSANILSSPSKRGQKGTLIGYSPEGTPLYNFMGDAFQHSSQSIPRFIKESLKQILEESDSRQIFYFLCLNLLFTFVELFYGVLTNSLGLISDGFHMLFDCSALVMGLFAALMSRWKATRIFSYGYGRIEILSGFINGLFLIVIAFFVFMESVARLIDPPELDTHMLTPVSVGGLIVNLIGICAFSHAHSHAHGASQGSCHSSDHSHSHHMHGHSDHGHGHSHGSAGGGMNANMRGVFLHVLADTLGSIGVIVSTVLIEQFGWFIADPLCSLFIAILIFLSVVPLIKDACQVLLLRLPPEYEKELHIALEKIQKIEGLISYRDPHFWRHSASIVAGTIHIQVTSDVLEQRIVQQVTGILKDAGVNNLTIQVEKEAYFQHMSGLSTGFHDVLAMTKQMESMKYCKDGTYIM

SEQ ID NO: 748425 - protein, 765 aa, Homo sapiens; identical to SEQ ID NO: 748424

SEQ ID NO: 748426 - protein, 400 aa, Homo sapiens
DSQQDPHEAPGYSPEGTPLYNFMGDAFQHSSQSIPRFIKESLKQILEESDSRQIFYFLCLNLLFTFVELFYGVLTNSLGLISDGFHMLFDCSALVMGLFAALMSRWKATRIFSYGYGRIEILSGFINGLFLIVIAFFVFMESVARLIDPPELDTHMLTPVSVGGLIVNLIGICAFSHAHSHAHGASQGSCHSSDHSHSHHMHGHSDHGHGHSHGSAGGGMNANMRGVFLHVLADTLGSIGVIVSTVLIEQFGWFIADPLCSLFIAILIFLSVVPLIKDACQVLLLRLPPEYEKELHIALEKIQKIEGLISYRDPHFWRHSASIVAGTIHIQVTSDVLEQRIVQQVTGILKDAGVNNLTIQVEKEAYFQHMSGLSTGFHDVLAMTKQMESMKYCKDGTYIM

SEQ ID NO: 748427 - protein, 671 aa, Homo sapiens
MEEKYGGDVLAGPGGGGGLGPVDVPSARLTKYIVLLCFTKFLKAVGLFESYDLLKAVHIVQFIFILKLGTAFFMVCFKSHFLLGKLLPNTSGSKYLNMQLLGAIISLLWFFGLTLCGPLRTLLLFEHSDIVVISLLSVLFTSSGGGPAKTRGAAFFIIAVICLLLFDNDDLMAKMAEHPEGHHDSALTHMLYTAIAFLGVADHKGGVLLLVLALCCKVGFHTASRKLSVDVGGAKRLQALSHLVSVLLLCPWVIVLSVTTESKVESWFSLIMPFATVIFFVMILDFYVDSICSVKMEVSKCARYGSFPIFISALLFGNFWTHPITDQLRAMNKAAHQESTEHVLSGGVVVSAIFFILSANILSSPSKRGQKGTLIGYSPEGTPLYNFMGDAFQHSSQSIPRFIKESLKQILEESDSRQIFYFLCLNLLFTFVELFYGVLTNSLGLISDGFHMLFDCSALVMGLFAALMSRWKATRIFSYGYGRIEILSGFINGLFLIVIAFFVFMESVARLIDPPELDTHMLTPVSVGGLIVNLIGICAFSHAHSHAHGASQGSCHSSDHSHSHHMHGHSDHGHGHSHGSAGGGMNANMRGVFLHVLADTLGSIGVIVSTVLIEQFGWFIADPLCSLFIAILIFLSVVPLIKDACQVLLLRLPPEYEKELHIALEKIRYCM

SEQ ID NO: 748428 - protein, 526 aa, Homo sapiens
MEEKYGGDVLAGPGGGGGLGPVDVPSARLTKYIVLLCFTKFLKAVGLFESYDLLKAVHIVQFIFILKLGTAFFMVCFKSHFLLGKLLPNTSGSKYLNMQLLGAIISLLWFFGLTLCGPLRTLLLFEHSDIVVISLLSVLFTSSGGGPAKTRGAAFFIIAVICLLLFDNDDLMAKMAEHPEGHHDSALTHMLYTAIAFLGVADHKGGVLLLVLALCCKVGFHTASRKLSVDVGGAKRLQALSHLVSVLLLCPWVIVLSVTTESKVESWFSLIMPFATVIFFVMILDFYVDSICSVKMEVSKCARYGSFPIFISALLFGNFWTHPITDQLRAMNKAAHQESTEHVLSGGVVVSAIFFILSANILSSPSKRGQKGTLIGYSPEGTPLYNFMGDAFQHSSQSIPRFIKESLKQILEESDSRQIFYFLCLNLLFTFVELFYGVLTNSLGLISDGFHMLFDCSALVMGLFAALMSRWKATRIFSYGYGRIEILSGFINGLFLIVIAFFVFMESVARLIDPPELDTHMLTPCP

SEQ ID NO: 748429 - protein, 92 aa, Homo sapiens
FPDLTARSPYPRLKSEREEVAVPEFQLRIRPSSALRASVPALHCVRPALAGACRRQPCRNPPGLTPSSPDPTKQQWISTRHAFPSTFTRSVF

SEQ ID NO: 748430 - protein, 113 aa, Homo sapiens
MYLAFFHSFSGGLCSPRHSGHVSVHLPKCWLLANVSSIGMQHLCLLEGTAASWQVQSLILRQVGLSVLASLNSGNVSLPCVYQHNSQHAREFKKGSWGDTYLIRCFQISEFHP

SEQ ID NO: 748431 - protein, 444 aa, Homo sapiens
MKFPASVLASVFLFVAETTAALSLSSTYRSGGDRMWQALTLLFSLLPCALVQLTLLFVHRDLSRDRPLVLLLHLLQLGPLFRCFEVFCIYFQSGNNEEPYVSITKKRQMPKNGLSEEIEKEVGQAEGKLITHRSAFSRASVIQAFLGSAPQLTLQLYISVMQQDVTVGRSLLMTISLLSIVYGALRCNILAIKIKYDEYEVKVKPLAYVCIFLWRSFEIATRVVVLVLFTSVLKTWVVVIILINFFSFFLYPWILFWCSGSPFPENIEKALSRVGTTIVLCFLTLLYTGINMFCWSAVQLKIDSPDLISKSHNWYQLLVYYMIRFIENAILLLLWYLFKTDIYMYVCAPLLVLQLLIGYCTAILFMLVFYQFFHPCKKLFSSSVSEGFQRWLRCFCWACRQQKPCEPIGKEDLQSSRDRDETPSSSKTSPEPGQFLNAEDLCSA

SEQ ID NO: 748432 - protein, 209 aa, Homo sapiens [sequence omitted]

SEQ ID NO: 748433 - protein, 131 aa, Homo sapiens
SWTGVSKKQLMWLLNRLQGLQELVLSGCSWLSVSALGSAPLPALRLLDLRWIEDVKDSQLRELLLPPPDTKPAERPGPEPLRPRRGPQCSPPHGPHVPTPRDPGAPQSCWLPPPNGPLHSSLGDRVRLSLL

SEQ ID NO: 748434 - protein, 295 aa, Homo sapiens [sequence omitted]

SEQ ID NO: 748435 - protein, 295 aa, Homo sapiens [sequence omitted]

SEQ ID NO: 748436 - protein, 295 aa, Homo sapiens [sequence omitted]

SEQ ID NO: 748437 - protein, 217 aa, Homo sapiens [sequence omitted]

SEQ ID NO: 748438 - protein, 195 aa, Homo sapiens
VDGRMWICDSVGIMVSTCLLPHIEAVSNIHNLNSVHQSPHQRLHRYVELAWGFSTALGTFLFLAEVVLVGWVKFVPIGAPLDTPTPMVPTSRVPGTLAPVATSLSPASNLPRSSASAAPSQAEPACPPRQACGGGGAHGPGWQAAMASTAIMVPVGLVFVAFALHFYRSLVAHKTDRYKQELEELNRLQGELQAV

SEQ ID NO: 748439 - protein, 204 aa, Homo sapiens
SWTGVSKKQLMWLLNRLQGLQELVLSGCSWLSVSALGSAPLPALRLLDLRWIEDVKDSQLRELLLPPPDTKPGQTESRGRLQGVAELRLAGLELTDASLRLLLRHAPQLSALDLSHCAHVGDPSVHLLTAPTSPLRETLVHLNLAGCHRLTDHCLPLFRRCPRLRRLDLRSCRQLSPEACARLAAAGPPGPFRCPEEKLLLKDS

SEQ ID NO: 748440 - protein, 169 aa, Homo sapiens [sequence omitted]

SEQ ID NO: 748441 - protein, 204 aa, Homo sapiens; identical to SEQ ID NO: 748439

SEQ ID NO: 748442 - protein, 204 aa, Homo sapiens; identical to SEQ ID NO: 748439

SEQ ID NO: 748443 - protein, 204 aa, Homo sapiens; identical to SEQ ID NO: 748439

SEQ ID NO: 748444 - protein, 204 aa, Homo sapiens; identical to SEQ ID NO: 748439

SEQ ID NO: 748445 - protein, 564 aa, Homo sapiens
PASSSLPSFLAFAAHSAAMEQRRVTDFFARRRPGPPRIAPPKLACRTPSPARPALRAPASATSGSRKRARPPAAPGRDQARPPARRRLRLSVDEVSSPSTPEAPDIPACPSPGQKIKKSTPAAGQPPHLTSAQDQDTISELASCLQRARELGARVRALKASAQDAGESCTPEAEGRPEEPCGEKAPAYQRFHALAQPGLPGLVLPYKYQVLAEMFRSMDTIVGMLHNRSETPTFAKVQRGVQDMMRRRFEERNVGQIKTVYPASYRFRQERSVPTFKDGARRSDYQLTIEPLLEQEADGAAPQLTASRLLQRRQIFSQKLVEHVKEHHKAFLASLSPAMVVPEDQLTRWHPRFNVDEVPDIEPAALPQPPATEKLTTAQEVLARARNLISPRMEKALSQLALRSAAPSSPGSPRPALPATPPATPPAASPSALKGVSQDLLERIRAKEAQKQLAQMTRCPEQEQRLQRLERLPELARVLRSVFVSERKPALSMEVACARMVGSCCTIMSPGEMEKHLLLLSELLPDWLSLHRIRTDTYVKLDKAADLAHITARLAHQTRAEEGL

SEQ ID NO: 748446 - protein, 576 aa, Homo sapiens
KPTTTQKHNKTKNLRLGTRLGVAFAAHSAAMEQRRVTDFFARRRPGPPRIAPPKLACRTPSPARPALRAPASATSGSRKRARPPAAPGRDQARPPARRRLRLSVDEVSSPSTPEAPDIPACPSPGQKIKKSTPAAGQPPHLTSAQDQDTISELASCLQRARELGARVRALKASAQDAGESCTPEAEGRPEEPCGEKAPAYQRFHALAQPGLPGLVLPYKYQVLAEMFRSMDTIVGMLHNRSETPTFAKVQRGVQDMMRRRFEERNVGQIKTVYPASYRFRQERSVPTFKDGARRSDYQLTIEPLLEQEADGAAPQLTASRLLQRRQIFSQKLVEHVKEHHKAFLASLSPAMVVPEDQLTRWHPRFNVDEVPDIEPAALPQPPATEKLTTAQEVLARARNLISPRMEKALSQLALRSAAPSSPGSPRPALPATPPATPPAASPSALKGVSQDLLERIRAKEAQKQLAQMTRCPEQEQRLQRLERLPELARVLRSVFVSERKPALSMEVACARMVGSCCTIMSPGEMEKHLLLLSELLPDWLSLHRIRTDTYVKLDKAADLAHITARLAHQTRAEEGL

SEQ ID NO: 748447 - protein, 576 aa, Homo sapiens; identical to SEQ ID NO: 748446

SEQ ID NO: 748448 - protein, 293 aa, Homo sapiens
SWYPPGMGYVDHAVGSPSSLLLEQEADGAAPQLTASRLLQRRQIFSQKLVEHVKEHHKAFLASLSPAMVVPEDQLTRWHPRFNVDEVPDIEPAALPQPPATEKLTTAQEVLARARNLISPRMEKALSQLALRSAAPSSPGSPRPALPATPPATPPAASPSALKGVSQDLLERIRAKEAQKQLAQMTRCPEQEQRLQRLERLPELARVLRSVFVSERKPALSMEVACARMVGSCCTIMSPGEMEKHLLLLSELLPDWLSLHRIRTDTYVKLDKAADLAHITARLAHQTRAEEGL

SEQ ID NO: 748449 - protein, 269 aa, Homo sapiens
MGNCCWTQCFGLLRKEAGRLQRVGGGGGSKYFRTCSRGEHLTIEFENLVESDEGESPGSSHRPLTEEEIVDLRERHYDSIAEKQKDLDKKIQKEQERQRIVQQYHPSNNGEYQSSGPEDDFESCLRNMKSQYEVFRSSRLSSDATVLTPNTESSCDLMTKTKSTSGNDDSTSLDLEWEDEEGMNRMLPMRERSKTEEDILRAALKYSNKKTGSNPTSASDDSNGLEWENDFVSAEMDDNGNSEYSGFVNPVLELSDSGIRHSDTDQQTR

SEQ ID NO: 748450 - protein, 269 aa, Homo sapiens; identical to SEQ ID NO: 748449

SEQ ID NO: 748451 - protein, 217 aa, Homo sapiens
MGNCCWTQCFGLLRKEAGRLQRVGGGGGSKYFRTCSRGEHLTIEFENLVESDEGESPGSSHRPLTEEEIVDLRERHYDSIAEKQKDLDKKIQKELALQEEKLRLEEEALYAAQREAARAAKQRKLLEQERQRIVQQYHPSNNGEYQSSGPEDDFESCLRNMKSQYEVFRSSRLSSDATVLTPNTESSCDLMTKTKSTSGNDDSTSLDLEWEDEEGIL

SEQ ID NO: 748452 - protein, 302 aa, Homo sapiens
MGNCCWTQCFGLLRKEAGRLQRVGGGGGSKYFRTCSRGEHLTIEFENLVESDEGESPGSSHRPLTEEEIVDLRERHYDSIAEKQKDLDKKIQKELALQEEKLRLEEEALYAAQREAARAAKQRKLLEQERQRIVQQYHPSNNGEYQSSGPEDDFESCLRNMKSQYEVFRSSRLSSDATVLTPNTESSCDLMTKTKSTSGNDDSTSLDLEWEDEEGMNRMLPMRERSKTEEDILRAALKYSNKKTGSNPTSASDDSNGLEWENDFVSAEMDDNGNSEYSGFVNPVLELSDSGIRHSDTDQQTR

SEQ ID NO: 748453 - protein, 245 aa, Homo sapiens
MHVIWPLTEEEIVDLRERHYDSIAEKQKDLDKKIQKELALQEEKLRLEEEALYAAQREAARAAKQRKLLEQERQRIVQQYHPSNNGEYQSSGPEDDFESCLRNMKSQYEVFRSSRLSSDATVLTPNTESSCDLMTKTKSTSGNDDSTSLDLEWEDEEGMNRMLPMRERSKTEEDILRAALKYSNKKTGSNPTSASDDSNGLEWENDFVSAEMDDNGNSEYSGFVNPVLELSDSGIRHSDTDQQTR

SEQ ID NO: 748454 - protein, 36 aa, Homo sapiens
MFLITERLKYQRLNQSPQNSISWVVKGTNKATRKIK

SEQ ID NO: 748455 - protein, 194 aa, Homo sapiens
MAAAAPNAGGSAPETAGSAEAPLQYSLLLQYLVGDKRQPRLLEPGSLGGIPSPAKSEEQKMIEKAMESCAFKAALACVGGFVLGGAFGVFTAGIDTNVGFDPKDPYRTPTAKEVLKDMGQRGMSYAKNFAIVGAMFSCTECLIESYRGTSDWKNSVISGCITGGAIGFRAGLKAGAIGCGGFAAFSAAIDYYLR

SEQ ID NO: 748456 - protein, 205 aa, Homo sapiens
LRLGTRPGVAVMAAAAPNAGGSAPETAGSAEAPLQYSLLLQYLVGDKRQPRLLEPGSLGGIPSPAKSEEQKMIEKAMESCAFKAALACVGGFVLGGAFGVFTAGIDTNVGFDPKDPYRTPTAKEVLKDMGQRGMSYAKNFAIVGAMFSCTECLIESYRGTSDWKNSVISGCITGGAIGFRAGLKAGAIGCGGFAAFSAAIDYYLR

SEQ ID NO: 748457 - protein, 197 aa, Homo sapiens
MYARMLRDPNAGGSAPETAGSAEAPLQYSLLLQYLVGDKRQPRLLEPGSLGGIPSPAKSEEQKMIEKAMESCAFKAALACVGGFVLGGAFGVFTAGIDTNVGFDPKDPYRTPTAKEVLKDMGQRGMSYAKNFAIVGAMFSCTECLIESYRGTSDWKNSVISGCITGGAIGFRAGLKAGAIGCGGFAAFSAAIDYYLR

SEQ ID NO: 748458 - protein, 79 aa, Homo sapiens
LFEDPRRMSYAKNFAIVGAMFSCTECLIESYRGTSDWKNSVISGCITGGAIGFRAGLKAGAIGCGGFAAFSAAIDYYLR

SEQ ID NO: 748459 - protein, 200 aa, Homo sapiens
MAAAAPNAGGSAPETAGSAEAPLQYSLLLQYLVGDKRQPRLLEPGSLGGIPSPAKSEEQKMIEKAMESCAFKAALACVGGFVLGGAFGVFTAGIDTNVGFDPKDPYRTPTAKEVLKDMGQRGMSYAKNFAIVGAMFSCTECLIESYRGTSDWKNSVISGCITGGAIGFRAGLKAGAIGCGGFAAFFFGPLLCPLKKYFFG

SEQ ID NO: 748460 - protein, 107 aa, Homo sapiens
IPQDTHWKGSLAVLLSPSGALSQDAHLRIGHIPKVSDVWARACFRDCDTWNYSRWPDARVLWFGCVPTQISSGILFPIIHACGGRDPVGGNLIMVGGFPHPVHVTVS

SEQ ID NO: 748461 - protein, 346 aa, Homo sapiens
CLCPWPYAPTSGGEFSPSVDGRPCSSPSELPAKLLLGATLPRAPRLPRRLAWCSIDWEQVCLLQRLGAGGFGSVYKATYRGVPVAIKQVNKCTKNRLASRRSFWAELNVARLRHDNIVRVVAASTRTPAGSNSLGTIIMEFGGNVTLHQVIYGAAGHPEGDAGEPHCRTGGQLSLGKCLKYSLDVVNGLLFLHSQSIVHLDLKPANILISEQDVCKISDFGCSEKLEDLLCFQTPSYPLGGTYTHRAPELLKGEGVTPKADIYSFAITLWQMTTKQAPYSGERQHILYAVVAYDLRPSLSAAVFEDSLPGQRLGDVIQRCWRPSAAQRPSARLLLVDLTSLKAELG

SEQ ID NO: 748462 - protein, 146 aa, Homo sapiens
MLSAVWGAGGPGAGGAARGQPSRKELLLRHHLWSGPRCLSFPLGSLPASLLGLPGATSHRSCLSPNLASGLAARGTQTQSVLFGEVRLPLDGGVRGARKRSLLRAHPRTGILPGRCGMVWKDKKLQPSGCHEKAGGVFCGPSRGGV

SEQ ID NO: 748463 - protein, 144 aa, Homo sapiens
MLSAVWGAGGPGAGGAARGQPSRKELLLRHHLWSGPRCLSFPLGSLPASLLGLPGATSHRSCLSPNLASGLAARGTQTQSVLFGEEAESTTSTFSGAWGGQPPGQSKERMRSDMGVAVSGEGDGRFQHDAISNKFQHSSISFHK

SEQ ID NO: 748464 - protein, 612 aa, Homo sapiens
PPAAGQPRARDSGDVRSQPRPLFQWSKWKKRMGSSMSAATARRPVFDDKEDVNFDHFQILRAIGKGSFGKVCIVQKRDTEKMYAMKYMNKQQCIERDEVRNVFRELEILQEIEHVFLVNLWYSFQDEEDMFMVVDLLLGGDLRYHLQQNVQFSEDTVRLYICEMALALDYLRGQHIIHRDVKPDNILLDERGHAHLTDFNIATIIKDGERATALAGTKPYMAPEIFHSFVNGGTGYSFEVDWWSVGVMAYELLRGWRPYDIHSSNAVESLVQLFSTVSVQYVPTWSKEMVALLRKLLTVNPEHRLSSLQDVQAAPALAGVLWDHLSEKRVEPGFVPNKGRLHCDPTFELEEMILESRPLHKKKKRLAKNKSRDNSRDSSQSENDYLQDCLDAIQQDFVIFNREKLKRSQDLPREPLPAPESRDAAEPVEDEAERSALPMCGPIVPLGRERLGRDARGPHPLSCFGDSAARGRAMGRGLAFTFPPSLAGGAHSAPDTFHTSGSWWCRGQEAVGAGDTCGGHFPWAPETRLDGGSAAGRPLTAHGELGPWMGQESLSLLSPEAVHGPRHKVTLAAQAAGAPGSAQFLEVKGMGWGSGWGGECFLEIQTAPAISV

SEQ ID NO: 748465 - protein, 528 aa, Homo sapiens
MKYMNKQQCIERDEVRNVFRELEILQEIEHVFLVNLWYSFQDEEDMFMVVDLLLGGDLRYHLQQNVQFSEDTVRLYICEMALALDYLRGQHIIHRDVKPDNILLDERGHAHLTDFNIATIIKDGERATALAGTKPYMAPEIFHSFVNGGTGYSFEVDWWSVGVMAYELLRGWRPYDIHSSNAVESLVQLFSTVSVQYVPTWSKEMVALLRKLLTVNPEHRLSSLQDVQAAPALAGVLWDHLSEKRVEPGFVPNKGRLHCDPTFELEEMILESRPLHKKKKRLAKNKSRDNSRDSSQSENDYLQDCLDAIQQDFVIFNREKLKRSQDLPREPLPAPESRDAAEPVEDEAERSALPMCGPIVPLGRERLGRDARGPHPLSCFGDSAARGRAMGRGLAFTFPPSLAGGAHSAPDTFHTSGSWWCRGQEAVGAGDTCGGHFPWAPETRLDGGSAAGRPLTAHGELGPWMGQESLSLLSPEAVHGPRHKVTLAAQAAGAPGSAQFLEVKGMGWGSGWGGECFLEIQTAPAISV

SEQ ID NO: 748466 - protein, 498 aa, Homo sapiens
MTFSVTLYSFQDEEDMFMVVDLLLGGDLRYHLQQNVQFSEDTVRLYICEMALALDYLRGQHIIHRDVKPDNILLDERGHAHLTDFNIATIIKDGERATALAGTKPYMAPEIFHSFVNGGTGYSFEVDWWSVGVMAYELLRGWRPYDIHSSNAVESLVQLFSTVSVQYVPTWSKEMVALLRKLLTVNPEHRLSSLQDVQAAPALAGVLWDHLSEKRVEPGFVPNKGRLHCDPTFELEEMILESRPLHKKKKRLAKNKSRDNSRDSSQSENDYLQDCLDAIQQDFVIFNREKLKRSQDLPREPLPAPESRDAAEPVEDEAERSALPMCGPIVPLGRERLGRDARGPHPLSCFGDSAARGRAMGRGLAFTFPPSLAGGAHSAPDTFHTSGSWWCRGQEAVGAGDTCGGHFPWAPETRLDGGSAAGRPLTAHGELGPWMGQESLSLLSPEAVHGPRHKVTLAAQAAGAPGSAQFLEVKGMGWGSGWGGECFLEIQTAPAISV

SEQ ID NO: 748467 - protein, 102 aa, Homo sapiens
MLSAVWGAGGPGAGGAARGQPSRKELLLRHHLWSGPRCLSFPLGSLPASLLGLPGATSHRSCLSPNLASGLAARGTQTQSVLFGEVRLPLDGGVRGARKRRS

SEQ ID NO: 748468 - protein, 108 aa, Homo sapiens
MLSAVWGAGGPGAGGAARGQPSRKELLLRHHLWSGPRCLSFPLGSLPASLLGLPGATSHRSCLSPNLASGLAARGTQTQSVLFGEVRLPLDGGVRGARKRSECPEEGF

SEQ ID NO: 748469 - protein, 102 aa, Homo sapiens; identical to SEQ ID NO: 748467

SEQ ID NO: 748470 - protein, 681 aa, Homo sapiens
MLSAVWGAGGPGAGGAARGQPSRKELLLRHHLWSGPRCLSFPLGSLPASLLGLPGATSHRSCLSPNLASGLAARGTQTQSVLFGEVRLPLDGGVRGARKRMNFDHFQILRAIGKGSFGKVSPRVPRRPQASCRTALALQVCIVQKRDTEKMYAMKYMNKQQCIERDEVRNVFRELEILQEIEHVFLVNLWYSFQDEEDMFMVVDLLLGGDLRYHLQQNVQFSEDTVRLYICEMALALDYLRGQHIIHRDVKPDNILLDERGHAHLTDFNIATIIKDGERATALAGTKPYMAPEIFHSFVNGGTGYSFEVDWWSVGVMAYELLRGWRPYDIHSSNAVESLVQLFSTVSVQYVPTWSKEMVALLRKLLTVNPEHRLSSLQDVQAAPALAGVLWDHLSEKRVEPGFVPNKGRLHCDPTFELEEMILESRPLHKKKKRLAKNKSRDNSRDSSQSENDYLQDCLDAIQQDFVIFNREKLKRSQDLPREPLPAPESRDAAEPVEDEAERSALPMCGPICPSAEERLGRDARGPHPLSCFGDSAARGRAMGRGLAFTFPPSLAGGAHSAPDTFHTSGSWWCRGQEAVGAGDTCGGHFPWAPETRLDGGSAAGRPLTAHGELGPWMGQESLSLLSPEAVHGPRHKVTLAAQAAGAPGSAQFLEVKGMGWGSGWGGECFLEIQTAPAISV

SEQ ID NO: 748471 - protein, 106 aa, Homo sapiens
MEPPEQFSHAIFQQLGQLPVTLSCTTSVTRSSDFHIHVDDPSSTRASQFLDILSSLILCSAYPSHCSVGHSLNFVINKAPSVTSISSNSCSTSFLISSSSPIPITC

SEQ ID NO: 748472 - protein, 187 aa, Homo sapiens
MVAATVAAAWLLLWAAACAQQEQDFYDFKAVNIRGKLVSLEKYRGSVSLVVNVASECGFTDQHYRALQQLQRDLGPHHFNVLAFPCNQFGQQEPDSNKEIESFARRTYSVSFPMFSKIAVTGTGAHPAFKYLAQTSGKEPTWNFWKYLVAPDGKVVGAWDPTVSVEEVRPQITALVRKLILLKREDL

SEQ ID NO: 748473 - protein, 187 aa, Homo sapiens; identical to SEQ ID NO: 748472

SEQ ID NO: 748474 - protein, 187 aa, Homo sapiens; identical to SEQ ID NO: 748472

SEQ ID NO: 748475 - protein, 151 aa, Homo sapiens [sequence omitted]

SEQ ID NO: 748476 - protein, 104 aa, Homo sapiens
MDKKEKSLGSWTTALLQAGLVILLEAAILLSLVKCNWLYLNDVALRFCQSRYYFNLLRPASTSRSREVSAHINGLALLKGISGPGVVAHACNPNTLGGRGGQIT

SEQ ID NO: 748477 - protein, 1046 aa, Homo sapiens
PGGAGVSSGPVGPGRGAMASEAVKVVVRCRPMNQRERELRCQPVVTVDCARAQCCIQNPGAADEPPKQFTFDGAYHVDHVTEQIYNEIAYPLVEGVTEGYNGTIFAYGQTGSGKSFTMQGLPDPPSQRGIIPRAFEHVFESVQCAENTKFLVRASYLEIYNEDVRDLLGADTKQKLELKEHPEKGVYVKGLSMHTVHSVAQCEHIMETGWKNRSVGYTLMNKDSSRSHSIFTISIEMSAVDERGKDHLRAGKLNLVDLAGSERQSKTGATGERLKEATKINLSLSALGNVISALVDGRCKHVPYRDSKLTRLLQDSLGGNTKTLMVACLSPADNNYDETLSTLRYANRAKNIRNKPRINEDPKDALLREYQEEIKKLKAILTQQMSPSSLSALLSRQVPPDPVQVEEKLLPQPVIQHDMEAEKQLIREEYEERLARLKADYKAEQESRARLEEDITAMRNSYDVRLSTLEENLRKETEAVLQVGVLYKAEVMSRAEFASSAEYPPAFQYETVVKPKVFSTTDTLPSDDVSKTQVSSRFAELPKVEPSKSEISLGSSESSSLEETSVSEAFPGPEEPSNVEVSMPTEESRSRYFLDECLGQEAAGHLLGEQNYLPQEEPQEVPLQGLLGLQDPFAEVEAKLARLSSTVARTDAPQADVPKVPVQVPAPTDLLEPSDARPEAEAADDFPPRPEVDLASEVALEVVRTAEPGVWLEAQAPVALVAQPEPLPATAGVKRESVGMEVAVLTDDPLPVVDQQQVLARLQLLEQQVVGGEQAKNKDLKEKHKRRKRYADERRKQLVAALQNSDEDSGDWVLLNVYDSIQEEVRAKSKLLEKMQRKLRAAEVEIKDLQSEFQLEKIDYLATIRRQERDSMLLQQLLEQVQPLIRRDCNYSNLEKILRESCWDEDNGFWKIPHPVITKTSLPVAVSTGPQNKPARKTSAADNGEPNMEEDRYRLMLSRSNSENIASNYFRSKRASQILSTDARKSLTHHNSPPGLSCPLSNNSAIPPTQAPEMPQPRPFRLESLDIPFTKAKRKKSKSNFGSEPL

SEQ ID NO: 748478 - protein, 412 aa, Homo sapiens
KNSTGRVFVSLVSLAGGDLSGLQQAEWPRLGLSHLGAVGGGWGGLPTSTWVSLHTQEVDLASEVALEVVRTAEPGVWLEAQAPVALVAQPEPLPATAGVKRESVGMEVAVLTDDPLPVVDQQQVLARLQLLEQQVVGGEQAKNKDLKEKHKRRKRYADERRKQLVAALQNSDEDSGDWVLLNVYDSIQEEVRAKSKLLEKMQRKLRAAEVEIKDLQSEFQLEKIDYLATIRRQERDSMLLQQLLEQVQPLIRRDCNYSNLEKILRESCWDEDNGFWKIPHPVITKTSLPVAVSTGPQNKPARKTSAADNGEPNMEEDRYRLMLSRSNSENIASNYFRSKRASQILSTDARKSLTHHNSPPGLSCPLSNNSAIPPTQAPEMPQPRPFRLESLDIPFTKAKRKKSKSNFGSEPL

SEQ ID NO: 748479 - protein, 816 aa, Homo sapiens
PGGAGVSSGPVGPGRGAMASEAVKVVVRCRPMNQRERELRCQPVVTVDCARAQCCIQNPGAADEPPKQFTFDGAYHVDHVTEQIYNEIAYPLVEGVTEGYNGTIFAYGQTGSGKSFTMQGLPDPPSQRGIIPRAFEHVFESVQCAENTKFLVRASYLEIYNEDVRDLLGADTKQKLELKEHPEKGVYVKGLSMHTVHSVAQCEHIMETGWKNRSVGYTLMNKDSSRSHSIFTISIEMSAVDERGKDHLRAGKLNLVDLAGSERQSKTGATGERLKEATKINLSLSALGNVISALVDGRCKHVPYRDSKLTRLLQDSLGGNTKTLMVACLSPADNNYDETLSTLRYANRAKNIRNKPRINEDPKDALLREYQEEIKKLKAILTQQMSPSSLSALLSRQVPPDPVQVEEKLLPQPVIQHDMEAEKQLIREEYEERLARLKADYKAEQESRARLEEDITAMRNSYDVRLSTLEENLRKEKVPAPTDLLEPSDARPEAEAADDFPPRPEVDLASEVALEVVRTAEPGVWLEAQAPVALVAQPEPLPATAGVKRESVGMEVAVLTDDPLPVVDQQQVLARLQLLEQQVVGGEQAKNKDLKEKHKRRKRYADERRKQLVAALQNSDEDSGDWVLLNVYDSIQEEVRAKSKLLEKMQRKLRAAEVEIKDLQSEFQLEKIDYLATIRRQERDSMLLQQLLEQVQPLIRRDCNYSNLEKILRESCWDEDNGFWKIPHPVITKTSLPVAVSTGPQNKPARKTSAADNGEPNMEEDRYRLMLSRSNSENIASNYFRSKRASQILSTDARKSLKPTPMPTSVGLCLKA

SEQ ID NO: 748480 - protein, 175 aa, Homo sapiens
MLLQQLLEQVQPLIRRDCNYSNLEKILRESCWDEDNGFWKIPHPVITKTSLPVAVSTGPQNKPARKTSAADNGEPNMEEDRYRLMLSRSNSENIASNYFRSKRASQILSTDARKSLTHHNSPPGLSCPLSNNSAIPPTQAPEMPQPRPFRLESLDIPFTKAKRKKSKSNFGSEPL

SEQ ID NO: 748481 - protein, 860 aa, Homo sapiens
PGGAGVSSGPVGPGRGAMASEAVKVVVRCRPMNQRERELRCQPVVTVDCARAQCCIQNPGAADEPPKQFTFDGAYHVDHVTEQIYNEIAYPLVEGVTEGYNGTIFAYGQTGSGKSFTMQGLPDPPSQRGIIPRAFEHVFESVQCAENTKFLVRASYLEIYNEDVRDLLGADTKQKLELKEHPEKGVYVKGLSMHTVHSVAQCEHIMETGWKNRSVGYTLMNKDSSRSHSIFTISIEMSAVDERGKDHLRAGKLNLVDLAGSERQSKTGATGERLKEATKINLSLSALGNVISALVDGRCKHVPYRDSKLTRLLQDSLGGNTKTLMVACLSPADNNYDETLSTLRYANRAKNIRNKPRINEDPKDALLREYQEEIKKLKAILTQQMSPSSLSALLSRQVPPDPVQVEEKLLPQPVIQHDMEAEKQLIREEYEERLARLKADYKAEQESRARLEEDITAMRNSYDVRLSTLEENLRKEKVPAPTDLLEPSDARPEAEAADDFPPRPEVDLASEVALEVVRTAEPGVWLEAQAPVALVAQPEPLPATAGVKRESVGMEVAVLTDDPLPVVDQQQVLARLQLLEQQVVGGEQAKNKDLKEKHKRRKRYADERRKQLVAALQNSDEDSGDWVLLNVYDSIQEEVRAKSKLLEKMQRKLRAAEVEIKDLQSEFQLEKIDYLATIRRQERDSMLLQQLLEQVQPLIRRDCNYSNLEKILRESCWDEDNGFWKIPHPVITKTSLPVAVSTGPQNKPARKTSAADNGEPNMEEDRYRLMLSRSNSENIASNYFRSKRASQILSTDARKSLTHHNSPPGLSCPLSNNSAIPPTQAPEMPQPRPFRLESLDIPFTKAKRKKSKSNFGSEPL

SEQ ID NO: 748482 - protein, 860 aa, Homo sapiens; identical to SEQ ID NO: 748481

SEQ ID NO: 748483 - protein, 202 aa, Homo sapiens [sequence omitted]

SEQ ID NO: 748484 - protein, 108 aa, Homo sapiens
MRGTLRQPPRPWRQKGPGRTTDWEETEKAEESQAAGVWMGPAQADAVSYPLSPLLPGPGLVSLRSLGMRQKQRLFSCGTTGCNQSTQCCFRNLNRLPIFLNWQHRLPH

SEQ ID NO: 748485 - protein, 120 aa, Homo sapiens
MPLHSSLGERNSVSKKTVGVDCRSQGRDTRHSICSMCPIHNSQCVSRDAAPSSGFPAHGGSSRAGASDGKLQAAKGGDGETPCFTFGLSCNSAHAPSAANRPWETVSSSPKLGQCLPGGA

SEQ ID NO: 748486 - protein, 236 aa, Homo sapiens
SLLFTSQRGWAPAAPLNHRFQKSSAEVLPSLISRTTIPRDFGFTTFLFLPDLSRSWLGFGRPEAHSDDVIRRERVPGFPRRPFFLSPRSSPLQAVAAGLSGDLAGRACALPCFLPGWWRRPFCSSSSSSCSSWLERSVRSGLGGESPRAGFGAFSSVPSRCPEPHKKRTRRRKKACGKLGAHEEQSKQVRRITTHNPEAENNPQKEFTNKRQLNKCPAQPEKKRAPGEKQNGVKNT

SEQ ID NO: 748487 - protein, 205 aa, Homo sapiens
SLLFTSQRGWAPAAPLNHRFQKSSAEVLPSLISRTTIPRDFGFTTFLFLPDLSRSWLGFGRPEAHSDDVIRRERVPGFPRRPFFLSPRSSPLQAVAAGLSGDLAGRACALPCFLPGWWRRPFCSSSSSSCSSWLERSVRSGLGGESPRAGFGAFSSVPSRCPEPPSPSSPPPPLPNPALPLVPGSLRRTHHDGRRRAAPDSTHTS

SEQ ID NO: 748488 - protein, 110 aa, Homo sapiens
MRPWSSIRIVCLRPPVWSGSREVAEPRPRPSPRVSRAARWRLVSSVPWRVSLVATWALPTQSEFSGRPPSSLSPEAASWHSLPLPLAVGTSRLITGSLDLLLVSLDFCLH

SEQ ID NO: 748489 - protein, 163 aa, Homo sapiens
KVEAWKEKLVTTVQNMQQGAAQSQEELCQLQAKLLIDSDDDSQCQMNHRDLIQKYEGSETQLKNLGQELAHTQHSIRQLCDGKDSLFPQLDILPQLPREALSSHTAESLHASESALSSESSKLLQQEIEKLRKSLQEKDATIRSLQGDNQRLYDSIAAISERE

SEQ ID NO: 748490 - protein, 614 aa, Homo sapiens
VALTAQACYGSSSLCGISCHIGKMKNSRTWAWRAPVELFLLCAALGCLSLPGSRGERPHSFGSNAVNKSFAKSRQMRSVDVTLMPIDCELSSWSSWTTCDPCQKKRYRYAYLLQPSQFHGEPCNFSDKEVEDCVTNRPCRSQVRCEGFVCAQTGRCVNRRLLCNGDNDCGDQSDEANCRRIYKKCQHEMDQYWGIGSLASGINLFTNSFEGPVLDHRYYAGGCSPHYILNTRFRKPYNVESYTPQTQGKYEFILKEYESYSDFERNVTEKMASKSGFSFGFKIPGIFELGISSQSDRGKHYIRRTKRFSHTKSVFLHARSDLEVAHYKLKPRSLMLHYEFLQRVKRLPLEYSYGEYRDLFRDFGTHYITEAVLGGIYEYTLVMNKEAMERGDYTLNNVHACAKNDFKIGGAIEEVYVSLGVSVGKCRGILNEIKDRNKRDTMVEDLVVLVRGGASEHITTLAYQELPTADLMQEWGDAVQYNPAIIKVKVEPLYELVTATDFAYSSTVRQNMKQALEEFQKEVSSCHCAPCQGNGVPVLKGSRCDCICPVGSQGLACEVSYRKNTPIDGKWNCWSNWSSCSGRRKTRQRQCNNPPPQNGGSPCSGPASETLDCS

SEQ ID NO: 748491 - protein, 596 aa, Homo sapiens
VALTAQACYGSSSLCGISCHIGKMKNSRTWAWRAPVELFLLCAALGCLSLPGSRGERPHSFGSNAVNKSFAKSRQMRSVDVTLMPIDCELSSWSSWTTCDPCQKKRYRYAYLLQPSQFHGEPCNFSDKEVEDCVTNRPCRSQVRCEGFVCAQTGRCVNRRLLCNGDNDCGDQSDEANCRRIYKKCQHEMDQYWGIGSLASGINLFTNSFEGPVLDHRYYAGGCSPHYILNTRFRKPYNVESYTPQTQGKYEFILKEYESYSDFERNVTEKMASKSGFSFGFKIPGIFELGISSQSDRGKHYIRRTKRFSHTKSVFLHARSDLEVAHYKLKPRSLMLHYEFLQRVKRLPLEYSYGEYRDLFRDFGTHYITEAVLGGIYEYTLVMNKEAMERGDYTLNNVHACAKNDFKIGGAIEEVYVSLGVSVGKCRGILNEIKGASEHITTLAYQELPTADLMQEWGDAVQYNPAIIKVKVEPLYELVTATDFAYSSTVRQNMKQALEEFQKEVSSCHCAPCQGNGVPVLKGSRCDCICPVGSQGLACEVSYRKNTPIDGKWNCWSNWSSCSGRRKTRQRQCNNPPPQNGGSPCSGPASETLDCS

SEQ ID NO: 748492 - protein, 596 aa, Homo sapiens
VALTAQACYGSSSLCGISCHIGKMKNSRTWAWRAPVELFLLCAALGCLSLPGSRGERPHSFGSNAVNKSFAKSRQMRSVDVTLMPIDCELSSWSSWTTCDPCQKKRYRYAYLLQPSQFHGEPCNFSDKEVEDCVTNRPCRSQVRCEGFVCAQTGRCVNRRLLCNGDNDCGDQSDEANCRRIYKINLFTNSFEGPVLDHRYYAGGCSPHYILNTRFRKPYNVESYTPQTQGKYEFILKEYESYSDFERNVTEKMASKSGFSFGFKIPGIFELGISSQSDRGKHYIRRTKRFSHTKSVFLHARSDLEVAHYKLKPRSLMLHYEFLQRVKRLPLEYSYGEYRDLFRDFGTHYITEAVLGGIYEYTLVMNKEAMERGDYTLNNVHACAKNDFKIGGAIEEVYVSLGVSVGKCRGILNEIKDRNKRDTMVEDLVVLVRGGASEHITTLAYQELPTADLMQEWGDAVQYNPAIIKVKVEPLYELVTATDFAYSSTVRQNMKQALEEFQKEVSSCHCAPCQGNGVPVLKGSRCDCICPVGSQGLACEVSYRKNTPIDGKWNCWSNWSSCSGRRKTRQRQCNNPPPQNGGSPCSGPASETLDCS

SEQ ID NO: 748493 - protein, 497 aa, Homo sapiens
FFMLLSQYRYAYLLQPSQFHGEPCNFSDKEVEDCVTNRPCRSQVRCEGFVCAQTGRCVNRRLLCNGDNDCGDQSDEANCRRIYKINLFTNSFEGPVLDHRYYAGGCSPHYILNTRFRKPYNVESYTPQTQGKYEFILKEYESYSDFERNVTEKMASKSGFSFGFKIPGIFELGISSQSDRGKHYIRRTKRFSHTKSVFLHARSDLEVAHYKLKPRSLMLHYEFLQRVKRLPLEYSYGEYRDLFRDFGTHYITEAVLGGIYEYTLVMNKEAMERGDYTLNNVHACAKNDFKIGGAIEEVYVSLGVSVGKCRGILNEIKDRNKRDTMVEDLVVLVRGGASEHITTLAYQELPTADLMQEWGDAVQYNPAIIKVKVEPLYELVTATDFAYSSTVRQNMKQALEEFQKEVSSCHCAPCQGNGVPVLKGSRCDCICPVGSQGLACEVSYRKNTPIDGKWNCWSNWSSCSGRRKTRQRQCNNPPPQNGGSPCSGPASETLDCS

SEQ ID NO: 748494 - protein, 515 aa, Homo sapiens
FFMLLSQYRYAYLLQPSQFHGEPCNFSDKEVEDCVTNRPCRSQVRCEGFVCAQTGRCVNRRLLCNGDNDCGDQSDEANCRRIYKKCQHEMDQYWGIGSLASGINLFTNSFEGPVLDHRYYAGGCSPHYILNTRFRKPYNVESYTPQTQGKYEFILKEYESYSDFERNVTEKMASKSGFSFGFKIPGIFELGISSQSDRGKHYIRRTKRFSHTKSVFLHARSDLEVAHYKLKPRSLMLHYEFLQRVKRLPLEYSYGEYRDLFRDFGTHYITEAVLGGIYEYTLVMNKEAMERGDYTLNNVHACAKNDFKIGGAIEEVYVSLGVSVGKCRGILNEIKDRNKRDTMVEDLVVLVRGGASEHITTLAYQELPTADLMQEWGDAVQYNPAIIKVKVEPLYELVTATDFAYSSTVRQNMKQALEEFQKEVSSCHCAPCQGNGVPVLKGSRCDCICPVGSQGLACEVSYRKNTPIDGKWNCWSNWSSCSGRRKTRQRQCNNPPPQNGGSPCSGPASETLDCS

SEQ ID NO: 748495 - protein, 344 aa, Homo sapiens
MASKSGFSFGFKIPGIFELGISSQSDRGKHYIRRTKRFSHTKSVFLHARSDLEVAHYKLKPRSLMLHYEFLQRVKRLPLEYSYGEYRDLFRDFGTHYITEAVLGGIYEYTLVMNKEAMERGDYTLNNVHACAKNDFKIGGAIEEVYVSLGVSVGKCRGILNEIKDRNKRDTMVEDLVVLVRGGASEHITTLAYQELPTADLMQEWGDAVQYNPAIIKVKVEPLYELVTATDFAYSSTVRQNMKQALEEFQKEVSSCHCAPCQGNGVPVLKGSRCDCICPVGSQGLACEVSYRKNTPIDGKWNCWSNWSSCSGRRKTRQRQCNNPPPQNGGSPCSGPASETLDCS

SEQ ID NO: 748496 - protein, 559 aa, Homo sapiens
VALTAQACYGSSSLCGISCHIGKMKNSRTWAWRAPVELFLLCAALGCLSLPGSRGERPHSFGSNAVNKSFAKSRQMRSVDVTLMPIDCELSSWSSWTTCDPCQKKRYRYAYLLQPSQFHGEPCNFSDKEVEDCVTNRPCRSQVRCEGFVCAQTGRCVNRRLLCNGDNDCGDQSDEANCRRIYKKCQHEMDQYWGIGSLASGINLFTNSFEGPVLDHRYYAGGCSPHYILNTRFRKPYNVESYTPQTQGKYEFILKEYESYSDFERNVTEKMASKSGFSFGFKIPGIFELGISSQSDRGKHYIRRTKRFSHTKSVFLHARSDLEVAHYKLKPRSLMLHYEFLQRVKRLPLEYSYGEYRDLFRDFGTHYITEAVLGGIYEYTLVMNKEAMERGDYTLNNVHACAKNDFKIGGAIEEVYVSLGVSVGKCRGILNEIKGASEHITTLAYQELPTADLMQEWGDAVQYNPAIIKVKVEPLYELVTATDFAYSSTVRQNMKQALEEFQKEVSSCHCAPCQGNGVPVLKGSRCDCICPVGSQGLACEVSYRKSKLIGKGTLGRSRE

SEQ ID NO: 748497 - protein, 234 aa, Homo sapiens
VALTAQACYGSSSLCGISCHIGKMKNSRTWAWRAPVELFLLCAALGCLSLPGSRGERPHSFGSNAVNKSFAKSRQMRSVDVTLMPIDCELSSWSSWTTCDPCQKKRYRYAYLLQPSQFHGEPCNFSDKEVEDCVTNRPCRSQVRCEGFVCAQTGRCVNRRLLCNGDNDCGDQSDEANCRRIYKINLFTNSFEGPVLDHRYYAGGCSPHYILNTRFRKPYNVESYTPQTQGYVHI

SEQ ID NO: 748498 - protein, 301 aa, Homo sapiens
MSYPTKEGSDTAGNAHKNSENEPPNDCSTDIESPSADPNMIYQVETNPINREPGTATSQEDVVPQAAENSELETEIQKDQREEDLKEELLLLQTPIPRKLVSHKPLNDRSRSHSGKVEMKANNFPINHKTRFRLSTSWRVPFINSHEIRSMILHLLCDRYFSQAAGCQNTMWVKRKYIACLYHPNSFTHHERAITFRRPSRVHYYRPLTERMTSGKFCKSTDTKGKCRFRAIVRSVLFVSQIQIESIFNIKGFVDILTYIHTMNVMITNTNNGWKYFCPICGRLFNTYSELRQHSCSSSGN

SEQ ID NO: 748499 - protein, 301 aa, Homo sapiens; identical to SEQ ID NO: 748498

SEQ ID NO: 748500 - protein, 95 aa, Homo sapiens
SLGSRCLSQKQCGAREGSSRGLSLLVREPGTRCPLLTHGNVGTASTGYPRTVPRATAASVLPTPGPQTPCSQCWDISQCVRQCFLIFPGFLGLTP

SEQ ID NO: 748501 - protein, 131 aa, Homo sapiens
PPPTTTKFAAGRRACCEPDTQLLRSPEPPMKQRLSSTHFTEEAERGEVGFTPRNARARAASGHPTPGPPCCVGRKASVLQISTGSLQTPGLSRVPQLEVTGVEANMQTSQHSASGLPNSMSPTWNWELNQM

SEQ ID NO: 748502 - protein, 1161 aa, Homo sapiens [sequence omitted]

SEQ ID NO: 748503 - protein, 337 aa, Homo sapiens
YYYYIGRSTFKYLKNLLMIHGAWNYNRVSKCILYCFYKNIVLYIIEIWFAFVNGFSGQILFERWCIGLYNVMFTAMPPLTLGIFERSCRKENMLKYPELYKTSQNALDFNTKVFWVHCLNGLFHSVILFWFPLKALQYGTAFGNGKTSDYLLLGNFVYTFVVITVCLKAGLETSYWTWFSHIAIWGSIALWVVFFGIYSSLWPAIPMAPDMSGEAAMLFSSGVFWMGLLFIPVASLLLDVVYKVIKRTAFKTLVDEVQELEAKSQDPGAVVLGKSLTERAQLLKNVFKKNHVNLYRSESLQQNLLHGYAFSQDENGIVSQSEVIRAYDTTKQRPDEW

SEQ ID NO: 748504 - protein, 885 aa, Homo sapiens
MRRTVSEIRSRAEGYEKTDDVSEKTSLADQEEVRTIFINQPQLTKFCNNHVSTAKYNIITFLPRFLYSQFRRAANSFFLFIALLQQIPDVSPTGRYTTLVPLLFILAVAAIKEIIEDIKRHKADNAVNKKQTQVLRNGAWEIVHWEKVAVGEIVKVTNGEHLPADLISLSSSEPQAMCYIETSNLDGETNLKIRQGLPATSDIKDVDSLMRISGRIECESPNRHLYDFVGNIRLDGHGTVPLGADQILLRGAQLRNTQWVHGIVVYTGHDTKLMQNSTSPPLKLSNVERITNVQILILFCILIAMSLVCSVGSAIWNRRHSGKDWYLNLNYGGASNFGLNFLTFIILFNNLIPISLLVTLEVVKFTQAYFINWDLDMHYEPTDTAAMARTSNLNEELGQVKYIFSDKTGTLTCNVMQFKKCTIAGVAYGHVPEPEDYGCSPDEWQNSQFGDEKTFSDSSLLENLQNNHPTAPIICEFLTMMAVCHTAVPEREGDKIIYQAASPDEGALVRAAKQLNFVFTGRTPDSVIIDSLGQEERYELLNVLEFTSARKRMSVIVRTPSGKLRLYCKGADTVIYDRLAETSKYKEITLKHLEQFATEGLRTLCFAVAEISESDFQEWRAVYQRASTSVQNRLLKLEESYELIEKNLQLLGATAIEDKLQDQVPETIETLMKADIKIWILTGDKQETAINIGHSCKLLKKNMGMIVINEGSLDGTRETLSRHCTTLGDALRKENDFALIIDGKTLKYALTFGVRQYFLDLALSCKAVICCRVSPLQKSEVVEMVKKQVKVVTLAIGDGANDVSMIQTAHVGVGISGNEGLQAANSSDYSIAQFKYLKNLLMIHGAWNYNRVSKCILYCFYKNIVLYIIENTDIQANNNLYSLFT

SEQ ID NO: 748505 - protein, 548 aa, Homo sapiens
MRRTVSEIRSRAEGYEKTDDVSEKTSLADQEEVRTIFINQPQLTKFCNNHVSTAKYNIITFLPRFLYSQFRRAANSFFLFIALLQQIPDVSPTGRYTTLVPLLFILAVAAIKEIIEDIKRHKADNAVNKKQTQVLRNGAWEIVHWEKVAVGEIVKVTNGEHLPADLISLSSSEPQAMCYIETSNLDGETNLKIRQGLPATSDIKDVDSLMRISGRIECESPNRHLYDFVGNIRLDGHGTVPLGADQILLRGAQLRNTQWVHGIVVYTGHDTKLMQNSTSPPLKLSNVERITNVQILILFCILIAMSLVCSVGSAIWNRRHSGKDWYLNLNYGGASNFGLNFLTFIILFNNLIPISLLVTLEVVKFTQAYFINWDLDMHYEPTDTAAMARTSNLNEELGQVKYIFSDKTGTLTCNVMQFKKCTIAGVAYGHVPEPEDYGCSPDEWQNSQFGDEKTFSDSSLLENLQNNHPTAPIICEFLTMMAVCHTAVPEREGDKIIYQAASPDEGALVRAAKQLNFVFTGRTPDSVIIDSLGQEERYELLNVLEFTR

SEQ ID NO: 748506 - protein, 186 aa, Homo sapiens
MAGLGLGSAVPVWLAEDDLGCIICQGLLDWPATLPCGHSFCRHCLEALWGARDARRWACPTCRQGAAQQPHLRKNTLLQDLADKYRRAAREIQAGSDPAHCPCPGSSSLSSAAARPRRRPELQRVAVEKSITEVAQELTELVEHLVDIVRSLQNQRPLSESGPDNELSILGKRTPGSPVFLLMPIA

SEQ ID NO: 748507 - protein, 432 aa, Homo sapiens
MAGLGLGSAVPVWLAEDDLGCIICQGLLDWPATLPCGHSFCRHCLEALWGARDARRWACPTCRQGAAQQPHLRKNTLLQDLADKYRRAAREIQAGSDPAHCPCPGSSSLSSAAARPRRRPELQRVAVEKSITEVAQELTELVEHLVDIVRSLQNQRPLSESGPDNELSILGKAFSSGVDLSMASPKLVTSDTAAGKIRDILHDLEEIQEKLQESVTWKEAPEAQMQGELLEAPSSSSCPLPDQSHPALRRASRFAQWAIHPTFNLKSLSCSLEVSKDSRTVTVSHRPQPYRWSCERFSTSQVLCSQALSSGKHYWEVDTRNCSHWAVGVASWEMSRDQVLGRTMDSCCVEWKGTSQLSAWHMVKETVLGSDRPGVVGIWLNLEEGKLAFYSVDNQEKLLYECTISASSPLYPAFWLYGLHPGNYLIIKQVKV

SEQ ID NO: 748508 - protein, 164 aa, Homo sapiens
MAGLGLGSAVPVWLAEDDLGCIICQGLLDWPATLPCGHSFCRHCLEALWGARDARRWACPTCRQGAAQQPHLRKNTLLQDLADKYRRAAREIQAGSDPAHCPCPGSSSLSSAAARPRRRPELQRVGRPGPQLPWLPRAARRLTLSHVARTPFLSRSTFTFLFSV

SEQ ID NO: 748509 - protein, 555 aa, Homo sapiens
MAGSGLDLIGRGPTSAPRPPVGHGGPGPGLRRSRVAGRGRPRLHHLPGAAGLARHAALRPQLLPPLPGGPVGRPRRPPLGLPHLPPGRRAAAAPAEEHATAGPGRQVPPRRTRDTGGLRPCPLPLPGLQFPLQRGREAPAPPGTAAGREAGPAAPLAPPGCPPPDPFPCGSNPFPQPFYFYVPFLSLKVEFRSSEALWKVHKKYEEVEKNKFPIFRKLVNLAVTQLGIFQLLPNRSSVSFSETCKIVVAVEKSITEVAQELTELVEHLVDIVRSLQNQRPLSESGPDNELSILGKAFSSGVDLSMASPKLVTSDTAAGKIRDILHDLEEIQEKLQESVTWKEAPEAQMQGELLEAPSSSSCPLPDQSHPALRRASRFAQWAIHPTFNLKSLSCSLEVSKDSRTVTVSHRPQPYRWSCERFSTSQVLCSQALSSGKHYWEVDTRNCSHWAVGVASWEMSRDQVLGRTMDSCCVEWKGTSQLSAWHMVKETVLGSDRPGVVGIWLNLEEGKLAFYSVDNQEKLLYECTISASSPLYPAFWLYGLHPGNYLIIKQVKV

SEQ ID NO: 748510 - protein, 138 aa, Homo sapiens
MAGLGLGSAVPVWLAEDDLGCIICQGLLDWPATLPCGHSFCRHCLEALWGARDARRWACPTCRQGAAQQPHLRKNTLLQDLADKYRRAAREIQAGSDPAHCPCPGSSSLSSAAARPRRRPELQRRTPGSPVFLLMPIA

SEQ ID NO: 748511 - protein, 432 aa, Homo sapiens; identical to SEQ ID NO: 748507

SEQ ID NO: 748512 - protein, 251 aa, Homo sapiens
MASPKLVTSDTAAGKIRDILHDLEEIQEKLQESVTWKEAPEAQMQGELLEAPSSSSCPLPDQSHPALRRASRFAQWAIHPTFNLKSLSCSLEVSKDSRTVTVSHRPQPYRWSCERFSTSQVLCSQALSSGKHYWEVDTRNCSHWAVGVASWEMSRDQVLGRTMDSCCVEWKGTSQLSAWHMVKETVLGSDRPGVVGIWLNLEEGKLAFYSVDNQEKLLYECTISASSPLYPAFWLYGLHPGNYLIIKQVKV

SEQ ID NO: 748513 - protein, 217 aa, Homo sapiens
LSISAVAPTTANCLFPNLLRYFCICAVATNYSQLPLPKPAQWAIHPTFNLKSLSCSLEVSKDSRTVTVSHRPQPYRWSCERFSTSQVLCSQALSSGKHYWEVDTRNCSHWAVGVASWEMSRDQVLGRTMDSCCVEWKGTSQLSAWHMVKETVLGSDRPGVVGIWLNLEEGKLAFYSVDNQEKLLYECTISASSPLYPAFWLYGLHPGNYLIIKQVKV

SEQ ID NO: 748514 - protein, 164 aa, Homo sapiens; identical to SEQ ID NO: 748508

SEQ ID NO: 748515 - protein, 350 aa, Homo sapiens
MLEGAELYFNVDHGYLEGLVRGCKASLLTQQDYINLVQCETLEDLKIHLQTTDYGNFLANHTNPLTVSKIDTEMRKRLCGEFEYFRNHSLEPLSTFLTYMTCSYMIDNVILLMNGALQKKSVKEILGKCHPLGRFTEMEAVNIAETPSDLFNAILIETPLAPFFQDCMSENALDELNIELLRNKLYKSYLEAFYKFCKNHGDVTAEVMCPILEFEADRRAFIITLNSFGTELSKEDRETLYPTFGKLYPEGLRLLAQAEDFDQMKNVADHYGVYKPLFEAVGGSGGKTLEDVFYEREVQMNVLAFNRQFHYGVFYAYVKLKEQEIRNIVWIAECISQRHRTKINSYIPIL

SEQ ID NO: 748516 - protein, 350 aa, Homo sapiens; identical to SEQ ID NO: 748515

SEQ ID NO: 748517 - protein, 160 aa, Homo sapiens
MAKMEVKTSLLDNMIGVGDMVLLEPLNEETFINNLKKRFDHSEIYTYIGSVVISVNPYRSLPIYSPEKVEEYRNRNFYELSPHIFALSDEAYRSLRDQDKDQCILITGESGAGKTEASKLVMSYVAAVCGKGAEVNQVKEQLLQSNPVLEAFGNAKTVRE

SEQ ID NO: 748518 - protein, 160 aa, Homo sapiens; identical to SEQ ID NO: 748517

SEQ ID NO: 748519 - protein, 218 aa, Homo sapiens
QSARRAVGRQPRDSLGRTAAAGAPQPRAGPASRSATGERGRRGGGVAPGEVAPGELETMAKMEVKTSLLDNMIGVGDMVLLEPLNEETFINNLKKRFDHSEIYTYIGSVVISVNPYRSLPIYSPEKVEEYRNRNFYELSPHIFALSDEAYRSLRDQDKDQCILITGESGAGKTEASKLVMSYVAAVCGKGAEVNQVKEQLLQSNPVLEAFGNAKTVRE

SEQ ID NO: 748520 - protein, 160 aa, Homo sapiens; identical to SEQ ID NO: 748517

SEQ ID NO: 748521 - protein, 102 aa, Homo sapiens
TSTRHLRSDCHRRLELLNIVEGIYQLKKACRRELQTEQGQLLTPEEVVDRIFLLVDENGDGQLSLNEFVEGARRDKWVMKMLQMDMNPSSWLAQQRRKSAMF

SEQ ID NO: 748522 - protein, 51 aa, Homo sapiens
MTTSPPPCSGQLSLNEFVEGARRDKWVMKMLQMDMNPSSWLAQQRRKSAMF

SEQ ID NO: 748523 - protein, 75 aa, Homo sapiens
ILSLCRNISNFFTITIEPVFTYHSENPRALKDCAKSTLGVPYKCNSKAWMIVQLFTTWFTEYFKPTIETNSSEKK

SEQ ID NO: 748524 - protein, 520 aa, Homo sapiens
GTQSLLLCSSLGRGSQSFRLLCAEGVELRGLVASQFLFCEQPRSRAPPQPPVPPRSPSPPLPSPSLLMQGAQEASASEMLPLLLPLLWAGALAQERRFQLEGPESLTVQEGLCVLVPCRLPTTLPASYYGYGYWFLEGADVPVATNDPDEEVQEETRGRFHLLWDPRRKNCSLSIRDARRRDNAAYFFRLKSKWMKYGYTSSKLSVRVMALTHRPNISIPGTLESGHPSNLTCSVPWVCEQGTPPIFSWMSAAPTSLGPRTTQSSVLTITPRPQDHSTNLTCQVTFPGAGVTMERTIQLNVSYAPQKVAISIFQGNSAAFKILQNTSSLPVLEGQALRLLCDADGNPPAHLSWFQGFPALNATPISNTGVLELPQVGSAEEGDFTCRAQHPLGSLQISLSLFVHWKPEGRAGGVLGAVWGASITTLVFLCVCFIFRVKTRRKKAAQPVQNTDDVNPVMVSGSRGHQHQFQTGIVSDHPAEAGPISEDEQELHYAVLHFHKVQPQEPKVTDTEYSEIKIHK

SEQ ID NO: 748525 - protein, 520 aa, Homo sapiens; identical to SEQ ID NO: 748524

SEQ ID NO: 748526 - protein, 420 aa, Homo sapiens
GTQSLLLCSSLGRGSQSFRLLCAEGVELRGLVASQFLFCEQPRSRAPPQPPVPPRSPSPPLPSPSLLMQGAQEASASEMLPLLLPLLWAGALAQERRFQLEGPESLTVQEGLCVLVPCRLPTTLPASYYGYGYWFLEGADVPVATNDPDEEVQEETRGRFHLLWDPRRKNCSLSIRDARRRDNAAYFFRLKSKWMKYGYTSSKLSVRVMALTHRPNISIPGTLESGHPSNLTCSVPWVCEQGTPPIFSWMSAAPTSLGPRTTQSSVLTITPRPQDHSTNLTCQVTFPGAGVTMERTIQLNVSYAPQKVAISIFQGNSAAFKILQNTSSLPVLEGQALRLLCDADGNPPAHLSWFQGFPALNATPISNTGVLELPQVGSAEEGDFTCRAQHPLGSLQISLSLFVHWSSAPVPDRHSFRPPC

SEQ ID NO: 748527 - protein, 368 aa, Homo sapiens
GTQSLLLCSSLGRGSQSFRLLCAEGVELRGLVASQFLFCEQPRSRAPPQPPVPPRSPSPPLPSPSLLMQGAQEASASEMLPLLLPLLWAASYYGYGYWFLEGADVPVATNDPDEEVQEETRGRFHLLWDPRRKNCSLSIRDARRRDNAAYFFRLKSKWMKYGYTSSKLSVRVMALTHRPNISIPGTLESGHPSNLTCSVPWVCEQGTPPIFSWMSAAPTSLGPRTTQSSVLTITPRPQDHSTNLTCQVTFPGAGVTMERTIQLNVSSFKILQNTSSLPVLEGQALRLLCDADGNPPAHLSWFQGFPALNATPISNTGVLELPQVGSAEEGDFTCRAQHPLGSLQISLSLFVHWSSAPVPDRHSFRPPC

SEQ ID NO: 748528 - protein, 409 aa, Homo sapiens
GTQSLLLCSSLGRGSQSFRLLCAEGVELRGLVASQFLFCEQPRSRAPPQPPVPPRSPSPPLPSPSLLMQGAQEASASEMLPLLLPLLWAGALAQERRFQLEGPESLTVQEGLCVLVPCRLPTTLPASYYGYGYWFLEGADVPVATNDPDEEVQEETRGRFHLLWDPRRKNCSLSIRDARRRDNAAYFFRLKSKWMKYGYTSSKLSVRVMGTLESGHPSNLTCSVPWVCEQGTPPIFSWMSAAPTSLGPRTTQSSVLTITPRPQDHSTNLTCQVTFPGAGVTMERTIQLNVSYAPQKVAISIFQGNSAAFKILQNTSSLPVLEGQALRLLCDADGNPPAHLSWFQGFPALNATPISNTGVLELPQVGSAEEGDFTCRAQHPLGSLQISLSLFVHWSSAPVPDRHSFRPPC

SEQ ID NO: 748529 - protein, 133 aa, Homo sapiens
SPPLPSPLQISLSLFVHWKPEGRAGGVLGAVWGASITTLVFLCVCFIFRVKTRRKKAAQPVQNTDDVNPVMVSGSRGHQHQFQTGIVSDHPAEAGPISEDEQELHYAVLHFHKVQPQEPKVTDTEYSEIKIHK

SEQ ID NO: 748530 - protein, 120 aa, Homo sapiens
TDESVDPISPCAGPRGPWHSWFETRVSFRPLGVPKSGQKAHEGKVTHLGQREKKTTTVPRISGAWVPHRRNCLPISTCTAPRGHWYPWLEPSMLLGLLGVPQDRQKAHEGKVRHLGQRRK

SEQ ID NO: 748531 - protein, 103 aa, Homo sapiens
FDGDSLPQVSFRPLGVPKSGQKAHEGKVTHLGQREKKTTTVPRISGAWVPHRRNCLPISTCTAPRGHWYPWLEPSMLLGLLGVPQDRQKAHEGKVRHLGQRRK

SEQ ID NO: 748532 - protein, 102 aa, Homo sapiens
MFNTSCSILGFSPGASPESLCVRASQGCFCEGGNPNSKASRKSTLCASQITPASWPSDSALLGVSLMERHSNGWRPTHSFCLFVLCFEMESSSVARLECSGA

SEQ ID NO: 748533 - protein, 116 aa, Homo sapiens
DHHASFPRTEGYPYVGLLVPKAGKSGANQDKLVTLPMTIIQVNEHCALRVHLRLNPLGSSNYFSTFCSLSYFETFFPLIVYSPVECFFERESHSVAQAGVQWCDLCSLWPLPPGFK

SEQ ID NO: 748534 - protein, 581 aa, Homo sapiens
MLENYSNLVSVGYQASKPDALFKLEQGEPWTVENEIHSQICPEIKKVDNHLQMHSQKQRCLKRVEQCHKHNAFGNIIHQRKSDFPLRQNHDTFDLHGKILKSNLSLVNQNKRYEIKNSVGVNGDGKSFLHAKHEQFHNEMNFPEGGNSVNTNSQFIKHQRTQNIDKPHVCTECGKAFLKKSRLIYHQRVHTGEKPHGCSICGKAFSRKSGLTEHQRNHTGEKPYECTECDKAFRWKSQLNAHQKIHTGEKSYICSDCGKGFIKKSRLINHQRVHTGEKPHGCSLCGKAFSKRSRLTEHQRTHTGEKPYECTECDKAFRWKSQLNAHQKAHTGEKSYICRDCGKGFIQKGNLIVHQRIHTGEKPYICNECGKGFIQKGNLLIHRRTHTGEKPYVCNECGKGFSQKTCLISHQRFHTGKTPFVCTECGKSCSHKSGLINHQRIHTGEKPYTCSDCGKAFRDKSCLNRHRRTHTGERPYGCSDCGKAFSHLSCLVYHKGMLHAREKCVGSVKLENPCSESHSLSHTRDLIQDKDSVNMVTLQMPSVAAQTSLTNSAFQAESKVAIVSQPVARSSVSADSRICTE

SEQ ID NO: 748535 - protein, 109 aa, Homo sapiens [sequence omitted]

SEQ ID NO: 748536 - protein, 1017 aa, Homo sapiens
MTSRRLEESMGAVQMGLVNMFKGFQSKVLPPLSPKVVTEEEVNRMLTPSEFLKEMSLTTEQRLAKTRLMCRPQIIELLDMGETTHQKFSGIDLDQALFQPFPSEIIFQNYTPCEVYEVPLILRNNDKIPRLVKVVEESSPYFKVISPKDIGHKVAPGVPSIFRILFTPEENKDYAHTLTCVTEREKFIVPIKARGARAILDFPDKLNFSTCPVKYSTQKILLVRNIGNKNAVFHIKTCRPFSIEPAIGTLNVGESMQLEVEFEPQSVGDHSGRLIVCYDTGEKVFVSLYGAAIDMNIRLDKNSLTIEKTYISLANQRTITIHNRSNIIAHFLWKVFATQQEEDREKYRACDDLIKEEKDETDEFFEECITDPLLREHLSVLSRTFANQRRLVQGDSKLFFNNVFTVEPLEGDVWPNSSAEITVYFNPLEAKLYQQTIYCDILGREIRLPLRIKGEGMGPTIHFNFELLDIGKVFTGSAHCYEAILYNKGSIDALFNMTPPTSALGACFVFSPKEGIIEPSGVQAIQISFSSTILGNFEEEFLVNVNGSPEPVKLTIRGCVIGPTFHFNVPALHFGDVSFGFPHTLICSLNNTSLIPMTYKLRIPGDGLGHKSISYCEQHVDYKRPSWTKEEISSMKPKEFTISPDCGTIRPQGFAAIRVTLCSNTVQKYELALVVDVEGIGEEVLALLITARCVVPALHLVNTEVDFGHCFLKYPYEKTLQLANQDDLPGFYEVQPQVCEEVPTVLFSSPTPSGVISPSSTIHIPLVLETQVTGEHRSTVYISIFGSQDPPLVCHLKSAGEGPVIYVHPNQVDFGNIYVLKDSSRILNLCNQSFIPAFFQAHMAHKKSLWTIEPNEGMVPPETDVQLALTANLNDTLTFKDCVILDIENSSTYRIPVQASGTGSTIVSDKPFAPELNLGAHFSLDTHYYHFKLINKGRRIQQLFWMNDSFRPQAKLSKKGRVKKGHAHVQPQPSGSQEPRDPQSPVFHLHPASMELYPGQAIDVILEGYSATPRVRG

SEQ ID NO: 748537 - protein, 121 aa, Homo sapiens
QIVKEKLVCHAIIGAQKGKSLVMAVNITCEFVAPLIQLSTKQLIYRLEKKPNSILKPDYQPLAVKNISTLPVNLLLSTSGPFFICETDKSLLPATPEPIKLEIDEEKNLLIKFDPSYRNDL

SEQ ID NO: 748538 - protein, 1017 aa, Homo sapiens; identical to SEQ ID NO: 748536

SEQ ID NO: 748539 - protein, 1059 aa, Homo sapiens
MTSRRLEESMGAVQMGLVNMFKGFQSKVLPPLSPKVVTEEEVNRMLTPSEFLKEMSLTTEQRLAKTRLMCRPQIIELLDMGETTHQKFSGIDLDQALFQPFPSEIIFQNYTPCEVYEVPLILRNNDKLRRLKFRPDQGHTSSEVVDGFQSVFNSAFSHARCSSSCVSLQIPRLVKVVEESSPYFKVISPKDIGHKVAPGVPSIFRILFTPEENKDYAHTLTCVTEREKFIVPIKARGARAILDFPDKLNFSTCPVKYSTQKILLVRNIGNKNAVFHIKTCRPFSIEPAIGTLNVGESMQLEVEFEPQSVGDHSGRLIVCYDTGEKVFVSLYGAAIDMNIRLDKNSLTIEKTYISLANQRTITIHNRSNIIAHFLWKVFATQQEEDREKYRACDDLIKEEKDETDEFFEECITDPLLREHLSVLSRTFANQRRLVQGDSKLFFNNVFTVEPLEGDVWPNSSAEITVYFNPLEAKLYQQTIYCDILGREIRLPLRIKGEGMGPTIHFNFELLDIGKVFTGSAHCYEAILYNKGSIDALFNMTPPTSALGACFVFSPKEGIIEPSGVQAIQISFSSTILGNFEEEFLVNVNGSPEPVKLTIRGCVIGPTFHFNVPALHFGDVSFGFPHTLICSLNNTSLIPMTYKLRIPGDGLGHKSISYCEQHVDYKRPSWTKEEISSMKPKEFTISPDCGTIRPQGFAAIRVTLCSNTVQKYELALVVDVEGIGEEVLALLITARCVVPALHLVNTEVDFGHCFLKYPYEKTLQLANQDDLPGFYEVQPQVCEEVPTVLFSSPTPSGVISPSSTIHIPLVLETQVTGEHRSTVYISIFGSQDPPLVCHLKSAGEGPVIYVHPNQVDFGNIYVLKDSSRILNLCNQSFIPAFFQAHMAHKKSLWTIEPNEGMVPPETDVQLALTANLNDTLTFKDCVILDIENSSTYRIPVQASGTGSTIVSDKPFAPELNLGAHFSLDTHYYHFKLINKGRRIQQLFWMNDSFRPQAKLSKKGRVKKGHAHVQPQPSGSQEPRDPQSPVFHLHPASMELYPGQAIDVILEGYSATPRVRG

SEQ ID NO: 748540 - protein, 951 aa, Homo sapiens
MTSRRLEESMGAVQMGLVNMFKGFQSKVLPPLSPKVVTEEEVNRMLTPSEFLKEMSLTTEQRLAKTRLMCRPQIIELLDMGETTHQKFSGIDLDQALFQPFPSEIIFQNYTPCEVYEVPLILRNNDKIPRLVKVVEESSPYFKVISPKDIGHKVAPGVPSIFRILFTPEENKGPFSIEPAIGTLNVGESMQLEVEFEPQSVGDHSGRLIVCYDTGEKVFVSLYGAAIDMNIRLDKNSLTIEKTYISLANQRTITIHNRSNIIAHFLWKVFATQQEEDREKYRACDDLIKEEKDETDEFFEECITDPLLREHLSVLSRTFANQRRLVQGDSKLFFNNVFTVEPLEGDVWPNSSAEITVYFNPLEAKLYQQTIYCDILGREIRLPLRIKGEGMGPTIHFNFELLDIGKVFTGSAHCYEAILYNKGSIDALFNMTPPTSALGACFVFSPKEGIIEPSGVQAIQISFSSTILGNFEEEFLVNVNGSPEPVKLTIRGCVIGPTFHFNVPALHFGDVSFGFPHTLICSLNNTSLIPMTYKLRIPGDGLGHKSISYCEQHVDYKRPSWTKEEISSMKPKEFTISPDCGTIRPQGFAAIRVTLCSNTVQKYELALVVDVEGIGEEVLALLITARCVVPALHLVNTEVDFGHCFLKYPYEKTLQLANQDDLPGFYEVQPQVCEEVPTVLFSSPTPSGVISPSSTIHIPLVLETQVTGEHRSTVYISIFGSQDPPLVCHLKSAGEGPVIYVHPNQVDFGNIYVLKDSSRILNLCNQSFIPAFFQAHMAHKKSLWTIEPNEGMVPPETDVQLALTANLNDTLTFKDCVILDIENSSTYRIPVQASGTGSTIVSDKPFAPELNLGAHFSLDTHYYHFKLINKGRRIQQLFWMNDSFRPQAKLSKKGRVKKGHAHVQPQPSGSQEPRDPQSPVFHLHPASMELYPGQAIDVILEGYSATPRVRG

SEQ ID NO: 748541 - protein, 332 aa, Homo sapiens
MRLIFNKCVVPALHLVNTEVDFGHCFLKYPYEKTLQLANQDDLPGFYEVQPQVCEEVPTVLFSSPTPSGVISPSSTIHIPLVLETQVTGEHRSTVYISIFGSQDPPLVCHLKSAGEGPVIYVHPNQVDFGNIYVLKDSSRILNLCNQSFIPAFFQAHMAHKKSLWTIEPNEGMVPPETDVQLALTANLNDTLTFKDCVILDIENSSTYRIPVQASGTGSTIVSDKPFAPELNLGAHFSLDTHYYHFKLINKGRRIQQLFWMNDSFRPQAKLSKKGRVKKGHAHVQPQPSGSQEPRDPQSPVFHLHPASMELYPGQAIDVILEGYSATPRVRG

SEQ ID NO: 748542 - protein, 365 aa, Homo sapiens
MTSRRLEESMGAVQMGLVNMFKGFQSKVLPPLSPKVVTEEEVNRMLTPSEFLKEMSLTTEQRLAKTRLMCRPQIIELLDMGETTHQKFSGIDLDQALFQPFPSEIIFQNYTPCEVYEVPLILRNNDKIPRLVKVVEESSPYFKVISPKDIGHKVAPGVPSIFRILFTPEENKDYAHTLTCVTEREKFIVPIKARGARAILDFPDKLNFSTCPVKYSTQKILLVRNIGNKNAVFHIKTCRPFSIEPAIGTLNVGESMQLEVEFEPQSVGDHSGRLIVCYDTGEKVFVSLYGAAIDMNIRLDKNSLTIEKTYISLANQRTITIHNRSNIIAHFLWKVFATQQEEDREKYRWMAPFVPGQVWTWEYFL

SEQ ID NO: 748543 - protein, 708 aa, Homo sapiens
MTSRRLEESMGAVQMGLVNMFKGFQSKVLPPLSPKVVTEEEVNRMLTPSEFLKEMSLTTEQRLAKTRLMCRPQIIELLDMGETTHQKFSGIDLDQALFQPFPSEIIFQNYTPCEVYEVPLILRNNDKIPRLVKVVEESSPYFKVISPKDIGHKVAPGVPSIFRILFTPEENKDYAHTLTCVTEREKFIVPIKARGARAILDFPDKLNFSTCPVKYSTQKILLVRNIGNKNAVFHIKTCRPFSIEPAIGTLNVGESMQLEVEFEPQSVGDHSGRLIVCYDTGEKVFVSLYGAAIDMNIRLDKNSLTIEKTYISLANQRTITIHNRSNIIAHFLWKVFATQQEEDREKYRACDDLIKEEKDETDEFFEECITDPLLREHLSVLSRTFANQRRLVQGDSKLFFNNVFTVEPLEGDVWPNSSAEITVYFNPLEAKLYQQTIYCDILGREIRLPLRIKGEGMGPTIHFNFELLDIGKVFTGSAHCYEAILYNKGSIDALFNMTPPTSALGACFVFSPKEGIIEPSGVQAIQISFSSTILGNFEEEFLVNVNGSPEPVKLTIRGCVIGPTFHFNVPALHFGDVSFGFPHTLICSLNNTSLIPMTYKLRIPGDGLGHKSISYCEQHVDYKRPSWTKEEISSMKPKEFTISPDCGTIRPQGFAAIRVTLCSNTVQKYELALVVDVEGIGEEVLALLITARYCSPACSSPESPPSLQ

SEQ ID NO: 748544 - protein, 70 aa, Homo sapiens
STLPALFAPMGYRCEVTSMSLARILSLLAASGPTWDQVPPFQWSTSPFSGLLHMGQPDLWKFAPVKVSWD

SEQ ID NO: 748545 - protein, 171 aa, Homo sapiens
MSGRGSAPMLLPQAPPHPTPGLPLTSGPYPQRPDGGTRPQAVPPLNKSGCGPMLCFLGWQGRWGQRFFSSQVWVLRHPPCSLLCSPLSVLLSIHSSANILTHHPSAQPSTHPSVFHHPSIHLPIHLSSIHSPIQPPIQPFSHLHLSIFFLLLFFLFLFFLSGSFTPAWERE

SEQ ID NO: 748546 - protein, 495 aa, Homo sapiens
RADGVPGALRSSGRPRPRRPAQYPARPRRPASTAGSAPFPEGWMMGCFALQTVDTELTADSVEWCPLQGCRHLLACGTYQLRRPEDRPAGPQNKGGMEVKEPQVRLGRLFLYSFNDNNSIHPLVEVQRKDTSAILDMKWCHIPVAGHALLGLADASGSIQLLRLVESEKSHVLEPLSSLALEEQCLALSLDWSTGKTGRAGDQPLKIISSDSTGQLHLLMVNETRPRLQKVASWQAHQFEAWIAAFNYWHPEIVYSGGDDGLLRGWDTRVPGKFLFTSKRHTMGVCSIQSSPHREHILATGSYDEHILLWDTRNMKQPLADTPVQGGVWRIKWHPFHHHLLLAACMHSGFKILNCQKAMEERQEATVLTSHTLPDSLVYGADWSWLLFRSLQRAPSWSFPSNLGTKTADLKGASELPTPCHECREDNDGEGHARPQSGMKPLTEGMRKNGTWLQATAATTRDCGVNPEEADSAFSLLATCSFYDHALHLWEWEGN

SEQ ID NO: 748547 - protein, 107 aa, Homo sapiens
RADGVPGALRSSGRPRPRRPAQYPARPRRPASTAGSAPFPEGWMMGCFALQTVDTELTADSVEWCPLQGCRHLLACGTYQLRRPEDRPAGPQNKIYNHFLLCHTCLQ

SEQ ID NO: 748548 - protein, 366 aa, Homo sapiens
RADGVPGALRSSGRPRPRRPAQYPARPRRPASTAGSAPFPEGWMMGCFALQTVDTELTADSVEWCPLQGCRHLLACGTYQLRRPEDRPAGPQNKGGMEVKEPQVRLGRLFLYSFNDNNSIHPLVEVQRKDTSAILDMKWCHIPVAGHALLGLADASGSIQLLRLVESEKSHVLEPLSSLALEEQCLALSLDWSTGKTGRAGDQPLKIISSDSTGQLHLLMVNETRPRLQKVASWQAHQFEAWIAAFNYWHPEIVYSGGDDGLLRGWDTRVPGKFLFTSKRHTMGVCSIQSSPHREHILATGSYDEHILLWDTRNMKQPLADTPVQGGVWRIKWHPFHHHLLLAACMHSGFKILNCQKAMGCGSLRA

SEQ ID NO: 748549 - protein, 138 aa, Homo sapiens
RADGVPGALRSSGRPRPRRPAQYPARPRRPASTAGSAPFPEGWMMGCFALQTVDTELTADSVEWCPLQGCRHLLACGTYQLRRPEDRPAGPQNKGGMEVKEPQVRLGRLFLYSFNDNNSIHPLVEVQRKDTSAILDMK

SEQ ID NO: 748550 - protein, 138 aa, Homo sapiens; identical to SEQ ID NO: 748549

SEQ ID NO: 748551 - protein, 276 aa, Homo sapiens
MVNETRPRLQKVASWQAHQFEAWIAAFNYWHPEIVYSGGDDGLLRGWDTRVPGKFLFTSKRHTMGVCSIQSSPHREHILATGSYDEHILLWDTRNMKQPLADTPVQGGVWRIKWHPFHHHLLLAACMHSGFKILNCQKAMEERQEATVLTSHTLPDSLVYGADWSWLLFRSLQRAPSWSFPSNLGTKTADLKGASELPTPCHECREDNDGEGHARPQSGMKPLTEGMRKNGTWLQATAATTRDCGVNPEEADSAFSLLATCSFYDHALHLWEWEGN

SEQ ID NO: 748552 - protein, 276 aa, Homo sapiens; identical to SEQ ID NO: 748551

SEQ ID NO: 748553 - protein, 122 aa, Homo sapiens
RADGVPGALRSSGRPRPRRPAQYPARPRRPASTAGSAPFPEGWMMGCFALQTVDTELTADSVEWCPLQGCRHLLACGTYQLRRPEDRPAGPQNKVSHPGGWTCPLGLGRCQWIHTTAPPGGI

SEQ ID NO: 748554 - protein, 172 aa, Homo sapiens
MAERIDYAGQELETKCSVTNSGPLFSIMEQRPRLQKVASWQAHQFEAWIAAFNYWHPEIVYSGGDDGLLRGWDTRVPGKFLFTSKRHTMGVCSIQSSPHREHILATGSYDEHILLWDTRNMKQPLADTPVQGGVWRIKWHPFHHHLLLAACMHSGFKILNCQKAMGCGSLRA

SEQ ID NO: 748555 - protein, 158 aa, Homo sapiens
MLLEGPLWLSLNIQHLTPPRSHLCPVEALGPGLGLPGPGPYNLGTFCNPVRSCSALSPSSISTHSGSDSGHCWHQSLYFRGSDGSPFRAQVATQPCSPWLTFHLLSATAPASPGLASWTPDRLGFGHASSFPLLLCALGGSCGLFPVAVATSIKKLLT

SEQ ID NO: 748556 - protein, 235 aa, Homo sapiens
HRQSPRGASSQTVTQGSFLTDRVIQGSFLTDRVTQGSFLTDRVTQGSFLTDSHPGELPHRQSPRGASSQTESPRGASSQTVTPGSFLTDINGLTENTHFLSLVVLMLLFLHTGGDDGLLRGWDTRVPGKFLFTSKRHTMGVCSIQSSPHREHILATGSYDEHILLWDTRNMKQPLADTPVQGGVWRIKWHPFHHHLLLAACMHSGFKILNCQKAMAVEEVLLARVDVLSDCWMKD

SEQ ID NO: 748557 - protein, 495 aa, Homo sapiens; identical to SEQ ID NO: 748546

SEQ ID NO: 748558 - protein, 495 aa, Homo sapiens; identical to SEQ ID NO: 748546

SEQ ID NO: 748559 - protein, 88 aa, Homo sapiens
ARYPGYTSDSGNVGDVREDNDGEGHARPQSGMKPLTEGMRKNGTWLQATAATTRDCGVNPEEADSAFSLLATCSFYDHALHLWEWEGN

SEQ ID NO: 748560 - protein, 495 aa, Homo sapiens; identical to SEQ ID NO: 748546

SEQ ID NO: 748561 - protein, 366 aa, Homo sapiens; identical to SEQ ID NO: 748548

SEQ ID NO: 748562 - protein, 360 aa, Homo sapiens
RADGVPGALRSSGRPRPRRPAQYPARPRRPASTAGSAPFPEGWMMGCFALQTVDTELTADSVEWCPLQGCRHLLACGTYQLRRPEDRPAGPQNKGGMEVKEPQVRLGRLFLYSFNDNNSIHPLVEVQRKDTSAILDMKWCHIPVAGHALLGLADASGSIQLLRLVESEKSHVLEPLSSLALEEQCLALSLDWSTGKTGRAGDQPLKIISSDSTGQLHLLMVNETRPRLQKVASWQAHQFEAWIAAFNYWHPEIVYSGGDDGLLRGWDTRVPGKFLFTSKRHTMGVCSIQSSPHREHILATGSYDEHILLWDTRNMKQPLADTPVQGGVWRIKWHPFHHHLLLATCSFYDHALHLWEWEGN

SEQ ID NO: 748563 - protein, 371 aa, Homo sapiens
RADGVPGALRSSGRPRPRRPAQYPARPRRPASTAGSAPFPEGWMMGCFALQTVDTELTADSVEWCPLQGCRHLLACGTYQLRRPEDRPAGPQNKGGMEVKEPQVRLGRLFLYSFNDNNSIHPLVEVQRKDTSAILDMKWCHIPVAGHALLGLADASGSIQLLRLVESEKSHVLEPLSSLALEEQCLALSLDWSTGKTGRAGDQPLKIISSDSTGQLHLLMVNETRPRLQKVASWQAHQFEAWIAAFNYWHPEIVYSGGDDGLLRGWDTRVPGKFLFTSKRHTMGVCSIQSSPHREHILATGSYDEHILLWDTRNMKQPLADTPVQGGVWRIKWHPFHHHLLLAACMHSGFKILNCQKAMGEWGPVAAGPQG

SEQ ID NO: 748564 - protein, 309 aa, Homo sapiens
RADGVPGALRSSGRPRPRRPAQYPARPRRPASTAGSAPFPEGWMMGCFALQTVDTELTADSVEWCPLQGCRHLLACGTYQLRRPEDRPAGPQNKGGMEVKEPQVRLGRLFLYSFNDNNSIHPLVEVQRKDTSAILDMKWCHIPVAGHALLGLADASGSIQLLRLVESEKSHVLEPLSSLALEEQCLALSLDWSTGKTGRAGDQPLKIISSDSTGQLHLLMVNETRPRLQKVASWQAHQFEAWIAAFNYWHPEIVYSGGDDGLLRGWDTRVPGKFLFTSKRHTMACVSIARAATCMREHTPRTSRRYSTD

SEQ ID NO: 748565 - protein, 138 aa, Homo sapiens; identical to SEQ ID NO: 748549

SEQ ID NO: 748566 - protein, 138 aa, Homo sapiens; identical to SEQ ID NO: 748549

SEQ ID NO: 748567 - protein, 138 aa, Homo sapiens; identical to SEQ ID NO: 748549

SEQ ID NO: 748568 - protein, 104 aa, Homo sapiens
VCWTLVQKPPLLADTPWVCAASRAALIGSTSWPREGESPGGSRALLVSFAVPGGLLGPSSLFRCLSSWHHCSISSASASPECRYMGLVKGTLSSRDAWDRSLGD

SEQ ID NO: 748569 - protein, 1301 aa, Homo sapiens
MVNPEMYKLLNGELKQLYTAITRARVNLWIFDENREKRAPAFKYFIRRDFVQVVKTDENKDFDDSMFVKTSTPAEWIAQGDYYAKHQCWKVAAKCYQKGGAFEKEKLALAHDTALSMKSKKVSPKEKQLEYLELAKTYLECKEPTLSLKCLSYAKEFQLSAQLCERLGKIRDAAYFYKRSQCYKDAFRCFEQIQEFDLALKMYCQEELFEEAAIAVEKYEEMLKTKTLPISKLSYSASQFYLEAAAKYLSANKMKEMMAVLSKLDIEDQLVFLKSRKRLAEAADLLNREGRREEAALLMKQHGCLLEAARLTADKDFQASCLLGAARLNVARDSDIEHTKDILREALDICYQTGQLSGIAEAHFLQGVILRDFQKLRDAFFKFDTLNHSAGVVEALYEAASQCEAEPEKILGLAPGGLEILLSLVRALKRVTNNAEKEMVKSCFEFFGISQVDAKYCQIAQNDPGPILRIIFDLDLNLREKKTKDHFLIMTDQVKLALNKHLLGRLCQITRSLLGKTYRGVCMRFIVGLKCEDENCEHFHRPLRRCEAKCLVQSKMNLVAINGLLLEAKKVFPKILAEELKEIDYILSTDMYGLCKSILDVLFPKHFHQRVLSENPMACKEILKPNYKSFRFYRFALKEYIHFLFENESARNRRESTDLWLSAMQAFLLSSNYPEEFEKLLHQEEDNYNRELKALESEKDERGRGRGSRIKGIEGKFGMLAPNRDDENMDKTHLCFIRLLENCIDQFYVYRNPEDYKRLFFRFMNVLIKRCKEPLIPSIGNTVALLEFQFIHCGVVLARLWKNVILCLPKSYIALLHYWEFLFSKKDKELGDVFSIIQEYKPKDVTRAIQDFRFHLSYLAKVLCGYENVNFNVLLDAFSEIDYVVSGEAERTLVLCLVMLVNAEEILQPYCKPLLYRHFREIESRLQLMSMDCPGQVPERLLKVVKRVLVAVNVKSVAEALQDLLFERDEEYLMDCDWRWDPVHTKGSIVRGLYYEEVRLNRLLCLDPVDYFAEPECEFGQDEMDELALEDRDHVLATILSQKQRKASIQRKLRRACLVVSLCISWRRRVGTQMERVREEAREPRAGNFKKADVDRTQCDLCGVKFTRGPENYFSPSKAFEGAASEVAVLSRAELEREECQERNSESYEQHIHLEHHQRQQVAYQKYSEFFHEKVDPAIDEGKLVVQDIEQSVWIHSHVGSKEHSHMLQKVQEHIKRVSDMVEDLYRRKAWAGAEEAMTRLVNILILSVRDARDWLMKTETRLKKEGIVQEDDYENEVEDFGELRPRRRSRKCGNKVHVGL

SEQ ID NO: 748570 - protein, 1299 aa, Homo sapiens [sequence omitted]

SEQ ID NO: 748571 - protein, 112 aa, Homo sapiens
MSSQAGRDVSNPSGPGIAVCTENRWTQHTRTLSVWSGGGYTGPKWKDKPGIGFLLFGLSEICLQDRPTAQNFSCSMLTNVHCSIYDSKAWSKTGSPINANSRGPVRQTTAPQ

SEQ ID NO: 748572 - protein, 34 aa, Homo sapiens
VRVKGSTIKTNLFPSHSSSSYAIADNAYRMMCAE

SEQ ID NO: 748573 - protein, 101 aa, Homo sapiens
TNLQAHLHTHTPHVLSSLLFRWKECLCSYKVQLSTWALITSTPTSPGPSAAVTRVIAGFLMSITNMLEELPRLKRKKFSLILPLPPSNYSSSLCSAFSTIS

SEQ ID NO: 748574 - protein, 229 aa, Homo sapiens
MKLDPVLTPRKEFPVQWGGGSGEADEDERLVWSGLQQGAGMRHCENPGGKDFQFCLGTKKDEFPGGDIGMLGCEGHTESLPSGKAVARLHSRWTEQYVQGEEMGTSQIKKQRAQCGSVLGVGGGTWPLLLSRHKTLRPISDSCCHSAAPTIAGLIIAGLGSRPTFKCSKLPPFTLELDTRQPCSGPWFPHLENGDESSFLKGLLLRFLSVSIMKPGRIPSTSVCWIGEE

SEQ ID NO: 748575 - protein, 37 aa, Homo sapiens
MVSCNMVALRIHRFHMCGFNQLCTENKIASLQTRRLF

SEQ ID NO: 748576 - protein, 119 aa, Homo sapiens
GCGILKSAPCLLLGFEAFLSVLPDLQVTTMKFLAVLVLLGVSIFLVSAQNPTTAAPADTYPATGPADDEAPDAETTAAATTATTAAPTTATTAASTTARKDIPVLPKWVGDLPNGRVCP

SEQ ID NO: 748577 - protein, 100 aa, Homo sapiens
QYFIYWIEQFRLLASMGGDHGYQLAVTKAENPTTAAPADTYPATGPADDEAPDAETTAAATTATTAAPTTATTAASTTARKDIPVLPKWVGDLPNGRVCP

SEQ ID NO: 748578 - protein, 105 aa, Homo sapiens
KSPLIILSDCDMNNAVKGALMANFLTQGQVCCNGTRVFVQKEILDKFTEEVVKQTQRIKSGDPLVEDTRMGPLINRPLLVKTFQFYPNGLGISRMVECVPEMESA

SEQ ID NO: 748579 - protein, 1258 aa, Homo sapiens
MALTSINATPTQLSSSSNCLSDTNQNKQSSESAVSSTVNPVAIHKRSKVKTEPEGLRPASPLALTQGQVLDTAHVGVPFPSPQEQLADLKEDLDRDDCKQEAEVVIYETNCHWEDCTKEYDTQEQLVHHINNEHIHGEKKEFVCRWQACTREQKPFKAQYMLVVHMRRHTGEKPHKCTFEGCSKAYSRLENLKTHLRSHTGEKPYVCEHEGCNKAFSNASDRAKHQNRTHSNEKPYICKIPGCTKRYTDPSSLRKHVKTVHGPDAHVTKKQRNDVHLRTPLLKENGDSEAGTEPGGPESTEASSTSQAVEDCLHVRAIKTESSGLCQSSPGAQSSCSSEPSPLGSAPNNDSGVEMPGTGPGSLGDLTALDDTPPGADTSALAAPSAGGLQLRKHMTTMHRFEQLKKEKLKSLKDSCSWAGPTPHTRNTKLPPLPGSGSILENFSGSGGGGPAGLLPNPRLSELSASEVTMLSQLQERRDSSTSTVSSAYTVSRRSSGISPYFSSRRSSEASPLGAGRPHNASSADSYDPISTDASRRSSEASQCSGGSGLLNLTPAQQYSLRAKYAAATGGPPPTPLPGLERMSLRTRLALLDAAEGTLPAGCPRPLGPRRGSDGPTYGHGHAGAAPAFPHEAPGGGTRRASDPVRRPDALSLPRVQRFHSTHNVNPGPLPPCADRRGLRLQSHPSTDGGLARGAYSPRPPSISENVAMEAVAAGVDGAGPEADLGLPEDDLVLPDDVVQYIKAHASGALDEGTGQVYPTESTGFSDNPRLPSPGLHGQRRMVAADSNVGPSAPMLGGCQLGFGAPSSLNKNNMPVQWNEVSSGTVDSLASQVKPPPFPQGNLAVVQQKPAFGQYPGYSPQGLQASPGGLDSTQPHLQPRSGAPSQGIPRVNYMQQLRQPVAGSQCPGMTTTMSPHACYGQVHPQLSPSTISGALNQFPQSCSNMPAKPGHLGHPQQTEVAPDPTTMGNRHRELGVPNSALAGVPPPHPVQSYPQQSHHLAASMSQEGYHQVPSLLPARQPGFMEPQTGPMGVATAGFGLVQPRPPLEPSPTGRHRGVRAVQQQLAYARATGHAMAAMPSSQETAEAVPKGAMGNMGSVPPQPPPQDAGGAPDHSMLYYYGQIHMYEQDGGLENLGSCQVMRSQPPQPQACQDSIQPQPLPSPGVNQVSSTVDSQLLEAPQIDFDAIMDDGDHSSLFSGALSPSLLHSLSQNSSRLTTPRNSLTLPSIPAGISNMAVGDMSSMLTSLAEESKFLNMMT

SEQ ID NO: 748580 - protein, 1241 aa, Homo sapiens
MALTSINATPTQLSSSSNCLSDTNQNKQSSESAVSSTVNPVAIHKRSKVKTEPEGLRPASPLALTQEQLADLKEDLDRDDCKQEAEVVIYETNCHWEDCTKEYDTQEQLVHHINNEHIHGEKKEFVCRWQACTREQKPFKAQYMLVVHMRRHTGEKPHKCTFEGCSKAYSRLENLKTHLRSHTGEKPYVCEHEGCNKAFSNASDRAKHQNRTHSNEKPYICKIPGCTKRYTDPSSLRKHVKTVHGPDAHVTKKQRNDVHLRTPLLKENGDSEAGTEPGGPESTEASSTSQAVEDCLHVRAIKTESSGLCQSSPGAQSSCSSEPSPLGSAPNNDSGVEMPGTGPGSLGDLTALDDTPPGADTSALAAPSAGGLQLRKHMTTMHRFEQLKKEKLKSLKDSCSWAGPTPHTRNTKLPPLPGSGSILENFSGSGGGGPAGLLPNPRLSELSASEVTMLSQLQERRDSSTSTVSSAYTVSRRSSGISPYFSSRRSSEASPLGAGRPHNASSADSYDPISTDASRRSSEASQCSGGSGLLNLTPAQQYSLRAKYAAATGGPPPTPLPGLERMSLRTRLALLDAAEGTLPAGCPRPLGPRRGSDGPTYGHGHAGAAPAFPHEAPGGGTRRASDPVRRPDALSLPRVQRFHSTHNVNPGPLPPCADRRGLRLQSHPSTDGGLARGAYSPRPPSISENVAMEAVAAGVDGAGPEADLGLPEDDLVLPDDVVQYIKAHASGALDEGTGQVYPTESTGFSDNPRLPSPGLHGQRRMVAADSNVGPSAPMLGGCQLGFGAPSSLNKNNMPVQWNEVSSGTVDSLASQVKPPPFPQGNLAVVQQKPAFGQYPGYSPQGLQASPGGLDSTQPHLQPRSGAPSQGIPRVNYMQQLRQPVAGSQCPGMTTTMSPHACYGQVHPQLSPSTISGALNQFPQSCSNMPAKPGHLGHPQQTEVAPDPTTMGNRHRELGVPNSALAGVPPPHPVQSYPQQSHHLAASMSQEGYHQVPSLLPARQPGFMEPQTGPMGVATAGFGLVQPRPPLEPSPTGRHRGVRAVQQQLAYARATGHAMAAMPSSQETAEAVPKGAMGNMGSVPPQPPPQDAGGAPDHSMLYYYGQIHMYEQDGGLENLGSCQVMRSQPPQPQACQDSIQPQPLPSPGVNQVSSTVDSQLLEAPQIDFDAIMDDGDHSSLFSGALSPSLLHSLSQNSSRLTTPRNSLTLPSIPAGISNMAVGDMSSMLTSLAEESKFLNMMT

SEQ ID NO: 748581 - protein, 829 aa, Homo sapiens
MALTSINATPTQLSSSSNCLSDTNQNKQSSESAVSSTVNPVAIHKRSKVKTEPEGLRPASPLALTQGQVLDTAHVGVPFPSPQEQLADLKEDLDRDDCKQEAEVVIYETNCHWEDCTKEYDTQEQLVHHINNEHIHGEKKEFVCRWQACTREQKPFKAQYMLVVHMRRHTGEKPHKCTFEGCSKAYSRLENLKTHLRSHTGEKPYVCEHEGCNKAFSNASDRAKHQNRTHSNEKPYICKIPGCTKRYTDPSSLRKHVKTVHGPDAHVTKKQRNDVHLRTPLLKENGDSEAGTEPGGPESTEASSTSQAVEDCLHVRAIKTESSGLCQSSPGAQSSCSSEPSPLGSAPNNDSGVEMPGTGPGSLGDLTALDDTPPGADTSALAAPSAGGLQLRKHMTTMHRFEQLKKEKLKSLKDSCSWAGPTPHTRNTKLPPLPGSGSILENFSGSGGGGPAGLLPNPRLSELSASEVTMLSQLQERRDSSTSTVSSAYTVSRRSSGISPYFSSRRSSEASPLGAGRPHNASSADSYDPISTDASRRSSEASQCSGGSGLLNLTPAQQYSLRAKYAAATGGPPPTPLPGLERMSLRTRLALLDAAEGTLPAGCPRPLGPRRGSDGPTYGHGHAGAAPAFPHEAPGGGTRRASDPVRRPDALSLPRVQRFHSTHNVNPGPLPPCADRRGLRLQSHPSTDGGLARGAYSPRPPSISENVAMEAVAAGVDGAGPEADLGLPEDDLVLPDDVVQYIKAHASGALDEGTGQVYPTESTGFSDNPRLPSPGLHGQRRMVAADSNVGPSAPMLGGCQLGFGAPSSLNKNNMPVQWNEASATWLSGT

SEQ ID NO: 748582 - protein, 812 aa, Homo sapiens
MALTSINATPTQLSSSSNCLSDTNQNKQSSESAVSSTVNPVAIHKRSKVKTEPEGLRPASPLALTQEQLADLKEDLDRDDCKQEAEVVIYETNCHWEDCTKEYDTQEQLVHHINNEHIHGEKKEFVCRWQACTREQKPFKAQYMLVVHMRRHTGEKPHKCTFEGCSKAYSRLENLKTHLRSHTGEKPYVCEHEGCNKAFSNASDRAKHQNRTHSNEKPYICKIPGCTKRYTDPSSLRKHVKTVHGPDAHVTKKQRNDVHLRTPLLKENGDSEAGTEPGGPESTEASSTSQAVEDCLHVRAIKTESSGLCQSSPGAQSSCSSEPSPLGSAPNNDSGVEMPGTGPGSLGDLTALDDTPPGADTSALAAPSAGGLQLRKHMTTMHRFEQLKKEKLKSLKDSCSWAGPTPHTRNTKLPPLPGSGSILENFSGSGGGGPAGLLPNPRLSELSASEVTMLSQLQERRDSSTSTVSSAYTVSRRSSGISPYFSSRRSSEASPLGAGRPHNASSADSYDPISTDASRRSSEASQCSGGSGLLNLTPAQQYSLRAKYAAATGGPPPTPLPGLERMSLRTRLALLDAAEGTLPAGCPRPLGPRRGSDGPTYGHGHAGAAPAFPHEAPGGGTRRASDPVRRPDALSLPRVQRFHSTHNVNPGPLPPCADRRGLRLQSHPSTDGGLARGAYSPRPPSISENVAMEAVAAGVDGAGPEADLGLPEDDLVLPDDVVQYIKAHASGALDEGTGQVYPTESTGFSDNPRLPSPGLHGQRRMVAADSNVGPSAPMLGGCQLGFGAPSSLNKNNMPVQWNEASATWLSGT

SEQ ID NO: 748583 - protein, 71 aa, Homo sapiens
MGLTATSFQGQVLDTAHVGVPFPSPQEQLADLKEDLDRDDCKQEAEVVIYETNCHWEDCTKEYDTQEQLVH

SEQ ID NO: 748584 - protein, 91 aa, Homo sapiens
NLSQVSILSIIRMYIFWPSGNDEFSERMTLRFWDDLCLTQGCLGKGEQKQVEGAGLLNPIQPRFPAKPWDEDLRRLLPPTALRIAQKSGCW

SEQ ID NO: 748585 - protein, 403 aa, Homo sapiens
MAAFLKMSVSVNFFRPFTRFLVPFTLHRKRNNLTILQRYMSSKIPAVTYPKNESTPPSEELELDKWKTTMKSSVQEECVSTISSSKDEDPLAATREFIEMWRLLGREVPEHITEEELKTLMECVSNTAKKKYLKYLYTKEKVKKARQIKKEMKAAAREEAKNIKLLETTEEDKQKNFLFLRLWDRNMDIAMGWKGAQAMQFGQPLVFDMAYENYMKRKELQNTVSQLLESEGWNRRNVDPFHIYFCNLKIDGALHRELVKRYQEKWDKLLLTSTEKSHVDLFPKDSIIYLTADSPNVMTTFRHDKVYVIGSFVDKSMQPGTSLAKAKRLNLATECLPLDKYLQWEIGNKNLTLDQMIRILLCLKNNGNWQEALQFVPKRKHTGFLEISQHSQEFINRLKKAKT

SEQ ID NO: 748586 - protein, 403 aa, Homo sapiens; identical to SEQ ID NO: 748585

SEQ ID NO: 748587 - protein, 308 aa, Homo sapiens
IPVISFLLLGREVPEHITEEELKTLMECVSNTAKKKYLKYLYTKEKVKKARQIKKEMKAAAREEAKNIKLLETTEEDKQKNFLFLRLWDRNMDIAMGWKGAQAMQFGQPLVFDMAYENYMKRKELQNTVSQLLESEGWNRRNVDPFHIYFCNLKIDGALHRELVKRYQEKWDKLLLTSTEKSHVDLFPKDSIIYLTADSPNVMTTFRHDKVYVIGSFVDKSMQPGTSLAKAKRLNLATECLPLDKYLQWEIGNKNLTLDQMIRILLCLKNNGNWQEALQFVPKRKHTGFLEISQHSQEFINRLKKAKT

SEQ ID NO: 748588 - protein, 150 aa, Homo sapiens
LVTIVGRRYQEKWDKLLLTSTEKSHVDLFPKDSIIYLTADSPNVMTTFRHDKVYVIGSFVDKSMQPGTSLAKAKRLNLATECLPLDKYLQWEIGNKNLTLDQMIRILLCLKNNGNWQEALQFVPKRKHTGFLEISQHSQEFINRLKKAKT

SEQ ID NO: 748589 - protein, 403 aa, Homo sapiens; identical to SEQ ID NO: 748585

SEQ ID NO: 748590 - protein, 385 aa, Homo sapiens
MAAFLKMSVSVNFFRPFTRFLVPFTLHRKRNNLTILQRYMSSKIPAVTYPKNESTPPSEELELDKWSKDEDPLAATREFIEMWRLLGREVPEHITEEELKTLMECVSNTAKKKYLKYLYTKEKVKKARQIKKEMKAAAREEAKNIKLLETTEEDKQKNFLFLRLWDRNMDIAMGWKGAQAMQFGQPLVFDMAYENYMKRKELQNTVSQLLESEGWNRRNVDPFHIYFCNLKIDGALHRELVKRYQEKWDKLLLTSTEKSHVDLFPKDSIIYLTADSPNVMTTFRHDKVYVIGSFVDKSMQPGTSLAKAKRLNLATECLPLDKYLQWEIGNKNLTLDQMIRILLCLKNNGNWQEALQFVPKRKHTGFLEISQHSQEFINRLKKAKT

SEQ ID NO: 748591 - protein, 126 aa, Homo sapiens
MGLPAPSLHATSTLRPDQFSPHTNPSLSLPCLKSFPVSLWPWGRASLLCHLSRLFVCHRPLTPTSQAPNMFSCVSSSLTLAASSAWPASHLPISHSPFLPPHLLRSQLSVTSSREPRLSLPLQLGQ

SEQ ID NO: 748592 - protein, 79 aa, Homo sapiens
LPAALSGNEQEKQLTEQPPGTKTVRPHRLQGAGPTAPLPQGTRTGLFRDFAVLRTLENKIPGSCLNAERRWRDPPDESG

SEQ ID NO: 748593 - protein, 138 aa, Homo sapiens
TIGYVRGPVLSAEGFLKGCTEDPQPPAKPKPPRRSVRSGPLLPPVRLPIPRMSTSVPQGHTWTQRVKKDDEEEDPLDQLISRSGCAASHFAVQECMAQHQDWRQCQPQVQAFKDCMSEQQARRQEELQRRQEQAGAHH

SEQ ID NO: 748594 - protein, 137 aa, Homo sapiens
NYSDAWALPTRGWFLKGCTEDPQPPAKPKPPRRSVRSGPLLPPVRLPIPRMSTSVPQGHTWTQRVKKDDEEEDPLDQLISRSGCAASHFAVQECMAQHQDWRQCQPQVQAFKDCMSEQQARRQEELQRRQEQAGAHH

SEQ ID NO: 748595 - protein, 138 aa, Homo sapiens
TIGYVRGPVVIGRGSLHDPAANHLAYPESLSRGRRHFTPEETEAKRLPIPRMSTSVPQGHTWTQRVKKDDEEEDPLDQLISRSGCAASHFAVQECMAQHQDWRQCQPQVQAFKDCMSEQQARRQEELQRRQEQAGAHH

SEQ ID NO: 748596 - protein, 57 aa, Homo sapiens
MRGAVKAEGTGLDRQPTGAARTHRVRKHGQARVRSRYTPLERASLHTLHRHTSAIAT

SEQ ID NO: 748597 - protein, 96 aa, Homo sapiens
MFYRLPIPRMSTSVPQGHTWTQRVKKDDEEEDPLDQLISRSGCAASHFAVQECMAQHQDWRQCQPQVQAFKDCMSEQQARRQEELQRRQEQAGAHH

SEQ ID NO: 748598 - protein, 140 aa, Homo sapiens
MLVQKLNTNDLQSERTPFDGTMVYAQNKRQQVVLTERWAQGHPAIHFSSMHPGWADTPGVRQAMPGFHARFGDRLRSEAQGADTMLWLALSSAAAAQPSGRFFQDRKPVSTHLPLATASSSPAEEEKLIEILEQLAQTFK

SEQ ID NO: 748599 - protein, 291 aa, Homo sapiens
MSLYRSVVWFAKGLREYTKSGYESACKDFVPHDLEVQIPGRVFLVTGGNSGIGKATALEIAKRGGTVHLVCRDQAPAEDARGEIIRESGNQNIFLHIVDLSDPKQIWKFVENFKQEHKLHVLINNAGCMVNKRELTEDGLEKNFAANTLGVYILTTGLIPVLEKEHDPRVITVSSGGMLVQKLNTNDLQSERTPFDGTMVYAQNKRQQVVLTERWAQGHPAIHFSSMHPGWADTPGVRQAMPGFHARFGDRLRSEAQGADTMLWLALSSAAAAQPSGRFFQGDFLPGCEGS

SEQ ID NO: 748600 - protein, 342 aa, Homo sapiens
RGVEWRSRESFQAQSEGRAETVSWNRTPRVACARGGRRPRSLSSTERGYWRFVVDSDEVLVIHNRCISVERSLDFRIVEMKTSCSRGTAVMRPHVWRLCGRLSSRLFDYSDKQQRGTVHLVCRDQAPAEDARGEIIRESGNQNIFLHIVDLSDPKQIWKFVENFKQEHKLHVLINNAGCMVNKRELTEDGLEKNFAANTLGVYILTTGLIPVLEKEHDPRVITVSSGGMLVQKLNTNDLQSERTPFDGTMVYAQNKRQQVVLTERWAQGHPAIHFSSMHPGWADTPGVRQAMPGFHARFGDRLRSEAQGADTMLWLALSSAAAAQPSGRFFQGDFLPGCEGS

SEQ ID NO: 748601 - protein, 368 aa, Homo sapiens
MSLYRSVVWFAKGLREYTKSGYESACKDFVPHDLEVQIPGRVFLVTGGNSGIGKATALEIAKRGGTVHLVCRDQAPAEDARGEIIRESGNQNIFLHIVDLSDPKQIWKFVENFKQEHKLHVLINNAGCMVNKRELTEDGLEKNFAANTLVWHLFLSVHEALRHLSSSPGKRNIWLEGSSEGGTAPQVATCPLVGGGCGQTVPTSVLQDPLSWGFLQPPHGMLCAASGVYILTTGLIPVLEKEHDPRVITVSSGGMLVQKLNTNDLQSERTPFDGTMVYAQNKRQQVVLTERWAQGHPAIHFSSMHPGWADTPGVRQAMPGFHARFGDRLRSEAQGADTMLWLALSSAAAAQPSGRFFQGDFLPGCEGS

SEQ ID NO: 748602 - protein, 158 aa, Homo sapiens [sequence omitted]

SEQ ID NO: 748603 - protein, 272 aa, Homo sapiens
MSLYRSVVWFAKGLREYTKSGYESACKDFVPHDLEVQIPGRVFLVTGGNSGIGKATALEIAKRGGTVHLVCRDQAPAEDARGEIIRESGNQNIFLHIVDLSDPKQIWKFVENFKQEHKLHVLINNAGCMVNKRELTEDGLEKNFAANTLGVYILTTGLIPVLEKEHDPRVITVSSGGMLVQKLNTNDLQSERTPFDGTMVYAQNKGSQPHLLENAVLIRLTLPSPRCEAGDAGVPRQVRGPPALRGPGRGHHAVAGPLLCRSRTAQRPLLSR

SEQ ID NO: 748604 - protein, 136 aa, Homo sapiens
APPQTSGLQNHRRIHITVSSGGMLVQKLNTNDLQSERTPFDGTMVYAQNKRQQVVLTERWAQGHPAIHFSSMHPGWADTPGVRQAMPGFHARFGDRLRSEAQGADTMLWLALSSAAAAQPSGRFFQGDFLPGCEGS

SEQ ID NO: 748605 - protein, 159 aa, Homo sapiens
EYNVLLQATNFVVIGHNSKKHCSTGGEEWKGSQALVCKSLLPLLQITVSSGGMLVQKLNTNDLQSERTPFDGTMVYAQNKRQQVVLTERWAQGHPAIHFSSMHPGWADTPGVRQAMPGFHARFGDRLRSEAQGADTMLWLALSSAAAAQPSGRFFQVGS

SEQ ID NO: 748606 - protein, 242 aa, Homo sapiens
MNLHVKTLSLMTWRSRFLEESFWSLEETAALAKQLPLKSPSENIFLHIVDLSDPKQIWKFVENFKQEHKLHVLINNAGCMVNKRELTEDGLEKNFAANTLGVYILTTGLIPVLEKEHDPRVITVSSGGMLVQKLNTNDLQSERTPFDGTMVYAQNKRQQVVLTERWAQGHPAIHFSSMHPGWADTPGVRQAMPGFHARFGDRLRSEAQGADTMLWLALSSAAAAQPSGRFFQGDFLPGCEGS

SEQ ID NO: 748607 - protein, 297 aa, Homo sapiens
MNLHVKTLSLMTWRSRFLEESFWSLEETAALAKQLPLKSPSENIFLHIVDLSDPKQIWKFVENFKQEHKLHVLINNAGCMVNKRELTEDGLEKNFAANTLGVYILTTGLIPVLEKEHDPRVITVSSGGMLVQKLNTNDLQSERTPFDGTMVYAQNKRQQVVLTERWAQGHPAIHFSSMHPGWADTPDRNEQELRKVVGEAQTASPLPRFLEIMMHEGKCQHKDTARMIWKRVGAAVEGSRILFRIGLTNSMTSGSSPGLSAALSSSTNKGTESSSSHSTHPRVHPRRQELVSALSAD

SEQ ID NO: 748608 - protein, 132 aa, Homo sapiens
MSGRATPGGRDQGGGRAGSAVGLGVGRSRHVPVPQRRVVRQGAARVHQVRRRGGARGPGLSRGPPRRGRAGLAGTRPRLLRPLAGPTKRVQNDGCARRLATHGWAWGSRQTPAAQCPRPRLAPEGRGCGAPK

SEQ ID NO: 748609 - protein, 313 aa, Homo sapiens
MSLYRSVVWFAKGLREYTKSGYESACKDFVPHDLEVQIPGRVFLVTGGNSGIGKATALEIAKRGGTVHLVCRDQAPAEDARGEIIRESGNQNIFLHIVDLSDPKQIWKFVENFKQEHKLHVLINNAGCMVNKRELTEDGLEKNFAANTLGVYILTTGLIPVLEKEHDPRVKGLGSCSSVQGLGMRSVSWSIQITVSSGGMLVQKLNTNDLQSERTPFDGTMVYAQNKRQQVVLTERWAQGHPAIHFSSMHPGWADTPGVRQAMPGFHARFGDRLRSEAQGADTMLWLALSSAAAAQPSGRFFQGDFLPGCEGS

SEQ ID NO: 748610 - protein, 114 aa, Homo sapiens
MLVQKLNTNDLQSERTPFDGTMVYAQNKRQQVVLTERWAQGHPAIHFSSMHPGWADTPGVRQAMPGFHARFGDRLRSEAQGADTMLWLALSSAAAAQPSGRFFQGDFLPGCEGS

SEQ ID NO: 748611 - protein, 166 aa, Homo sapiens
EYNVLLQATNFVVIGHNSKKHCSTGGEEWKGSQALVCKSLLPLLQITVSSGGMLVQKLNTNDLQSERTPFDGTMVYAQNKRQQVVLTERWAQGHPAIHFSSMHPGWADTPGVRQAMPGFHARFGDRLRSEAQGADTMLWLALSSAAAAQPSGRFFQGDFLPGCEGS

SEQ ID NO: 748612 - protein, 158 aa, Homo sapiens [sequence omitted]

SEQ ID NO: 748613 - protein, 232 aa, Homo sapiens
MSLYRSVVWFAKGLREYTKSGYESACKDFVPHDLEVQIPGRVFLVTGGNSGIGKATALEIAKRGGTVHLVCRDQAPAEDARGEIIRESGNQNIFLHIVDLSDPKQIWKFVENFKQEHKLHVLINNAGCMVNKRELTEDGLEKNFAANTLGVYILTTGLIPVLEKEHDPRVITVSSGGMLVQKLNTNDLQSERTPFDGTMVYAQNKGAHIVCKAASTLRLPCRCCVPSEGGPV

SEQ ID NO: 748614 - protein, 551 aa, Homo sapiens
MVKLSLWTLPDILIIHLKRFCQVGERRNKLSTLVKFPLSGLNMAPHVAQRSTSPEAGLGPWPSWKQPDCLPTSYPLDFLYDLYAVCNHHGNLQGGHYTAYCRNSLDGQWYSYDDSTVEPLREDEVNTRGAYILFYQKRNSIPPWSASSSMRGSTSSSLSDHWLLRLGSHAGSTRGSLLSWSSAPCPSLPQVPDSPIFTNSLCNQEKGGLEPRRLVRGVKGRSISMKAPTTSRAKQGPFKTMPLRWSFGSKEKPPGASVELVEYLESRRRPRSTSQSIVSLLTGTAGEDEKSASPRSNVALPANSEDGGRAIERGPAGVPCPSAQPNHCLAPGNSDGPNTARKLKENAGQDIKLPRKFDLPLTVMPSVEHEKPARPEGQKAMNWKESFQMGSKSSPPSPYMGFSGNSKDSRRGTSELDRPLQGTLTLLRSVFRKKENRRNERAEVSPQVPPVSLVSGGLSPAMDGQAPGSPPALRIPEGLARGLGSRLERDVWSAPSSLRLPRKASRAPRGSALGMSQRTVPGEQASYGTFQRVKYHTLSLGRKKTLPESSF

SEQ ID NO: 748615 - protein, 101 aa, Homo sapiens
CVDVSISSEYLPGGGIAGSRGDNFFEELPDCFPKQLHHFTFPPAVYEGSSFSTSSPALIAGSLFFVFFLNEMYTPMPCLFSFLLTSIKNDAVSPGCSGSRL

SEQ ID NO: 748616 - protein, 106 aa, Homo sapiens
MASPLVERGRRPRGCGAASKRGEPGVSKHLLLDMPALNGGCAGLQTHLAGALWQGRGTLLQILCWLRFCIQCFSECIHSPTEIEPCALGVTVICLILNKISEKQKK

SEQ ID NO: 748617 - protein, 322 aa, Homo sapiens
MEGISNFKTPSKLSEKKKSVLCSTPTINIPASPFMQKLGFGTGVNVYLMKRSPRGLSHSPWAVKKINPICNDHYRSVYQKRLMDEAKILKSLHHPNIVGYRAFTEANDGSLCLAMEYGGEKSLNDLIEERYKASQDPFPAAIILKVALNMARGLKYLHQEKKLLHGDIKSSNVVIKGDFETIKICDVGVSLPLDENMTVTDPEACYIGTEPWKPKEAVEENGVITDKADIFAFGLTLWEMMTLSIPHINLSNDDDDEDKTFDESDFDDEAYYAALGTRPPINMEELDESYQKVIELFSVCTNEDPKDRPSAAHIVEALETDV

SEQ ID NO: 748618 - protein, 322 aa, Homo sapiens; identical to SEQ ID NO: 748617

SEQ ID NO: 748619 - protein, 322 aa, Homo sapiens; identical to SEQ ID NO: 748617

SEQ ID NO: 748620 - protein, 322 aa, Homo sapiens; identical to SEQ ID NO: 748617

SEQ ID NO: 748621 - protein, 277 aa, Homo sapiens [sequence omitted]

SEQ ID NO: 748622 - protein, 197 aa, Homo sapiens
MFNSNYKYPGLSVYAEAWLWYWGKCVPNEKYLHQEKKLLHGDIKSSNVVIKGDFETIKICDVGVSLPLDENMTVTDPEACYIGTEPWKPKEAVEENGVITDKADIFAFGLTLWEMMTLSIPHINLSNDDDDEDKTFDESDFDDEAYYAALGTRPPINMEELDESYQKVIELFSVCTNEDPKDRPSAAHIVEALETDV

SEQ ID NO: 748623 - protein, 322 aa, Homo sapiens; identical to SEQ ID NO: 748617

SEQ ID NO: 748624 - protein, 68 aa, Homo sapiens
HRVLVLSVVAELEDALELGAHSTDLLWYLCSEIEGRITRMEHRSCRITENLLGVVLTPLMSSVWVLVG

SEQ ID NO: 748625 - protein, 868 aa, Homo sapiens
MRGAASASVREPTPLPGRGAPRTKPRAGRGPTVGTPATLALPARGRPRSRNGLASKGQRGAAPTGPGHRALPSRDTALPQERNKKLEAVGTGIEPKAMSQGLVTFGDVAVDFSQEEWEWLNPIQRNLYRKVMLENYRNLASLGLCVSKPDVISSLEQGKEPWTVKRKMTRAWCPDLKAVWKIKELPLKKDFCEGKLSQAVITERLTSYNLEYSLLGEHWDYDALFETQPGLVTIKNLAVDFRQQLHPAQKNFCKNGIWENNSDLGSAGHCVAKPDLVSLLEQEKEPWMVKRELTGSLFSGQRSVHETQELFPKQDSYAEGVTDRTSNTKLDCSSFRENWDSDYVFGRKLAVGQETQFRQEPITHNKTLSKERERTYNKSGRWFYLDDSEEKVHNRDSIKNFQKSSVVIKQTGIYAGKKLFKCNECKKTFTQSSSLTVHQRIHTGEKPYKCNECGKAFSDGSSFARHQRCHTGKKPYECIECGKAFIQNTSLIRHWRYYHTGEKPFDCIDCGKAFSDHIGLNQHRRIHTGEKPYKCDVCHKSFRYGSSLTVHQRIHTGEKPYECDVCRKAFSHHASLTQHQRVHSGEKPFKCKECGKAFRQNIHLASHLRIHTGEKPFECAECGKSFSISSQLATHQRIHTGEKPYECKVCSKAFTQKAHLAQHQKTHTGEKPYECKECGKAFSQTTHLIQHQRVHTGEKPYKCMECGKAFGDNSSCTQHQRLHTGQRPYECIECGKAFKTKSSLICHRRSHTGEKPYECSVCGKAFSHRQSLSVHQRIHSGKKPYECKECRKTFIQIGHLNQHKRVHTGERSYNYKKSRKVFRQTAHLAHHQRIHTGESSTCPSLPSTSNPVDLFPKFLWNPSSLPSP

SEQ ID NO: 748626 - protein, 848 aa, Homo sapiens
MRGAASASVREPTPLPGRGAPRTKPRAGRGPTVGTPATLALPARGRPRSRNGLASKGQRGAAPTGPGHRALPSRDTALPQERNKKLEAVGTGIEPKAMSQGLVTFGDVAVDFSQEEWEWLNPIQRNLYRKVMLENYRNLASLGLCVSKPDVISSLEQGKEPWTVKRKMTRAWCPDLKAVWKIKELPLKKDFCEGKLSQAVITERLTSYNLEYSLLGEHWDYDALFETQPGLVTIKNLAVDFRQQLHPAQKNFCKNGIWENNSDLGSAGHCVAKPDLVSLLEQEKEPWMVKRELTGSLFSGQRSVHETQELFPKQDSYAEGVTDRTSNTKLDCSSFRENWDSDYVFGRKLAVGQETQFRQEPITHNKTLSKERERTYNKSGRWFYLDDSEEKVHNRDSIKNFQKSSVVIKQTGIYAGKKLFKCNECKKTFTQSSSLTVHQRIHTGEKPYKCNECGKAFSDGSSFARHQRCHTGKKPYECIECGKAFIQNTSLIRHWRYYHTGEKPFDCIDCGKAFSDHIGLNQHRRIHTGEKPYKCDVCHKSFRYGSSLTVHQRIHTGEKPYECDVCRKAFSHHASLTQHQRVHSGEKPFKCKECGKAFRQNIHLASHLRIHTGEKPFECAECGKSFSISSQLATHQRIHTGEKPYECKVCSKAFTQKAHLAQHQKTHTGEKPYECKECGKAFSQTTHLIQHQRVHTGEKPYKCMECGKAFGDNSSCTQHQRLHTGQRPYECIECGKAFKTKSSLICHRRSHTGEKPYECSVCGKAECKECRKTFIQIGHLNQHKRVHTGERSYNYKKSRKVFRQTAHLAHHQRIHTGESSTCPSLPSTSNPVDLFPKFLWNPSSLPSP

SEQ ID NO: 748627 - protein, 349 aa, Homo sapiens
MRGAASASVREPTPLPGRGAPRTKPRAGRGPTVGTPATLALPARGRPRSRNGLASKGQRGAAPTGPGHRALPSRDTALPQERNKKLEAVGTGIEPKAMSQGLVTFGDVAVDFSQEEWEWLNPIQRNLYRKVMLENYRNLASLGLCVSKPDVISSLEQGKEPWTVKRKMTRAWCPDLKAVWKIKELPLKKDFCEGKLSQAVITERLTSYNLEYSLLGEHWDYDALFETQPGLVTIKNLAVDFRQQLHPAQKNFCKNGIWENNSDLGSAGHCVAKPDLVSLLEQEKEPWMVKRELTGSLFSGECRRAWCGKSTARESGAFTKKAASSLIYSRKLYPGSLGLERKLNSGSSK

SEQ ID NO: 748628 - protein, 106 aa, Homo sapiens
MRGAASASVREPTPLPGRGAPRTKPRAGRGPTVGTPATLALPARGRPRSRNGLASKGQRGAAPTGPGHRALPSRDTALPQERNKKLEAVGTGIEPKAMSQKNFADT

SEQ ID NO: 748629 - protein, 119 aa, Homo sapiens
VAPRGRTLRLGRPPRGGSRSARETSGAPARILLRDPEGPSTSRPPAQQLSRRPWGGPHPSQTHTHWSLHGQDTVKHPPGLPVIGLEYGPSRSLLPHSPPPPTPPTPNRDAETIPPPTKT

SEQ ID NO: 748630 - protein, 119 aa, Homo sapiens
IERGEGLLQGECLTVDSFFSEYSWDGVMYSTDVFSSRARDELAPQMSVQWEKGRSCLIAPYEYCLPHVPVKDLKHQQESPLGSDGRNAFTNQDPSGSPDMFRSIPLLHQGPDRIVWQAQ

SEQ ID NO: 748631 - protein, 100 aa, Homo sapiens
RPAFLLAARCLLYPCLPLPPLFFSLPSLSDPLPLPPDPFPPPLIFPLSLRSSSSPTPPFLLSPPLLPLPLSSVSFHRLPCLPVFQSLFFSPVSLSVSLPH

SEQ ID NO: 748632 - protein, 489 aa, Homo sapiens
APAPPRSFCMTVTKMSWRPQYRSSKFRNVYGKVANREHCFDGIPITKNVHDNHFCAVNTRFLAIVTESAGGGSFLVIPLEQTGRIEPNYPKVCGHQGNVLDIKWNPFIDNIIASCSEDTSVRIWEIPEGGLKRNMTEALLELHGHSRRVGLVEWHPTTNNILFSAGYDYKVLIWNLDVGEPVKMIDCHTDVILCMSFNTDGSLLTTTCKDKKLRVIEPRSGRVLQEANCKNHRVNRVVFLGNMKRLLTTGVSRWNTRQIALWDQEDLSMPLIEEEIDGLSGLLFPFYDADTHMLYLAGKGDGNIRYYEISTEKPYLSYLMEFRSPAPQKGLGVMPKHGLDVSACEVFRFYKLVTLKGLIEPISMIVPRRSDSYQEDIYPMTPGTEPALTPDEWLGGINRDPVLMSLKEGYKKSSKMVFKAPIKEKKSVVVNGIDLLENVPPRTENELLRMFFRQQDEIRRLKEELAQKDIRIRQLQLELKNLRNSPKNC

SEQ ID NO: 748633 - protein, 475 aa, Homo sapiens
MSWRPQYRSSKFRNVYGKVANREHCFDGIPITKNVHDNHFCAVNTRFLAIVTESAGGGSFLVIPLEQTGRIEPNYPKVCGHQGNVLDIKWNPFIDNIIASCSEDTSVRIWEIPEGGLKRNMTEALLELHGHSRRVGLVEWHPTTNNILFSAGYDYKVLIWNLDVGEPVKMIDCHTDVILCMSFNTDGSLLTTTCKDKKLRVIEPRSGRVLQEANCKNHRVNRVVFLGNMKRLLTTGVSRWNTRQIALWDQEDLSMPLIEEEIDGLSGLLFPFYDADTHMLYLAGKGDGNIRYYEISTEKPYLSYLMEFRSPAPQKGLGVMPKHGLDVSACEVFRFYKLVTLKGLIEPISMIVPRRSDSYQEDIYPMTPGTEPALTPDEWLGGINRDPVLMSLKEGYKKSSKMVFKAPIKEKKSVVVNGIDLLENVPPRTENELLRMFFRQQDEIRRLKEELAQKDIRIRQLQLELKNLRNSPKNC

SEQ ID NO: 748634 - protein, 489 aa, Homo sapiens; identical to SEQ ID NO: 748632

SEQ ID NO: 748635 - protein, 489 aa, Homo sapiens; identical to SEQ ID NO: 748632

SEQ ID NO: 748636 - protein, 38 aa, Homo sapiens
MGSSVRAFPLPSLDPVLMSLKEGYKKSSKMVFKAPIKE

SEQ ID NO: 748637 - protein, 657 aa, Homo sapiens
RTSGAGAVRATSRANNCAARGTRVGKLELLRGPRGSLGGGAMVGQLSEGAIAAIMQKGDTNIKPILQVINIRPITTGNSPPRYRLLMSDGLNTLSSFMLATQLNPLVEEEQLSSNCVCQIHRFIVNTLKDGRRVVILMELEVLKSAEAVGVKIGNPVPYNEGLGQPQVAPPAPAASPAASSRPQPQNGSSGMGSTVSKAYGASKTFGKAAGPSLSHTSGGTQSKVVPIASLTPYQSKWTICARVTNKSQIRTWSNSRGEGKLFSLELVDESGEIRATAFNEQVDKFFPLIEVNKVYYFSKGTLKIANKQFTAVKNDYEMTFNNETSVMPCEDDHHLPTVQFDFTGIDDLENKSKDSLVDIIGICKSYEDATKITVRSNNREVAKRNIYLMDTSGKVVTATLWGEDADKFDGSRQPVLAIKGARVSDFGGRSLSVLSSSTIIANPDIPEAYKLRGWFDAEGQALDGVSISDLKSGGVGGSNTNWKTLYEVKSENLGQGDKPDYFSSVATVVYLRKENCMYQACPTQDCNKKVIDQQNGLYRCEKCDTEFPNFKYRMILSVNIADFQENQWVTCFQESAEAILGQNAAYLGELKDKNEQAFEEVFQNANFRSFIFRVRVKVETYNDESRIKATVMDVKPVDYREYGRRLVMSIRRSALM

SEQ ID NO: 748638 - protein, 606 aa, Homo sapiens
MRKGESQRRPRTTTYDVINIRPITTGNSPPRYRLLMSDGLNTLSSFMLATQLNPLVEEEQLSSNCVCQIHRFIVNTLKDGRRVVILMELEVLKSAEAVGVKIGNPVPYNEGLGQPQVAPPAPAASPAASSRPQPQNGSSGMGSTVSKAYGASKTFGKAAGPSLSHTSGGTQSKVVPIASLTPYQSKWTICARVTNKSQIRTWSNSRGEGKLFSLELVDESGEIRATAFNEQVDKFFPLIEVNKVYYFSKGTLKIANKQFTAVKNDYEMTFNNETSVMPCEDDHHLPTVQFDFTGIDDLENKSKDSLVDIIGICKSYEDATKITVRSNNREVAKRNIYLMDTSGKVVTATLWGEDADKFDGSRQPVLAIKGARVSDFGGRSLSVLSSSTIIANPDIPEAYKLRGWFDAEGQALDGVSISDLKSGGVGGSNTNWKTLYEVKSENLGQGDKPDYFSSVATVVYLRKENCMYQACPTQDCNKKVIDQQNGLYRCEKCDTEFPNFKYRMILSVNIADFQENQWVTCFQESAEAILGQNAAYLGELKDKNEQAFEEVFQNANFRSFIFRVRVKVETYNDESRIKATVMDVKPVDYREYGRRLVMSIRRSALM

SEQ ID NO: 748639 - protein, 657 aa, Homo sapiens; identical to SEQ ID NO: 748637

SEQ ID NO: 748640 - protein, 657 aa, Homo sapiens; identical to SEQ ID NO: 748637

SEQ ID NO: 748641 - protein, 445 aa, Homo sapiens
MQLGGEKFIQSKVVPIASLTPYQSKWTICARVTNKSQIRTWSNSRGEGKLFSLELVDESGEIRATAFNEQVDKFFPLIEVNKVYYFSKGTLKIANKQFTAVKNDYEMTFNNETSVMPCEDDHHLPTVQFDFTGIDDLENKSKDSLVDIIGICKSYEDATKITVRSNNREVAKRNIYLMDTSGKVVTATLWGEDADKFDGSRQPVLAIKGARVSDFGGRSLSVLSSSTIIANPDIPEAYKLRGWFDAEGQALDGVSISDLKSGGVGGSNTNWKTLYEVKSENLGQGDKPDYFSSVATVVYLRKENCMYQACPTQDCNKKVIDQQNGLYRCEKCDTEFPNFKYRMILSVNIADFQENQWVTCFQESAEAILGQNAAYLGELKDKNEQAFEEVFQNANFRSFIFRVRVKVETYNDESRIKATVMDVKPVDYREYGRRLVMSIRRSALM

SEQ ID NO: 748642 - protein, 657 aa, Homo sapiens; identical to SEQ ID NO: 748637

SEQ ID NO: 748643 - protein, 613 aa, Homo sapiens
RTSGAGAVRATSRANNCAARGTRVGKLELLRGPRGSLGGGAMVGQLSEGAIAAIMQKGDTNIKPILQVINIRPITTGNSPPRYRLLMSDGLNTLSSFMLATQLNPLVEEEQLSSNCVCQIHRFIVNTLKDGRRVVILMELEVLKSAEAVGVKIGNPVPYNEGLGQPQVAPPAPAASPAASSRPQPQNGSSGMGSTVSKAYGASKTFGKAAGPSLSHTSGGTQSKVVPIASLTPYQSKWTICARVTNKSQIRTWSNSRGEGKLFSLELVDESGEIRATAFNEQVDKFFPLIEVNKVYYFSKGTLKIANKQFTAVKNDYEMTFNNETSVMPCEDDHHLPTVQFDFTGIDDLENKSKDSLVDIIGICKSYEDATKITVRSNNREVAKRNIYLMDTSGKVVTATLWGEDADKFDGSRQPVLAIKGARVSDFGGRSLSVLSSSTIIANPDIPEAYKLRGWFDAEGQALDGVSISDLKSGGVGGSNTNWKTLYEVKSENLGQGDKPDYFSSVATVVYLRKENCMYQACPTQDCNKKVIDQQNGLYRCEKCDTEFPNFKYRMILSVNIADFQENQWVTCFQESAEAILGQNAAYLGELKDKIFHIQSQGQSGDLQRRVSN

SEQ ID NO: 748644 - protein, 281 aa, Homo sapiens
MTIPTSYPTNIYLMDTSGKVVTATLWGEDADKFDGSRQPVLAIKGARVSDFGGRSLSVLSSSTIIANPDIPEAYKLRGWFDAEGQALDGVSISDLKSGGVGGSNTNWKTLYEVKSENLGQGDKPDYFSSVATVVYLRKENCMYQACPTQDCNKKVIDQQNGLYRCEKCDTEFPNFKYRMILSVNIADFQENQWVTCFQESAEAILGQNAAYLGELKDKNEQAFEEVFQNANFRSFIFRVRVKVETYNDESRIKATVMDVKPVDYREYGRRLVMSIRRSALM

SEQ ID NO: 748645 - protein, 97 aa, Homo sapiens
GMQGITSMWVTCFQESAEAILGQNAAYLGELKDKNEQAFEEVFQNANFRSFIFRVRVKVETYNDESRIKATVMDVKPVDYREYGRRLVMSIRRSALM

SEQ ID NO: 748646 - protein, 657 aa, Homo sapiens; identical to SEQ ID NO: 748637

SEQ ID NO: 748647 - protein, 186 aa, Homo sapiens
RTSGAGAVRATSRANNCAARGTRVGKLELLRGPRGSLGGGAMVGQLSEGAIAAIMQKGDTNIKPILQVINIRPITTGNSPPRYRLLMSDGLNTLSSFMLATQLNPLVEEEQLSSNCVCQIHRFIVNTLKDGRRVVILMELEVLKSAEAVGVKIGNPVPYNEEAEKKVITSDNSRERQKESSNHWPH

SEQ ID NO: 748648 - protein, 227 aa, Homo sapiens
MSHTEVKLKIPFGNKLLDAVCLVPNKSLTYGIILTHGASGDMNLPHLMSLASHLASHGFFCLRFTCKGLNIVHRIKAYKSVLNYLKTSGEYKLAGVFLGGRSMGSRAAASVMCHIEPDDGDDFVRGLICISYPLHHPKQQHKLRDEDLFRLKEPVLFVSGSADEMCEKNLLEKVAQKMQAPHKIHWIEKANHSMAVKGRSTNDVFKEINTQILFWIQEITEMDKKCH

SEQ ID NO: 748649 - protein, 265 aa, Homo sapiens
PARACVVAERCGGAGEAVASSALVSSLKGVTAVGCPRPLLPSRVKLKIPFGNKLLDAVCLVPNKSLTYGIILTHGASGDMNLPHLMSLASHLASHGFFCLRFTCKGLNIVHRIKAYKSVLNYLKTSGEYKLAGVFLGGRSMGSRAAASVMCHIEPDDGDDFVRGLICISYPLHHPKQQHKLRDEDLFRLKEPVLFVSGSADEMCEKNLLEKVAQKMQAPHKIHWIEKANHSMAVKGRSTNDVFKEINTQILFWIQEITEMDKKCH

SEQ ID NO: 748650 - protein, 151 aa, Homo sapiens
PARACVVAERCGGAGEAVASSALVSSLKGVTAVGCPRPLLPSRVKLKIPFGNKLLDAVCLVPNKSLTYGIILTHGASGDMNLPHLMSLASHLASHGFFCLRFTCKGLNIVHRIKAYKSVLNYLKTSGEYKLAGVFLGELVGESGTENASSP

SEQ ID NO: 748651 - protein, 227 aa, Homo sapiens; identical to SEQ ID NO: 748648

SEQ ID NO: 748652 - protein, 227 aa, Homo sapiens; identical to SEQ ID NO: 748648

SEQ ID NO: 748653 - protein, 227 aa, Homo sapiens; identical to SEQ ID NO: 748648

SEQ ID NO: 748654 - protein, 227 aa, Homo sapiens; identical to SEQ ID NO: 748648

SEQ ID NO: 748655 - protein, 227 aa, Homo sapiens; identical to SEQ ID NO: 748648

SEQ ID NO: 748656 - protein, 113 aa, Homo sapiens
MSHTEVKLKIPFGNKLLDAVCLVPNKSLTYGIILTHGASGDMNLPHLMSLASHLASHGFFCLRFTCKGLNIVHRIKAYKSVLNYLKTSGEYKLAGVFLGELVGESGTENASSP

SEQ ID NO: 748657 - protein, 210 aa, Homo sapiens
MSHTEVKLKIPFGNKLLDAVCLVPNKSLTYGIILTHGASGDMNLPHLMSLASHLASHGFFCLRFTCKGLNIVHRIKAYKSVLNYLKTSGEYKLAGVFLGGRSMGSRAAASVMCHIEPDDGDDFVRGLICISYPLHHPKQQHKLRDEDLFRLKEPVLFVSGSADEMCEKWIEKANHSMAVKGRSTNDVFKEINTQILFWIQEITEMDKKCH

SEQ ID NO: 748658 - protein, 113 aa, Homo sapiens; identical to SEQ ID NO: 748656

SEQ ID NO: 748659 - protein, 113 aa, Homo sapiens; identical to SEQ ID NO: 748656

SEQ ID NO: 748660 - protein, 46 aa, Homo sapiens
MGSDTTEHVHGAWGLGQQQSDTETPAGTEFIVPGEVCYSKCTSQFC

SEQ ID NO: 748661 - protein, 166 aa, Homo sapiens
PKAYPSFIKGPAPRSQYKNTKSPISLITIKKPKSGKLRGQGKRPLGQGHRGALLMAPGLAAGSPGIAVATRLGGSDCPVGTTVLLGRGPSLLLGCAQLLHAPDLVQQTRNEGLCGFVTVNQQLLDRGSPGIVTLHVQELIHVNLQFWDLLFLAVVEARELLQDPLL

SEQ ID NO: 748662 - protein, 72 aa, Homo sapiens
LTSSGEFREGFPAEVVFKWRPKSIEGMHKKERNKDKMEREDKKREKRKKSKRKTHTGQAQWLTPVILALWEA

SEQ ID NO: 748663 - protein, 76 aa, Homo sapiens
TKASEVLIVHLQECAHRASRRWFSLLSPFALIEKATHSYTLGRRRKLATRWGKHVCHSNAGLPGLVTHLAHFPGCP

SEQ ID NO: 748664 - protein, 286 aa, Homo sapiens
ITLFNIVYTSLPVLAMGIFDQDVSDQNSVDCPQLYKPGQLNLLFNKRKFFICVLHGIYTSLVLFFIPYGAFYNVAGEDGQHIADYQSFAVTMATSLVIVVSVQIALDTSYWTFINHVFIWGSIAIYFSILFTMHSNGIFGIFPNQFPFVGNARHSLTQKCIWLVILLTTVASVMPVVAFRFLKVDLYPTLSDQIRRWQKAQKKARPPSSRRPRTRRSSSRRSGYAFAHQEGYGELITSGKNMRAKNPPPTSGLEKTHYNSTSWIENLCKKTTDTVSSFSQDKTVKL

SEQ ID NO: 748665 - protein, 154 aa, Homo sapiens [sequence omitted]

SEQ ID NO: 748666 - protein, 154 aa, Homo sapiens [sequence omitted]

SEQ ID NO: 748667 - protein, 154 aa, Homo sapiens [sequence omitted]

SEQ ID NO: 748668 - protein, 108 aa, Homo sapiens
ITLFNIVYTSLPVLAMGIFDQDVSDQNSVDCPQLYKPGQLNLLFNKRKFFICVLHGIYTSLVLFFIPYGAFYNVAGEDGQHIADYQSFAVTMATSLVIVVSVQVTLSV

SEQ ID NO: 748669 - protein, 312 aa, Homo sapiens
KVRKRKVTTYINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDNLKTPPECLLTPLPPSALPSAPPSADDNLKTRAECLLHPLPPSADDNLKTPSERQLTPLPPSAPPSADDNIKTPAERLRGPLPPSADDNLKTPSERQLTPLPPSAPPSADDNIKTPAERLRGPLPPSADD

SEQ ID NO: 748670 - protein, 128 aa, Homo sapiens
ASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMR

SEQ ID NO: 748671 - protein, 342 aa, Homo sapiens [sequence omitted]

SEQ ID NO: 748672 - protein, 126 aa, Homo sapiens [sequence omitted]

SEQ ID NO: 748673 - protein, 223 aa, Homo sapiens
MAAEEEDEVEWVVESIAGFLRGPDWSIPILDFVEQKCEVFDDEEESKLTYTEIHQEYKELVEKLLEGYLKEIGINEDQFQEACTSPLAKTHTSQAILQPVLAAEDFTIFKAMMVQKNIEMQLQAIRIIQERNGVLPDCLTDGSDVVSDLEHEEMKILREVLRKSKEEYDQEEERKRKKQVPTEHITEVFYCCYLLLSLHLDLTIKIYTYVELHNFKYNVNIDQ

SEQ ID NO: 748674 - protein, 140 aa, Homo sapiens
MAAEEEDEVEWVVESIAGFLRGPDWSIPILDFVEQKCEVFDDEEESKLTYTEIHQEYKELVEKLLEGYLKEIGINEDQFQEACTSPLAKTHTSQAILQPVLAAEDFTIFKAMMVQKNIEMQLQAIRIIQERNGKMLKLEI

SEQ ID NO: 748675 - protein, 106 aa, Homo sapiens
MAAEEEDEVEWVVESIAGFLRGPDWSIPILDFVEQKCEVFDDEEESKLTYTEIHQEYKELVEKLLEGYLKEIGINEDQFQEACTSPLAKTHTSQVFALCYSANIQF

SEQ ID NO: 748676 - protein, 189 aa, Homo sapiens
MKILREVLRKSKEEYDQEEERKRKKQLSEAKTEEPTVHSSEAAIMNNSQGDGEHFAHPPSEVKMHFANQSIEPLGRKVERSETSSLPQKGLKIPGLEHASIEGPIANLSVLGTEELRQREHYLKQKRDKLMSMRKDMRTKQIQNMEQKGKPTGEVEEMTEKPEMTAEEKQTLLKRRLLAEKLKEEVINK

SEQ ID NO: 748677 - protein, 299 aa, Homo sapiens
MAAEEEDEVEWVVESIAGFLRGPDWSIPILDFVEQKCEVFDDEEESKLTYTEIHQEYKELVEKLLEGYLKEIGINEDQFQEACTSPLAKTHTSQAILQPVLAAEDFTIFKAMMVQKNIEMQLQAIRIIQERNGVLPDCLTDGSDVVSDLEHEEMKILREVLRKSKEEYDQEEERKRKKQLSEAKTEEPTVHSSEAAIMNNSQGDGEHFAHPPSEVKMHFANQSIEPLGRKVERSETSSLPQKGLKIPGLEHASIEGPIAVSKRHHLRTISKMTRYWEIKLRIESLSGHLCYLLNGFEFR

SEQ ID NO: 748678 - protein, 114 aa, Homo sapiens
LEDPVHRTSSLPQKGLKIPGLEHASIEGPIANLSVLGTEELRQREHYLKQKRDKLMSMRKDMRTKQIQNMEQKGKPTGEVEEMTEKPEMTAEEKQTLLKRRLLAEKLKEEVINK

SEQ ID NO: 748679 - protein, 223 aa, Homo sapiens; identical to SEQ ID NO: 748673

SEQ ID NO: 748680 - protein, 169 aa, Homo sapiens
MAAEEEDEVEWVVESIAGFLRGPDWSIPILDFVEQKCEVFDDEEESKLTYTEIHQEYKELVEKLLEGYLKEIGINEDQFQEACTSPLAKTHTSQAILQPVLAAEDFTIFKAMMVQKNIEMQLQAIRIIQERNGVLPDCLTDGSDVVSDLEHEEMKILREVLRYHSLIVF

SEQ ID NO: 748681 - protein, 379 aa, Homo sapiens
TSKAGLMDEGGRCGRRFDSRAVRPSSHKAPAAIAPCTPAVTAAVQPLPRGLRGGSHTPRPVYALCTCLPENMLQTPESRGLPVPQAEGEKDGGHDGETRAPTASQERPKEELGAGREEGAAEPALTRKGARALAAKSLARRRAYRRLNRTVAELVQFLLVKDKKKSPITRSEMVKYVIGDLKILFPDIIARAAEHLRYVFGFELKQFDRKHHTYILINKLKPLEEEEEEEDLGGDGPRLGLLMMILGLIYMRGNSAREAQVWEMLRRLGVQPSKYHFLFGYPKRLIMEDFVQQRYLSYRRVPHTNPPEYEFSWGPRSNLEISKMEVLGFVAKLHKKEPQHWPVQYREALADEADRARAKARAEASMRARASARAGIHLW

SEQ ID NO: 748682 - protein, 389 aa, Homo sapiens
GSGPSRGRGLRLRAAGSGCWRRCGRRFDSRAVRPSSHKAPAAIAPCTPAVTAAVQPLPRGLRGGSHTPRPVYALCTCLPENMLQTPESRGLPVPQAEGEKDGGHDGETRAPTASQERPKEELGAGREEGAAEPALTRKGARALAAKSLARRRAYRRLNRTVAELVQFLLVKDKKKSPITRSEMVKYVIGDLKILFPDIIARAAEHLRYVFGFELKQFDRKHHTYILINKLKPLEEEEEEEDLGGDGPRLGLLMMILGLIYMRGNSAREAQVWEMLRRLGVQPSKYHFLFGYPKRLIMEDFVQQRYLSYRRVPHTNPPEYEFSWGPRSNLEISKMEVLGFVAKLHKKEPQHWPVQYREALADEADRARAKARAEASMRARASARAGIHLW

SEQ ID NO: 748683 - protein, 389 aa, Homo sapiens; identical to SEQ ID NO: 748682

SEQ ID NO: 748684 - protein, 357 aa, Homo sapiens
DWLGRGWVAAIAPCTPAVTAAVQPLPRGLRGGSHTPRPVYALCTCLPENMLQTPESRGLPVPQAEGEKDGGHDGETRAPTASQERPKEELGAGREEGAAEPALTRKGARALAAKSLARRRAYRRLNRTVAELVQFLLVKDKKKSPITRSEMVKYVIGDLKILFPDIIARAAEHLRYVFGFELKQFDRKHHTYILINKLKPLEEEEEEEDLGGDGPRLGLLMMILGLIYMRGNSAREAQVWEMLRRLGVQPSKYHFLFGYPKRLIMEDFVQQRYLSYRRVPHTNPPEYEFSWGPRSNLEISKMEVLGFVAKLHKKEPQHWPVQYREALADEADRARAKARAEASMRARASARAGIHLW

SEQ ID NO: 748685 - protein, 363 aa, Homo sapiens
NKLKYEAGCSIESEGAIAPCTPAVTAAVQPLPRGLRGGSHTPRPVYALCTCLPENMLQTPESRGLPVPQAEGEKDGGHDGETRAPTASQERPKEELGAGREEGAAEPALTRKGARALAAKSLARRRAYRRLNRTVAELVQFLLVKDKKKSPITRSEMVKYVIGDLKILFPDIIARAAEHLRYVFGFELKQFDRKHHTYILINKLKPLEEEEEEEDLGGDGPRLGLLMMILGLIYMRGNSAREAQVWEMLRRLGVQPSKYHFLFGYPKRLIMEDFVQQRYLSYRRVPHTNPPEYEFSWGPRSNLEISKMEVLGFVAKLHKKEPQHWPVQYREALADEADRARAKARAEASMRARASARAGIHLW

SEQ ID NO: 748686 - protein, 207 aa, Homo sapiens
MVKYVIGDLKILFPDIIARAAEHLRYVFGFELKQFDRKHHTYILINKLKPLEEEEEEEDLGGDGPRLGLLMMILGLIYMRGNSAREAQVWEMLRRLGVQPSKYHFLFGYPKRLIMEDFVQQRYLSYRRVPHTNPPEYEFSWGPRSNLEISKMEVLGFVAKLHKKEPQHWPVQYREALADEADRARAKARAEASMRARASARAGIHLW

SEQ ID NO: 748687 - protein, 290 aa, Homo sapiens
GSGPSRGRGLRLRAAGSGCWRRCGRRFDSRAVRPSSHKAPAAIAPCTPAVTAAVQPLPRGLRGGSHTPRPVYALCTCLPENMLQTPESRGLPVPQAEGEKDGGHDGETRAPTASQERPKEELGAGREEGAAEPALTRKGARALAAKSLARRRAYRRLNRTVAELVQFLLVKDKKKSPITRSEMVKYVIGDLKILFPDIIARAAEHLRYVFGFELKQFDRKHHTYILINKLKPLEEEEEEEDLGGDAASVGGATLKVSFPLWVSEEAYYGRFCAAAISQLQAGASHQSTRI

SEQ ID NO: 748688 - protein, 227 aa, Homo sapiens
LFPDIIFKSPITYFTISERVMVKYVIGDLKILFPDIIARAAEHLRYVFGFELKQFDRKHHTYILINKLKPLEEEEEEEDLGGDGPRLGLLMMILGLIYMRGNSAREAQVWEMLRRLGVQPSKYHFLFGYPKRLIMEDFVQQRYLSYRRVPHTNPPEYEFSWGPRSNLEISKMEVLGFVAKLHKKEPQHWPVQYREALADEADRARAKARAEASMRARASARAGIHLW

SEQ ID NO: 748689 - protein, 173 aa, Homo sapiens
RTFKAEMLIGLVCAGGMAEGELSQVGGDLVEGWVILIMVEMYLSSGQHLRFGNSKAEMLRRLGVQPSKYHFLFGYPKRLIMEDFVQQRYLSYRRVPHTNPPEYEFSWGPRSNLEISKMEVLGFVAKLHKKEPQHWPVQYREALADEADRARAKARAEASMRARASARAGIHLW

SEQ ID NO: 748690 - protein, 641 aa, Homo sapiens
MWKSWKLRTDVRVREGAGGSPCASSQPGSRGPCFLPGLSSQEVSRRRQFLREHAAPFSAFLTDSFGRQHSYLRISLTEKCNLRCQYCMPEEGVPLTPKANLLTTEEILTLARLFVKEGIDKIRLTGGEPLIRPDVVDIVAQLQRLEGLRTIGVTTNGINLARLLPQLQKAGLSAINISLDTLVPAKFEFIVRRKGFHKVMEGIHKAIELGYNPVKVNCVVMRGLNEDELLDFAALTEGLPLDVRFIEYMPFDGNKWNFKKMVSYKEMLDTVRQQWPELEKVPEEESSTAKAFKIPGFQGQISFITSMSEHFCGTCNRLRITADGNLKVCLFGNSEVSLRDHLRAGASEQELLRIIGAAVGRKKRQHAGMFSISQMKNRPMILIGGGPIKLFLMFPNSPPANPSIFSWDPLHVQGLRPRMSFSSQVATLWKGCRVPQTPPLAQQRLGSGSFQRHYTSRADSDANSKCLSPGSWASAAPSGPQLTSEQLTHVDSEGRAAMVDVGRKPDTERVAVASAVVLLGPVAFKLVQQNQLKKGDALVVAQLAGVQAAKVTSQLIPLCHHVALSHIQVQLELDSTRHAVKIQASCRARGPTGVEMEALTSAAVAALTLYDMCKAVSRDIVLEEIKLISKTGGQRGDFHRA

SEQ ID NO: 748691 - protein, 672 aa, Homo sapiens
APPRPCWDDPGGECPASVLPKRAAVPLVSGFMAARPLSRMLRRLLRSSARSCSSGAPVTQPCPGESARAASEEVSRRRQFLREHAAPFSAFLTDSFGRQHSYLRISLTEKCNLRCQYCMPEEGVPLTPKANLLTTEEILTLARLFVKEGIDKIRLTGGEPLIRPDVVDIVAQLQRLEGLRTIGVTTNGINLARLLPQLQKAGLSAINISLDTLVPAKFEFIVRRKGFHKVMEGIHKAIELGYNPVKVNCVVMRGLNEDELLDFAALTEGLPLDVRFIEYMPFDGNKWNFKKMVSYKEMLDTVRQQWPELEKVPEEESSTAKAFKIPGFQGQISFITSMSEHFCGTCNRLRITADGNLKVCLFGNSEVSLRDHLRAGASEQELLRIIGAAVGRKKRQHAGMFSISQMKNRPMILIGGGPIKLFLMFPNSPPANPSIFSWDPLHVQGLRPRMSFSSQVATLWKGCRVPQTPPLAQQRLGSGSFQRHYTSRADSDANSKCLSPGSWASAAPSGPQLTSEQLTHVDSEGRAAMVDVGRKPDTERVAVASAVVLLGPVAFKLVQQNQLKKGDALVVAQLAGVQAAKVTSQLIPLCHHVALSHIQVQLELDSTRHAVKIQASCRARGPTGVEMEALTSAAVAALTLYDMCKAVSRDIVLEEIKLISKTGGQRGDFHRA

SEQ ID NO: 748692 - protein, 672 aa, Homo sapiens; identical to SEQ ID NO: 748691

SEQ ID NO: 748693 - protein, 651 aa, Homo sapiens
APPRPCWDDPGGECPASVLPKRAAVPLVSGFMAARPLSRMLRRLLRSSARSCSSGAPVTQPCPGESARAASEEVSRRRQFLREHAAPFSAFLTDSFGRQHSYLRISLTEKCNLRCQYCMPEEGVPLTPKANLLTTEEILTLARLFVKEGIDKIRLTGGEPLIRPDVVDIVAQLQRLEGLRTIGVTTNGINLARLLPQLQKAGLSAINISLDTLVPAKFEFIVRRKGFHKVMEGIHKAIELGYNPVKVNCVVMRGLNEDELLDFAALTEGLPLDVRFIEYMPFDGNKWNFKKMVSYKEMLDTVRQQWPELEKVPEEESSTAKAFKIPGFQGQISFITSMSEHFCGTCNRLRITADGNLKVCLFGNSEVSLRDHLRAGASEQELLRIIGAAVGRKKRQHAELFLMFPNSPPANPSIFSWDPLHVQGLRPRMSFSSQVATLWKGCRVPQTPPLAQQRLGSGSFQRHYTSRADSDANSKCLSPGSWASAAPSGPQLTSEQLTHVDSEGRAAMVDVGRKPDTERVAVASAVVLLGPVAFKLVQQNQLKKGDALVVAQLAGVQAAKVTSQLIPLCHHVALSHIQVQLELDSTRHAVKIQASCRARGPTGVEMEALTSAAVAALTLYDMCKAVSRDIVLEEIKLISKTGGQRGDFHRA

SEQ ID NO: 748694 - protein, 554 aa, Homo sapiens
MPEEGVPLTPKANLLTTEEILTLARLFVKEGIDKIRLTGGEPLIRPDVVDIVAQLQRLEGLRTIGVTTNGINLARLLPQLQKAGLSAINISLDTLVPAKFEFIVRRKGFHKVMEGIHKAIELGYNPVKVNCVVMRGLNEDELLDFAALTEGLPLDVRFIEYMPFDGNKWNFKKMVSYKEMLDTVRQQWPELEKVPEEESSTAKAFKIPGFQGQISFITSMSEHFCGTCNRLRITADGNLKVCLFGNSEVSLRDHLRAGASEQELLRIIGAAVGRKKRQHAGMFSISQMKNRPMILIGGGPIKLFLMFPNSPPANPSIFSWDPLHVQGLRPRMSFSSQVATLWKGCRVPQTPPLAQQRLGSGSFQRHYTSRADSDANSKCLSPGSWASAAPSGPQLTSEQLTHVDSEGRAAMVDVGRKPDTERVAVASAVVLLGPVAFKLVQQNQLKKGDALVVAQLAGVQAAKVTSQLIPLCHHVALSHIQVQLELDSTRHAVKIQASCRARGPTGVEMEALTSAAVAALTLYDMCKAVSRDIVLEEIKLISKTGGQRGDFHRA

SEQ ID NO: 748695 - protein, 615 aa, Homo sapiens
MGEGTETCLEETQGEEVSRRRQFLREHAAPFSAFLTDSFGRQHSYLRISLTEKCNLRCQYCMPEEGVPLTPKANLLTTEEILTLARLFVKEGIDKIRLTGGEPLIRPDVVDIVAQLQRLEGLRTIGVTTNGINLARLLPQLQKAGLSAINISLDTLVPAKFEFIVRRKGFHKVMEGIHKAIELGYNPVKVNCVVMRGLNEDELLDFAALTEGLPLDVRFIEYMPFDGNKWNFKKMVSYKEMLDTVRQQWPELEKVPEEESSTAKAFKIPGFQGQISFITSMSEHFCGTCNRLRITADGNLKVCLFGNSEVSLRDHLRAGASEQELLRIIGAAVGRKKRQHAGMFSISQMKNRPMILIGGGPIKLFLMFPNSPPANPSIFSWDPLHVQGLRPRMSFSSQVATLWKGCRVPQTPPLAQQRLGSGSFQRHYTSRADSDANSKCLSPGSWASAAPSGPQLTSEQLTHVDSEGRAAMVDVGRKPDTERVAVASAVVLLGPVAFKLVQQNQLKKGDALVVAQLAGVQAAKVTSQLIPLCHHVALSHIQVQLELDSTRHAVKIQASCRARGPTGVEMEALTSAAVAALTLYDMCKAVSRDIVLEEIKLISKTGGQRGDFHRA

SEQ ID NO: 748696 - protein, 223 aa, Homo sapiens
MSFSSQVATLWKGCRVPQTPPLAQQRLGSGSFQRHYTSRADSDANSKCLSPGSWASAAPSGPQLTSEQLTHVDSEGRAAMVDVGRKPDTERVAVASAVVLLGPVAFKLVQQNQLKKGDALVVAQLAGVQAAKVTSQLIPLCHHVALSHIQVQLELDSTRHAVKIQASCRARGPTGVEMEALTSAAVAALTLYDMCKAVSRDIVLEEIKLISKTGGQRGDFHRA

SEQ ID NO: 748697 - protein, 402 aa, Homo sapiens
APPRPCWDDPGGECPASVLPKRAAVPLVSGFMAARPLSRMLRRLLRSSARSCSSGAPVTQPCPGESARAASEEVSRRRQFLREHAAPFSAFLTDSFGRQHSYLRISLTEKCNLRCQYCMPEEGVPLTPKANLLTTEEILTLARLFVKEGIDKIRLTGGEPLIRPDVVDIVAQLQRLEGLRTIGVTTNGINLARLLPQLQKAGLSAINISLDTLVPAKFEFIVRRKGFHKVMEGIHKAIELGYNPVKVNCVVMRGLNEDELLDFAALTEGLPLDVRFIEYMPFDGNKWNFKKMVSYKEMLDTVRQQWPELEKVPEEESSTAKAFKIPGFQGQISFITSMSEHFCGTCNRLRITADGNLKVCLFGNSEVSLRDHLRAGASEQELLTSSLLLPKSVSHQTCSLSA

SEQ ID NO: 748698 - protein, 323 aa, Homo sapiens
APPRPCWDDPGGECPASVLPKRAAVPLVSGFMAARPLSRMLRRLLRSSARSCSSGAPVTQPCPGESARAASEEVSRRRQFLREHAAPFSAFLTDSFGRQHSYLRISLTEKCNLRCQYCMPEEGVPLTPKANLLTTEEILTLARLFVKEGIDKIRLTGGEPLIRPDVVDIVAQLQRLEGLRTIGVTTNGINLARLLPQLQKAGLSAINISLDTLVPAKFEFIVRRKGFHKVMEGIHKAIELGYNPVKVNCVVMRGLNEDELLDFAALTEGLPLDVRFIEYMPFDGNKWNFKKMVSYEGDARHCPAAVARAGEGARGGIQHSQGL

SEQ ID NO: 748699 - protein, 65 aa, Homo sapiens
PPVGWKHFALWPFEVTQLFEGQGQLDSNEIKVTGSCCPQESGRWSSVVQAVALLQGWEVERCGQR

SEQ ID NO: 748700 - protein, 102 aa, Homo sapiens
WAELGNCVSIALSSDCLHYVKLQAPRQGPRCFVPGCSSEPRTTVMPVSPLLQRFSFCSEGQYPQRLAVRSVTYRMSSAQSTLPGQGSRSCCVLGLQDLRALQ

SEQ ID NO: 748701 - protein, 805 aa, Homo sapiens
MNAVGSPEGQELHKLGSGAWDNPAYSGPPSPHGTLRVCTISSTGPLQPQPKKPEDEPQETAYRTQVSSCCLHICQGIRGLWGTTLTENTAENRELYIKTTLRELLVYIVFLVDICLLTYGMTSSSAYYYTKVMSELFLHTPSDTGVSFQAISSMADFWDFAQGPLLDSLYWTKWYNNQSLGHGSHSFIYYENMLLGVPRLRQLKVRNDSCVVHEDFREDILSCYDVYSPDKEEQLPFGPFNGTAWTYHSQDELGGFSHWGRLTSYSGGGYYLDLPGSRQGSAEALRALQEGLWLDRGTRVVFIDFSVYNANINLFCVLRLVVEFPATGGAIPSWQIRTVKLIRYVSNWDFFIVGCEVIFCVFIFYYVVEEILELHIHRLRYLSSIWNILDLVVILLSIVAVGFHIFRTLEVNRLMGKLLQQPNTYADFEFLAFWQTQYNNMNAVNLFFAWIKIFKYISFNKTMTQLSSTLARCAKDILGFAVMFFIVFFAYAQLGYLLFGTQVENFSTFIKCIFTQFRIILGDFDYNAIDNANRILGPAYFVTYVFFVFFVLLNMFLAIINDTYSEVKEELAGQKDELQLSDLLKQGYNKTLLRLRLRKERVSDVQKVLQGGEQEIQFEDFTNTLRELGHAEHEITELTATFTKFDRDGNRILDEKEQEKMRQDLEEERVALNTEIEKLGRSIVSSPQGKSGPEAARAGGWVSGEEFYMLTRRVLQLETVLEGVVSQIDAVGSKLKMLERKGWLAPSPGVKEQAIWKHPQPAPAVTPDPWGVQGGQESEVPYKREEEALEERRLSRGEIPTLQRS

SEQ ID NO: 748702 - protein, 105 aa, Homo sapiens
MNAVGSPEGQELHKLGSGAWDNPAYSGPPSPHGTLRVCTISSTGPLQPQPKKPEDEPQETAYRTQVSSCCLHICQGIREVPYKREEEALEERRLSRGEIPTLQRS

SEQ ID NO: 748703 - protein, 392 aa, Homo sapiens
MVLLSILRILFLCELVLFMEHRAQMAEGGQSSIALLAEAPTLPLIEELLEESPGEQPRKPRLLGHSLRYMLELYRRSADSHGHPRENRTIGATMVRLVKPLTNVARPHRGTWHIQILGFPLRPNRGLYQLVRATVVYRHHLQLTRFNLSCHVEPWVQKNPTNHFPSSEGDSSKPSLMSNAWKEMDITQLVQQRFWNNKGHRILRLRFMCQQQKDSGGLELWHGTSSLDIAFLLLYFNDTHKSIRKAKFLPRGMEEFMERESLLRRTRQADGISAEVTASSSKHSGPENNQCSLHPFQISFRQLGWDHWIIAPPFYTPNYCKGTCLRVLRDGLNSPNHAIIQNLINQLVDQSVPRPSCVPYKYVPISVLMIEANGSILYKEYEGMIAESCTCR

SEQ ID NO: 748704 - protein, 364 aa, Homo sapiens
MAQQWSLQRLAGRHPQDSYEDSTQSSIFTYTNSNSTRGPFEGPNYHIAPRWVYHLTSVWMIFVVIASVFTNGLVLAATMKFKKLRHPLNWILVNLAVADLAETVIASTISVVNQVYGYFVLGHPMCVLEGYTVSLCGITGLWSLAIISWERWMVVCKPFGNVRFDAKLAIVGIAFSWIWAAVWTAPPIFGWSRYWPHGLKTSCGPDVFSGSSYPGVQSYMIVLMVTCCITPLSIIVLCYLQVWLAIRAVAKQQKESESTQKAEKEVTRMVVVMVLAFCFCWGPYAFFACFAAANPGYPFHPLMAALPAFFAKSATIYNPVIYVFMNRQFRNCILQLFGKKVDDGSELSSASKTEVSSVSSVSPA

SEQ ID NO: 748705 - protein, 527 aa, Homo sapiens
MILSSYNTIQSVFCCCCCCSVQKRQMRTQISLSTDEELPEKYTQHRRPWLSQLSNKKQSNTGRVQPSKRKPLPPLPPSEVAEEKIQVKALYDFLPREPCNLALRRAEEYLILEKYNPHWWKARDRLGNEGLIPSNYVTENKITNLEIYEWYHRNITRNQAEHLLRQESKEGAFIVRDSRHLGSYTISVFMGARRSTEAAIKHYQIKKNDSGQWYVAERHAFQSIPELIWYHQHNAAGLMTRLRYPVGLMGSCLPATAGFSYEKWEIDPSELAFIKEIGSGQFGVVHLGEWRSHIQVAIKAINEGSMSEEDFIEEAKVMMKLSHSKLVQLYGVCIQRKPLYIVTEFMENGCLLNYLRENKGKLRKEMLLSVCQDICEGMEYLERNGYIHRDLAARNCLVSSTCIVKISDFGMTRYVLDDEYVSSFGAKFPIKWSPPEVFLFNKYSSKSDVWSFGVLMWEVFTEGKMPFENKSNLQVVEAISEGFRLYRPHLAPMSIYEVMYSCWHEKPEGRPTFAELLRAVTEIAETW

SEQ ID NO: 748706 - protein, 214 aa, Homo sapiens
MFFFTRKLSHSKLVQLYGVCIQRKPLYIVTEFMENGCLLNYLRENKGKLRKEMLLSVCQDICEGMEYLERNGYIHRDLAARNCLVSSTCIVKISDFGMTRYVLDDEYVSSFGAKFPIKWSPPEVFLFNKYSSKSDVWSFGVLMWEVFTEGKMPFENKSNLQVVEAISEGFRLYRPHLAPMSIYEVMYSCWHEKPEGRPTFAELLRAVTEIAETW

SEQ ID NO: 748707 - protein, 428 aa, Homo sapiens
MLEGDLVSKMLRAVLQSHKNGVALPRLQGEYRSLTGDWIPFKQLGFPTLEAYLRSVPAVVRIETSRSGEITCYAMACTETARIAQLVARQRSSKRKTGRQVNCQMRVKKTMPFFLEGKPKATLRQPGFASNFSVGKKPNPAPLRDKGNSVGVKPDAEMSPYMLHTTLGNEAFKDIPVQRHVTMSTNNRFSPKASLQPPLQMHLSRTSTKEMSDNLNQTVEKPNVKPPASYTYKMDEVQNRIKEILNKHNNGIWISKLPHFYKELYKEDLNQGILQQFEHWPHICTVEKPCSGGQDLLLYPAKRKQLLRSELDTEKVPLSPLPGPKQTPPLKGCPTVMAGDFKEKVADLLVKYTSGLWASALPKAFEEMYKVKFPEDALKNLASLSDVCSIDYISGNPQKAILYAKLPLPTDKIQKDAGQAHGDNDIKA

SEQ ID NO: 748708 - protein, 156 aa, Homo sapiens
MVPKVKKEAPAPPKAEAKAKALKAKKAVLKGVHSHKKKKIRTSPTFRRPKTLRLRRQPKYPRKSAPRRNKLDHYAIIKFPLTTESAMKKIEDNNTLVFIVDVKANKHQIKQAVKKLYDIDVAKVNTLIRPDGEKKAYVRLAPDYDALDVANKIGII

SEQ ID NO: 748709 - protein, 124 aa, Homo sapiens
TGSTQHGDSHRLLLVTTCAKCEGHLQVTPCVQTIMATHICILKGYGGRAWFLPGYMNNTPGQANPLGPMQTRYCLLQPPDIRDCLSVAHRVYLCSFPMSQYGGAVLFFLPSYLLLNFSLLKTTP

SEQ ID NO: 748710 - protein, 511 aa, Homo sapiens
MDVCGWKEMEVALVNFDNSDEIQEEPGYATDFDSTSPKGRPGGSSFSNGKILISESTNHETAFSKLPGDYADPPGPEPVVLNEGNQRVIINIAGLRFETQLRTLSQFPETLLGDREKRMQFFDSMRNEYFFDRNRPSFDGILYYYQSGGKIRRPANVPIDIFADEISFYELGSEAMDQFREDEGFIKDPETLLPTNDIHRQFWLLFEYPESSSAARAVAVVSVLVVVISITIFCLETLPEFREDRELKVVRDPNLNMSKTVLSQTMFTDPFFMVESTCIVWFTFELVLRFVVCPSKTDFFRNIMNIIDIISIIPYFATLITELVQETEPSAQQNMSLAILRIIRLVRVFRIFKLSRHSKGLQILGQTLKASMRELGLLIFFLFIGVILFSSAVYFAEVDEPESHFSSIPDGFWWAVVTMTTVGYGDMCPTTPGGKIVGTLCAIAGVLTIALPVPVIVSNFNYFYHRETENEEKQNIPGEIERILNSVGSRMGSTDSLNKTNGGCSTEKSRK

SEQ ID NO: 748711 - protein, 286 aa, Homo sapiens
MWASLARATDHPRASTIFLSKSQTDVREKRKSNHLNHVSPGQLTKKYSSCSTIFLDDSTVSQPNLRTTVKCVTLAIYYHIKNRDANRSLDIFDERSHPLTREKVPEEYFKHDPEHKFIYRFVRTLFSAAQLTAECAIVTLVYLERLLTYAEIDICPTNWKRIVLGAILLASKVWDDQAVWNVDYCQILKDITVEDMNEMERHFLELLQFNINVPASVYAKYYFDLRSLADDNNLNFLFAPLSKERAQNLEAISRLCEDKDLCRAAMRRSFSADNFIGIQRSKAILS

SEQ ID NO: 748712 - protein, 126 aa, Homo sapiens
GTLKNEARVSSTSASEAVTFNLHPSSRVLGCRRDHKNEMERHFLELLQFNINVPASVYAKYYFDLRSLADDNNLNFLFAPLSKERAQNLEAISRLCEDKDLCRAAMRRSFSADNFIGIQRSKAILS

SEQ ID NO: 748713 - protein, 286 aa, Homo sapiens; identical to SEQ ID NO: 748711

SEQ ID NO: 748714 - protein, 286 aa, Homo sapiens; identical to SEQ ID NO: 748711

SEQ ID NO: 748715 - protein, 286 aa, Homo sapiens; identical to SEQ ID NO: 748711

SEQ ID NO: 748716 - protein, 264 aa, Homo sapiens
MWASLARATDHPRASTIFLSKSQTDVREKRKSNHLNHVSPGQLTKKYSSCSTIFLDDSTVSQPNLRTTVKCVTLAIYYHIKNRDANRSLDIFDERSHPLTREKVPEEYFKHDPEHKFIYRFVRTLFSAAQLTAECAIVTLVYLERLLTYAEIDICPTNWKRIVLGAILLASKVWDDQAVWNVDYCQILKDITVEDMNEMERHFLELLQFNINVPASVYAKYYFDLRSLADDNNLNFLFAPLSKERAQNLELVTLPFAPFSNGEK

SEQ ID NO: 748717 - protein, 326 aa, Homo sapiens
MGPPSACPHRECIPWQGLLLTASLLTFWNAPTTAWLFIASAPFEVAEGENVHLSVVYLPENLYSYGWYKGKTVEPNQLIAAYVIDTHVRTPGPAYSGRETISPSGDLHFQNVTLEDTGYYNLQVTYRNSQIEQASHHLRVYGECSKFDSEISEDAAWPQDTFCWSLYATESVAQPSIQASSTTVTEKGSVVLTCHTNNTGTSFQWIFNNQRLQVTKRMKLSWFNHVLTIDPIRQEDAGEYQCEVSNPVSSNRSDPLKLTVKYDNTLGILIGVLVGSLLVAALVCFLLLRKTGRASDQSDFREQQPPASTPGHGPSDSSISYGIATL

SEQ ID NO: 748718 - protein, 298 aa, Homo sapiens
MGPPSACPHRECIPWQGLLLTASLLTFWNAPTTAWLFIASAPFEVAEGENVHLSVVYLPENLYSYGWYKGKTVEPNQLIAAYVIDTHVRTPGPAYSGRETISPSGDLHFQNVTLEDTGYYNLQVTYRNSQIEQASHHLRVYESVAQPSIQASSTTVTEKGSVVLTCHTNNTGTSFQWIFNNQRLQVTKRMKLSWFNHVLTIDPIRQEDAGEYQCEVSNPVSSNRSDPLKLTVKYDNTLGILIGVLVGSLLVAALVCFLLLRKTGRASDQSDFREQQPPASTPGHGPSDSSISYGIATL

SEQ ID NO: 748719 - protein, 103 aa, Homo sapiens
SRAPTQTRRGHPCSRCTANPCQAQLPHPFWEKHGLQNEEGDQEPLWERLRPEAVPTLAPPALADWVPGPCAFHWAMGSTSPCIPSWSDPCQGPFLPAHGLQVA

SEQ ID NO: 748720 - protein, 359 aa, Homo sapiens
METQLSNGPTCNNTANGPTTINNNCSSPVDSGNTEDSKTNLIVNYLPQNMTQEELKSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGISRGVGFIRFDKRIEAEEAIKGLNGQKPPGATEPITVKFANNPSQKTNQAILSQLYQSPNRRYPGPLAQQAQRFRLDNLLNMAYGVKRFSPMTIDGMTSLAGINIPGHPGTGWCIFVYNLAPDADESILWQMFGPFGAVTNVKVIRDFNTNKCKGFGFVTMTNYDEAAMAIRSLNGYRLGDRVLQVSFKTNKTHKA

SEQ ID NO: 748721 - protein, 492 aa, Homo sapiens
SPASPCRHGPEGRSGRARAGGGRGAANSPPAPPPGALPSKPLLPAPLQTAGPRRLGVTEAVAGRVRRAVAGAARRGAGGAGVPPASSPLSRRRRRHRLSAELAPSDSSAAVLTASGTSRSSCSFESQQQVIAAMETQLSNGPTCNNTANGPTTINNNCSSPVDSGNTEDSKTNLIVNYLPQNMTQEELKSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGISRGVGFIRFDKRIEAEEAIKGLNGQKPPGATEPITVKFANNPSQKTNQAILSQLYQSPNRRYPGPLAQQAQRFRLDNLLNMAYGVKRFSPMTIDGMTSLAGINIPGHPGTGWCIFVYNLAPDADESILWQMFGPFGAVTNVKVIRDFNTNKCKGFGFVTMTNYDEAAMAIRSLNGYRLGDRVLQVSFKTNKTHKA

SEQ ID NO: 748722 - protein, 359 aa, Homo sapiens; identical to SEQ ID NO: 748720

SEQ ID NO: 748723 - protein, 224 aa, Homo sapiens
MTQKELEQLFSQYGRIITSRILVDQVTGISRGVGFIRFDKRIEAEEAIKGLNGQKPPGATEPITVKFANNPSQKTNQAILSQLYQSPNRRYPGPLAQQAQRFRLDNLLNMAYGVKRFSPMTIDGMTSLAGINIPGHPGTGWCIFVYNLAPDADESILWQMFGPFGAVTNVKVIRDFNTNKCKGFGFVTMTNYDEAAMAIRSLNGYRLGDRVLQVSFKTNKTHKA

SEQ ID NO: 748724 - protein, 346 aa, Homo sapiens [sequence omitted]

SEQ ID NO: 748725 - protein, 373 aa, Homo sapiens
MTKQYEVAVQVIAAMETQLSNGPTCNNTANGPTTINNNCSSPVDSGNTEDSKTNLIVNYLPQNMTQEELKSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGISRGVGFIRFDKRIEAEEAIKGLNGQKPPGATEPITVKFANNPSQKTNQAILSQLYQSPNRRYPGPLAQQAQRFRLDNLLNMAYGVKRFSPMTIDGMTSLAGINIPGHPGTGWCIFVYNLAPDADESILWQMFGPFGAVTNVKVIRDFNTNKCKGFGFVTMTNYDEAAMAIRSLNGYRLGDRVLQVSFKTNKTHKA

SEQ ID NO: 748726 - protein, 359 aa, Homo sapiens; identical to SEQ ID NO: 748720

SEQ ID NO: 748727 - protein, 30 aa, Homo sapiens
MGTLRAAGQTTKAGHNTGDPQRRGFHQATH

SEQ ID NO: 748728 - protein, 343 aa, Homo sapiens
MPNPASRVEIQAGCGRVGLSSWGSAQLSHLASRTPTAGATGTQGGLEDGLALPVCYTHRGHARNAEGDAAATFQSTKTPRRPVHLPRECQPGRDTHTAEAGPDPRANPWVPLEGARQEEMAHKHWGRNRRGGSKGTRPLTSDPTTSREAISVVMVVPGLALPAPTPTTQSLHPVTPPSCDLPLPSISHAFPSPPSGSLPSLWPPVPTSHAPSRGNLCQGSLHFLAPASLPGTQAGPGTLVLNKGTRLNDVGGNLPSVGTGANTTHCQHGPRATPPQASTSSPEEARGSTGHAPEWEVTHGEGSLVPRGLAVSLLRCRAHYGPRRGLSRVISSFTAAVGPADIS

SEQ ID NO: 748729 - protein, 170 aa, Homo sapiens
MGPCAPIQAAQTRRAQVSRTHDGSLPSLWPPVPTSHAPSRGNLCQGSLHFLAPASLPGTQAGPGTLVLNKGTRLNDVGGNLPSVGTGANTTHCQHGPRATPPQASTSSPEEARGSTGHAPEWEVTHGEGSLVPRGLAVSLLRCRAHYGPRRGLSRVISSFTAAVGPADIS

SEQ ID NO: 748730 - protein, 329 aa, Homo sapiens
MPNPASRVEIQAGCGRVGLSSWGSAQLSHLASRTPTAGATGTQGGLEDGLALPVCYTHRGHARNAEGDAAATFQSTKTPRRPVHLPRECQPGRDTHTAEAGPDPRANPWVPLEGARQEEMAHKHWGRNRRGGSKGTRPLTSDPTTSREAISVVMVVPGLALPAPTPTTQSLHPVTPPSCDLPLPSISHAFPSPPSGSLPSLWPPVPTSHAPSRGNLCQGSLHFLAPASLPGTQAGPGTLVLNKGTRLNDVGGNLPSVGTGANTTHCQHGPRATPPQASTSSPEEARGSTGHAPEWEVTHGAYNGIGLIREKEEILTHAPAWRNLEDDAE

SEQ ID NO: 748731 - protein, 146 aa, Homo sapiens
RTCWSCSDPLGNIDGKGPIGSKDVGDWSETPRYHSSEFQLREPMQDCKAVDSLVPIGRGQRELIIGDRQTGKTSIAIDTIINQKRFNDGSDEKKKLYCIYVAIGQKRSTVAQLVKRLTDADAMKYTIVVSATASDAAPLQYLAPYS

SEQ ID NO: 748732 - protein, 119 aa, Homo sapiens
MGNVLQSSSDAIYLARHVGLRVGIPKETPALTINRLCGSGFQSIVNGCQEICVKEAEVVLCGGTESMSQAPYCVRNVRFGTKLGSDIKFLTWPFWKLKGMGLKRIYADFSHQTHLRYLL

SEQ ID NO: 748733 - protein, 104 aa, Homo sapiens
CSWSTGMQLRYNISQLEEWLRGRNLHQSGAVQTMEPLIQAAQLLQLKKKTQEDAEAICSLCTSLSTQQIVKILNLYTPLNEFEERVTVAFIRTIQGSFSGGTNP

SEQ ID NO: 748734 - protein, 397 aa, Homo sapiens
MALLRGVFVVAAKRTPFGAYGGLLKDFTATDLSEFAAKAALSAGKVSPETVDSVIMGNVLQSSSDAIYLARHVGLRVGIPKETPALTINRLCGSGFQSIVNGCQEICVKEAEVVLCGGTESMSQAPYCVRNVRFGTKLGSDIKLEDSLWVSLTDQHVQLPMAMTAENLAVKHKISREECDKYALQSQQRWKAANDAGYFNDEMAPIEVKTKKGKQTMQVDEHARPQTTLEQLQKLPPVFKKDGTVTAGNASGVADGAGAVIIASEDAVKKHNFTPLARIVGYFVSGCDPSIMGIGPVPAISGALKKAGLSLKDMDLVEVNEAFAPQYLAVERSLDLDISKTNVNGGAIALGHPLGGSGSRITAHLVHELRRRGGKYAVGSACIGGGQGIAVIIQSTA

SEQ ID NO: 748735 - protein, 397 aa, Homo sapiens; identical to SEQ ID NO: 748734

SEQ ID NO: 748736 - protein, 397 aa, Homo sapiens; identical to SEQ ID NO: 748734

SEQ ID NO: 748737 - protein, 397 aa, Homo sapiens; identical to SEQ ID NO: 748734

SEQ ID NO: 748738 - protein, 397 aa, Homo sapiens; identical to SEQ ID NO: 748734

SEQ ID NO: 748739 - protein, 236 aa, Homo sapiens
MALLRGVFVVAAKRTPFGAYGGLLKDFTATDLSEFAAKAALSAGKVSPETVDSVIMGNVLQSSSDAIYLARHVGLRVGIPKETPALTINRLCGSGFQSIVNGCQEICVKEAEVVLCGGTESMSQAPYCVRNVRFGTKLGSDIKLEDSLWVSLTDQHVQLPMAMTAENLAVKHKISREECDKYALQSQQRWKAANDAGYFNDEMAPIEVKTKKGVTETSSSIQERWNCYCRECIGCS

SEQ ID NO: 748740 - protein, 342 aa, Homo sapiens
MGNVLQSSSDAIYLARHVGLRVGIPKETPALTINRLCGSGFQSIVNGCQEICVKEAEVVLCGGTESMSQAPYCVRNVRFGTKLGSDIKLEDSLWVSLTDQHVQLPMAMTAENLAVKHKISREECDKYALQSQQRWKAANDAGYFNDEMAPIEVKTKKGKQTMQVDEHARPQTTLEQLQKLPPVFKKDGTVTAGNASGVADGAGAVIIASEDAVKKHNFTPLARIVGYFVSGCDPSIMGIGPVPAISGALKKAGLSLKDMDLVEVNEAFAPQYLAVERSLDLDISKTNVNGGAIALGHPLGGSGSRITAHLVHELRRRGGKYAVGSACIGGGQGIAVIIQSTA

SEQ ID NO: 748741 - protein, 394 aa, Homo sapiens
MMGVFVVAAKRTPFGAYGGLLKDFTATDLSEFAAKAALSAGKVSPETVDSVIMGNVLQSSSDAIYLARHVGLRVGIPKETPALTINRLCGSGFQSIVNGCQEICVKEAEVVLCGGTESMSQAPYCVRNVRFGTKLGSDIKLEDSLWVSLTDQHVQLPMAMTAENLAVKHKISREECDKYALQSQQRWKAANDAGYFNDEMAPIEVKTKKGKQTMQVDEHARPQTTLEQLQKLPPVFKKDGTVTAGNASGVADGAGAVIIASEDAVKKHNFTPLARIVGYFVSGCDPSIMGIGPVPAISGALKKAGLSLKDMDLVEVNEAFAPQYLAVERSLDLDISKTNVNGGAIALGHPLGGSGSRITAHLVHELRRRGGKYAVGSACIGGGQGIAVIIQSTA

SEQ ID NO: 748742 - protein, 264 aa, Homo sapiens
MWRNRKHEPSSLLCQKCAFWNQAWIRYQAGRFFMGIINRSACPAPHGNDCRESCCKTQNTNDAGYFNDEMAPIEVKTKKGKQTMQVDEHARPQTTLEQLQKLPPVFKKDGTVTAGNASGVADGAGAVIIASEDAVKKHNFTPLARIVGYFVSGCDPSIMGIGPVPAISGALKKAGLSLKDMDLVEVNEAFAPQYLAVERSLDLDISKTNVNGGAIALGHPLGGSGSRITAHLVHELRRRGGKYAVGSACIGGGQGIAVIIQSTA

SEQ ID NO: 748743 - protein, 342 aa, Homo sapiens; identical to SEQ ID NO: 748740

SEQ ID NO: 748744 - protein, 342 aa, Homo sapiens; identical to SEQ ID NO: 748740

SEQ ID NO: 748745 - protein, 414 aa, Homo sapiens
PGVNRRGQTRAATTSSRMALLRGVFVVAAKRTPFGAYGGLLKDFTATDLSEFAAKAALSAGKVSPETVDSVIMGNVLQSSSDAIYLARHVGLRVGIPKETPALTINRLCGSGFQSIVNGCQEICVKEAEVVLCGGTESMSQAPYCVRNVRFGTKLGSDIKLEDSLWVSLTDQHVQLPMAMTAENLAVKHKISREECDKYALQSQQRWKAANDAGYFNDEMAPIEVKTKKGKQTMQVDEHARPQTTLEQLQKLPPVFKKDGTVTAGNASGVADGAGAVIIASEDAVKKHNFTPLARIVGYFVSGCDPSIMGIGPVPAISGALKKAGLSLKDMDLVEVNEAFAPQYLAVERSLDLDISKTNVNGGAIALGHPLGGSGSRITAHLVHELRRRGGKYAVGSACIGGGQGIAVIIQSTA

SEQ ID NO: 748746 - protein, 360 aa, Homo sapiens
MALLRGVFVVAAKRTPFGAYGGLLKDFTATDLSEFAAKAALSAGKVSPETVDSVIMGNVLQSSSDAIYLARHVGLRVGIPKETPALTINRLCGSGFQSIVNGCQEICVKEAEVVLCGGTESMSQAPYCVRNVRFGTKLGSDIKLEDSLWVSLTDQHVQLPMAMTAENLAVKHKISREECDKYALQSQQRWKAANDAGYFNDEMAPIEVKTKKGKQTMQVDEHARPQTTLEQLQKLPPVFKKDGTVTAGNASGVAGGAGTGTHKLVEELWYETYISPHGQELGARYEILEVIPSNRRMGQSRQQGAMSSERFMTRIASAEHDPKGVQRGHRHKHRRSWKDQERQTAGRHTENKREVDNEHA

SEQ ID NO: 748747 - protein, 354 aa, Homo sapiens
MALLRGVFVVAAKRTPFGAYGGLLKDFTATDLSEFAAKAALSAGKVSPETVDSVIMGNVLQEICVKEAEVVLCGGTESMSQAPYCVRNVRFGTKLGSDIKLEDSLWVSLTDQHVQLPMAMTAENLAVKHKISREECDKYALQSQQRWKAANDAGYFNDEMAPIEVKTKKGKQTMQVDEHARPQTTLEQLQKLPPVFKKDGTVTAGNASGVADGAGAVIIASEDAVKKHNFTPLARIVGYFVSGCDPSIMGIGPVPAISGALKKAGLSLKDMDLVEVNEAFAPQYLAVERSLDLDISKTNVNGGAIALGHPLGGSGSRITAHLVHELRRRGGKYAVGSACIGGGQGIAVIIQSTA

SEQ ID NO: 748748 - protein, 276 aa, Homo sapiens [sequence omitted]

SEQ ID NO: 748749 - protein, 171 aa, Homo sapiens
MVLELLQKLPPVFKKDGTVTAGNASGVADGAGAVIIASEDAVKKHNFTPLARIVGYFVSGCDPSIMGIGPVPAISGALKKAGLSLKDMDLVEVNEAFAPQYLAVERSLDLDISKTNVNGGAIALGHPLGGSGSRITAHLVHELRRRGGKYAVGSACIGGGQGIAVIIQSTA

SEQ ID NO: 748750 - protein, 173 aa, Homo sapiens
MALLRGVFVVAAKRTPFGAYGGLLKDFTATDLSEFAAKAALSAGKVSPETVDSVIMGNVLQSSSDAIYLARHVGLRVGIPKETPALTINRLCGSGFQSIVNGCQEICVKEAEVVLCGGTESMSQAPYCVRNVRFGTKLGSDIKGFLMVIKLDKLWSRFSLSMNWRGFVCTTFS

SEQ ID NO: 748751 - protein, 139 aa, Homo sapiens
MALLRGVFVVAAKRTPFGAYGGLLKDFTATDLSEFAAKAALSAGKVSPETVDSVIMGNVLQSSSDAIYLARHVGLRVGIPKETPALTINRLCGSGFQSIVNGCQEICVKEAEVVLCGGTESMSQAPYCVITDNMPAPME

SEQ ID NO: 748752 - protein, 145 aa, Homo sapiens
CSWSTGMQLRYNISQLEEWLRGRNLHQSGAVQTMEPLIQAAQLLQLKKKTQEDAEAICSLCTSLSTQQIVKILNLYTPLNEFEERVTVAFIRTIQAQLQERNDPQQLLLDAKHMFPVLFPFNPSSLTMDSIHIPACLNLEFLNEV

SEQ ID NO: 748753 - protein, 565 aa, Homo sapiens
LRAAGGGRTMPSFDEALQRVGEFGRFQRRVFLLLCLTGVTFAFLFVGVVFLGTQPDHYWCRGPSAAALAERCGWSPEEEWNRTAPASRGPEPPERRGRCQRYLLEAANDSASATSALSCADPLAAFPNRSAPLVPCRGGWRYAQAHSTIVSEFDLVCVNAWMLDLTQAILNLGFLTGAFTLGYAADRYGRIVIYLLSCLGVGVTGVVVAFAPNFPVFVIFRFLQGVFGKGTWMTCYVIVTEIVGSKQRRIVGIVIQMFFTLGIIILPGIAYFIPNWQGIQLAITLPSFLFLLYYWVVPESPRWLITRKKGDKALQILRRIAKCNGKYLSSNYSEITVTDEEVSNPSFLDLVRTPQMRKCTLILMFAWFTSAVVYQGLVMRLGIIGGNLYIDFFISGVVELPGALLILLTIERLGRRLPFAASNIVAGVACLVTAFLPEGIAWLRTTVATLGRLGITMAFEIVYLVNSELYPTTLRNFGVSLCSGLCDFGGIIAPFLLFRLAAVWLELPLIIFGILASICGGLVMLLPETKGIALPETVDDVEKLGSPHSCKCGRNKKTPVSRSHL

SEQ ID NO: 748754 - protein, 565 aa, Homo sapiens; identical to SEQ ID NO: 748753

SEQ ID NO: 748755 - protein, 656 aa, Homo sapiens
VLSDIKSIGLYLRSQKIPLYEECQLLVRKGFDFQRKQYGKLKKFTTVNPEFYNEPKTKLYLKLSRKERSSAYSKNDLWVVSKTLDFELDTFIACSAFFGPSSINEIEILPLKGYFPSNWPTNMVVHALLVCNASTELTTLKNIQDYFNPATLPLTQYLLTTSSPTIVSNKRVSKRKFIPPAFTNVSTKFELLSLGATLKLASELIQVHKLNKDQATALIQIAQMMASHESIEEVKELQTHTFPITIIHGVFGAGKSYLLAVVILFFVQLFEKSEAPTIGNARPWKLLISSSTNVAVDRVLLGLLSLGFENFIRVGSVRKIAKPILPYSLHAGSENESEQLKELHALMKEDLTPTERVYVRKSIEQHKLGTNRTLLKQVWCEKLILVGDPKQLPPTIQGSDAAHENGLEQTLFDRLCLMGHKPILLRTQYRCHPAISAIANDLFYKGALMNGVTEIERSPLLEWLPTLCFYNVKGLEQIERDNSFHNVAEATFTLKLIQSLIASGIAGSMIGVITLYKSQMYKLCHLLSAVDFHHPDIKTVQVSTVDAFQGAEKEIIILSCVRTRQVGFIDSEKRMNVALTRGKRHLLIVGNLACLRKNQLWGRVIQHCEGREDGLQHANQYEPQLNHLLKDYFEKQVEEKQKKKSEKEKSKDKSHS

SEQ ID NO: 748756 - protein, 510 aa, Homo sapiens
MPLFLKLFICFIFIRSSPTIVSNKRVSKRKFIPPAFTNVSTKFELLSLGATLKLASELIQVHKLNKDQATALIQIAQMMASHESIEEVKELQTHTFPITIIHGVFGAGKSYLLAVVILFFVQLFEKSEAPTIGNARPWKLLISSSTNVAVDRVLLGLLSLGFENFIRVGSVRKIAKPILPYSLHAGSENESEQLKELHALMKEDLTPTERVYVRKSIEQHKLGTNRTLLKQVWCEKLILVGDPKQLPPTIQGSDAAHENGLEQTLFDRLCLMGHKPILLRTQYRCHPAISAIANDLFYKGALMNGVTEIERSPLLEWLPTLCFYNVKGLEQIERDNSFHNVAEATFTLKLIQSLIASGIAGSMIGVITLYKSQMYKLCHLLSAVDFHHPDIKTVQVSTVDAFQGAEKEIIILSCVRTRQVGFIDSEKRMNVALTRGKRHLLIVGNLACLRKNQLWGRVIQHCEGREDGLQHANQYEPQLNHLLKDYFEKQVEEKQKKKSEKEKSKDKSHS

SEQ ID NO: 748757 - protein, 161 aa, Homo sapiens
VLSDIKSIGLYLRSQKIPLYEECQLLVRKGFDFQRKQYGKLKKFTTVNPEFYNEPKTKLYLKLSRKERSSAYSKNDLWVVSKTLDFELDTFIACSAFFGPSSINEIEILPLKGYFPSNWPTNMVVHALLVCNASTELTTLKNIQDYFNPATLPLTQYLLTT

SEQ ID NO: 748758 - protein, 510 aa, Homo sapiens; identical to SEQ ID NO: 748756

SEQ ID NO: 748759 - protein, 448 aa, Homo sapiens
RSERPVHVQAAADHIPSSTMAQPGTLNLNNEVVKMRKEVKRIRVLVIRKLVRSVGRLKSKKGTEDALLKNQRRAQRLLEEIHAMKELKPDIVTKSALGDDINFEKIFKKPDSTATERAIARLAVHPLLKKKIDVLKAAVQAFKEARQNVAEVESSKNASEDNHSENTLYSNDNGSNLQREATVISEQKVKETKILAKKPIHNSKEKIAKMEHGPKAVTIANSPSKPSEKDSVVSLESQKTPADPKLKTLSQTKKNKGSDSSLSGNSDGGEEFCEEEKEYFDDSTEERFYKQSSMSEDSDSGDDFFIGKVRRTRKKESSCHSSVKEQKPLEKVFLKEDTGETHGDTRNDKIKPSTETRKLESVFFHSLSGSKSSRRNFKEQAPKTRSLDFPQNEPQIKNQFNKKLSGRLENTKQQLQLPLHPSWEASRRRKEQQSNIAVFQGKKITFDD

SEQ ID NO: 748760 - protein, 592 aa, Homo sapiens
AASPPALQTWRGGTRWALPRVLGRLSDTKMSDDAGDTLATGDKAEVTEMPNSDSLPEDAEVHCDSAAVSHEPTPADPRGEGHENAAVQGAGAAAIGPPVQPQDANALEPPLNGDVTEDTLAECIDSVSLEAEPRSEIPLQEQNYLAVDSPPSGGGWAGWGSWGKSLLSSASATVGHGLTAVKEKAGATLRIHGVNSGSSEGAQPNTENGVPEITDAATDQGPAESPPTSPSSASRGMLSAITNVVQNTGKSVLTGGLDALEFIGKKTMNVLAESDPGFKRTKTLMERTVSLSQMLREAKEKEKQRLAQQLTMERTAHYGMLFDEYQGLSHLEALEILSNESESKVQSFLASLDGEKLELLKNDLISIKDIFAAKELENEENQEEQGLEEKGEEFARMLTELLFELHVAATPDKLNKAMKRAHDWVEEDQTVVSVDVAKVSEEETKKEEKEEKSQDPQEDKKEEKKTKTIEEVYMSSIESLAEVTARCIEQLHKVAELILHGQEEEKPAQDQAKVLIKLTTAMCNEVASLSKKFTNSLTTVGSNKKAEVLNPMISSVLLEGCNSTTYIQDAFQLLLPVLQVSHIQTSCLKAQP

SEQ ID NO: 748761 - protein, 563 aa, Homo sapiens
MSDDAGDTLATGDKAEVTEMPNSDSLPEDAEVHCDSAAVSHEPTPADPRGEGHENAAVQGAGAAAIGPPVQPQDANALEPPLNGDVTEDTLAECIDSVSLEAEPRSEIPLQEQNYLAVDSPPSGGGWAGWGSWGKSLLSSASATVGHGLTAVKEKAGATLRIHGVNSGSSEGAQPNTENGVPEITDAATDQGPAESPPTSPSSASRGMLSAITNVVQNTGKSVLTGGLDALEFIGKKTMNVLAESDPGFKRTKTLMERTVSLSQMLREAKEKEKQRLAQQLTMERTAHYGMLFDEYQGLSHLEALEILSNESESKVQSFLASLDGEKLELLKNDLISIKDIFAAKELENEENQEEQGLEEKGEEFARMLTELLFELHVAATPDKLNKAMKRAHDWVEEDQTVVSVDVAKVSEEETKKEEKEEKSQDPQEDKKEEKKTKTIEEVYMSSIESLAEVTARCIEQLHKVAELILHGQEEEKPAQDQAKVLIKLTTAMCNEVASLSKKFTNSLTTVGSNKKAEVLNPMISSVLLEGCNSTTYIQDAFQLLLPVLQVSHIQTSCLKAQP

SEQ ID NO: 748762 - protein, 592 aa, Homo sapiens; identical to SEQ ID NO: 748760

SEQ ID NO: 748763 - protein, 221 aa, Homo sapiens
MKNKSRFFCRVLFLGLEEKGEEFARMLTELLFELHVAATPDKLNKAMKRAHDWVEEDQTVVSVDVAKVSEEETKKEEKEEKSQDPQEDKKEEKKTKTIEEVYMSSIESLAEVTARCIEQLHKVAELILHGQEEEKPAQDQAKVLIKLTTAMCNEVASLSKKFTNSLTTVGSNKKAEVLNPMISSVLLEGCNSTTYIQDAFQLLLPVLQVSHIQTSCLKAQP

SEQ ID NO: 748764 - protein, 130 aa, Homo sapiens
LACVYSFQEVYMSSIESLAEVTARCIEQLHKVAELILHGQEEEKPAQDQAKVLIKLTTAMCNEVASLSKKFTNSLTTVGSNKKAEVLNPMISSVLLEGCNSTTYIQDAFQLLLPVLQVSHIQTSCLKAQP

SEQ ID NO: 748765 - protein, 119 aa, Homo sapiens [sequence omitted]

SEQ ID NO: 748766 - protein, 67 aa, Homo sapiens
DAWVDPRVRNSLTTVGSNKKAEVLNPMISSVLLEGCNSTTYIQDAFQLLLPVLQVSHIQTSCLKAQP

SEQ ID NO: 748767 - protein, 592 aa, Homo sapiens; identical to SEQ ID NO: 748760

SEQ ID NO: 748768 - protein, 561 aa, Homo sapiens
AASPPALQTWRGGTRWALPRVLGRLSDTKMSDDAGDTLATGDKAEVTEMPNSDSLPEDAEVHCDSAAVSHEPTPADPRGEGHENAAVQGAGAAAIGPPVQPQDANALEPPLNGDVTEDTLAECIDSVSLEAEPRSEIPLQEQNYLAVDSPPSGGGWAGWGSWGKSLLSSASATVGHGLTAVKEKAGATLRIHGVNSGSSEGAQPNTENGVPEITDAATDQGPAESPPTSPSSASRGMLSAITNVVQNTGKSVLTGGLDALEFIGKKTMNVLAESDPGFKRTKTLMERTVSLSQMLREAKEKEKQRLAQQLTMERTAHYGMLFDEYQGLSHLEALEILSNESESKVQSFLASLDGEKLELLKNDLISIKDIFAAKELENEENQEEQGLEEKGEEFARMLTELLFELHVAATPDKLNKAMKRAHDWVEEDQTVVSVDVAKVSEEETKKEEKEEKSQDPQEDKKEEKKTKTIEEVYMSSIESLAEVTARCIEQLHKVAELILHGQEEEKPAQDQAKVLIKLTTAMCNEVASLSKKFTNSLTTVGAFSNRASLYTSRMTREVEAH

SEQ ID NO: 748769 - protein, 376 aa, Homo sapiens
AASPPALQTWRGGTRWALPRVLGRLSDTKMSDDAGDTLATGDKAEVTEMPNSDSLPEDAEVHCDSAAVSHEPTPADPRGEGHENAAVQGAGAAAIGPPVQPQDANALEPPLNGDVTEDTLAECIDSVSLEAEPRSEIPLQEQNYLAVDSPPSGGGWAGWGSWGKSLLSSASATVGHGLTAVKEKAGATLRIHGVNSGSSEGAQPNTENGVPEITDAATDQGPAESPPTSPSSASRGMLSAITNVVQNTGKSVLTGGLDALEFIGKKTMNVLAESDPGFKRTKTLMERTVSLSQMLREAKEKEKQRLAQQLTMERTAHYGMLFDEYQGLSHLEALEILSNESESKVLLHYSFEMACLVMCCLNMKETGKSAIKRSHF

SEQ ID NO: 748770 - protein, 101 aa, Homo sapiens
THICPVVRIQFSRALWVSTCLVLAITPGKWLLPEDRALSLMLLASLQCCPPPFGAWWIQVLTHKGRQAGLGPGCPPGPSDGRDQRDLGKLHSLCLSVLSGD

SEQ ID NO: 748771 - protein, 372 aa, Homo sapiens
GTGPKVRKSEGSEGFCCANAVTEGSAHARLILPEDGATGGCGIRAPCPALCLPAQAGHSAGRPPSAAHRASHAARNHYEVLVLGGGSGGITMAARMKRKVGAENVAIVEPSERHFYQPIWTLVGAGAKQLSSSGRPTASVIPSGVEWIKARVTELNPDKNCIHTDDDEKISYRYLIIALGIQLDYEKIKGLPEGFAHPKIGSNYSVKTVEKTWKALQDFKEGNAIFTFPNTPVKCAGAPQKIMYLSEAYFRKTGKRSKANIIFNTSLGAIFGVKKYADALQEIIQERNLTVNYKKNLILKCFMFTPPMSPPDVLKTSPVADAAGWVDVDKETLATQEVPQLCLGLGAAPTFLRQRPLLAVACPSQEYLIEQF

SEQ ID NO: 748772 - protein, 363 aa, Homo sapiens
MVPLVAVVSGPRAQLFACLLRLGTQQVGPLQLHTGASHAARNHYEVLVLGGGSGGITMAARMKRKVGAENVAIVEPSERHFYQPIWTLVGAGAKQLSSSGRPTASVIPSGVEWIKARVTELNPDKNCIHTDDDEKISYRYLIIALGIQLDYEKIKGLPEGFAHPKIGSNYSVKTVEKTWKALQDFKEGNAIFTFPNTPVKCAGAPQKIMYLSEAYFRKTGKRSKANIIFNTSLGAIFGVKKYADALQEIIQERNLTVNYKKNLIEVRADKQEAVFENLDKPGETQVIFILKCFMFTPPMSPPDVLKTSPVADAAGWVDVDKETLATQEVPQLCLGLGAAPTFLRQRPLLAVACPSQEYLIEQF

SEQ ID NO: 748773 - protein, 153 aa, Homo sapiens [sequence omitted]

SEQ ID NO: 748774 - protein, 266 aa, Homo sapiens
YVALAQRKEECQAHLTNQYMQRMASVRAVPNLEINPYQPAPPSGYFMAAIPQTQNGAAYYPPSQIAQLRPSPRWTAEGARPHPFQNRPSAIRPAAPRPPFSTMRPASSQVPGVMSTQRVANTSTQTMGPRPAAAAAATPHYNYAAGVRSPQKHLNAQPQVTMQQPAAHVQGQEPLTASMLVSAHAQEQKQMLGERLFPLIQAMHLTLAGKITGMLLEIGNSELLHMLESPESLRSKVNETVAVLQAHQAEVAAQKAVNRATGVPTV

SEQ ID NO: 748775 - protein, 109 aa, Homo sapiens
MRAAHPGLTLLQLIHKQKGGYTESQRPMGRDQHSTESIRSNSKLFIMNTECGQTHDCACPRRFAEGNCFLTPSSLRLSIGTSRECSLASLLWTEQLTPSSTSLHTISFA

SEQ ID NO: 748776 - protein, 125 aa, Homo sapiens
MRAAHPGLTLLQLIHKQKGGYTESQRPMGRDQHSTESIRSNSKLFIMNTECGQTHDCACPRRFAEGNCFLTPSSLRLSIGTSRECSLASLLWTEQLTPSSTSLLSSSPLLSSSPLLSSFSPSVVF

SEQ ID NO: 748777 - protein, 113 aa, Homo sapiens [sequence omitted]

SEQ ID NO: 748778 - protein, 75 aa, Homo sapiens
PPVNLPPPPPPNVGLPGVKPPPVPRPSNPGFTKMAWVIPHASLKYENLIPVEELKPNNLPHQNYGGEGVGIRYVR

SEQ ID NO: 748779 - protein, 487 aa, Homo sapiens
MGCLWGLALPLFFFCWEVGVSGSSAGPSTRRADTAMTTDDTEVPAMTLAPGHAALETQTLSAETSSRASTPAGPIPEAETRGAKRISPARETRSFTKTSPNFMVLIATSVETSAASGSPEGAGMTTVQTITGSDPEEAIFDTLCTDDSSEEAKTLTMDILTLAHTSTEAKGLSSESSASSDGPHPVITPSRASESSASSDGPHPVITPSRASESSASSDGPHPVITPSWSPGSDVTLLAEALVTVTNIEVINCSITEIETTTSSIPGASDIDLIPTEGVKASSTSDPPALPDSTEAKPHITEVTASAETLSSALSVETPSYVKVSGAAPVSIEAGSAVGKTTSFAGSSASSYSPSEAALKNFTPSETPTMDIATKGPFPTSRDPLPSVPPTTTNSSRGTNSTLAKITTSAKTTMKPPTATPTTARTRPTTDVSAGENGGFLLLRLSVASPEDLTDPRVAERLMQQLHRELHAHAPHFQVSLLRVRRG

SEQ ID NO: 748780 - protein, 75 aa, Homo sapiens
LWRAHGPDGLKGQLALLLSSSTGNSTPTRLTSRSPYCVSGEANGHQLQPGMSRMPKEGAAPSLGPHRQTAAALLC

SEQ ID NO: 748781 - protein, 107 aa, Homo sapiens
VLLLLLWLSLGVKTGSCSQPQNLCCLGTDHHCKRGSCYCDEFCHVAPDCHPDHSVLCNPASQMTKMVLQMVLRMENPPSPARSHLDWMQSMIVKIVPGEQQEEDGDP

SEQ ID NO: 748782 - protein, 538 aa, Homo sapiens
MGCLWGLALPLFFFCWEVGVSGSSAGPSTRRADTAMTTDDTEVPAMTLAPGHAALETQTLSAETSSRASTPAGPIPEAETRGAKRISPARETRSFTKTSPNFMVLIATSVETSAASGSPEGAGMTTVQTITGSDPEEAIFDTLCTDDSSEEAKTLTMDILTLAHTSTEAKGLSSESSASSDGPHPVITPSRASESSASSDGPHPVITPSRASESSASSDGPHPVITPSWSPGSDVTLLAEALVTVTNIEVINCSITEIETTTSSIPGASDIDLIPTEGVKASSTSDPPALPDSTEAKPHITEVTASAETLSTAGTTESAAPHATVGTPLPTNSATEREVTAPGATTLSGALVTVSRNPLEETSALSVETPSYVKVSGAAPVSIEAGSAVGKTTSFAGSSASSYSPSEAALKNFTPSETPTMDIATKGPFPTSRDPLPSVPPTTTNSSRGTNSTLAKITTSAKTTMKPPTATPTTARTRPTTDVSAGENGGFLLLRLSVASPEDLTDPRVAERLMQQLHRELHAHAPHFQVSLLRVRRG

SEQ ID NO: 748783 - protein, 503 aa, Homo sapiens
MTTDDTEVPAMTLAPGHAALETQTLSAETSSRASTPAGPIPEAETRGAKRISPARETRSFTKTSPNFMVLIATSVETSAASGSPEGAGMTTVQTITGSDPEEAIFDTLCTDDSSEEAKTLTMDILTLAHTSTEAKGLSSESSASSDGPHPVITPSRASESSASSDGPHPVITPSRASESSASSDGPHPVITPSWSPGSDVTLLAEALVTVTNIEVINCSITEIETTTSSIPGASDIDLIPTEGVKASSTSDPPALPDSTEAKPHITEVTASAETLSTAGTTESAAPHATVGTPLPTNSATEREVTAPGATTLSGALVTVSRNPLEETSALSVETPSYVKVSGAAPVSIEAGSAVGKTTSFAGSSASSYSPSEAALKNFTPSETPTMDIATKGPFPTSRDPLPSVPPTTTNSSRGTNSTLAKITTSAKTTMKPPTATPTTARTRPTTDVSAGENGGFLLLRLSVASPEDLTDPRVAERLMQQLHRELHAHAPHFQVSLLRVRRG

SEQ ID NO: 748784 - protein, 503 aa, Homo sapiens; identical to SEQ ID NO: 748783

SEQ ID NO: 748785 - protein, 538 aa, Homo sapiens; identical to SEQ ID NO: 748782

SEQ ID NO: 748786 - protein, 522 aa, Homo sapiens
MTTDDTEVPAMTLAPGHAALETQTLSAETSSRASTPAGPIPEAETRGAKRISPARETRSFTKTSPNFMVLIATSVETSAASGSPEGAGMTTVQTITGSDPEEAIFDTLCTDDSSEEAKTLTMDILTLAHTSTEAKGLSSESSASSDGPHPVITPSRASESSASSDGPHPVITPSRASESSASSDGPHPVITPSRASESSASSDGPHPVITPSWSPGSDVTLLAEALVTVTNIEVINCSITEIETTTSSIPGASDIDLIPTEGVKASSTSDPPALPDSTEAKPHITEVTASAETLSTAGTTESAAPHATVGTPLPTNSATEREVTAPGATTLSGALVTVSRNPLEETSALSVETPSYVKVSGAAPVSIEAGSAVGKTTSFAGSSASSYSPSEAALKNFTPSETPTMDIATKGPFPTSRDPLPSVPPTTTNSSRGTNSTLAKITTSAKTTMKPPTATPTTARTRPTTDVSAGENGGFLLLRLSVASPEDLTDPRVAERLMQQLHRELHAHAPHFQVSLLRVRRG

SEQ ID NO: 748787 - protein, 503 aa, Homo sapiens; identical to SEQ ID NO: 748783

SEQ ID NO: 748788 - protein, 557 aa, Homo sapiens
MGCLWGLALPLFFFCWEVGVSGSSAGPSTRRADTAMTTDDTEVPAMTLAPGHAALETQTLSAETSSRASTPAGPIPEAETRGAKRISPARETRSFTKTSPNFMVLIATSVETSAASGSPEGAGMTTVQTITGSDPEEAIFDTLCTDDSSEEAKTLTMDILTLAHTSTEAKGLSSESSASSDGPHPVITPSRASESSASSDGPHPVITPSRASESSASSDGPHPVITPSRASESSASSDGPHPVITPSWSPGSDVTLLAEALVTVTNIEVINCSITEIETTTSSIPGASDIDLIPTEGVKASSTSDPPALPDSTEAKPHITEVTASAETLSTAGTTESAAPHATVGTPLPTNSATEREVTAPGATTLSGALVTVSRNPLEETSALSVETPSYVKVSGAAPVSIEAGSAVGKTTSFAGSSASSYSPSEAALKNFTPSETPTMDIATKGPFPTSRDPLPSVPPTTTNSSRGTNSTLAKITTSAKTTMKPPTATPTTARTRPTTDVSAGENGGFLLLRLSVASPEDLTDPRVAERLMQQLHRELHAHAPHFQVSLLRVRRG

SEQ ID NO: 748789 - protein, 503 aa, Homo sapiens; identical to SEQ ID NO: 748783

SEQ ID NO: 748790 - protein, 538 aa, Homo sapiens
MGCLWGLALPLFFFCWEVGVSGSSAGPSTRRADTAMTTDDTEVPAMTLAPGHAALETQTLSAVIVYMPAIWGRKNMFIPKTGAKRISPARETRSFTKTSPNFMVLIATSVETSAASGSPEGAGMTTVQTITGSDPEEAIFDTLCTDDSSEEAKTLTMDILTLAHTSTEAKGLSSESSASSDGPHPVITPSRASESSASSDGPHPVITPSRASESSASSDGPHPVITPSWSPGSDVTLLAEALVTVTNIEVINCSITEIETTTSSIPGASDIDLIPTEGVKASSTSDPPALPDSTEAKPHITEVTASAETLSTAGTTESAAPHATVGTPLPTNSATEREVTAPGATTLSGALVTVSRNPLEETSALSVETPSYVKVSGAAPVSIEAGSAVGKTTSFAGSSASSYSPSEAALKNFTPSETPTMDIATKGPFPTSRDPLPSVPPTTTNSSRGTNSTLAKITTSAKTTMKPPTATPTTARTRPTTDVSAGENGGFLLLRLSVASPEDLTDPRVAERLMQQLHRELHAHAPHFQVSLLRVRRG

SEQ ID NO: 748791 - protein, 586 aa, Homo sapiens
MGCLWGLALPLFFFCWEVGVSGSSAGPSTRRADTAMTTDDTEVPAMTLAPGHAALETQTLSAETSSRASTPAGPIPEAETRGAKRISPARETRSFTKTSPNFMVLIATSVETSAASGSPEGAGMTTVQTITGSDPEEAIFDTLCTDDSSEEAKTLTMDILTLAHTSTEAKGLSSESSASSDGPHPVITPSRASESSASSDGPHPVITPSRASESSASSDGPHPVITPSWSPGSDVTLLAEALVTVTNIEVINCSITEIETTTSSIPGASDIDLIPTEGVKASSTSDPPALPDSTEAKPHITEVTASAETLSTAGTTESAAPHATVGTPLPTNSATEREVTAPGATTLSGALVTVSRNPLEETSALSVETPSYVKVSGAAPVSIEAGSAVGKTTSFAGSSASSYSPSEAALKNFTPSETPTMDIATKGPFPTSRDPLPSVPPTTTNSSRGTNSTLAKITTSAKTTMKPPTATPTTARTRPTTDVSAGENGGFLLLRLSVASPEDLTDPRVAERLMQQVSGHFPGQGSRGRGEVRRGCREDPQDTEEQLPHLEGSLVSYGELGAESEDLCLALLLPAFSEFFISFSAM

SEQ ID NO: 748792 - protein, 280 aa, Homo sapiens
RPDVDFGAGASDIDLIPTEGVKASSTSDPPALPDSTEAKPHITEVTASAETLSTAGTTESAAPHATVGTPLPTNSATEREVTAPGATTLSGALVTVSRNPLEETSALSVETPSYVKVSGAAPVSIEAGSAVGKTTSFAGSSASSYSPSEAALKNFTPSETPTMDIATKGPFPTSRDPLPSVPPTTTNSSRGTNSTLAKITTSAKTTMKPPTATPTTARTRPTTDVSAGENGGFLLLRLSVASPEDLTDPRVAERLMQQLHRELHAHAPHFQVSLLRVRRG

SEQ ID NO: 748793 - protein, 414 aa, Homo sapiens
MGCLWGLALPLFFFCWEVGVSGSSAGPSTRRADTAMTTDDTEVPAMTLAPGHAALETQTLSAETSSRASTPAGPIPEAETRGAKRISPARETRSFTKTSPNFMVLIATSVETSAASGSPEGAGMTTVQTITGSDPEEAIFDTLCTDDSSEEAKTLTMDILTLAHTSTEAKGLSSESSASSDGPHPVITPSRASESSASSDGPHPVITPSRASESSASSDGPHPVITPSWSPGSDVTLLAEALVTVTNIEVINCSITEIETTTSSIPGASDIDLIPTEGVKASSTSDPPALPDSTEAKPHITEVTASAETLSTAGTTESAAPHATVGTPLPTNSATEREVTAPGATTLSGALVTVSRNPLEETSALSVETPSYVKVSGAAPVSIEAGSAVGKTTSFAGSSASSYSPPKVKIRAEY

SEQ ID NO: 748794 - protein, 118 aa, Homo sapiens
MDIATKGPFPTSRDPLPSVPPTTTNSSRGTNSTLAKITTSAKTTMKPPTATPTTARTRPTTDVSAGENGGFLLLRLSVASPEDLTDPRVAERLMQQLHRELHAHAPHFQVSLLRVRRG

SEQ ID NO: 748795 - protein, 194 aa, Homo sapiens
APPLSGAVKGVRPPRLSAGAHQSLAKQPRFRSCQGLLCQPGNARILVVNSFAGSSASSYSPSEAALKNFTPSETPTMDIATKGPFPTSRDPLPSVPPTTTNSSRGTNSTLAKITTSAKTTMKPPTATPTTARTRPTTDVSAGENGGFLLLRLSVASPEDLTDPRVAERLMQQLHRELHAHAPHFQVSLLRVRRG

SEQ ID NO: 748796 - protein, 324 aa, Homo sapiens
MGCLWGLALPLFFFCWEVGVSGSSAGPSTRRADTAMTTDDTEVPAMTLAPGHAALETQTLSAETSSRASTPAGPIPEAETRGAKRISPARETRSFTKTSPNFMVLIATSVETSAASGSPEGAGMTTVQTITGSDPEEAIFDTLCTDDSSEEAKTLTMDILTLAHTSTEAKGLSSESSASSDGPHPVITPSRASESSASSDGPHPVITPSRASESSASSDGPHPVITPSWSPGSDVTLLAEALVTVTNIEVINCSITEIETTTSSIPGASDIDLIPTEGVKASSTSDPPALPEAPGMLEVVGPISVMLQLITSRLVTVTRASREE

SEQ ID NO: 748797 - protein, 193 aa, Homo sapiens
MLCTEGVENASYVTESRSVVPCRLAGADSKGTGRSLQAAAPNPRTFAVLGRITTARGEVATVMNSAMWHQTATQTTVSSATLVTHIQARFHRQQSWMLWLAEANPLPALQAKAGMWPRWFLRSLTILRSCILSISGPSQMTKMVLQMVLRMENPPSPARSHLDWMQSMVQRVLQTSLPGMPFTMAVRRIKKRA

SEQ ID NO: 748798 - protein, 402 aa, Homo sapiens [sequence omitted]

SEQ ID NO: 748799 - protein, 587 aa, Homo sapiens
ARVSALCSAAGSGSGAAAAAGPEPRALRPAAGCVRPRSPASRLGAPTRPRSGAGTRAGAEGGPGPGRRRGRSSRRRQQPRQPRRRRQRQRQRQQRARRSQPGLVGPAPARPPARTASGRPLHCARYKEMVELVISPSLTVNSDCLDKLKFNRADAAVWTLSDRQGITKSAPLRVSQLFSRSCPRVLPRQPSTAMAAYGQTQYSAGIQQATPYTAYPPPAQAYGIPSYSIKTEDSLNHSPGQSGFLSYGSSFSTSPTGQSPYTYQMHGTTGFYQGGNGLGNAAGFGSVHQDYPSYPGFPQSQYPQYYGSSYNPPYVPASSICPSPLSTSTYVLQEASHNVPNQSSESLAGEYNTHNGPSTPAKEGDTDRPHRASDGKLRGRSKRSSDPSPAGDNEIERVFVWDLDETIIIFHSLLTGTFASRYGKDTTTSVRIGLMMEEMIFNLADTHLFFNDLEDCDQIHVDDVSSDDNGQDLSTYNFSADGFHSSAPGANLCLGSGVHGGVDWMRKLAFRYRRVKEMYNTYKNNVGGKESCFERIMQRFGRKAVYVVIGDGVEEEQGAKKHNMPFWRISCHADLEALRHALELEYL

SEQ ID NO: 748800 - protein, 666 aa, Homo sapiens
ARVSALCSAAGSGSGAAAAAGPEPRALRPAAGCVRPRSPASRLGAPTRPRSGAGTRAGAEGGPGPGRRRGRSSRRRQQPRQPRRRRQRQRQRQQRARRSQPGLVGPAPARPPARTASGRPLHCARYKEMVELVISPSLTVNSDCLDKLKFNRADAAVWTLSDRQGITKSAPLRVSQLFSRSCPRVLPRQPSTAMAAYGQTQYSAGIQQATPYTAYPPPAQAYGIPSYSIKTEDSLNHSPGQSGFLSYGSSFSTSPTGQSPYTYQMHGTTGFYQGGNGLGNAAGFGSVHQDYPSYPGFPQSQYPQYYGSSYNPPYVPASSICPSPLSTSTYVLQEASHNVPNQSSESLAGEYNTHNGPSTPAKEGDTDRPHRASDGKLRGRSKRSSDPSPAGDNEIERVFVWDLDETIIIFHSLLTGTFASRYGKDTTTSVRIGLMMEEMIFNLADTHLFFNDLEDCDQIHVDDVSSDDNGQDLSTYNFSADGFHSSAPGANLCLGSGVHGGVDWMRKLAFRYRRVKEMYNTYKNNVGGLIGTPKRETWLQLRAELEALTDLWLTHSLKALNLINSRPNCVNVLVTTTQLIPALAKVLLYGLGSVFPIENIYSATKTGKESCFERIMQRFGRKAVYVVIGDGVEEEQGAKKHNMPFWRISCHADLEALRHALELEYL

SEQ ID NO: 748801 - protein, 538 aa, Homo sapiens
MVELVISPSLTVNSDCLDKLKFNRADAAVWTLSDRQGITKSAPLRVSQLFSRSCPRVLPRQPSTAMAAYGQTQYSAGIQQATPYTAYPPPAQAYGIPSYSIKTEDSLNHSPGQSGFLSYGSSFSTSPTGQSPYTYQMHGTTGFYQGGNGLGNAAGFGSVHQDYPSYPGFPQSQYPQYYGSSYNPPYVPASSICPSPLSTSTYVLQEASHNVPNQSSESLAGEYNTHNGPSTPAKEGDTDRPHRASDGKLRGRSKRSSDPSPAGDNEIERVFVWDLDETIIIFHSLLTGTFASRYGKDTTTSVRIGLMMEEMIFNLADTHLFFNDLEDCDQIHVDDVSSDDNGQDLSTYNFSADGFHSSAPGANLCLGSGVHGGVDWMRKLAFRYRRVKEMYNTYKNNVGGLIGTPKRETWLQLRAELEALTDLWLTHSLKALNLINSRPNCVNVLVTTTQLIPALAKVLLYGLGSVFPIENIYSATKTGKESCFERIMQRFGRKAVYVVIGDGVEEEQGAKKHNMPFWRISCHADLEALRHALELEYL

SEQ ID NO: 748802 - protein, 402 aa, Homo sapiens [sequence omitted]

SEQ ID NO: 748803 - protein, 412 aa, Homo sapiens
GTRQLFSRSCPRVLPRQPSTAMAAYGQTQYSAGIQQATPYTAYPPPAQAYGIPSYSIKTEDSLNHSPGQSGFLSYGSSFSTSPTGQSPYTYQMHGEYNTHNGPSTPAKEGDTDRPHRASDGKLRGRSKRSSDPSPAGDNEIERVFVWDLDETIIIFHSLLTGTFASRYGKDTTTSVRIGLMMEEMIFNLADTHLFFNDLEDCDQIHVDDVSSDDNGQDLSTYNFSADGFHSSAPGANLCLGSGVHGGVDWMRKLAFRYRRVKEMYNTYKNNVGGLIGTPKRETWLQLRAELEALTDLWLTHSLKALNLINSRPNCVNVLVTTTQLIPALAKVLLYGLGSVFPIENIYSATKTGKESCFERIMQRFGRKAVYVVIGDGVEEEQGAKKHNMPFWRISCHADLEALRHALELEYL

SEQ ID NO: 748804 - protein, 170 aa, Homo sapiens
FNFYTIKTKHREGPRRVLTDALFVQFLHNVGGLIGTPKRETWLQLRAELEALTDLWLTHSLKALNLINSRPNCVNVLVTTTQLIPALAKVLLYGLGSVFPIENIYSATKTGKESCFERIMQRFGRKAVYVVIGDGVEEEQGAKKHNMPFWRISCHADLEALRHALELEYL

SEQ ID NO: 748805 - protein, 672 aa, Homo sapiens
ARVSALCSAAGSGSGAAAAAGPEPRALRPAAGCVRPRSPASRLGAPTRPRSGAGTRAGAEGGPGPGRRRGRSSRRRQQPRQPRRRRQRQRQRQQRARRSQPGLVGPAPARPPARTASGRPLHCARYKEMVELVISPSLTVNSDCLDKLKFNRADAAVWTLSDRQGITKSAPLRVSQLFSRSCPRVLPRQPSTAMAAYGQTQYSAGIQQATPYTAYPPPAQAYGIPSYSIKTEDSLNHSPGQSGFLSYGSSFSTSPTGQSPYTYQMHGTTGFYQGGNGLGNAAGFGSVHQDYPSYPGFPQSQYPQYYGSSYNPPYVPASSICPSPLSTSTYVLQEASHNVPNQSSESLAGEYNTHNGPSTPAKEGDTDRPHRASDGKLRGRSKRSSDPSPAGDNEIERVFVWDLDETIIIFHSLLTGTFASRYGKDTTTSVRIGLMMEEMIFNLADTHLFFNDLEDCDQIHVDDVSSDDNGQDLSTYNFSADGFHSSAPGANLCLGSGVHGGVDWMRKLAFRYRRVKEMYNTYKNNVGGLIGTPKRETWLQLRAELEALTDLWLTHSLKALNLINSRPNCVNVLVTTTQLIPALAKVLLYGLGSVFPIENIYSATKTAAISPSDPLAFPTSPPRIRNYALVPVWLGFLVVGLVWFFELVCGVVHSSNVSTLFSKLCFVGTIIL

SEQ ID NO: 748806 - protein, 664 aa, Homo sapiens
ARVSALCSAAGSGSGAAAAAGPEPRALRPAAGCVRPRSPASRLGAPTRPRSGAGTRAGAEGGPGPGRRRGRSSRRRQQPRQPRRRRQRQRQRQQRARRSQPGLVGPAPARPPARTASGRPLHCARYKEMVELVISPSLTVNSDCLDKLKFNRADAAVWTLSDRQGITKSAPLRVSQLFSRSCPRVLPRQPSTAMAAYGQTQYSAGIQQATPYTAYPPPAQAYGIPSYSIKTEDSLNHSPGQSGFLSYGSSFSTSPTGQSPYTYQMHGTTGFYQGGNGLGNAAGFGSVHQDYPSYPGFPQSQYPQYYGSSYNPPYVPASSICPSPLSTSTYVLQEASHNVPNQSSESLAGEYNTHNGPSTPAKEGDTDRPHRASDGKLRGRSKRSSDPSPAGDNEIERVFVWDLDETIIIFHSLLTGTFASRYGKDTTTSVRIGLMMEEMIFNLADTHLFFNDLEDCDQIHVDDVSSDDNGQDLSTYNFSADGFHSSAPGANLCLGSGVHGGVDWMRKLAFRYRRVKEMYNTYKNNVGGLIGTPKRETWLQLRAELEALTDLWLTHSLKALNLINSRPNCVNVLVTTTQLIPALAKVLLYGLGSVFPIENIYSATKTGKESCFERIMQRFGRKAVYVVIGDGVEEEQGAKKHNMPLSEFGTSFFFFFFFFFFFSC

SEQ ID NO: 748807 - protein, 606 aa, Homo sapiens
ARVSALCSAAGSGSGAAAAAGPEPRALRPAAGCVRPRSPASRLGAPTRPRSGAGTRAGAEGGPGPGRRRGRSSRRRQQPRQPRRRRQRQRQRQQRARRSQPGLVGPAPARPPARTASGRPLHCARYKEMVELVISPSLTVNSDCLDKLKFNRADAAVWTLSDRQGITKSAPLRVSQLFSRSCPRVLPRQPSTAMAAYGQTQYSAGIQQATPYTAYPPPAQAYGIPSYSIKTEDSLNHSPGQSGFLSYGSSFSTSPTGQSPYTYQMHGTTGFYQGGNGLGNAAGFGSVHQDYPSYPGFPQSQYPQYYGSSYNPPYVPASSICPSPLSTSTYVLQEASHNVPNQSSESLAGEYNTHNGPSTPAKEGDTDRPHRASDGKLRGRSKRSSDPSPAGDNEIERVFVWDLDETIIIFHSLLTGTFASRYGKDTTTSVRIGLMMEEMIFNLADTHLFFNDLEDCDQIHVDDVSSDDNGQDLSTYNFSADGFHSSAPGANLCLGSGVHGGVDWMRKLAFRYRRVKEMYNTYKNNVGGEYCEPWASEEGKLIGMDAVSAPGREVHKFSTSPLNATLTTPFGIEHWDFVTFTLGVGKLRDGGCIWSKILQATNGAGW

SEQ ID NO: 748808 - protein, 429 aa, Homo sapiens
ARVSALCSAAGSGSGAAAAAGPEPRALRPAAGCVRPRSPASRLGAPTRPRSGAGTRAGAEGGPGPGRRRGRSSRRRQQPRQPRRRRQRQRQRQQRARRSQPGLVGPAPARPPARTASGRPLHCARYKEMVELVISPSLTVNSDCLDKLKFNRADAAVWTLSDRQGITKSAPLRVSQLFSRSCPRVLPRQPSTAMAAYGQTQYSAGIQQATPYTAYPPPAQAYGIPSYSIKTEDSLNHSPGQSGFLSYGSSFSTSPTGQSPYTYQMHGTTGFYQGGNGLGNAAGFGSVHQDYPSYPGFPQSQYPQYYGSSYNPPYVPASSICPSPLSTSTYVLQEASHNVPNQSSESLAGEYNTHNGPSTPAKEGDTDRPHRASDGKLRGRSKRSSDPSPAGDNEIEEKQLKDVFKQNKEENQGRETWDPENSGSNPEIQ

SEQ ID NO: 748809 - protein, 102 aa, Homo sapiens
MPLTKSRLTFPEYHPRDRAVPVQVCALALHGGQRGRNKGSCGLGGHSVRTHKPHKEVSRRPPIPFHSPAEQDRERSVLRKVFHSTRQSLQLLCCIVLSPVTL

SEQ ID NO: 748810 - protein, 123 aa, Homo sapiens
REFWRGLREGKGAASFTGRVQLTSLPLCRLEKNGPDPLDSSDERIQREAFESVLAETFFTKEPLRCWCPWRAWVENELIYEEVSEWTKPGAMDSKDVEVSSIQVRRKPQHGVCSQLLGNYRCL

SEQ ID NO: 748811 - protein, 102 aa, Homo sapiens; identical to SEQ ID NO: 748809

SEQ ID NO: 748812 - protein, 102 aa, Homo sapiens; identical to SEQ ID NO: 748809

SEQ ID NO: 748813 - protein, 175 aa, Homo sapiens
MTVNMPSAHASPVSGSRTWVNTLAESLTGVLSWLLSCLLMERCLASGPDLDESSWHMLEAWNVIPQFHCHQFSANPTVAFSANFMVFILVSVSSPERGHLKGIERVCLVCCCSPSTESDALLCPCSWKAWLRQFPCLFPFQGHPLIRFLEEETSRISGLPSLHLSPNLPFLDPCA

SEQ ID NO: 748814 - protein, 175 aa, Homo sapiens; identical to SEQ ID NO: 748813

SEQ ID NO: 748815 - protein, 394 aa, Homo sapiens
KCDVCGKIFNQKQYIVYHHRCHTGEKTYKCNECGKTFTQMSSLVCHRRLHTGEKPYKCNECGKTFSEKSSLRCHRRLHTGEKPYKCNECGKTFGRNSALVIHKAIHTGEKPYKCNECGKTFSQKSSLQCHHILHTGEKPYKCEECDNVYIRRSHLERHRKIHTGEGSYKCKVCDKVFRSDSYLAEHQRVHTGEKPYKCNKCGRSFSRKSSLQYHHTLHTGEKPYTCNECGKVFSRRENLARHHRLHAGEKPYKCEECDKVFSRRSHLERHRRIHTGEKPYKCKVCDKAFRSDSCLANHTRVHTGEKPYKCNKCAKVFNQKGILAQHQRVHTGEKPYKCNECGKVFNQKASLAKHQRVHTAEKPYKCNECGKAFTGQSTLIHHQAIHGCRETLQM

SEQ ID NO: 748816 - protein, 123 aa, Homo sapiens
MSSGGSPGCLRLAEGCPNHRAWVRWNRRQPHSAFLIASHLFLSVLVWFNSFQGLELESENPRHLLWNVCLVVLVCPSSSLACRFQVYQRTFCSVESHRTKRKILQLFANILPYLYKQPYTKKH

SEQ ID NO: 748817 - protein, 307 aa, Homo sapiens
RAGGGGRRATGRAQDEGGHCWGSASGRRTLRRRRAAQRCGGGARADAGPMARTTSQLYDAVPIQSSVVLCSCPSPSMVRTQTESSTPPGIPGGSRQGPAMDGTAAEPRPGAGSLQHAQPPPQPRKKRPEDFKFGKILGEGSFSTVVLARELATSREYAIKILEKRHIIKENKVPYVTRERDVMSRLDHPFFVKLYFTFQDDEKLYFGLSYAKNGELLKYIRKIGSFDETCTRFYTAEIVSALEYLHGKGIIHRDLKPENILLNEDMHIQITDFGTAKVLSPESKQGLLKQHVLGLVGRVDLVLSLGL

SEQ ID NO: 748818 - protein, 238 aa, Homo sapiens
RAGGGGRRATGRAQDEGGHCWGSASGRRTLRRRRAAQRCGGGARADAGPMARTTSQLYDAVPIQSSVVLCSCPSPSMVRTQTESSTPPGIPGGSRQGPAMDGTAAEPRPGAGSLQHAQPPPQPRKKRPEDFKFGKILGEGSFSTVVLARELATSREYATRANSFVGTAQYVSPELLTEKSACKSSDLWALGCIIYQLVAGLPPFRAGNEYLIFQKIIKLEYDFPEKFFPKARDLVEKL

SEQ ID NO: 748819 - protein, 352 aa, Homo sapiens
RAGGGGRRATGRAQDEGGHCWGSASGRRTLRRRRAAQRCGGGARADAGPMARTTSQLYDAVPIQSSVVLCSCPSPSMVRTQTESSTPPGIPGGSRQGPAMDGTAAEPRPGAGSLQHAQPPPQPRKKRPEDFKFGKILGEGSFSTVVLARELATSREYAIKILEKRHIIKENKVPYVTRERDVMSRLDHPFFVKLYFTFQDDEKLYFGLSYAKNGELLKYIRKIGSFDETCTRFYTAEIVSALEYLHGKGIIHRDLKPENILLNEDMHIQITDFGTAKVLSPESKQARANSFVGTAQYVSPELLTEKSACKSSDLWALGCIIYQLVAGLPPFRAGKEYLNSEDYKGICFRKFS

SEQ ID NO: 748820 - protein, 340 aa, Homo sapiens
MVRTQTESSTPPGIPGGSRQGPAMDGTAAEPRPGAGSLQHAQPPPQPRKKRPEDFKFGKILGEGSFSTVVLARELATSREYAIKILEKRHIIKENKVPYVTRERDVMSRLDHPFFVKLYFTFQDDEKLYFGLSYAKNGELLKYIRKIGSFDETCTRFYTAEIVSALEYLHGKGIIHRDLKPENILLNEDMHIQITDFGTAKVLSPESKQARANSFVGTAQYVSPELLTEKSACKSSDLWALGCIIYQLVAGLPPFRAGKEYLNSEDYKGICFRKFSWEDWGNWVDAHRVRSSQKNSRTGDAWDRRDKKSRFEHTPVPDREVDHKHRKKRSSEDTYYTMRV

SEQ ID NO: 748821 - protein, 367 aa, Homo sapiens
RGGGLDAPYDAVPIQSSVVLCSCPSPSMVRTQTESSTPPGIPGGSRQGPAMDGTAAEPRPGAGSLQHAQPPPQPRKKRPEDFKFGKILGEGSFSTVVLARELATSREYAIKILEKRHIIKENKVPYVTRERDVMSRLDHPFFVKLYFTFQDDEKLYFGLSYAKNGELLKYIRKIGSFDETCTRFYTAEIVSALEYLHGKGIIHRDLKPENILLNEDMHIQITDFGTAKVLSPESKQARANSFVGTAQYVSPELLTEKSACKSSDLWALGCIIYQLVAGLPPFRAGKEYLNSEDYKGICFRKFSSGRTGGTGLTPTGCVAVRRTLEPVTRGIGEIRSLVFNTRLYLTEKRPQTQEKEKQRGHLLTMRV

SEQ ID NO: 748822 - protein, 110 aa, Homo sapiens [sequence omitted]

SEQ ID NO: 748823 - protein, 800 aa, Homo sapiens
MAVRELCFPRQRQVLFLFLFWGVSLAGSGFGRYSVTEETEKGSFVVNLAKDLGLAEGELAARGTRVVSDDNKQYLLLDSHTGNLLTNEKLDREKLCGPKEPCMLYFQILMDDPFQIYRAELRVRDINDHAPVFQDKETVLKISENTAEGTAFRLERAQDPDGGLNGIQNYTISPNSFFHINISGGDEGMIYPELVLDKALDREEQGELSLTLTALDGGSPSRSGTSTVRIVVLDVNDNAPQFAQALYETQAPENSPIGFLIVKVWAEDVDSGVNAEVSYSFFDASENIRTTFQINPFSGEIFLRELLDYELVNSYKINIQAMDGGGLSARCRVLVEVLDTNDNPPELIVSSFSNSVAENSPETPLAVFKINDRDSGENGKMVCYIQENLPFLLKPSVENFYILITEGALDREIRAEYNITITVTDLGTPRLKTEHNITVLVSDVNDNAPAFTQTSYTLFVRENNSPALHIGSVSATDRDSGTNAQVTYSLLPPQDPHLPLASLVSINADNGHLFALRSLDYEALQAFEFRVGATDRGSPALSREALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHLLLVDGFSQPYLPLPEAAPAQAQAEADLLTVYLVVALASVSSLFLLSVLLFVAVRLCRRSRAASVGRCSVPEGPFPGHLVDVRGAETLSQSYQYEVCLTGGPGTSEFKFLKPVISDIQAQGPGRKGEENSTFRNSFGFNIQ

SEQ ID NO: 748824 - protein, 262 aa, Homo sapiens
MDGKQGGMDGSKPAGPRDFPGIRLLSNPLMGDAVSDWSPMHEAAIHGHQLSLRNLISQGWAVNIITADHVSPLHEACLGGHLSCVKILLKHGAQVNGVTADWHTPLFNACVSGSWDCVNLLLQHGASVQPESDLASPIHEAARRGHVECVNSLIAYGGNIDHKISHLGTPLYLACENQQRACVKKLLESGADVNQGKGQDSPLHAVARTASEELACLLMDFGADTQAKNAEGKRPVELVPPESPLAQLFLEREGASLPKPKP

SEQ ID NO: 748825 - protein, 294 aa, Homo sapiens
MDGKQGGMDGSKPAGPRDFPGIRLLSNPLMGDAVSDWSPMHEAAIHGHQLSLRNLISQGWAVNIITADHVSPLHEACLGGHLSCVKILLKHGAQVNGVTADWHTPLFNACVSGSWDCVNLLLQHGASVQPESDLASPIHEAARRGHVECVNSLIAYGGNIDHKISHLGTPLYLACENQQRACVKKLLESGADVNQGKGQDSPLHAVARTASEELACLLMDFGADTQAKNAEGKRPVELVPPESPLAQLFLEREGPPSLMQLCRLRIRKCFGIQQHHKITKLVLPEDLKQFLLHL

SEQ ID NO: 748826 - protein, 262 aa, Homo sapiens; identical to SEQ ID NO: 748824

SEQ ID NO: 748827 - protein, 252 aa, Homo sapiens
MDGKQGGMDGSKPAGPRDFPGIRLLSNPLMGDAVSDWSPMHEAAIHGHQLSLRNLISQGWAVNIITADHVSPLHEACLGGHLSCVKILLKHGAQVNGVTADWHTPLFNACVSGSWDCVNLLLQHGASVQPESDLASPIHEAARRAYGGNIDHKISHLGTPLYLACENQQRACVKKLLESGADVNQGKGQDSPLHAVARTASEELACLLMDFGADTQAKNAEGKRPVELVPPESPLAQLFLEREGASLPKPKP

SEQ ID NO: 748828 - protein, 233 aa, Homo sapiens
MDGKQGGMDGSKPAGPRDFPGIRLLSNPLMGDAVSDWSPMHEAAIHGHQLSLRNLISQGWAVNIITADHVSPLHEACLGGHLSCVKILLKHGAQHGASVQPESDLASPIHEAARRGHVECVNSLIAYGGNIDHKISHLGTPLYLACENQQRACVKKLLESGADVNQGKGQDSPLHAVARTASEELACLLMDFGADTQAKNAEGKRPVELVPPESPLAQLFLEREGASLPKPKP

SEQ ID NO: 748829 - protein, 262 aa, Homo sapiens; identical to SEQ ID NO: 748824

SEQ ID NO: 748830 - protein, 265 aa, Homo sapiens
MDGKQGGMDGSKPAGPRDFPGIRLLSNPLMGDAVSDWSPMHEAAIHGHQLSLRNLISQGWAVNIITADHVSPLHEACLGGHLSCVKILLKHGAQHGASVQPESDLASPIHEAARRGHVECVNSLIAYGGNIDHKISHLGTPLYLACENQQRACVKKLLESGADVNQGKGQDSPLHAVARTASEELACLLMDFGADTQAKNAEGKRPVELVPPESPLAQLFLEREGPPSLMQLCRLRIRKCFGIQQHHKITKLVLPEDLKQFLLHL

SEQ ID NO: 748831 - protein, 322 aa, Homo sapiens
MDGKQGGMDGSKPAGPRDFPGIRLLSNPLMGDAVSDWSPMHEAAIHGHQLSLRNLISQGWAVNIITADHVSPLHEACLGGHLSCVKILLKHGAQVNGVTADWHTPLFNACVSGSWDCVNLLLQHGASVQPESDLASPIHEAARRGHVECVNSLIAYGGNIDHKISHLGTPLYLACENQQRACVKKLLESGADVNQGKGQDSPLHAVARTASEELACLLMDFGADTQAKNAEGKRPVELVPPESPLAQLFLEREDGVTLCRPGWSAVARSRLIATSASRNSDKMCSPGQQSFMLLVIRRKEYGESSIDANQPLLVGRPLLAGT

SEQ ID NO: 748832 - protein, 120 aa, Homo sapiens
MDGKQGGMDGSKPAGPRDFPGIRLLSNPLMGDAVSDWSPMHEAAIHGHQLSLRNLISQGWAVNIITADHVSPLHEACLGGHLSCVKILLKHGAQHGASVQPESDLASPIHEAARRAWPTW

SEQ ID NO: 748833 - protein, 99 aa, Homo sapiens [sequence omitted]

SEQ ID NO: 748834 - protein, 107 aa, Homo sapiens
LNIRSSNKSITFSFFFKTESYSVTQAECSGTISAHCSLHLLGSNDSYASSLPSSWEYRHRPPHPADFLYFHKEGGVELLSSGSLPASASQSARITGMSDHAWPFLCF

SEQ ID NO: 748835 - protein, 129 aa, Homo sapiens
TYDIPTANIILNGEKLKASPLGTGTRQGCLLSPLLFNIELEVLTRAIRQEKEIKGIQIGKDEVKLSLFDDMIFYLENPKDSSRKLLELIKEFSRVPIYKINVHKSVAFLYTNSDQAENQELHHFYNSCK

SEQ ID NO: 748836 - protein, 367 aa, Homo sapiens
MLAVGAMEGTRQSAFLLSSPPLAALHSMAEMKTPLYPAAYPPLPAGPPSSSSSSSSSSSPSPPLGTHNPGGLKPPATGGLSSLGSPPQQLSAATPHGINDILSRPSMPVASGAALPSASPSGSSSSSSSSASASSASAAAAAAAAAAAAASSPAGLLAGLPRFSSLSPPPPPPGLYFSPSAAAVAAVGRYPKPLAELPGRTPIFWPGVMQSPPWRDARLACTPHQGSILLDKDGKRKHTRPTFSGQQIFALEKTFEQTKYLAGPERARLAYSLGMTESQVKVWFQNRRTKWRKKHAAEMATAKKKQDSETERLKGASENEEEDDDYNKPLDPNSDDEKITQLLKKHKSSSGGGGGLLLHASEPESSS

SEQ ID NO: 748837 - protein, 129 aa, Homo sapiens
GPVDTAWSAVRIGLYAQHLDHWLRYFPLSHFLFVSGERLVSDPAGEVGRVQDFLGLKRVVTDKHFYFNATKGFPCLKKAQGGSRPRCLGKSKGRPHPRVPQAVVRRLQEFYRPFNRRFYQMTGQDFGWG

SEQ ID NO: 748838 - protein, 75 aa, Homo sapiens
FTPTAKAPPAIGGSHKGVMETPVWQRGVTNTSVARLHGAWASFSVRKGSLQGNCLQKSCSYCGGTDLGPWSKLSP

SEQ ID NO: 748839 - protein, 397 aa, Homo sapiens
AGAVARGQLTRRALTQKLGPGGGSGRGGPRRAESPGGSCGRGRRGLEWVVAPSWDAPPSTISPGLQGPRAYTASSHAVLRNPCWPQNTSALPPVQPCLAGGPSSTAMVWKKLGSRNFSSCPSGSIQWIWDVLGECAQDGWDEASVGLGLISILCFAASTFPQFIKAYKTGNMDQALSLWFLLGWIGGDSCNLIGSFLADQLPLQTYTAVYYVLADLVMLTLYFYYKFRTRPSLLSAPINSVLLFLMGMACATPLLSAAGPVAAPREAFRGRALLSVESGSKPFTRQEVIGFVIGSISSVLYLLSRLPQIRTNFLRKSTQGISYSLFALVMLGNTLYGLSVLLKNPEEGQSEGSYLLHHLPWLVGSLGVLLLDTIISIQFLVYRRSTAASELEPLLPS

SEQ ID NO: 748840 - protein, 226 aa, Homo sapiens
MDQALSLWFLLGWIGGDSCNLIGSFLADQLPLQTYTAVYYVLADLVMLTLYFYYKFRTRPSLLSAPINSVLLFLMGMACATPLLSAAGPVAAPREAFRGRALLSVESGSKPFTRQEVIGFVIGSISSVLYLLSRLPQIRTNFLRKSTQGISYSLFALVMLGNTLYGLSVLLKNPEEGQSEGSYLLHHLPWLVGSLGVLLLDTIISIQFLVYRRSTAASELEPLLPS

SEQ ID NO: 748841 - protein, 387 aa, Homo sapiens
AGAVARGQLTRRALTQKLGPGGGSGRGGPRRAESPGGSCGRGRRGLEWVVAPSWDAPPSTISPGLQGPRAYTASSHAVLRNPCWPQNTSALPPVQPCLAGGPSSTAMVWKKLGSRNFSSCPSGSIQWIWDVLGECAQDGWDEASVGLGLISILCFAASTFPQFIKAYKTGNMDQALSLWFLLGWIGGDSCNLIGSFLADQLPLQDLVMLTLYFYYKFRTRPSLLSAPINSVLLFLMGMACATPLLSAAGPVAAPREAFRGRALLSVESGSKPFTRQEVIGFVIGSISSVLYLLSRLPQIRTNFLRKSTQGISYSLFALVMLGNTLYGLSVLLKNPEEGQSEGSYLLHHLPWLVGSLGVLLLDTIISIQFLVYRRSTAASELEPLLPS

SEQ ID NO: 748842 - protein, 328 aa, Homo sapiens
AGAVARGQLTRRALTQKLGPGGGSGRGGPRRAESPGGSCGRGRRGLEWVVAPSWDAPPSTISPGLQGPRAYTASSHAVLRNPCWPQNTSALPPVQPCLAGGPSSTAMVWKKLGSRNFSSCPSGSIQWIWDVLGECAQDGWDEASVGLGLISILCFAASTFPQFIKAYKTGNMDQALSLWFLLGWIGGDSCNLIGSFLADQLPLQTYTAVYYVLADLVMLTLYFYYKFRTRPSLLSAPINSVLLFLMGMACATPLLSAAGPVAAPREAFRGRALLSVESGSKPFTRQEVIGFVIGSISSVLYLLSRLPQIRTNSCTPPVCQAPSWTLEP

SEQ ID NO: 748843 - protein, 397 aa, Homo sapiens; identical to SEQ ID NO: 748839

SEQ ID NO: 748844 - protein, 166 aa, Homo sapiens
TRVVIDSYKGARFHSLSSNLYEEVENNKKWTENQFLKYRKDHLGHINECLKVLQEKLEKSENKMEEKLLQLSSKVENFINTQKQETQLSKVKHMENKLSKKMEQMEKQIWGELETMQNEYQSGFKSIHDSLSSLQQIQKTKMDLEKYKVQKDLKKLQRKIVELQEV

SEQ ID NO: 748845 - protein, 452 aa, Homo sapiens
MQLQFLGTLASSEKRKKSQRLFFKNIKSTKNKAGKASIMSSDTNVNKSASPTATAEEQPVEPDGPLPGSDNNQEKKVRLSPAKMSTKNSTDLVEYVDKSHAFLPIIPNTQRGQLEDRLNNQARTIAFLLEQAFRIKEDISACLQGTHGFRKEESLARKLLESHIQTITSIVKKLSQNIEILEDQIRARDQAATGTNFAVHEINIKHLQGVGDLRGRVARCDSSIVKLSGDIHLFRQEHRQIEKAIQEFVPALETLSKNLDMKVMQLLGKIETASSEQTSNLKMVQGDYRHEMNLLEFKFHSLSSNLYEEVENNKKWTENQFLKYRKDHLGHINECLKVLQEKLEKSENKMEEKLLQLSSKVENFINTQKQETQLSKVKHMENKLSKKMEQMEKQIWGELETMQNEYQSGFKSIHDSLSSLQQIQKTKMDLEKYKVQKDLKKLQRKIVELQEV

SEQ ID NO: 748846 - protein, 192 aa, Homo sapiens [sequence omitted]

SEQ ID NO: 748847 - protein, 330 aa, Homo sapiens
SPLGRGPRNRKTLVRMQLQFLGTLASSEKRKKSQRLFFKNIKSTKNKAGKASIMSSDTNVNKSASPTATAEEQPVEPDGPLPGSDNNQEKKVRLSPAKMSTKNSTDLVEYVDKSHAFLPIIPNTQRGQLEDRLNNQARTIAFLLEQAFRIKEDISACLQGTHGFRKEESLARKLLESHIQTITSIVKKLSQNIEILEDQIRARDQAATGTNFAVHEINIKHLQGVGDLRGRVARCDSSIVKLSGDIHLFRQEHRQIEKAIQEFVPALETLSKNLDMKVMQLLGKIETASSEQTSNLKMVQGDYRHEMNLLEFKKSLKIKWKKNCCSFQAK

SEQ ID NO: 748848 - protein, 130 aa, Homo sapiens
FSYYDAPLYVIFKAYEIWPASEKSENKMEEKLLQLSSKVENFINTQKQETQLSKVKHMENKLSKKMEQMEKQIWGELETMQNEYQSGFKSIHDSLSSLQQIQKTKMDLEKYKVQKDLKKLQRKIVELQEV

SEQ ID NO: 748849 - protein, 247 aa, Homo sapiens
SPLGRGPRNRKTLVRMQLQFLGTLASSEKRKKSQRLFFKNIKSTKNKAGKASIMSSDTNVNKSASPTATAEEQPVEPDGPLPGSDNNQEKKVRLSPAKMSTKNSTDLVEYVDKSHAFLPIIPNTQRGQLEDRLNNQARTIAFLLEQAFRIKEDISACLQGTHGFRKEESLARKLLESHIQTITSIVKKLSQNIEILEDQIRARDQAATGTNFAVHEINIKHLQGVGDLRGRVARTSLLARLYLRETG

SEQ ID NO: 748850 - protein, 134 aa, Homo sapiens
SPLGRGPRNRKTLVRMQLQFLGTLASSEKRKKSQRLFFKNIKSTKNKAGKASIMSSDTNVNKSASPTATAEEQPVEPDGPLPGSDNNQEKKVRLSPAKMSTKNSTDLVEYVDNAIPGAPPGKVYHRGTTPGTWK

SEQ ID NO: 748851 - protein, 112 aa, Homo sapiens
MVPRVVHPPTWGWGPTPLPTGTFSTVDNPVSWSQPKEWHTASPFSAFLLYSCPCLQFTFHWCSTECSGTHIPPVVGLVVVNIILPISRDKFGIFTLYFHEEPNLGWFFLFFF

SEQ ID NO: 748852 - protein, 56 aa, Homo sapiens
MVLIPTSLWGENQSLIRASEECMTQKGQEYKRSQAQGESLLCRVQGLGSIYNHNCK

SEQ ID NO: 748853 - protein, 448 aa, Homo sapiens
MALTLLEDWCKGMDMDPRKALLIVGIPMECSEVEIQDTVKAGLQPLCAYRVLGRMFRREDNAKAVFIELADTVNYTTLPSHIPGKGGSWEVVVKPRNPDDEFLSRLNYFLKDEGRSMTDVARALGCCSLPAESLDAEVMPQVRSPPLEPPKESMWYRKLKVFSGTASPSPGEETFEDWLEQVTEIMPIWQVSEVEKRRRLLESLRGPALSIMRVLQANNDSITVEQCLDALKQIFGDKEDFRASQFRFLQTSPKIGEKVSTFLLRLEPLLQKAVHKSPLSVRSTDMIRLKHLLARVAMTPALRGKLELLDQRGCPPNFLELMKLIRDEEEWENTEAVMKNKEKPSGRGRGASGRQARAEASVSAPQATVQARSFSDSSPQTIQGGLPPLVKRRRLLGSESTRGEDHGQATYPKAENQTPGREGPQAAGEELGNEAGAGAMSHPKPWET

SEQ ID NO: 748854 - protein, 259 aa, Homo sapiens
CGMKGAKETGQGRDPQEKRGGGGKGWYKQPWHLSVSLRHLDTQVGKDADTGGQKRRIPPFFHFYSVSGGPKEGTFVALLCSQAHLCVSSCRESTLGHAAALPSQERGRMAAQMSEASALAPQVFPSPLELMVGEPSSKSPGQCFWGFCYEKAAGPRGALAQLRELCCQWLMPEACSKEQMLELLVLEQLLGTLLPEIQAYTQEQWLGSPEEATALAERLQQESAGPGLQMNGGWSGGWVCFPCSRPQLSQHWGQSWVGG

SEQ ID NO: 748855 - protein, 139 aa, Homo sapiens
TCSENRTFTGLDLNLAFFAALMKADLGDWKKNREMVFMALQLPLQLSLERHRLENMVVSGFFFWLSKQLLFPSGLEWRHLSPILAGQEGAGGETKVIFPFTNTWKPGVTLQKTNPIMLQRGNCRGPSIQLSPPLSPPPS

SEQ ID NO: 748856 - protein, 1424 aa, Homo sapiens
WSTILFNVLPYKATDTYILKSPDEASQLLDDHIVMTQNMSFSPYKKPFEQRINSWENKLKLTQEVLEEWLNCQRSWLYLEPIFSSEDINQQLPVESKRYQTMERIWKKIMKNAYENREVINVCSDLRMLDSLRDCNKILDLVQKGLSEYLETKRSAFPRFYFLSDDELLEILSQTKDPTAVQPHLRKCFENIARLLFQEDLEITHMYSAEGEEVQLCFSIYPSSNVEDWLREVERSMKASVHDIIEKAIRAYPTMPRTQWVLNWPGQVTIAGCQTYWTMEVAEALEAGNLRSQLFPQLCQQLSDLVALVRGKLSRMQRAVLSALIVIEVHAKDVVSKLIQENVVSVNDFQWISQLRYYWTNNDLYIRAVNAEFIYGYEYLGNSGRLVITPLTDRCYLTLTGALHLKFGGAPAGPAGTGKTETTKDLGKALAIQTVVFNCSDQLDFMAMGKFFKGLASAGAWACFDEFNRIDIEVLSVVAQQITTIQKAQQQRVERFMFEGVEIPLVPSCAVFITMNPGYAGRTELPDNLKALFRPVAMMVPDYAMITEISLYSFGFNEASVLAKKITTTFKLSSEQLSSQDHYDFGMRAVKTVISAAGNLKRENPSMNEELICLRAIRDVNVPKFLQEDLKLFSGIVSDLFPTIKEEDTDYGILDEAIREACRNSNLKDVEGFLTKCIQLYETTVVRHGLMLVGPTGSGKSTCYRVLAAAMTSLKGQPSISGGMYEAVNYYVLNPKSITMGQLYGEFDLLTHEWTDGIFSSFIRAGAITSDTNKKWYMFDGPVDAIWIENMNTVLDDNKKLCLSSGEIIKLTEAMTMMFEVQDLAVASPATVSRCGMVYLEPSILGLMPFIECWLRKLPPLLKPYEEHFKALFVSFLEESISFVRSSVKEVIASTNCNLTMSLLKLLDCFFKPFLPREGLKKIPSEKLSRIVELIEPWFIFSLIWSVGATGDSSGRTSFSHWLRLKMENEQLTLLFPEEGLVFDYRLEDAGISGTNDSEDEEEEYKQVAWVKWMDSSAPFTMVPDTNYCNIIVPTMDTVQMSHLLDMLLTNKKPVLCIGPTGTGKTLTISDKLLKNLALDYISHFLTFSARTSANQTQDFIDSKLDKRRKGVFGPPLGRNFIFFIDDLNMPALETYGAQPPIELLRQWMDHGGWYDRKIIGAFKNLVDINFVCAMGPPGGGRNTVTPRLMRHFNYLSFAEMDEVSKKRIFSTILGNWLDGLLGEKSYRERVPGAPHIAHFTEPLVDATIMVYATITSQLLPTPAKSHYTFNLRDLSKVFQGMLMADPAKVEDQVQLLRLWYHENCRVFRDRLVNEEDRSWFDQLLKRCMEQWEVTFNKVCPFQPILYGDFMSPGSDVKSYELITSESKMMQVIEEYIEDYNQINTAKLKLVLFMDAMSHICRISRTLRQALGNALLLGVGGSGR

SEQ ID NO: 748857 - protein, 1227 aa, Homo sapiens
MKFGETEMSRYSAEGEEVQLCFSIYPSSNVEDWLREVERSMKASVHDIIEKAIRAYPTMPRTQWVLNWPGQVTIAGCQTYWTMEVAEALEAGNLRSQLFPQLCQQLSDLVALVRGKLSRMQRAVLSALIVIEVHAKDVVSKLIQENVVSVNDFQWISQLRYYWTNNDLYIRAVNAEFIYGYEYLGNSGRLVITPLTDRCYLTLTGALHLKFGGAPAGPAGTGKTETTKDLGKALAIQTVVFNCSDQLDFMAMGKFFKGLASAGAWACFDEFNRIDIEVLSVVAQQITTIQKAQQQRVERFMFEGVEIPLVPSCAVFITMNPGYAGRTELPDNLKALFRPVAMMVPDYAMITEISLYSFGFNEASVLAKKITTTFKLSSEQLSSQDHYDFGMRAVKTVISAAGNLKRENPSMNEELICLRAIRDVNVPKFLQEDLKLFSGIVSDLFPTIKEEDTDYGILDEAIREACRNSNLKDVEGFLTKCIQLYETTVVRHGLMLVGPTGSGKSTCYRVLAAAMTSLKGQPSISGGMYEAVNYYVLNPKSITMGQLYGEFDLLTHEWTDGIFSSFIRAGAITSDTNKKWYMFDGPVDAIWIENMNTVLDDNKKLCLSSGEIIKLTEAMTMMFEVQDLAVASPATVSRCGMVYLEPSILGLMPFIECWLRKLPPLLKPYEEHFKALFVSFLEESISFVRSSVKEVIASTNCNLTMSLLKLLDCFFKPFLPREGLKKIPSEKLSRIVELIEPWFIFSLIWSVGATGDSSGRTSFSHWLRLKMENEQLTLLFPEEGLVFDYRLEDAGISGTNDSEDEEEEYKQVAWVKWMDSSAPFTMVPDTNYCNIIVPTMDTVQMSHLLDMLLTNKKPVLCIGPTGTGKTLTISDKLLKNLALDYISHFLTFSARTSANQTQDFIDSKLDKRRKGVFGPPLGRNFIFFIDDLNMPALETYGAQPPIELLRQWMDHGGWYDRKIIGAFKNLVDINFVCAMGPPGGGRNTVTPRLMRHFNYLSFAEMDEVSKKRIFSTILGNWLDGLLGEKSYRERVPGAPHIAHFTEPLVDATIMVYATITSQLLPTPAKSHYTFNLRDLSKVFQGMLMADPAKVEDQVQLLRLWYHENCRVFRDRLVNEEDRSWFDQLLKRCMEQWEVTFNKVCPFQPILYGDFMSPGSDVKSYELITSESKMMQVIEEYIEDYNQINTAKLKLVLFMDAMSHICRISRTLRQALGNALLLGVGGSG

SEQ ID NO: 748858 - protein, 433 aa, Homo sapiens
ADVVTLEGQRPDAHCHDSQTWASQAWLAQVMVPDTNYCNIIVPTMDTVQMSHLLDMLLTNKKPVLCIGPTGTGKTLTISDKLLKNLALDYISHFLTFSARTSANQTQDFIDSKLDKRRKGVFGPPLGRNFIFFIDDLNMPALETYGAQPPIELLRQWMDHGGWYDRKIIGAFKNLVDINFVCAMGPPGGGRNTVTPRLMRHFNYLSFAEMDEVSKKRIFSTILGNWLDGLLGEKSYRERVPGAPHIAHFTEPLVDATIMVYATITSQLLPTPAKSHYTFNLRDLSKVFQGMLMADPAKVEDQVQLLRLWYHENCRVFRDRLVNEEDRSWFDQLLKRCMEQWEVTFNKVCPFQPILYGDFMSPGSDVKSYELITSESKMMQVIEEYIEDYNQINTAKLKLVLFMDAMSHICRISRTLRQALGNALLLGVGGSGR

SEQ ID NO: 748859 - protein, 78 aa, Homo sapiens
MPCPPGFLTKCIQLYETTVVRHGLMLVGPTGSGKSTVSRAKLGSQCPDSGPVGGCSFNRGWPPFVPLGIEYPSPSPWP

SEQ ID NO: 748860 - protein, 103 aa, Homo sapiens
SSLGLLGNTMVSPAHCPGCLGLVAAGGFYDIACGDLWQEPRPVLDTLAPSKCGGPPEGQGGIMGISTADGRIPGALYPFVCCLQYGGWALPAACQPSLARDNL

SEQ ID NO: 748861 - protein, 201 aa, Homo sapiens
MAARTAFGAVCRRLWQGLGNFSVNTSKGNTAKNGGLLLSTNMKWVQFSNLHVDVPKDLTKPVVTISDEPDILYKRLSVLVKGHDKAVLDSYEYFAVLAAKELGISIKVHEPPRKIERFTLLQSVHIYKKHRVQYEMRTLYRCLELEHLTGSTADVYLEYIQRNLPEGVAMEVTKTQLEQLPEHIKEPIWETLSEEKEESKS

SEQ ID NO: 748862 - protein, 201 aa, Homo sapiens; identical to SEQ ID NO: 748861

SEQ ID NO: 748863 - protein, 201 aa, Homo sapiens; identical to SEQ ID NO: 748861

SEQ ID NO: 748864 - protein, 201 aa, Homo sapiens; identical to SEQ ID NO: 748861

SEQ ID NO: 748865 - protein, 160 aa, Homo sapiens
MKWVQFSNLHVDVPKDLTKPVVTISDEPDILYKRLSVLVKGHDKAVLDSYEYFAVLAAKELGISIKVHEPPRKIERFTLLQSVHIYKKHRVQYEMRTLYRCLELEHLTGSTADVYLEYIQRNLPEGVAMEVTKTQLEQLPEHIKEPIWETLSEEKEESKS

SEQ ID NO: 748866 - protein, 201 aa, Homo sapiens
MAARTAFGAVCRRLWQGLGNFSVNTSKGNTAKNGGLLLSTNMKWVQFSNLHVDVPKDLTKPVVTISDEPDILYKRLSVLVKGHDKAVLDSYEYFAVLAAKELGISIKVHEPPRKIERFTLLQSVHIYKKHRVQYEMRTLYRCLELEHLTGSTADVYLEYIQRNLPEGVAMEVTKTQLEQLPEHIKEPIWETLSEEKEGWAR

SEQ ID NO: 748867 - protein, 192 aa, Homo sapiens
MAARTAFGAVCRRLWQGLGNFSVNTSKGNTAKNGGLLLSTNMKWVQFSNLHVDVPKDLTKPVVTISDEPDILYKRLSVLVKGHDKAVLDSYEYFAVLAAKELGISIKVHEPPRKIERFTLLQSVHIYKKHRVQYEMRTLYRCLELEHLTGSTADVYLEYIHKHEQTTLTESRKSENSILLRYWCSIISLYHF

SEQ ID NO: 748868 - protein, 164 aa, Homo sapiens
VCARERMRMASPQACARSVLMPLAWLPSAICTQGVLPRIDRIFTRCTSPETPKELRGFGVDSLWVEVADPPYQDFLPPPGPGWRSDLPPPLPRPRGDGPGGPGPRGPFGRKACSLRNGQGGRETRSCIRRKKKKKIVQSIGKYFSLLSFSLRSPLYFGKCHSVC

SEQ ID NO: 748869 - protein, 102 aa, Homo sapiens
NRDRNSHPAHLSADIDECGTEGANCGADQFCVNTEGSYECRDCAKACLGCMGAGPGRCKKCSPGYQQVGSKCLDVDECETEVCPGENKQCENTEGGYRCICA

SEQ ID NO: 748870 - protein, 209 aa, Homo sapiens
MPSMLVVNVHLAPGRANPHGVCVNTSLNHSLIYPIFVVHVSRIQCLCSRIWFSLHVFGVCAYRCAWCGLSPRPVCKRHPTQRPRQDPGLWAVVPGLPLQGRCVLLREHPCLGSNPGSGRQVVGVAASSASLDDAQEHAQSQRAQLLGSLTLGWALGRQPFGECVLMVVSGVSLTNNPPCPLDTGVPSSLAVFLIRVPHRPTARCVSPDL

SEQ ID NO: 748871 - protein, 209 aa, Homo sapiens; identical to SEQ ID NO: 748870

SEQ ID NO: 748872 - protein, 149 aa, Homo sapiens
EAGDERDVGGASEESQAMQATVSIILPVHNAEPWLDECLRSVLQQDFEGTMELSVFNDASKDKSGAIIEKWRVKLEDSGVHVIIGGHDSPSPRGVGYAKNQAVAQSSGSYLCFLDSDDVMMPQRVRLQHEAAVQHPSSLLVRGYVNYIV

SEQ ID NO: 748873 - protein, 334 aa, Homo sapiens
EAGDERDVGGGVRGEPGHAGHVSIILPVHNAEPWLDECLRSVLQQDFEDKSGAIIEKWRVKLEDSGVHVIIGGHDSPSPRGVGYAKNQAVAQSSGSYLCFLDSDDVMMPQRVRLQHEAAVQHPSSIIGCRVRRDPPNSTERYTRWINQLTPEQLLTQVFTSNGPTVIMPTWFCSRAWFSHVGPFNEGGQGVPEDLLFFYEHLRKGGGVIRVDQSLLLYRHHPQAATHCVLETTIWTHRVRFLEEQALPRWAAFTIWNAGKQGRRLYRSLTAGSQRKVVAFCDVDENKIRKGFYCHEDSQERPKPRIPILHFRAARPPFVICVKLDPQGAPLRTT

SEQ ID NO: 748874 - protein, 334 aa, Homo sapiens; identical to SEQ ID NO: 748873

SEQ ID NO: 748875 - protein, 334 aa, Homo sapiens; identical to SEQ ID NO: 748873

SEQ ID NO: 748876 - protein, 196 aa, Homo sapiens
MPLLLPPCRASRRTCCSSTSTSGRAAASSAWTRVSCCIATTHRRPRTASSNPGRQFPPENCEDTEVSATCLPRAAALSWKAGRRPRLASRPLRTTIWTHRVRFLEEQALPRWAAFTIWNAGKQGRRLYRSLTAGSQRKVVAFCDVDENKIRKGFYCHEDSQERPKPRIPILHFRAARPPFVICVKLDPQGAPLRTT

SEQ ID NO: 748877 - protein, 209 aa, Homo sapiens; identical to SEQ ID NO: 748870

SEQ ID NO: 748878 - protein, 542 aa, Homo sapiens
MEPDSVIEDKTIELMCSVPRSLWLGCANLVESMCALSCLQSMPSVRCLQISNGTSSVIVSRKRPSEGNYQKEKDLCIKYFDQWSESDQVEFVEHLISRMCHYQHGHINSYLKPMLQRDFITALPEQGLDHIAENILSYLDARSLCAAELVCKEWQRVISEGMLWKKLIERMVRTDPLWKGLSERRGWDQYLFKNRPTDGPPNSFYRSLYPKIIQDIETIESNWRCGRHNLQRIQCRSENSKGVYCLQYDDEKIISGLRDNSIKIWDKTSLECLKVLTGHTGSVLCLQYDERVIVTGSSDSTVRVWDVNTGEVLNTLIHHNEAVLHLRFSNGLMVTCSKDRSIAVWDMASATDITLRRVLVGHRAAVNVVDFDDKYIVSASGDRTIKVWSTSTCEFVRTLNGHKRGIACLQYRDRLVVSGSSDNTIRLWDIECGACLRVLEGHEELVRCIRFDNKRIVSGAYDGKIKVWDLQAALDPRAPASTLCLRTLVEHSGRVFRLQFDEFQIISSSHDDTILIWDFLNVPPSAQNETHSPSRTYTYISR

SEQ ID NO: 748879 - protein, 510 aa, Homo sapiens
MEDQDEDKSPKKNTPWQISNGTSSVIVSRKRPSEGNYQKEKDLCIKYFDQWSESDQVEFVEHLISRMCHYQHGHINSYLKPMLQRDFITALPEQGLDHIAENILSYLDARSLCAAELVCKEWQRVISEGMLWKKLIERMVRTDPLWKGLSERRGWDQYLFKNRPTDGPPNSFYRSLYPKIIQDIETIESNWRCGRHNLQRIQCRSENSKGVYCLQYDDEKIISGLRDNSIKIWDKTSLECLKVLTGHTGSVLCLQYDERVIVTGSSDSTVRVWDVNTGEVLNTLIHHNEAVLHLRFSNGLMVTCSKDRSIAVWDMASATDITLRRVLVGHRAAVNVVDFDDKYIVSASGDRTIKVWSTSTCEFVRTLNGHKRGIACLQYRDRLVVSGSSDNTIRLWDIECGACLRVLEGHEELVRCIRFDNKRIVSGAYDGKIKVWDLQAALDPRAPASTLCLRTLVEHSGRVFRLQFDEFQIISSSHDDTILIWDFLNVPPSAQNETHSPSRTYTYISR

SEQ ID NO: 748880 - protein, 444 aa, Homo sapiens
MCHYQHGHINSYLKPMLQRDFITALPEQGLDHIAENILSYLDARSLCAAELVCKEWQRVISEGMLWKKLIERMVRTDPLWKGLSERRGWDQYLFKNRPTDGPPNSFYRSLYPKIIQDIETIESNWRCGRHNLQRIQCRSENSKGVYCLQYDDEKIISGLRDNSIKIWDKTSLECLKVLTGHTGSVLCLQYDERVIVTGSSDSTVRVWDVNTGEVLNTLIHHNEAVLHLRFSNGLMVTCSKDRSIAVWDMASATDITLRRVLVGHRAAVNVVDFDDKYIVSASGDRTIKVWSTSTCEFVRTLNGHKRGIACLQYRDRLVVSGSSDNTIRLWDIECGACLRVLEGHEELVRCIRFDNKRIVSGAYDGKIKVWDLQAALDPRAPASTLCLRTLVEHSGRVFRLQFDEFQIISSSHDDTILIWDFLNVPPSAQNETHSPSRTYTYISR

SEQ ID NO: 748881 - protein, 72 aa, Homo sapiens
MRPPQPCGTNTSVLEDQDEDKSPKKNTPWQISNGTSSVIVSRKRPSEGNYQKEKDLCIKYFDQWSESDQVEF

SEQ ID NO: 748882 - protein, 332 aa, Homo sapiens [sequence omitted]

SEQ ID NO: 748883 - protein, 902 aa, Homo sapiens [sequence omitted]

SEQ ID NO: 748884 - protein, 832 aa, Homo sapiens
MHSPPPRPAPSPGTWESQPARSVRLGGPGGGAGGAGGGRVLECPSIRITSISPTPEPPAALEDNPDAWGDGSPRDYPPPEGFGGYREAGAQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFPLGLPFSPPAPFRPPPLPASPPLEGPFPSQSDVHPLPAEGYNKVGPGYGPGEGAPEQEKSRGGYSSGFRDSVPIQGITLEEVSEIIGRDLSGFPAPPGEEPPA

SEQ ID NO: 748885 - protein, 901 aa, Homo sapiens
MGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGAQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFPLGLPFSPPAPFRPPPLPASPPLEGPFPSQSDVHPLPAEGYNKVGPGYGPGEGAPEQEKSRGGYSSGFRDSVPIQGITLEEGGCGTGGCECECVQEIALHVC

SEQ ID NO: 748886 - protein, 780 aa, Homo sapiens
WGRTRGAWFSHLIPGGGAGASPAANQGQAGGGTALKKFGGKKFGKVSIITRGLLEGGGSDGGGGFSEKGREGATRVKIQQPPELPPPTQAGTWGLLPDPWGRPAARMRSWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFPLGLPFSPPAPFRPPPLPASPPLEGPFPSQSDVHPLPAEGYNKVGPGYGPGEGAPEQEKSRGGYSSGFRDSVPIQGITLEEGGCGTGGCECECVQEIALHVC

SEQ ID NO: 748887 - protein, 436 aa, Homo sapiens
MFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFPLGLPFSPPAPFRPPPLPASPPLEGPFPSQSDVHPLPAEGYNKVGPGYGPGEGAPEQEKSRGGYSSGFRDSVPIQGITLEEGGCGTGGCECECVQEIALHVC

SEQ ID NO: 748888 - protein, 391 aa, Homo sapiens
LFNPLSALGAAPYMVYVTPWILLVICVSTAEEGSLRALWQFSQRGWGQRRPPLHAQPSQSSSLHCSAAQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFPLGLPFSPPAPFRPPPLPASPPLEGPFPSQSDVHPLPAEGYNKVGPGYGPGEGAPEQEKSRGGYSSGFRDSVPIQGITLEEGGCGTGGCECECVQEIALHVC

SEQ ID NO: 748889 - protein, 791 aa, Homo sapiens
MGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGAQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRVSEIIGRDLSGFPAPPGEEPPA

SEQ ID NO: 748890 - protein, 901 aa, Homo sapiens; identical to SEQ ID NO: 748885

SEQ ID NO: 748891 - protein, 707 aa, Homo sapiens
MGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGAQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVSEIIGRDLSGFPAPPGEEPPA

SEQ ID NO: 748892 - protein, 727 aa, Homo sapiens
MGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGAQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNESLLPEPRELSSPGNPSPSLSPAPFPSFLEWWLQKLGANPGSSFPSFCLSHCLPSPPPAEVWPSGLVLPWRAGGRSVWRREEGED

SEQ ID NO: 748893 - protein, 397 aa, Homo sapiens
MGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGAQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVDCHSCIVRYLLNSSKVPANLSWRNS

SEQ ID NO: 748894 - protein, 160 aa, Homo sapiens [sequence omitted]

SEQ ID NO: 748895 - protein, 160 aa, Homo sapiens [sequence omitted]

SEQ ID NO: 748896 - protein, 773 aa, Homo sapiens
YVRVMDMGLLELTITAVKSDSDGEQTEPRFELHCSSDVVHIRTCSDSCAALMNLIQYIASYGDLQTPNKADMKPGAFQRRSKVDSSGRSSSRGPVLPEADQQMLRDLMSDAMEEIDMQQGTSSVKPQANGVLDEKSQIQEPCCSDLFLFPDESGNVSQESGPTYASFSHHFISDAMTGVPTENDDFCILFAPKAAMQEKEEEPVIKIMVDDAIVIRDNYFSLPVNKTDTSKAPLHFPIPVIRYVVKEVSLVWHLYGGKDFGTVPPTSPAKSYISPHSSPSHTPTRHGRNTVCGGKGRNHDFLMEIQLSKVKFQHEVYPPCKPDCDSSLSEHPVSRQVFIVQDLEIRDRLATSQMNKFLYLYCSKEMPRKAHSNMLTVKALHVCPESGRSPQECCLRVSLMPLRLNIDQDALFFLKDFFTSLSAEVELQMTPDPEVKKSPGADVTCSLPRHLSTSKEPNLVISFSGPKQPSQNDSANSVEVVNGMEEKNFSAEEASFRDQPVFFREFRFTSEVPIRLDYHGKHVSMDQGTLAGILIGLAQLNCSELKLKRLSYRHGLLGVDKLFSYAITEWLNDIKKNQLPGILGGVGPMHSLVQLVQGLKDLVWLPIEQYRKDGRIVRGFQRGAASFGTSTAMAALELTNRMVQTIQAAAETAYDMVSPGTLSIEPKKTKRFPHHRLAHQPVDLREGVAKAYSVVKEGITDTAQTIYETAAREHESRGVTGAVGEVLRQIPPAVVKPLIVATEATSNVLGGMRNQIRPDVRQDESQKWRHGDD

SEQ ID NO: 748897 - protein, 335 aa, Homo sapiens
MLIHSYAHLILMLIPPYAHPSLCSSLLMLIPPYDSSLLMLIPPYAHPSLCSSLLMFIPPLCSSLLREFRFTSEVPIRLDYHGKHVSMDQGTLAGILIGLAQLNCSELKLKRLSYRHGLLGVDKLFSYAITEWLNDIKKNQLPGILGGVGPMHSLVQLVQGLKDLVWLPIEQYRKDGRIVRGFQRGAASFGTSTAMAALELTNRMVQTIQAAAETAYDMVSPGTLSIEPKKTKRFPHHRLAHQPVDLREGVAKAYSVVKEGITDTAQTIYETAAREHESRGVTGAVGEVLRQIPPAVVKPLIVATEATSNVLGGMRNQIRPDVRQDESQKWRHGDD

SEQ ID NO: 748898 - protein, 773 aa, Homo sapiens; identical to SEQ ID NO: 748896

SEQ ID NO: 748899 - protein, 717 aa, Homo sapiens
YVRVMDMGLLELTITAVKSDSDGEQTEPRFELHCSSDVVHIRTCSDSCAALMNLIQYIASYGDLQTPNKADMKPGAFQRRSKVDSSGRSSSRGPVLPEADQQMLRDLMSDAMEEIDMQQGTSSVKPQANGVLDEKSQIQEPCCSDLFLFPDESGNVSQESGPTYASFSHHFISDAMTGVPTENDDFCILFAPKAAMQEKEEEPVIKIMVDDAIVIRDNYFSLPVNKTDTSKAPLHFPIPVIRYVVKEVSLVWHLYGGKDFGTVPPTSPAKSYISPHSSPSHTPTRHGRNTVCGGKGRNHDFLMEIQLSKVKFQHEVYPPCKPDCDSSLSEHPVSRQVFIVQDLEIRDRLATSQMNKFLYLYCSKEMPRKAHSNMLTVKALHVCPESGRSPQECCLRVSLMPLRLNIDQDALFFLKDFFTSLSAEVELQMTPDPEVKKSPGADVTCSLPRHLSTSKEPNLVISFSGPKQPSQNDSANSVEVVNGMEEKNFSAEEASFRDQPVFFREFRFTSEVPIRLDYHGKHVSMDQGTLAGILIGLAQLNCSELKLKRLSYRHGLLGVDKLFSYAITEWLNDIKKNQLPGILGGVGPMHSLVQLVQGLKDLVWLPIEQYRKDGRIVRGFQRGAASFGTSTAMAALELTNRMVQTIQAAAETAYDMVSPGTLSIEPKKTKRFPHHRLAHQPVDLREGVAKAYSVVKEVTEYLGGHIRTLLCAFPTFT

SEQ ID NO: 748900 - protein, 650 aa, Homo sapiens
YVRVMDMGLLELTITAVKSDSDGEQTEPRFELHCSSDVVHIRTCSDSCAALMNLIQYIASYGDLQTPNKADMKPGAFQRRSKVDSSGRSSSRGPVLPEADQQMLRDLMSDAMEEIDMQQGTSSVKPQANGVLDEKSQIQEPCCSDLFLFPDESGNVSQESGPTYASFSHHFISDAMTGVPTENDDFCILFAPKAAMQEKEEEPVIKIMVDDAIVIRDNYFSLPVNKTDTSKAPLHFPIPVIRYVVKEVSLVWHLYGGKDFGTVPPTSPAKSYISPHSSPSHTPTRHGRNTVCGGKGRNHDFLMEIQLSKVKFQHEVYPPCKPDCDSSLSEHPVSRQVFIVQDLEIRDRLATSQMNKFLYLYCSKEMPRKAHSNMLTVKALHVCPESGRSPQECCLRVSLMPLRLNIDQDALFFLKDFFTSLSAEVELQMTPDPEVKKSPGADVTCSLPRHLSTSKEPNLVISFSGPKQPSQNDSANSVEVVNGMEEKNFSAEEASFRDQPVFFREFRFTSEVPIRLDYHGKHVSMDQGTLAGILIGLAQLNCSELKLKRLSYRHGLLGVDKLFSYAITEWLNDIKKNQLPGILGGVGPMHSLVQLVQGLKDLVWLPIEQYRKDGRIVRGFQRGAASFGTSTAMAALELTNRMVQTIQVSF

SEQ ID NO: 748901 - protein, 509 aa, Homo sapiens
YVRVMDMGLLELTITAVKSDSDGEQTEPRFELHCSSDVVHIRTCSDSCAALMNLIQYIASYGDLQTPNKADMKPGAFQRRSKVDSSGRSSSRGPVLPEADQQMLRDLMSDAMEEIDMQQGTSSVKPQANGVLDEKSQIQEPCCSDLFLFPDESGNVSQESGPTYASFSHHFISDAMTGVPTENDDFCILFAPKAAMQEKEEEPVIKIMVDDAIVIRDNYFSLPVNKTDTSKAPLHFPIPVIRYVVKEVSLVWHLYGGKDFGTVPPTSPAKSYISPHSSPSHTPTRHGRNTVCGGKGRNHDFLMEIQLSKVKFQHEVYPPCKPDCDSSLSEHPVSRQVFIVQDLEIRDRLATSQMNKFLYLYCSKEMPRKAHSNMLTVKALHVCPESGRSPQECCLRVSLMPLRLNIDQDALFFLKDFFTSLSAEVELQMTPDPEVKKSPGADVTCSLPRHLSTSKEPNLVISFSGPKQPSQNDSANSVEVVNGMEEKNFSAEEASFRDQPVFFRRSGLW

SEQ ID NO: 748902 - protein, 588 aa, Homo sapiens
GGAWAGLYKPAAGGRRGVGVCGCWAGGAQAAGPEPGEARERRRRGSDSLPGETYGPKPCKCVLSRGLGSATATPPRGVAQVSRSPATPPSSAPGSGPREGGRSLCVAYFLRRRLQQRLHPARQLLLQGMAGYLSESDFVMVEEGFSTRDLLKELTLGASQATTDEVAAFFVADLGAIVRKHFCFLKCLPRVRPFYAVKCNSSPGVLKVLAQLGLGFSCANKAEMELVQHIGIPASKIICANPCKQIAQIKYAAKHGIQLLSFDNEMELAKVVKSHPSAKMVLCIATDDSHSLSCLSLKFGVSLKSCRHLLENAKKHHVEVVGVSFHIGSGCPDPQAYAQSIADARLVFEMGTELGHKMHVLDLGGGFPGTEGAKVRFEEIASVINSALDLYFPEGCGVDIFAELGRYYVTSAFTVAVSIIAKKEVLLDQPGREEENGSTSKTIVYHLDEGVYGIFNSVLFDNICPTPILQKKPSTEQPLYSSSLWGPAVDGCDCVAEGLWLPQLHVGDWLVFDNMGAYTVGMGSPFWGTQACHITYAMSRVAWEALRRQLMAAEQEDDVEGVCKPLSCGWEITDTLCVGPVFTPASIM

SEQ ID NO: 748903 - protein, 277 aa, Homo sapiens
GGAWAGLYKPAAGGRRGVGVCGCWAGGAQAAGPEPGEARERRRRGSDSLPGETYGPKPCKCVLSRGLGSATATPPRGVAQVSRSPATPPSSAPGSGPREGGRSLAEMELVQHIGIPASKIICANPCKQIAQIKYAAKHGIQLLSFDNEMELAKVVKSHPSAKMVLCIATDDSHSLSCLSLKFGVSLKSCRHLLENAKKHHVEVVGVSFHIGSGCPDPQAYAQSIADARLVFEMGTELGHKMHVLDLGGGFPGTEGAKVRFEEICFCDQAQTLRDPLD

SEQ ID NO: 748904 - protein, 608 aa, Homo sapiens
GGAWAGLYKPAAGGRRGVGVCGCWAGGAQAAGPEPGEARERRRRGSDSLPGETYGPKPCKCVLSRGLGSATATPPRGVAQVSRSPATPPSSAPGSGPREGGRSLCVAYFLRRRLQQRLHPARQLLLQGMAGYLSESDFVMVEEGFSTRDLLKELTLGASQATTDEVAAFFVADLGAIVRKHFCFLKCLPRVRPFYAVKCNSSPGVLKVLAQLGLGFSCANKAEMELVQHIGIPASKIICANPCKQIAQIKYAAKHGIQLLSFDNEMELAKVVKSHPSAKMVLCIATDDSHSLSCLSLKFGVSLKSCRHLLENAKKHHVEVVGVSFHIGSGCPDPQAYAQSIADARLVFEMGTELGHKMHVLDLGGGFPGTEGAKVRFEEIASVINSALDLYFPEGCGVDIFAELGRYYVTSAFTVAVSIIAKKEVLLDQPGREAPLPPPHIATCAASEPSPPAEENGSTSKTIVYHLDEGVYGIFNSVLFDNICPTPILQKKPSTEQPLYSSSLWGPAVDGCDCVAEGLWLPQLHVGDWLVFDNMGAYTVGMGSPFWGTQACHITYAMSRVAWEALRRQLMAAEQEDDVEGVCKPLSCGWEITDTLCVGPVFTPASIM

SEQ ID NO: 748905 - protein, 460 aa, Homo sapiens
MAGYLSESDFVMVEEGFSTRDLLKELTLGASQATTDEVAAFFVADLGAIVRKHFCFLKCLPRVRPFYAVKCNSSPGVLKVLAQLGLGFSCANKAEMELVQHIGIPASKIICANPCKQIAQIKYAAKHGIQLLSFDNEMELAKVVKSHPSAKMVLCIATDDSHSLSCLSLKFGVSLKSCRHLLENAKKHHVEVVGVSFHIGSGCPDPQAYAQSIADARLVFEMGTELGHKMHVLDLGGGFPGTEGAKVRFEEIASVINSALDLYFPEGCGVDIFAELGRYYVTSAFTVAVSIIAKKEVLLDQPGREEENGSTSKTIVYHLDEGVYGIFNSVLFDNICPTPILQKKPSTEQPLYSSSLWGPAVDGCDCVAEGLWLPQLHVGDWLVFDNMGAYTVGMGSPFWGTQACHITYAMSRVAWEALRRQLMAAEQEDDVEGVCKPLSCGWEITDTLCVGPVFTPASIM

SEQ ID NO: 748906 - protein, 460 aa, Homo sapiens; identical to SEQ ID NO: 748905

SEQ ID NO: 748907 - protein, 600 aa, Homo sapiens
GGAWAGLYKPAAGGRRGVGVCGCWAGGAQAAGPEPGEARERRRRGSDSLPGETYGPKPCKCVLSRGLGSATATPPRGVAQVSRSPATPPSSAPGSGPREGGRSLCVAYFLRRRLQQRLHPARQLLLQGMAGYLSESDFVMVEEGFSTRDLLKELTLGASQATTDEVAAFFVADLGAIVRKHFCFLKCLPRVRPFYAVKCNSSPGVLKVLAQLGLGFSCANKAEMELVQHIGIPASKIICANPCKQIAQIKYAAKHGIQLLSFDNEMELAKVVKSHPSAKFVQQRGTACLIRMVLCIATDDSHSLSCLSLKFGVSLKSCRHLLENAKKHHVEVVGVSFHIGSGCPDPQAYAQSIADARLVFEMGTELGHKMHVLDLGGGFPGTEGAKVRFEEIASVINSALDLYFPEGCGVDIFAELGRYYVTSAFTVAVSIIAKKEVLLDQPGREEENGSTSKTIVYHLDEGVYGIFNSVLFDNICPTPILQKKPSTEQPLYSSSLWGPAVDGCDCVAEGLWLPQLHVGDWLVFDNMGAYTVGMGSPFWGTQACHITYAMSRVAWEALRRQLMAAEQEDDVEGVCKPLSCGWEITDTLCVGPVFTPASIM

SEQ ID NO: 748908 - protein, 365 aa, Homo sapiens
MELVQHIGIPASKIICANPCKQIAQIKYAAKHGIQLLSFDNEMELAKVVKSHPSAKMVLCIATDDSHSLSCLSLKFGVSLKSCRHLLENAKKHHVEVVGVSFHIGSGCPDPQAYAQSIADARLVFEMGTELGHKMHVLDLGGGFPGTEGAKVRFEEIASVINSALDLYFPEGCGVDIFAELGRYYVTSAFTVAVSIIAKKEVLLDQPGREEENGSTSKTIVYHLDEGVYGIFNSVLFDNICPTPILQKKPSTEQPLYSSSLWGPAVDGCDCVAEGLWLPQLHVGDWLVFDNMGAYTVGMGSPFWGTQACHITYAMSRVAWEALRRQLMAAEQEDDVEGVCKPLSCGWEITDTLCVGPVFTPASIM

SEQ ID NO: 748909 - protein, 365 aa, Homo sapiens; identical to SEQ ID NO: 748908

SEQ ID NO: 748910 - protein, 490 aa, Homo sapiens
GGAWAGLYKPAAGGRRGVGVCGCWAGGAQAAGPEPGEARERRRRGSDSLPGETYGPKPCKCVLSRGLGSATATPPRGVAQVSRSPATPPSSAPGSGPREGGRSLCVAYFLRRRLQQRLHPARQLLLQGMAGYLSESDFVMVEEGFSTRDLLKELTLGASQATTDEVAAFFVADLGAIVRKHFCFLKCLPRVRPFYAVKCNSSPGVLKVLAQLGLGFSCANKAEMELVQHIGIPASKIICANPCKQIAQIKYAAKHGIQLLSFDNEMELAKVVKSHPSAKMVLCIATDDSHSLSCLSLKFGVSLKSCRHLLENAKKHHVEVVGVSFHIGSGCPDPQAYAQSIADARLVFEMGTELGHKMHVLDLGGGFPGTEGAKVRFEEIASVINSALDLYFPEGCGVDIFAELGRYYVTSAFTVAVSIIAKKEVLLDQPGREEENGSTSKTIVYHLDEGVYGIFNSVLFDNICPTPILQKSKNHSPCYMSLESIHFIAV

SEQ ID NO: 748911 - protein, 530 aa, Homo sapiens
GGAWAGLYKPAAGGRRGVGVCGCWAGGAQAAGPEPGEARERRRRGSDSLPGETYGPKPCKCVLSRGLGSATATPPRGVAQVSRSPATPPSSAPGSGPREGGRSLCVAYFLRRRLQQRLHPARQLLLQGMAGYLSESDFVMVEEGFSTRDLLKELTLGASQATTAEMELVQHIGIPASKIICANPCKQIAQIKYAAKHGIQLLSFDNEMELAKVVKSHPSAKMVLCIATDDSHSLSCLSLKFGVSLKSCRHLLENAKKHHVEVVGVSFHIGSGCPDPQAYAQSIADARLVFEMGTELGHKMHVLDLGGGFPGTEGAKVRFEEIASVINSALDLYFPEGCGVDIFAELGRYYVTSAFTVAVSIIAKKEVLLDQPGREEENGSTSKTIVYHLDEGVYGIFNSVLFDNICPTPILQKKPSTEQPLYSSSLWGPAVDGCDCVAEGLWLPQLHVGDWLVFDNMGAYTVGMGSPFWGTQACHITYAMSRVAWEALRRQLMAAEQEDDVEGVCKPLSCGWEITDTLCVGPVFTPASIM

SEQ ID NO: 748912 - protein, 529 aa, Homo sapiens
GGAWAGLYKPAAGGRRGVGVCGCWAGGAQAAGPEPGEARERRRRGSDSLPGETYGPKPCKCVLSRGLGSATATPPRGVAQVSRSPATPPSSAPGSGPREGGRSLDEVAAFFVADLGAIVRKHFCFLKCLPRVRPFYAVKCNSSPGVLKVLAQLGLGFSCANKAEMELVQHIGIPASKIICANPCKQIAQIKYAAKHGIQLLSFDNEMELAKVVKSHPSAKMVLCIATDDSHSLSCLSLKFGVSLKSCRHLLENAKKHHVEVVGVSFHIGSGCPDPQAYAQSIADARLVFEMGTELGHKMHVLDLGGGFPGTEGAKVRFEEIASVINSALDLYFPEGCGVDIFAELGRYYVTSAFTVAVSIIAKKEVLLDQPGREEENGSTSKTIVYHLDEGVYGIFNSVLFDNICPTPILQKKPSTEQPLYSSSLWGPAVDGCDCVAEGLWLPQLHVGDWLVFDNMGAYTVGMGSPFWGTQACHITYAMSRVAWEALRRQLMAAEQEDDVEGVCKPLSCGWEITDTLCVGPVFTPASIM

SEQ ID NO: 748913 - protein, 309 aa, Homo sapiens
MVLCIATDDSHSLSCLSLKFGVSLKSCRHLLENAKKHHVEVVGVSFHIGSGCPDPQAYAQSIADARLVFEMGTELGHKMHVLDLGGGFPGTEGAKVRFEEIASVINSALDLYFPEGCGVDIFAELGRYYVTSAFTVAVSIIAKKEVLLDQPGREEENGSTSKTIVYHLDEGVYGIFNSVLFDNICPTPILQKKPSTEQPLYSSSLWGPAVDGCDCVAEGLWLPQLHVGDWLVFDNMGAYTVGMGSPFWGTQACHITYAMSRVAWEALRRQLMAAEQEDDVEGVCKPLSCGWEITDTLCVGPVFTPASIM

SEQ ID NO: 748914 - protein, 502 aa, Homo sapiens
GGAWAGLYKPAAGGRRGVGVCGCWAGGAQAAGPEPGEARERRRRGSDSLPGETYGPKPCKCVLSRGLGSATATPPRGVAQVSRSPATPPSSAPGSGPREGGRSLCVAYFLRRRLQQRLHPARQLLLQGMAGYLSESDFVMVEEGFSTRDLLKELTLGASQATTDEVAAFFVADLGAIVRKHFCFLKCLPRVRPFYAVKCNSSPGVLKVLAQLGLGFSCANKAEMELVQHIGIPASKIICANPCKQIAQIKYAAKHGIQLLSFDNEMELAKVVKSHPSAKFVQQRGTACLIRMVLCIATDDSHSLSCLSLKFGVSLKSCRHLLENAKKHHVEVVGVSFHIGSGCPDPQAYAQSIADARLVFEMGTELGHKMHVLDLGGGFPGTEGAKVRFEEIASVINSALDLYFPEGCGVDIFAELGRYYVTSAFTVAVSIIAKKEVLLDQPGREEENGSTSKTIVYHLDEGVYGIFNSVLFDNICPTPILQKSKNHSPCYMSLESIHFIAV

SEQ ID NO: 748915 - protein, 394 aa, Homo sapiens
GGAWAGLYKPAAGGRRGVGVCGCWAGGAQAAGPEPGEARERRRRGSDSLPGETYGPKPCKCVLSRGLGSATATPPRGVAQVSRSPATPPSSAPGSGPREGGRSLCVAYFLRRRLQQRLHPARQLLLQGMAGYLSESDFVMVEEGFSTRDLLKELTLGASQATTDEVAAFFVADLGAIVRKHFCFLKCLPRVRPFYAVKCNSSPGVLKVLAQLGLGFSCANKAEMELVQHIGIPASKIICANPCKQIAQIKYAAKHGIQLLSFDNEMELAKVVKSHPSAKMVLCIATDDSHSLSCLSLKFGVSLKSCRHLLENAKKHHVEVVGVSFHIGSGCPDPQAYAQSIADARLVFEMGTELGHKMHVLDLGGGFPGTEGAKVRFEEICFCDQAQTLRDPLD

SEQ ID NO: 748916 - protein, 459 aa, Homo sapiens
GGAWAGLYKPAAGGRRGVGVCGCWAGGAQAAGPEPGEARERRRRGSDSLPGETYGPKPCKCVLSRGLGSATATPPRGVAQVSRSPATPPSSAPGSGPREGGRSLCVAYFLRRRLQQRLHPARQLLLQGMAGYLSESDFVMVEEGFSTRDLLKELTLGASQATTDEVAAFFVADLGAIVRKHFCFLKCLPRVRPFYAVKCNSSPGVLKVLAQLGLGFSCANKAEMELVQHIGIPASKIICANPCKQIAQIKYAAKHGIQLLSFDNEMELAKVVKSHPSAKMVLCIATDDSHSLSCLSLKFGVSLKSCRHLLENAKKHHVEVVGVSFHIGSGCPDPQAYAQSIADARLVFEMGTELGHKMHVLDLGGGFPGTEGAKVRFEEIASVINSALDLYFPEGCGVDIFAELGRYYVTSAFTVAVSIIAKKEVLLDQPGREGRCQVGSGALFSPEASDSGWLSRIWF

SEQ ID NO: 748917 - protein, 332 aa, Homo sapiens
GGAWAGLYKPAAGGRRGVGVCGCWAGGAQAAGPEPGEARERRRRGSDSLPGETYGPKPCKCVLSRGLGSATATPPRGVAQVSRSPATPPSSAPGSGPREGGRSLCVAYFLRRRLQQRLHPARQLLLQGMAGYLSESDFVMVEEGFSTRDLLKELTLGASQATTDEVAAFFVADLGAIVRKHFCFLKCLPRVRPFYAVKCNSSPGVLKVLAQLGLGFSCANKIASVINSALDLYFPEGCGVDIFAELGRYYVTSAFTVAVSIIAKKEVLLDQPGREEENGSTSKTIVYHLDEGVYGIFNSVLFDNICPTPILQKSKNHSPCYMSLESIHFIAV

SEQ ID NO: 748918 - protein, 124 aa, Homo sapiens
TSTRLSTQLCPPPTFLASCPQLSAGALAAAKSFFRKSKQLSRNRLGAVASLQHKAHISNTYIVSPFSSYQIASVINSALDLYFPEGCGVDIFAELGRYYVTSAFTVAVSIIAKKEVLLDQPGRE

SEQ ID NO: 748919 - protein, 68 aa, Homo sapiens
EPSPPAEENGSTSKTIVYHLDEGVYGIFNSVLFDNICPTPILQKVSLPHVGLFSVVCVYFNNICCVFI

SEQ ID NO: 748920 - protein, 594 aa, Homo sapiens
MLPRTKYNRFRNDSVTSVDDLLHSLSVSGGGGKVSAARATPAAAPYLVSGEALRKAPDDGPGSLGHLLHKVSHLKLSSSGLRGLSSAARERAGARLSGSCSAPSLAAPDGSAPSAPRAPAMSAARKGRPGDEPLPRPPRGAPHASDQVLGPGVTYVVKYLGCIEVLRSMRSLDFSTRTQITREAISRVCEAVPGAKGAFKKRKPPSKMLSSILGKSNLQFAGMSISLTISTASLNLRTPDSKQIIANHHMRSISFASGGDPDTTDYVAYVAKDPVNRRACHILECCDGLAQDVIGSIGQAFELRFKQYLQCPTKIPALHDRMQSLDEPWTEEEGDGSDHPYYNSIPSKMPPPGGFLDTRLKPRPHAPDTAQFAGKEQTYYQGRHLGDTFGEDWQQTPLRQGSSDIYSTPEGKLHVAPTGEAPTYVNTQQIPPQAWPAAVSSAESSPRKDLFDMKPFEDALKNQPLGPVLSKAASVECISPVSPRAPDAKMLEELQAETWYQGEMSRKEAEGLLEKDGDFLVRKSTTNPGSFVLTGMHNGQAKHLLLVDPEGTIRTKDRVFDSISHLINHHLESSLPIVSAGSELCLQQPVERKQ

SEQ ID NO: 748921 - protein, 557 aa, Homo sapiens
MLPRTKYNRFRNDSVTSVDDLLHSLSVSGGGGKVSAARATPAAAPYLVSGEALRKAPDDGPGSLGHLLHKVSHLKLSSSGLRGLSSAARERAGARLSGSCSAPSLAAPDGSAPSAPRAPAMSAARKGRPGDEPLPRPPRGAPHASDQVLGPGVTYVVKYLGCIEVLRSMRSLDFSTRTQITREAISRVCEAVPGAKGAFKKRKPPSKMLSSILGKSNLQFAGMSISLTISTASLNLRTPDSKQIIANHHMRSISFASGGDPDTTDYVAYVAKDPVNRRACHILECCDGLAQDVIGSIGQAFELRFKQYLQCPTKIPALHDRMQSLDEPWTEEEGDGSDHPYYNSIPSKMPPPGGFLDTRLKPRPHAPDTAQFAGKEQTYYQGRHLGDTFGEDWQQTPLRQGSSDIYSTPEGKLHVAPTGEAPTYVNTQQIPPQAWPAAVSSAESSPRKDLFDMKPFEDALKNQPLGPVLSKAASVECISPVSPRAPDAKMLEELQAETWYQGEMSRKEAEGLLEKDGDFLVRKSTTNPGSFVLTGMHNGQAKHLLLVDPEGTRSNSY

SEQ ID NO: 748922 - protein, 314 aa, Homo sapiens
QEAVYGQNDIHHKVLSLNFSECHTKIRHVDAHATLSDGVVVQVMGLLSNSGQPERKFMQTLFWLLKDLFQINFMFINDMFRYEDEVFGDSEPELDEESEDEVEEEQEERQPSPEPVQENANSGYYEAHPVTNGIEEPLEESSHEPEPEPESETKTEELKPQVEEKNLEELEEKSTTPPPAEPVSLPQEPPKPRVEAKPEVQSQPPRVREQRPRERPGFPPRGPRPGRGDMDQNGSDKRRIIRYPDSSSTFCGNLPPDIGENELRNSSEFETLWNFASIPGVGEAPIGWGWGLDRPTLLARFVGGAWGNRRRRPA

SEQ ID NO: 748923 - protein, 214 aa, Homo sapiens
QEAVYGQNDIHHKVLSLNFSECHTKIRHVDAHATLSDGVVVQVMGLLSNSGQPERKFMQTLFWLLKDLFQINFMFINDMFRYEDEVFGDSEPELDEESEDEVEEEQEERQPSPEPVQENANSGYYEAHPVTNGIEEPLEESSHEPEPEPESETKTEELKPQVEEKNLEELEEKSTTPPPAEPVSLPQEPPKAFSWASVTSKNLPPSGTVSSSGI

SEQ ID NO: 748924 - protein, 74 aa, Homo sapiens
FTHLIWQSRIVIPAVIDFPKRESALRGWLYNYIIMAGNKCNVLYYISSLEKWGFRRVRKIVTFSRCPLHKTLHI

SEQ ID NO: 748925 - protein, 97 aa, Homo sapiens
TLKRPWSTSEVSTIAIFSSVEDRGGVPSWLQTLDEGWGLRASQRASQEVVLPLLKASEAVLGLLGVGTTSVLQPFLEEVFSFLQHQKLAKDNIGFVK

SEQ ID NO: 748926 - protein, 642 aa, Homo sapiens
ARRRRRRRRWRRRRRRGGEGSGGQPKQWLSEGEQRAATKAAEERRRWRRCSSGRDWYGGSTGQTPLHSQGGGGGSGGGRRRTPRGMPKEKYEPPDPRRMYTIMSSEEAANGKKSHWAELEISGKVRSLSASLWSLTHLTALHLSDNSLSRIPSDIAKLHNLVYLDLSSNKIRSLPAELGNMVSLRELHLNNNLLRVLPFELGKLFQLQTLGLKGNPLTQDILNLYQEPDGTRRLLNYLLDNLSGTAKRITTEQPPPRSWIMLQEPDRTRPTALFSVMCYNVLCDKYATRQLYGYCPSWALNWDYRKKAIIQEILSCNADIVSLQEVETEQYYSFFLVELKERGYNGFFSPKSRARTMSEQERKHVDGCAIFFKTEKFTLVQKHTVEFNQLAMANSEGSEAMLNRVMTKDNIGVAVLLELRKESIEMPSGKPHLGTEKQLILVANAHMHWDPEYSDVKLVQTMMFLSEVKNIIDKASRNLKSSVLGEFGTIPLVLCADLNSLPDSGVVEYLSTGGVETNHKDFKELRYNESLTNFSCHGKNGTTNGRITHGFKLQSAYESGLMPYTNYTFDFKGIIDYIFYSKPQLNTLGILGPLDHHWLVENNISGCPHPLIPSDHFSLFAQLELLLPFLPQVNGIHLPGRR

SEQ ID NO: 748927 - protein, 642 aa, Homo sapiens; identical to SEQ ID NO: 748926

SEQ ID NO: 748928 - protein, 382 aa, Homo sapiens
MLQEPDRTRPTALFSVMCYNVLCDKYATRQLYGYCPSWALNWDYRKKAIIQEILSCNADIVSLQEVETEQYYSFFLVELKERGYNGFFSPKSRARTMSEQERKHVDGCAIFFKTEKFTLVQKHTVEFNQLAMANSEGSEAMLNRVMTKDNIGVAVLLELRKESIEMPSGKPHLGTEKQLILVANAHMHWDPEYSDVKLVQTMMFLSEVKNIIDKASRNLKSSVLGEFGTIPLVLCADLNSLPDSGVVEYLSTGGVETNHKDFKELRYNESLTNFSCHGKNGTTNGRITHGFKLQSAYESGLMPYTNYTFDFKGIIDYIFYSKPQLNTLGILGPLDHHWLVENNISGCPHPLIPSDHFSLFAQLELLLPFLPQVNGIHLPGRR

SEQ ID NO: 748929 - protein, 642 aa, Homo sapiens; identical to SEQ ID NO: 748926

SEQ ID NO: 748930 - protein, 642 aa, Homo sapiens; identical to SEQ ID NO: 748926

SEQ ID NO: 748931 - protein, 642 aa, Homo sapiens; identical to SEQ ID NO: 748926

SEQ ID NO: 748932 - protein, 509 aa, Homo sapiens
ARRRRRRRRWRRRRRRGGEGSGGQPKQWLSEGEQRAATKAAEERRRWRRCSSGRDWYGGSTGQTPLHSQGGGGGSGGGRRRTPRGMPKEKYEPPDPRRMYTIMSSEEAANGKKSHWAELEISGKVRSLSASLWSLTHLTALHLSDNSLSRIPSDIAKLHNLVYLDLSSNKIRSLPAELGNMVSLRELHLNNNLLRVLPFELGKLFQLQTLGLKGNPLTQDILNLYQEPDGTRRLLNYLLDNLSGTAKRITTEQPPPRSWIMLQEPDRTRPTALFSVMCYNVLCDKYATRQLYGYCPSWALNWDYRKKAIIQEILSCNADIVSLQEVETEQYYSFFLVELKERGYNGFFSPKSRARTMSEQERKHVDGCAIFFKTEKFTLVQKHTVEFNQLAMANSEGSEAMLNRVMTKDNIGVAVLLELRKESIEMPSGKPHLGTEKQLILVANAHMHWDPEYSDVKLVQTMMFLSEVKNIIDKASRNLKSSVLGEFGTIPLVLCADLNSLPDSGKKIM

SEQ ID NO: 748933 - protein, 557 aa, Homo sapiens
MPKEKYEPPDPRRMYTIMSSEEAANGKKSHWAELEISGKVRSLSASLWSLTHLTALHLSDNSLSRIPSDIAKLHNLVYLDLSSNKIRSLPAELGNMVSLRELHLNNNLLRVLPFELGKLFQLQTLGLKGNPLTQDILNLYQEPDGTRRLLNYLLDNLSGTAKRITTEQPPPRSWIMLQEPDRTRPTALFSVMCYNVLCDKYATRQLYGYCPSWALNWDYRKKAIIQEILSCNADIVSLQEVETEQYYSFFLVELKERGYNGFFSPKSRARTMSEQERKHVDGCAIFFKTEKFTLVQKHTVEFNQLAMANSEGSEAMLNRVMTKDNIGVAVLLELRKESIEMPSGKPHLGTEKQLILVANAHMHWDPEYSDVKLVQTMMFLSEVKNIIDKASRNLKSSVLGEFGTIPLVLCADLNSLPDSGVVEYLSTGGVETNHKDFKELRYNESLTNFSCHGKNGTTNGRITHGFKLQSAYESGLMPYTNYTFDFKGIIDYIFYSKPQLNTLGILGPLDHHWLVENNISGCPHPLIPSDHFSLFAQLELLLPFLPQVNGIHLPGRR

SEQ ID NO: 748934 - protein, 558 aa, Homo sapiens
ADLEYPRSPTRPRRMYTIMSSEEAANGKKSHWAELEISGKVRSLSASLWSLTHLTALHLSDNSLSRIPSDIAKLHNLVYLDLSSNKIRSLPAELGNMVSLRELHLNNNLLRVLPFELGKLFQLQTLGLKGNPLTQDILNLYQEPDGTRRLLNYLLDNLSGTAKRITTEQPPPRSWIMLQEPDRTRPTALFSVMCYNVLCDKYATRQLYGYCPSWALNWDYRKKAIIQEILSCNADIVSLQEVETEQYYSFFLVELKERGYNGFFSPKSRARTMSEQERKHVDGCAIFFKTEKFTLVQKHTVEFNQLAMANSEGSEAMLNRVMTKDNIGVAVLLELRKESIEMPSGKPHLGTEKQLILVANAHMHWDPEYSDVKLVQTMMFLSEVKNIIDKASRNLKSSVLGEFGTIPLVLCADLNSLPDSGVVEYLSTGGVETNHKDFKELRYNESLTNFSCHGKNGTTNGRITHGFKLQSAYESGLMPYTNYTFDFKGIIDYIFYSKPQLNTLGILGPLDHHWLVENNISGCPHPLIPSDHFSLFAQLELLLPFLPQVNGIHLPGRR

SEQ ID NO: 748935 - protein, 382 aa, Homo sapiens; identical to SEQ ID NO: 748928

SEQ ID NO: 748936 - protein, 642 aa, Homo sapiens; identical to SEQ ID NO: 748926

SEQ ID NO: 748937 - protein, 650 aa, Homo sapiens
ARRRRRRRRWRRRRRRGGEGSGGQPKQWLSEGEQRAATKAAEERRRWRRCSSGRDWYGGSTGQTPLHSQGGGGGSGGGRRRTPRGMPKEKYEPPDPRRMYTIMSSEEAANGKKSHWAELEISGKVRSLSASLWSLTHLTALHLSDNSLSRIPSDIAKLHNLVYLDLSSNKIRSLPAELGNMVSLRELHLNNNLLRVLPFELGKLFQLQTLGLKGNPLTQDILNLYQEPDGTRRLLNYLLDNLSGTAKRITTEQPPPRSWIMLQEPDRTRPTALFSVMCYNVLCDKYATRQLYGYCPSWALNWDYRKKAIIQEILSCNADIVSLQEVETEQYYSFFLVELKERGYNGFFSPKSRARTMSEQERKHVDGCAIFFKTEKFTLVQKHTVEFNQLAMANSEGSEAMLNRVMTKDNIGVAVLLELRKESIEMPSGKPHLGTEKQLILVANAHMHWDPEYSDVKLVQTMMFLSEVKNIIDKASRNLKSSVLGEFGTIPLVLCADLNSLPDSGVVEYLSTGGVETNHKDFKELRYNESLTNFSCHGKNGTTNGRITHGFKLQSAYESGLMPYTNYTFDFKGIIDYIFYSKPQLNTLGILGPLDHHWLVENNISGCPHPLIPSDHFSLFAQLELLLPFLPQVNGIHLPGRRHTAFCGSV

SEQ ID NO: 748938 - protein, 120 aa, Homo sapiens
RQGLALSPRLECSGVTSAHCNLHLQGSSGFCTSASGVAGSTGAYHHAWLIFVFFVETGFHCVAQAGLKLLASSDLPNLASQSAEIKSVSHHTQPVLCNLNEEKITWALRNNFYPGPLLSS

SEQ ID NO: 748939 - protein, 215 aa, Homo sapiens
MANRRVGRGCWEVSPTERRPPAGLRGPAAEEEASSPPVLSLSHFCRSPFLCFGDVLLGASRTLSLALDNPNEEVAEVKISHFPAADLGFSVSQRCFVLQPKEKIVISVNWTPLKEGRVREIMTFLVNDVLKHQAILLGNAEEQKKKKRSLWDTIKKKKISASTSHNRRVSNIQNVNKTFSVSQKVDRVRSPLQACENLAMNEGGPPTENNSLILE

SEQ ID NO: 748940 - protein, 114 aa, Homo sapiens
MQFGFLGSWRPSLSSISYIEHSRCFHIILIFLREWTNYFLLNSLFATFHKALVLNNRHGAAWSTKRLNFIFLVETGFQDVGQAALELLMSGDLPASASQSAGITSVDHCTQLLF

SEQ ID NO: 748941 - protein, 343 aa, Homo sapiens
MAGNCSWEAHPGNRNKMCPGLSEAPELYSRGFLTIEQIAMLPPPAVMNYIFLLLCLCGLVGNGLVLWFFGFSIKRNPFSIYFLHLASADVGYLFSKAVFSILNTGGFLGTFADYIRSVCRVLGLCMFLTGVSLLPAVSAERCASVIFPAWYWRRRPKRLSAVVCALLWVLSLLVTCLHNYFCVFLGRGAPGAACRHMDIFLGILLFLLCCPLMVLPCLALILHVECRARRRQRSAKLNHVILAMVSVFLVSSIYLGIDWFLFWVFQIPAPFPEYVTDLCICINSSAKPIVYFLAGRDKSQRLWEPLRVVFQRALRDGAELGEAGGSTPNTVTMEMQCPPGNAS

SEQ ID NO: 748942 - protein, 343 aa, Homo sapiens; identical to SEQ ID NO: 748941

SEQ ID NO: 748943 - protein, 343 aa, Homo sapiens; identical to SEQ ID NO: 748941

SEQ ID NO: 748944 - protein, 343 aa, Homo sapiens; identical to SEQ ID NO: 748941

SEQ ID NO: 748945 - protein, 46 aa, Homo sapiens
MADIQTERAYQKQPTIFQNKKRVLLGETGKEKLLRYYKNIGLGFKT

SEQ ID NO: 748946 - protein, 80 aa, Homo sapiens
AAAYYYYLLLEFKLLTDVRGHASVSDDGSNSSPAREALQTAVREKPDRGLGSQSRFLGSGVSKRGPRCWEPPREAGRLFL

SEQ ID NO: 748947 - protein, 445 aa, Homo sapiens
MLPWTALGLALSLRLALARSGAERGPPASAPRGDLMFLLDSSASVSHYEFSRVREFVGQLVAPLPLGTGALRASLVHVGSRPYTEFPFGQHSSGEAAQDAVRASAQRMGDTHTGLALVYAKEQLFAEASGARPGVPKVLVWVTDGGSSDPVGPPMQELKDLGVTVFIVSTGRGNFLELSAAASAPAEKHLHFVDVDDLHIIVQELRGSILDAMRPQQLHATEITSSGFRLAWPPLLTADSGYYVLELVPSAQPGAARRQQLPGNATDWIWAGLDPDTDYDVALVPESNVRLLRPQILRVRTRPGEAGPGASGPESGAGPAPTQLAALPAPEEAGPERIVISHARPRSLRVSWAPALGSAAALGYHVQFGPLRGGEAQRVEVPAGRNCTTLQGLAPGTAYLVTVTAAFRSGRESALSAKACTPDGPRPRPRPVPRAPTPGTASREP

SEQ ID NO: 748948 - protein, 557 aa, Homo sapiens
MATPREGRGRVLLSRGHCWPSPTQAGEICPGSHCPSGRPLQPATSRLGLTKTPRLKSSCLTSGTLQSCWGCVLGPGVWAPHWVGYMGNRPSVVPLDRASTNHLPLPCLFLQEAQVAWVLRVSLNSCLLSPFKPLCPCPPASAPRGDLMFLLDSSASVSHYEFSRVREFVGQLVAPLPLGTGALRASLVHVGSRPYTEFPFGQHSSGEAAQDAVRASAQRMGDTHTGLALVYAKEQLFAEASGARPGVPKVLVWVTDGGSSDPVGPPMQELKDLGVTVFIVSTGRGNFLELSAAASAPAEKHLHFVDVDDLHIIVQELRGSILDAMRPQQLHATEITSSGFRLAWPPLLTADSGYYVLELVPSAQPGAARRQQLPGNATDWIWAGLDPDTDYDVALVPESNVRLLRPQILRVRTRPGEAGPGASGPESGAGPAPTQLAALPAPEEAGPERIVISHARPRSLRVSWAPALGSAAALGYHVQFGPLRGGEAQRVEVPAGRNCTTLQGLAPGTAYLVTVTAAFRSGRESALSAKACTPDGPRPRPRPVPRAPTPGTASREP

SEQ ID NO: 748949 - protein, 233 aa, Homo sapiens
MRPQQLHATEITSSGFRLAWPPLLTADSGYYVLELVPSAQPGAARRQQLPGNATDWIWAGLDPDTDYDVALVPESNVRLLRPQILRVRTRPGEAGPGASGPESGAGPAPTQLAALPAPEEAGPERIVISHARPRSLRVSWAPALGSAAALGYHVQFGPLRGGEAQRVEVPAGRNCTTLQGLAPGTAYLVTVTAAFRSGRESALSAKACTPDGPRPRPRPVPRAPTPGTASREP

SEQ ID NO: 748950 - protein, 445 aa, Homo sapiens; identical to SEQ ID NO: 748947

SEQ ID NO: 748951 - protein, 297 aa, Homo sapiens
NPYTAEVEARGVIGRGVFIVSTGRGNFLELSAAASAPAEKHLHFVDVDDLHIIVQELRGSILDAMRPQQLHATEITSSGFRLAWPPLLTADSGYYVLELVPSAQPGAARRQQLPGNATDWIWAGLDPDTDYDVALVPESNVRLLRPQILRVRTRPGEAGPGASGPESGAGPAPTQLAALPAPEEAGPERIVISHARPRSLRVSWAPALGSAAALGYHVQFGPLRGGEAQRVEVPAGRNCTTLQGLAPGTAYLVTVTAAFRSGRESALSAKACTPDGPRPRPRPVPRAPTPGTASREP

SEQ ID NO: 748952 - protein, 233 aa, Homo sapiens; identical to SEQ ID NO: 748949

SEQ ID NO: 748953 - protein, 419 aa, Homo sapiens
MLPWTALGLALSLRLALARSGAERGPPASAPRGDLMFLLDSSASVSHYEFSRVREFVGQLVAPLPLGTGALRASLVHVGSRPYTEFPFGQHSSGEAAQDAVRASAQRMGDTHTGLALVYAKEQLFAEASGARPGVPKVLVWVTDGGSSDPVGPPMQELKDLGVTVFIVSTGRGNFLELSAAASAPAEKHLHFVDVDDLHIIVQELRGSILDAMRPQQLHATEITSSGFRLAWPPLLTADSGYYVLELVPSAQPGAARRQQLPGNATDWIWAGLDPDTDYDVALVPESNVRLAWRDPAAAPAPSPPRAGRRVGPWVIIESVRPRTVQGGAPVRLPRVKTGPQVARAGLGRAAWVLDVDRKRKGNRGKLAPGTAYLVTVTAAFRSGRESALSAKACTPDGPRPRPRPVPRAPTPGTASREP

SEQ ID NO: 748954 - protein, 143 aa, Homo sapiens
KNSTRGGHEAPPSARAARARCPPRPARPTARARAHAPCPAPRPRGPPAVSRKPASPPSREGRRLPEGPCVPNPERRRPTRQTGAGPAFPHADSARPRPSPCGRRASPPGACPPGLGPRLAGPRSSPGPIPAQSRASCGSVGDN

SEQ ID NO: 748955 - protein, 445 aa, Homo sapiens; identical to SEQ ID NO: 748947

SEQ ID NO: 748956 - protein, 445 aa, Homo sapiens; identical to SEQ ID NO: 748947

SEQ ID NO: 748957 - protein, 278 aa, Homo sapiens
MLPWTALGLALSLRLALARSGAERGPPASAPRGDLMFLLDSSASVSHYEFSRVREFVGQLVAPLPLGTGALRASLVHVGSRPYTEFPFGQHSSGEAAQDAVRASAQRMGDTHTGLALVYAKEQLFAEASGARPGVPKVLVWVTDGGSSDPVGPPMQELKDLGVTVFIVSTGRGNFLELSAAASAPAEKHLHFVDVDDLHIIVQELRGSILDAMRPQQLHATEITSSGFRLAWPPLLTADSGQHLLGTVALPSCPGHQLGPASSHWESEEWGRAGHSGP

SEQ ID NO: 748958 - protein, 445 aa, Homo sapiens; identical to SEQ ID NO: 748947

SEQ ID NO: 748959 - protein, 238 aa, Homo sapiens
MLPWTALGLALSLRLALARSGAERGPPASAPRGDLMFLLDSSASVSHYEFSRVREFVGQLVAPLPLGTGALRASLVHVGSRPYTEFPFGQHSSGEAAQDAVRASAQRMGDTHTGLALVYAKEQLFAEASGARPGVPKVLVWVTDGGSTLGSAAALGYHVQFGPLRGGEAQRVEVPAGRNCTTLQGLAPGTAYLVTVTAAFRSGRESALSAKACTPDGPRPRPRPVPRAPTPGTASREP

SEQ ID NO: 748960 - protein, 445 aa, Homo sapiens; identical to SEQ ID NO: 748947

SEQ ID NO: 748961 - protein, 154 aa, Homo sapiens
ATVCSLFLVALTLSGYWVDPRKNRRRRLGFNYSSQLWNLLLLTWTRTQEQNLRVAIWFLRRKRKAALEWFLYSNFNRRVRDGTRRRKDSLQPEIVETGLAGLELVTSGDPPASASQGVGITAVSHCIWPVCSFHKHLRGSLLQDFRSTSIDGGR

SEQ ID NO: 748962 - protein, 112 aa, Homo sapiens
MCSGRFQNIQVNPDFPRGRISNSFRRTSSTENKTKTLGKLHQEPRQLQSDGKRKILLEELANSDPKLALTGVPIVQWPKRDKCGMEKRRKGPGMVAHTCNPSTLGGPGRWIT

SEQ ID NO: 748963 - protein, 105 aa, Homo sapiens
WSLSQVVVGQRGLLFSILKERRLQELNGEESCVYVSTVIMSTFPTGCNKLTDQTLIYLRRIANVTLIDLRGCKQITRKACEHFISDLSINSLYCLSDEKLIQKIS

SEQ ID NO: 748964 - protein, 1162 aa, Homo sapiens
MEPEEERIRYSQRLRGTMRRRYEDDGISDDEIEGKRTFDLEEKLHTNKYNANFVTFMEGKDFNVEYIQRGGLRDPLIFKNSDGLGIKMPDPDFTVNDVKMCVGSRRMVDVMDVNTQKGIEMTMAQWTRYYETPEEEREKLYNVISLEFSHTRLENMVQRPSTVDFIDWVDNMWPRHLKESQTESTNAILEMQYPKVQKYCLMSVRGCYTDFHVDFGGTSVWYHIHQGGKVFWLIPPTAHNLELYENWLLSGKQGDIFLGDRVSDCQRIELKQGYTFVIPSGWIHAVYTPTDTLVFGGNFLHSFNIPMQLKIYNIEDRTRVPNKFRYPFYYEMCWYVLERYVYCITNRSHLTKEFQKESLSMDLELNGLESGNGDEEAVDREPRRLSSRRSVLTSPVANGVNLDYDGLGKTCRSLPSLKKTLAGDSSSDCSRGSHNGQVWDPQCAPRKDRQVHLTHFELEGLRCLVDKLESLPLHKKCVPTGIEDEDALIADVKILLEELANSDPKLALTGVPIVQWPKRDKLKFPTRPKVRVPTIPITKPHTMKPAPRLTPVRPAAASPIVSGARRRRVRCRKCKACVQGECGVCHYCRDMKKFGGPGRMKQSCVLRQCLAPRLPHSVTCSLCGEVDQNEETQDFEKKLMECCICNEIVHPGCLQMDGEGLLNEELPNCWECPKCYQEDSSEKAQKRKMEESDEEAVQAKVLRPLRSCDEPLTPPPHSPTSMLQLIHDPVSPRGMVTRSSPGAGPSDHHSASRDERFKRRQLLRLQATERTMVREKENNPSGKKELSEVEKAKIRGSYLTVTLQRPTKELHGTSIVPKLQAITASSANLRHSPRVLVQHCPARTPQRGDEEGLGGEEEEEEEEEEEDDSAEEGGAARLNGRGSWAQDGDESWMQREVWMSVFRYLSRRELCECMRVCKTWYKWCCDKRLWTKIDLSRCKAIVPQALSGIIKRQPVSLDLSWTNISKKQLTWLVNRLPGLKDLLLAGCSWSAVSALSTSSCPLLRTLDLRWAVGIKDPQIRDLLTPPADKPGQDNRSKLRNMTDFRLAGLDITDATLRLIIRHMPLLSRLDLSHCSHLTDQSSNLLTAVGSSTRYSLTELNMAGCNKLTDQTLIYLRRIANVTLIDLRGCKQITRKACEHFISDLSINSLYCLSDEKLIQKIS

SEQ ID NO: 748965 - protein, 1298 aa, Homo sapiens
MEPEEERIRYSQRLRGTMRRRYEDDGISDDEIEGKRTFDLEEKLHTNKYNANFVTFMEGKDFNVEYIQRGGLRDPLIFKNSDGLGIKMPDPDFTVNDVKMCVGSRRMVDVMDVNTQKGIEMTMAQWTRYYETPEEEREKLYNVISLEFSHTRLENMVQRPSTVDFIDWVDNMWPRHLKESQTESTNAILEMQYPKVQKYSDAPCIFLRVLWETKAIARIGFSLTSFALCLEVIKKMNYLKMRLYSSTRKSVCEHTIAHNHTVKGKKTYILVNTVEKKKTFFDNVMTENALLFLLLELKIKWKIKGVYKRRVWHFGGADVLFSISTLMLLLFLGRYCLMSVRGCYTDFHVDFGGTSVWYHIHQGGKVFWLIPPTAHNLELYENWLLSGKQGDIFLGDRVSDCQRIELKQGYTFVIPSGWIHAVYTPTDTLVFGGNFLHSFNIPMQLKIYNIEDRTRVPNKFRYPFYYEMCWYVLERYVYCITNRSHLTKEFQKESLSMDLELNGLESGNGDEEAVDREPRRLSSRRSVLTSPVANGVNLDYDGLGKTCRSLPSLKKTLAGDSSSDCSRGSHNGQVWDPQCAPRKDRQVHLTHFELEGLRCLVDKLESLPLHKKCVPTGIEDEDALIADVKILLEELANSDPKLALTGVPIVQWPKRDKLKFPTRPKVRVPTIPITKPHTMKPAPRLTPVRPAAASPIVSGARRRRVRCRKCKACVQGECGVCHYCRDMKKFGGPGRMKQSCVLRQCLAPRLPHSVTCSLCGEVDQNEETQDFEKKLMECCICNEIVHPGCLQMDGEGLLNEELPNCWECPKCYQEDSSEKAQKRKMEESDEEAVQAKVLRPLRSCDEPLTPPPHSPTSMLQLIHDPVSPRGMVTRSSPGAGPSDHHSASRDERFKRRQLLRLQATERTMVREKENNPSGKKELSEVEKAKIRGSYLTVTLQRPTKELHGTSIVPKLQAITASSANLRHSPRVLVQHCPARTPQRGDEEGLGGEEEEEEEEEEEDDSAEEGGAARLNGRGSWAQDGDESWMQREVWMSVFRYLSRRELCECMRVCKTWYKWCCDKRLWTKIDLSRCKAIVPQALSGIIKRQPVSLDLSWTNISKKQLTWLVNRLPGLKDLLLAGCSWSAVSALSTSSCPLLRTLDLRWAVGIKDPQIRDLLTPPADKPGQDNRSKLRNMTDFRLAGLDITDATLRLIIRHMPLLSRLDLSHCSHLTDQSSNLLTAVGSSTRYSLTELNMAGCNKLTDQTLIYLRRIANVTLIDLRGCKQITRKACEHFISDLSINSLYCLSDEKLIQKIS

SEQ ID NO: 748966 - protein, 1162 aa, Homo sapiens; identical to SEQ ID NO: 748964

SEQ ID NO: 748967 - protein, 1023 aa, Homo sapiens
RVVELDTGYDVASSLYNSHTRLENMVQRPSTVDFIDWVDNMWPRHLKESQTESTNAILEMQYPKVQKYCLMSVRGCYTDFHVDFGGTSVWYHIHQGGKPTNLELYENWLLSGKQGDIFLGDRVSDCQRIELKQGYTFVIPSGWIHAVYTPTDTLVFGGNFLHSFNIPMQLKIYNIEDRTRVPNKFRYPFYYEMCWYVLERYVYCITNRSHLTKEFQKESLSMDLELNGLESGNGDEEAVDREPRRLSSRRSVLTSPVANGVNLDYDGLGKTCRSLPSLKKTLAGDSSSDCSRGSHNGQVWDPQCAPRKDRQVHLTHFELEGLRCLVDKLESLPLHKKCVPTGIEDEDALIADVKILLEELANSDPKLALTGVPIVQWPKRDKLKFPTRPKVRVPTIPITKPHTMKPAPRLTPVRPAAASPIVSGARRRRVRCRKCKACVQGECGVCHYCRDMKKFGGPGRMKQSCVLRQCLAPRLPHSVTCSLCGEVDQNEETQDFEKKLMECCICNEIVHPGCLQMDGEGLLNEELPNCWECPKCYQEDSSEKAQKRKMEESDEEAVQAKVLRPLRSCDEPLTPPPHSPTSMLQLIHDPVSPRGMVTRSSPGAGPSDHHSASRDERFKRRQLLRLQATERTMVREKENNPSGKKELSEVEKAKIRGSYLTVTLQRPTKELHGTSIVPKLQAITASSANLRHSPRVLVQHCPARTPQRGDEEGLGGEEEEEEEEEEEDDSAEEGGAARLNGRGSWAQDGDESWMQREVWMSVFRYLSRRELCECMRVCKTWYKWCCDKRLWTKIDLSRCKAIVPQALSGIIKRQPVSLDLSWTNISKKQLTWLVNRLPGLKDLLLAGCSWSAVSALSTSSCPLLRTLDLRWAVGIKDPQIRDLLTPPADKPGQDNRSKLRNMTDFRLAGLDITDATLRLIIRHMPLLSRLDLSHCSHLTDQSSNLLTAVGSSTRYSLTELNMAGCNKLTDQTLIYLRRIANVTLIDLRGCKQITRKACEHFISDLSINSLYCLSDEKLIQKIS

SEQ ID NO: 748968 - protein, 831 aa, Homo sapiens
MCWYVLERYVYCITNRSHLTKEFQKESLSMDLELNGLESGNGDEEAVDREPRRLSSRRSVLTSPVANGVNLDYDGLGKTCRSLPSLKKTLAGDSSSDCSRGSHNGQVWDPQCAPRKDRQVHLTHFELEGLRCLVDKLESLPLHKKCVPTGIEDEDALIADVKILLEELANSDPKLALTGVPIVQWPKRDKLKFPTRPKVRVPTIPITKPHTMKPAPRLTPVRPAAASPIVSGARRRRVRCRKCKACVQGECGVCHYCRDMKKFGGPGRMKQSCVLRQCLAPRLPHSVTCSLCGEVDQNEETQDFEKKLMECCICNEIVHPGCLQMDGEGLLNEELPNCWECPKCYQEDSSEKAQKRKMEESDEEAVQAKVLRPLRSCDEPLTPPPHSPTSMLQLIHDPVSPRGMVTRSSPGAGPSDHHSASRDERFKRRQLLRLQATERTMVREKENNPSGKKELSEVEKAKIRGSYLTVTLQRPTKELHGTSIVPKLQAITASSANLRHSPRVLVQHCPARTPQRGDEEGLGGEEEEEEEEEEEDDSAEEGGAARLNGRGSWAQDGDESWMQREVWMSVFRYLSRRELCECMRVCKTWYKWCCDKRLWTKIDLSRCKAIVPQALSGIIKRQPVSLDLSWTNISKKQLTWLVNRLPGLKDLLLAGCSWSAVSALSTSSCPLLRTLDLRWAVGIKDPQIRDLLTPPADKPGQDNRSKLRNMTDFRLAGLDITDATLRLIIRHMPLLSRLDLSHCSHLTDQSSNLLTAVGSSTRYSLTELNMAGCNKLTDQTLIYLRRIANVTLIDLRGCKQITRKACEHFISDLSINSLYCLSDEKLIQKIS

SEQ ID NO: 748969 - protein, 523 aa, Homo sapiens
MECCICNEIVHPGCLQMDGEGLLNEELPNCWECPKCYQEDSSEKAQKRKMEESDEEAVQAKVLRPLRSCDEPLTPPPHSPTSMLQLIHDPVSPRGMVTRSSPGAGPSDHHSASRDERFKRRQLLRLQATERTMVREKENNPSGKKELSEVEKAKIRGSYLTVTLQRPTKELHGTSIVPKLQAITASSANLRHSPRVLVQHCPARTPQRGDEEGLGGEEEEEEEEEEEDDSAEEGGAARLNGRGSWAQDGDESWMQREVWMSVFRYLSRRELCECMRVCKTWYKWCCDKRLWTKIDLSRCKAIVPQALSGIIKRQPVSLDLSWTNISKKQLTWLVNRLPGLKDLLLAGCSWSAVSALSTSSCPLLRTLDLRWAVGIKDPQIRDLLTPPADKPGQDNRSKLRNMTDFRLAGLDITDATLRLIIRHMPLLSRLDLSHCSHLTDQSSNLLTAVGSSTRYSLTELNMAGCNKLTDQTLIYLRRIANVTLIDLRGCKQITRKACEHFISDLSINSLYCLSDEKLIQKIS

SEQ ID NO: 748970 - protein, 1162 aa, Homo sapiens; identical to SEQ ID NO: 748964

SEQ ID NO: 748971 - protein, 223 aa, Homo sapiens
DSRTQACSGIIKRQPVSLDLSWTNISKKQLTWLVNRLPGLKDLLLAGCSWSAVSALSTSSCPLLRTLDLRWAVGIKDPQIRDLLTPPADKPGQDNRSKLRNMTDFRLAGLDITDATLRLIIRHMPLLSRLDLSHCSHLTDQSSNLLTAVGSSTRYSLTELNMAGCNKLTDQTLIYLRRIANVTLIDLRGCKQITRKACEHFISDLSINSLYCLSDEKLIQKIS

SEQ ID NO: 748972 - protein, 1298 aa, Homo sapiens; identical to SEQ ID NO: 748965

SEQ ID NO: 748973 - protein, 1075 aa, Homo sapiens
MEPEEERIRYSQRLRGTMRRRYEDDGISDDEIEGKRTFDLEEKLHTNKYNANFVTFMEGKDFNVEYIQRGGLRDPLIFKNSDGLGIKMPDPDFTVNDVKMCVGSRRMVDVMDVNTQKGIEMTMAQWTRYYETPEEEREKLYNVISLEFSHTRLENMVQRPSTVDFIDWVDNMWPRHLKESQTESTNAILEMQYPKVQKYSDAPCIFLRVLWETKAIARIGFSLTSFALCLEVIKKMNYLKMRLYSSTRKSVCEHTIAHNHTVKGKKTYILVNTVEKKKTFFDNVMTENALLFLLLELKIKWKIKGVYKRRVWHFGGADVLFSISTLMLLLFLGRYCLMSVRGCYTDFHVDFGGTSVWYHIHQGGKVFWLIPPTAHNLELYENWLLSGKQGDIFLGDRVSDCQRIELKQGYTFVIPSGWIHAVYTPTDTLVFGGNFLHSFNIPMQLKIYNIEDRTRVPNKFRYPFYYEMCWYVLERYVYCITNRSHLTKEFQKESLSMDLELNGLESGNGDEEAVDREPRRLSSRRSVLTSPVANGVNLDYDGLGKTCRSLPSLKKTLAGDSSSDCSRGSHNGQVWDPQCAPRKDRQVHLTHFELEGLRCLVDKLESLPLHKKCVPTGIEDEDALIADVKILLEELANSDPKLALTGVPIVQWPKRDKLKFPTRPKVRVPTIPITKPHTMKPAPRLTPVRPAAASPIVSGARRRRVRCRKCKACVQGECGVCHYCRDMKKFGGPGRMKQSCVLRQCLAPRLPHSVTCSLCGEVDQNEETQDFEKKLMECCICNEIVHPGCLQMDGEGLLNEELPNCWECPKCYQEDSSEKAQKRKMEESDEEAVQAKVLRPLRSCDEPLTPPPHSPTSMLQLIHDPVSPRGMVTRSSPGAGPSDHHSASRDERFKRRQLLRLQATERTMVREKENNPSGKKELSEVEKAKIRGSYLTVTLQRPTKELHGTSIVPKLQAITASSANLRHSPRVLVQHCPARTPQRGDEEGLGGEEEEEEEEEEEDDSAEEGGAARLNGRGSWAQDGDESWMQREVWMSVFRYLSRRELCECMRVCKTWYKWSATRDFDTGQNNRAEL

SEQ ID NO: 748974 - protein, 308 aa, Homo sapiens
MEPEEERIRYSQRLRGTMRRRYEDDGISDDEIEGKRTFDLEEKLHTNKYNANFVTFMEGKDFNVEYIQRGGLRDPLIFKNSDGLGIKMPDPDFTVNDVKMCVGSRRMVDVMDVNTQKGIEMTMAQWTRYYETPEEEREKLYNVISLEFSHTRLENMVQRPSTVDFIDWVDNMWPRHLKESQTESTNAILEMQYPKVQKYCLMSVRGCYTDFHVDFGGTSVWYHIHQGGKVFWLIPPTAHNLELYENWLLSGKQGDIFLGDRVSDCQRIELKQGYTFVIPSGWIHAVYTPTDTLVFGGKSTSDESSDHL

SEQ ID NO: 748975 - protein, 961 aa, Homo sapiens
MSVRGCYTDFHVDFGGTSVWYHIHQGGKVFWLIPPTAHNLELYENWLLSGKQGDIFLGDRVSDCQRIELKQGYTFVIPSGWIHAVYTPTDTLVFGGNFLHSFNIPMQLKIYNIEDRTRVPNKFRYPFYYEMCWYVLERYVYCITNRSHLTKEFQKESLSMDLELNGLESGNGDEEAVDREPRRLSSRRSVLTSPVANGVNLDYDGLGKTCRSLPSLKKTLAGDSSSDCSRGSHNGQVWDPQCAPRKDRQVHLTHFELEGLRCLVDKLESLPLHKKCVPTGIEDEDALIADVKILLEELANSDPKLALTGVPIVQWPKRDKLKFPTRPKVRVPTIPITKPHTMKPAPRLTPVRPAAASPIVSGARRRRVRCRKCKACVQGECGVCHYCRDMKKFGGPGRMKQSCVLRQCLAPRLPHSVTCSLCGEVDQNEETQDFEKKLMECCICNEIVHPGCLQMDGEGLLNEELPNCWECPKCYQEDSSEKAQKRKMEESDEEAVQAKVLRPLRSCDEPLTPPPHSPTSMLQLIHDPVSPRGMVTRSSPGAGPSDHHSASRDERFKRRQLLRLQATERTMVREKENNPSGKKELSEVEKAKIRGSYLTVTLQRPTKELHGTSIVPKLQAITASSANLRHSPRVLVQHCPARTPQRGDEEGLGGEEEEEEEEEEEDDSAEEGGAARLNGRGSWAQDGDESWMQREVWMSVFRYLSRRELCECMRVCKTWYKWCCDKRLWTKIDLSRCKAIVPQALSGIIKRQPVSLDLSWTNISKKQLTWLVNRLPGLKDLLLAGCSWSAVSALSTSSCPLLRTLDLRWAVGIKDPQIRDLLTPPADKPGQDNRSKLRNMTDFRLAGLDITDATLRLIIRHMPLLSRLDLSHCSHLTDQSSNLLTAVGSSTRYSLTELNMAGCNKLTDQTLIYLRRIANVTLIDLRGCKQITRKACEHFISDLSINSLYCLSDEKLIQKIS

SEQ ID NO: 748976 - protein, 961 aa, Homo sapiens; identical to SEQ ID NO: 748975

SEQ ID NO: 748977 - protein, 1281 aa, Homo sapiens
MRRRYEDDGISDDEIEGKRTFDLEEKLHTNKYNANFVTFMEGKDFNVEYIQRGGLRDPLIFKNSDGLGIKMPDPDFTVNDVKMCVGSRRMVDVMDVNTQKGIEMTMAQWTRYYETPEEEREKLYNVISLEFSHTRLENMVQRPSTVDFIDWVDNMWPRHLKESQTESTNAILEMQYPKVQKYSDAPCIFLRVLWETKAIARIGFSLTSFALCLEVIKKMNYLKMRLYSSTRKSVCEHTIAHNHTVKGKKTYILVNTVEKKKTFFDNVMIENALLFLLLELKIKWKIKGVYKRRVWHFGGADVLFSISTLMLLLFLGRYCLMSVRGCYTDFHVDFGGTSVWYHIHQGGKVFWLIPPTAHNLELYENWLLSGKQGDIFLGDRVSDCQRIELKQGYTFVIPSGWIHAVYTPTDTLVFGGNFLHSFNIPMQLKIYNIEDRTRVPNKFRYPFYYEMCWYVLERYVYCITNRSHLTKEFQKESLSMDLELNGLESGNGDEEAVDREPRRLSSRRSVLTSPVANGVNLDYDGLGKTCRSLPSLKKTLAGDSSSDCSRGSHNGQVWDPQCAPRKDRQVHLTHFELEGLRCLVDKLESLPLHKKCVPTGIEDEDALIADVKILLEELANSDPKLALTGVPIVQWPKRDKLKFPTRPKVRVPTIPITKPHTMKPAPRLTPVRPAAASPIVSGARRRRVRCRKCKACVQGECGVCHYCRDMKKFGGPGRMKQSCVLRQCLAPRLPHSVTCSLCGEVDQNEETQDFEKKLMECCICNEIVHPGCLQMDGEGLLNEELPNCWECPKCYQEDSSEKAQKRKMEESDEEAVQAKVLRPLRSCDEPLTPPPHSPTSMLQLIHDPVSPRGMVTRSSPGAGPSDHHSASRDERFKRRQLLRLQATERTMVREKENNPSGKKELSEVEKAKIRGSYLTVTLQRPTKELHGTSIVPKLQAITASSANLRHSPRVLVQHCPARTPQRGDEEGLGGEEEEEEEEEEEDDSAEEGGAARLNGRGSWAQDGDESWMQREVWMSVFRYLSRRELCECMRVCKTWYKWCCDKRLWTKIDLSRCKAIVPQALSGIIKRQPVSLDLSWTNISKKQLTWLVNRLPGLKDLLLAGCSWSAVSALSTSSCPLLRTLDLRWAVGIKDPQIRDLLTPPADKPGQDNRSKLRNMTDFRLAGLDITDATLRLIIRHMPLLSRLDLSHCSHLTDQSSNLLTAVGSSTRYSLTELNMAGCNKLTDQTLIYLRRIANVTLIDLRGCKQITRKACEHFISDLSINSLYCLSDEKLIQKIS

SEQ ID NO: 748978 - protein, 1474 aa, Homo sapiens
MEPEEERIRYSQRLRGTMRRRYEDDGISDDEIEGKRTFDLEEKLHTNKYNANFVTFMEGKDFNVEYIQRGGLRDPLIFKNSDGLGIKMPDPDFTVNDVKMCVGSRRMVDVMDVNTQKGIEMTMAQWTRYYETPEEEREKLYNVISLEFSHTRLENMVQRPSTVDFIDWVDNMWPRHLKESQTESTNAILEMQYPKVQKYSDAPCIFLRVLWETKAIARIGFSLTSFALCLEVIKKMNYLKMRLYSSTRKSVCEHTIAHNHTVKGKKTYILVNTVEKKKTFFDNVMTENALLFLLLELKIKWKIKGVYKRRVWHFGGADVLFSISTLMLLLFLGRYCLMSVRGCYTDFHVDFGGTSVWYHIHQGGKVFWLIPPTAHNLELYENWLLSGKQGDIFLGDRVSDCQRIELKQGYTFVIPSGWIHAVYTPTDTLVFGGNFLHSFNIPMQLKIYNIEDRTRVPNKFRYPFYYEMCWYVLERYVYCITNRSHLTKEFQKESLSMDLELNGLESGNGDEEAVDREPRRLSSRRSVLTSPVANGVNLDYDGLGKTCRSLPSLKKTLAGDSSSDCSRGSHNGQVWDPQCAPRKDRQVHLTHFELEGLRCLVDKLESLPLHKKCVPTGIEDEDALIADVKILLEELANSDPKLALTGVPIVQWPKRDKLKFPTRPKVRVPTIPITKPHTMKPAPRLTPVRPAAASPIVSGARRRRVRCRKCKACVQGECGVCHYCRDMKKFGGPGRMKQSCVLRQCLAVSDLLGKEFWGGVAVPKELKYIKCRVKETSELERKGLYSLFGFILYLFSPGLDRRYLVLKIRFNFRLYLIFKQEIQHLKGKSLLSFPSSGRLERTGEAKYRPTENKLVSGAQVVESSSSPVIFPTQNLRSLHPASMLPGVVVENYRTQISHLQFKGNGNDKDLSQFSWILSLSSCEPRLPHSVTCSLCGEVDQNEETQDFEKKLMECCICNEIVHPGCLQMDGEGLLNEELPNCWECPKCYQEDSSEKAQKRKMEESDEEAVQAKVLRPLRSCDEPLTPPPHSPTSMLQLIHDPVSPRGMVTRSSPGAGPSDHHSASRDERFKRRQLLRLQATERTMVREKENNPSGKKELSEVEKAKIRGSYLTVTLQRPTKELHGTSIVPKLQAITASSANLRHSPRVLVQHCPARTPQRGDEEGLGGEEEEEEEEEEEDDSAEEGGAARLNGRGSWAQDGDESWMQREVWMSVFRYLSRRELCECMRVCKTWYKWCCDKRLWTKIDLSRCKAIVPQALSGIIKRQPVSLDLSWTNISKKQLTWLVNRLPGLKDLLLAGCSWSAVSALSTSSCPLLRTLDLRWAVGIKDPQIRDLLTPPADKPGQDNRSKLRNMTDFRLAGLDITDATLRLIIRHMPLLSRLDLSHCSHLTDQSSNLLTAVGSSTRYSLTELNMAGCNKLTDQTLIYLRRIANVTLIDLRGCKQITRKACEHFISDLSINSLYCLSDEKLIQKIS

SEQ ID NO: 748979 - protein, 1446 aa, Homo sapiens
MEPEEERIRYSQRLRGTMRRRYEDDGISDDEIEGKRTFDLEEKLHTNKYNANFVTFMEGKDFNVEYIQRGGLRDPLIFKNSDGLGIKMPDPDFTVNDVKMCVGSRRMVDVMDVNTQKGIEMTMAQWTRYYETPEEEREKLYNVISLEFSHTRLENMVQRPSTVDFIDWVDNMWPRHLKESQTESTNAILEMQYPKVQKYSDAPCIFLRVLWETKAIARIGFSLTSFALCLEVIKKMNYLKMRLYSSTRKSVCEHTIAHNHTVKGKKTYILVNTVEKKKTFFDNVMTENALLFLLLELKIKWKIKGVYKRRVWHFGGADVLFSISTLMLLLFLGRYCLMSVRGCYTDFHVDFGGTSVWYHIHQGGKVFWLIPPTAHNLELYENWLLSGKQGDIFLGDRVSDCQRIELKQGYTFVIPSGWIHAVYTPTDTLVFGGNFLHSFNIPMQLKIYNIEDRTRVPNKFRYPFYYEMCWYVLERYVYCITNRSHLTKEFQKESLSMDLELNGLESGNGDEEAVDREPRRLSSRRSVLTSPVANGVNLDYDGLGKTCRSLPSLKKTLAGDSSSDCSRGSHNGQVWDPQCAPRKDRQVHLTHFELEGLRCLVDKLESLPLHKKCVPTGIEDEDALIADVKLKFPTRPKVRVPTIPITKPHTMKPAPRLTPVRPAAASPIVSGARRRRVRCRKCKACVQGECGVCHYCRDMKKFGGPGRMKQSCVLRQCLAVSDLLGKEFWGGVAVPKELKYIKCRVKETSELERKGLYSLFGFILYLFSPGLDRRYLVLKIRFNLQALPNFQTRDEHLKGKSLLSFPSSGRLERTGEAKYRPTENKLVSGAQVVESSSSPVIFPTQNLRSLHPASMLPGVYVENYRTQISHLQFKGNGNDKDLSQFSWILSLSSCEPRLPHSVTCSLCGEVDQNEETQDFEKKLMECCICNEIVHPGCLQMDGEGLLNEELPNCWECPKCYQEDSSEKAQKRKMEESDEEAVQAKVLRPLRSCDEPLTPPPHSPTSMLQLIHDPVSPRGMVTRSSPGAGPSDHHSASRDERFKRRQLLRLQATERTMVREKENNPSGKKELSEVEKAKIRGSYLTVTLQRPTKELHGTSIVPKLQAITASSANLRHSPRVLVQHCPARTPQRGDEEGLGGEEEEEEEEEEEDDSAEEGGAARLNGRGSWAQDGDESWMQREVWMSVFRYLSRRELCECMRVCKTWYKWCCDKRLWTKIDLSRCKAIVPQALSGIIKRQPVSLDLSWTNISKKQLTWLVNRLPGLKDLLLAGCSWSAVSALSTSSCPLLRTLDLRWAVGIKDPQIRDLLTPPADKPGQDNRSKLRNMTDFRLAGLDITDATLRLIIRHMPLLSRLDLSHCSHLTDQSSNLLTAVGSSTRYSLTELNMAGCNKLTDQTLIYLRRIANVTLIDLRGCKQITRKACEHFISDLSINSLYCLSDEKLIQKIS

SEQ ID NO: 748980 - protein, 723 aa, Homo sapiens
MCSGRFQNIQVNPDFPRGRISNSFRRTSSTENKTKTLGKLHQEPRQLQSDGKRKILLEELANSDPKLALTGVPIVQWPKRDKLKFPTRPKVRVPTIPITKPHTMKPAPRLTPVRPAAASPIVSGARRRRVRCRKCKACVQGECGVCHYCRDMKKFGGPGRMKQSCVLRQCLAPRLPHSVTCSLCGEVDQNEETQDFEKKLMECCICNEIVHPGCLQMDGEGLLNEELPNCWECPKCYQEDSSEKAQKRKMEESDEEAVQAKVLRPLRSCDEPLTPPPHSPTSMLQLIHDPVSPRGMVTRSSPGAGPSDHHSASRDERFKRRQLLRLQATERTMVREKENNPSGKKELSEVEKAKIRGSYLTVTLQRPTKELHGTSIVPKLQAITASSANLRHSPRVLVQHCPARTPQRGDEEGLGGEEEEEEEEEEEDDSAEEGGAARLNGRGSWAQDGDESWMQREVWMSVFRYLSRRELCECMRVCKTWYKWCCDKRLWTKIDLSRCKAIVPQALSGIIKRQPVSLDLSWTNISKKQLTWLVNRLPGLKDLLLAGCSWSAVSALSTSSCPLLRTLDLRWAVGIKDPQIRDLLTPPADKPGQDNRSKLRNMTDFRLAGLDITDATLRLIIRHMPLLSRLDLSHCSHLTDQSSNLLTAVGSSTRYSLTELNMAGCNKLTDQTLIYLRRIANVTLIDLRGCKQITRKACEHFISDLSINSLYCLSDEKLIQKIS

SEQ ID NO: 748981 - protein, 1162 aa, Homo sapiens; identical to SEQ ID NO: 748964

SEQ ID NO: 748982 - protein, 148 aa, Homo sapiens
MEPEEERIRYSQRLRGTMRRRYEDDGISDDEIEGKRTFDLEEKLHTNKYNANFVTFMEGKDFNVEYIQRGGLRDPLIFKNSDGLGIKMPDPDFTVNDVKMCVGSRRMVDVMDVNTQKGIEMTMAQWTRYYETRADHTGAVEISQTSRP

SEQ ID NO: 748983 - protein, 1207 aa, Homo sapiens
MEPEEERIRYSQRLRGTMRRRYEDDGISDDEIEGKRTFDLEEKLHTNKYNANFVTFMEGKDFNVEYIQRGGLRDPLIFKNSDGLGIKMPDPDFTVNDVKMCVGSRRMVDVMDVNTQKGIEMTMAQWTRYYETPEEEREKLYNVISLEFSHTRLENMVQRPSTVDFIDWVDNMWPRHLKESQTESTNAILEMQYPKVQKYSDAPCIFLRVLWETKAIARIGFSLTSFALCLEVIKKMNYLKMRLYSSTRKSVCEHTIAHNHTVKGKKTYILVNTVEKKKTFFDNVMTENALLFLLLELKIKWKIKGVYKRRVWHFGGADVLFSISTLMLLLFLGRYCLMSVRGCYTDFHVDFGGTSVWYHIHQGGKVFWLIPPTAHNLELYENWLLSGKQGDIFLGDRVSDCQRIELKQGYTFVIPSGWIHAVYTPTDTLVFGGNFLHSFNIPMQLKIYNIEDRTRVPNKFRYPFYYEMCWYVLERYVYCITNRSHLTKEFQKESLSMDLELNGLESGNGDEEAVDREPRRLSSRRSVLTSPVANGVNLDYDGLGKTCRSLPSLKKTLAGDSSSDCSRGSHNGQVWDPQCAPRKDRQVHLTHFELEGLRCLVDKLESLPLHKKCVPTGIEDEDALIADVKILLEELANSDPKLALTGVPIVQWPKRDKLKFPTRPKVRVPTIPITKPHTMKPAPRLTPVRPAAASPIVSGARRRRVRCRKCKACVQGECGVCHYCRDMKKFGGPGRMKQSCVLRQCLAPRLPHSVTCSLCGEVDQNEETQDFEKKLMECCICNEIVHPGCLQMDGEGLLNEELPNCWECPKCYQEDSSEKAQKRKMEESDEEAVQAKVLRPLRSCDEPLTPPPHSPTSMLQLIHDPVSPRGMVTRSSPGAGPSDHHSASRDERFKRRQLLRLQATERTMVREKENNPSGKKELSEVEKAKIRGSYLTVTLQRPTKELHGTSIVPKLQAITASSANLRHSPRVLVQHCPARTPQRGDEEGLGGEEEEEEEEEEEDDSAEEGGAARLNGRGSWAQDGDESWMQREVWMSVFRYLSRRELCECMRVCKTWYKWCCDKRLWTKIDLSRCKAIVPQALSGIIKRQPVSLDLSWTNISKKQLTWLVNRLPGLKDLLLAGCSWSAVSALSTSSCPLLRTLDLRWAVGIKDPQIRDLLTPPADKPGQDNRSKLRNMTDFRLAGLDITDATLRLIIRHIVQRLTGIL

SEQ ID NO: 748984 - protein, 4368 aa, Homo sapiens
MAAQVAAREARDFREAPTLRLTSGAGLEAVGAVELEEEEENEEEAAARRARSFAQDARVRFLGGRLAMMLGFTEEKWSQYLESEDNRQVLGEFLESTSPACLVFSFAASGRLAASQEIPRDANHKLVFISKKITESIGVNDFSQVVLFGELPALSLGHVSAFLDEILVPVLSNKNNHKSWSCFTSQDMEYHIEVMKKKMYIFRGKMSRRTLLPIPTVAGKMDLDQNCSENKPPSNERIILHAIESVVIEWSHQIQEIIERDSVQRLLNGLHLSPQAELDFWMMRRENLSCIYDQLQAPVVLKMVKILTTKQSSYFPTLKDIFLAVENALLEAQDVELYLRPLRRHIQCLQETEFPQTRILIAPLFHTICLIWSHSKFYNTPARVIVLLQEFCNLFINQATAYLSPEDLLRGEIEESLEKVQVAVNILKTFKNSFFNYRKKLASYFMGRKLRPWDFQSHLVFCRFDKFLDRLIKIEDIFATTLEFEKLERLEFGGTKGAILNGQVHEMSEELMELCKLFKQSTYDPSDCTNMEFESDYVAFKSKTLEFDRRLGTIICEAFFNCNGLEAAFKLLTIFGNFLEKPVVMEIFSLHYSTLVHMFNTELDVCKQLYNEHMKQIECGHVVLNKNMPFTSGNMKWAQQVLQRLQMFWSNFASLRYLFLGNPDHALVYQKYVEMTTLLDQFESRIYNEWKSNVDEICEFNLNQPLVKFSAINGLLCVNFDPKLVAVLREVKYLLMLKKQDIPDSALAIFKKRNTILKYIGNLDLLVQGYNKLKQTLLEVEYPLIEDELRAIDEQLTAATTWLTWQDDCWGYIERVRAATSELEHRVERTQKNVKVIQQTMRGWARCVLPPRREHRREAAFTLEDKGDLFTKKYKLIQGDGCKIHNLVEENRKLFKANPSLDTWKIYVEFIDDIVVEGFFQAIMHDLDFFLKNTEKQLKPAPFFQAQMILLPPEIVFKPSLDREAGDGFYDLVEEMLCNSFRMSAQMNRIATHLEIKNYQNDMDNMLGLAEVRQEIMNRVVNVINKVLDFRNTLETHTYLWVDDRAEFMKHFLLYGHAVSSDEMDAHANEEIPEQPPTLEQFKEQIDIYEALYVQMSKFEDFRVFDSWFKVDMKPFKVSLLTIIKKWSWMFQEHLLRFVIDSLNELQEFIKETDSGLQRELNEGDHDGLVDIMVHLLAVRSRQRATDELFEPLKETITLLESYGQKMPEQVYIQLEELPERWETTKKIAATVRHEVSPLHNAEVTLIRKKCILFDAKQAEFRERFRHYAPLGFNAENPYTALDKANEELEALEEEMLQMQESTRLFEVALPEYKQMKQCRKEIKLLKGLWDVIIYVRRSIDNWTKTQWRQIHVEQMDVELRRFAKASSITEIWSLNKEVRVWDAYTGLEGTVKDMTASLRAITELQSPALRDRHWHQLMKAIGVKFLINEATTLADLLALRLHRVEDDVRRIVDKAVKELGTEKVITEISQTWATMKFSYEVHYRTGIPLLKSDEQLFETLEHNQVQLQTLLQSKYVEYFIEQVLSWQNKLNIADLVIFTWMEVQRTWSHLESIFVCSEDIRIQLVKDARRFDGVDAEFKELMFKTAKVENVLEATCRPNLYEKLKDLQSRLSLCEKALAEYLETKRIAFPRFYFVSSADLLDILSKGAQPKQVTCHLAKLFDSIADLQFEDNQDVSAHRAVGMYSKEKEYVPFQAECECVGHVETWLLQLEQTMQETVRHSITEAIVAYEEKPRELWIFDFPAQVALTSSQIWWTTDVGIAFSRLEEGYETALKDFHKKQISQLNTLITLLLGELPPGDRQKIMTICTIDVHARDVVAKLISQKQVVVSPQAFTWLSQLRHRWEDTQKHCFVNICDAQFQYFYEYLGNSPRLVITPLTDRCYITLTQSLHLTMSGAPAGPAGTGKTETTKDLGRALGMMVYVFNCSEQMDYKSIGNIYKGLVQTGAWGCFDEFNRISVEVLSVVAVQVKMIHDAIRNRKKRFVFLGEAITLKPSVGIFITMNPGYAGRTELPENLKALFRPCAMVAPDIELICEILLVAEGFVDARALARKFITLYTLCKELLSKQDHYDWGLRAIKSVLVVAGSLKRGDKNRPEDQVLMRALRDFNMPKIVTDDIPVFLGLVGDLFPALDVPRRRKLHFEQMVRQSTLELRLQPEESFILKVVQLEELLAVRHSVFVVGNAGTGKSKILRTLNRTYVNMKQKPVWNDLNPKAVTTDELFGFIHHATREWKDGKIVYSYFIGLFSSILREQANLKHDGPKWIVLDGDIDPMWIESLNTVMDDNKVLTLASNERIALTPFMRLLFEIHHLRSATPATVSRAGILYVNPQDLGWNPYVASWIDRRRHQSEKANLTILFDKYVPACLDKLRTSFKTITSIPESSLVQTLCVLLECLLTPENVPSDSPKEVYEVYFVFACIWAFGGTLLQDQISDYQADFSRWWQKEMKAVKFPSQGTIFDYYVDHKTKKLLPWADKIAQFTMDPDVPLQTVLVHTTETARLRYFMELLLEKGKPLMLVGNAGVGKTVFVGDTLASLSEDYIVSRVPFNYYTTSTALQKILEKPLEKKAGHNYGPGGNKKLIYFIDDMNMPEVDLYGTVQPHTLIRQHIDYGHWYDRQKVMLKEIHNCQYVACMNPMVGSFTISPRLQRHFTVFAFNFPSLDALNTIYGQIFSFHFQQQAFAPSILRSGPTLIQATIAFHQTMMCNFLPTAIKFHYIFNLRDLSNVFQGILFASPECLKGPLDLIHLWLHESARVYGDKLIDKKDCDLFQRRMLETAYKYFEGIDSHMLLQQPLIYCHFADRGKDPHYMPVKDWEVLKTILTETLDNYNELNAAMHLVLFEDAMQHVCRISRILRTPQGCALLVGVGGSGKQSLSRLAAYLRGLEVFQITLTEGYGIQELRVDLANLYIRTGAKNMPTVFLLTDAQVLDESFLVLINDLLASGEIPDLFSDEDVDKIISGIHNEVHALGMVDSRENCWKFFMARVRLQLKIILCFSPVGRTLRVRARKFPAIVNCTAIDWFHAWPQEALVSVSRRFIEETKGIEPVHKDSISLFMAHVHTTVNEMSTRYYQNERRHNYTTPKSFLEQISLFKNLLKKKQNEVSEKKERLVNGIQKLKTTASQVGDLKARLASQEAELQLRNHDAEALITKIGLQTEKVSREKTIADAEERKVTAIQTEVFQKQRECEADLLKAEPALVAATAALNTLNRVNLSELKAFPNPPIAVTNVTAAVMVLLAPRGRVPKDRSWKAAKVFMGKVDDFLQALINYDKEHIPENCLKVVNEHYLKDPEFNPNLIRTKSFAAAGLCAWVINIIKFYEVYCDVEPKRQALAQANLELAAATEKLEAIRKKLVDLDRNLSRLTASFEKATAEKVRCQEEVNQTNKTIKLANRLVKELEAKKIRWGQSIKSFEAQEKTLCGDVLLTAAFVSYVGPFTRQYRQELVHCKWVPFLQQKVSIPLTEGLDLISMLTDDATIAAWNNEGLPSDRMSTENAAILTHCERWPLVIDPQQQGIKWIKNKYGMDLKVTHLGQKGFLNAIETALAFGDVILIENLEETIDPVLDPLLGRNTIKKGKYIRIGDKECEFNKNFRLILHTKLANPHYKPELQAQTTLLNFTVTEDGLEAQLLAEVVSIERPDLEKLKLVLTKHQNDFKIELKYLEDDLLLRLSAAEGSFLDDTKLVERLEATKTTVAEIEHKVIEAKENERKINEARECYRPLAARASLLYFVINDLQKINPLYQFSLKAFNVLFHRAIEQADKVEDMQGRISILMESITHAVFLYTSQALFEKDKLTFLSQMAFQILLRKKEIDPLELDFLLRFTVEHTHLSPVDFLTSQSWSAIKAIAVMEEFRGIDRDVEGSAKQWRKWVESECPEKEKLPQEWKKKSLIQKLILLRAMRPDRMTYALRNFVEEKLGAKYVERTRLDLVKAFEESSPATPIFFILSPGVDALKDLEILGKRLGFTIDSGKFHNVSLGQGQETVAEVALEKASKGGHWVILQNVHLVAKWLGTLEKLLERFSQGSHRDYRVFMSAESAPTPDEHIIPQGLLENSIKITNEPPTGMLANLHAALYNFDQDTLEICSKEQEFKSILFSLCYFHACVAGRLRFGPQGWSRSYPFNPGDLTICASVLYNYLEANSKVPWEDLRYLFGEIMYGGHITDDWDRKLCRVYLEEFVNPSLTEDELMLAPGFAAPPYLDYAGYHQYIEEMLPPESPALYGLHPNAEIEFLTVTSNTLFRTLLEMQPRNALSGDELGQSTEEKVKNVLDDILEKLPEEFNMAEIMQKNSNRSPYVLVCFQECERMNILIREIRISLEQLDLSLKGELALSPAVEAQQFALSYDTVPDTWSKLAYPSTYGLAQWFNDLLLRCREL

SEQ ID NO: 748985 - protein, 167 aa, Homo sapiens
RPRVPSDGCPMAAQVAAREARDFREAPTLRLTSGAGLEAVGAVELEEEEENEEEAAARRARSFAQDARVRFLGGRLAMMLGFTEEKWSQYLESEDNRQVLGEFLESTSPACLVFSFAASGRLAASQEVRGDGQGDLPIQQNYPGETAQSLPFGFPRGAHSGTLTNLA

SEQ ID NO: 748986 - protein, 353 aa, Homo sapiens
RPRVPSDGCPMAAQVAAREARDFREAPTLRLTSGAGLEAVGAVELEEEEENEEEAAARRARSFAQDARVRFLGGRLAMMLGFTEEKWSQYLESEDNRQVLGEFLESTSPACLVFSFAASGRLAASQEIPRDANHKLVFISKKITESIGVNDFSQVVLFGELPALSLGHVSAFLDEILVPVLSNKNNHKSWSCFTSQDMEYHIEVMKKKMYIFRGKMSRRTLLPIPTVAGKMDLDQNCSENKPPSNERIILHAIESVVIEWSHQIQEIIERDSVQRLLNGLHLSPQAELDFWMMRRENLSCIYDQLQAPVVLKMVKILTTKQSSYFPTLKDIFLAVENGKTLVPQPGINITICS

SEQ ID NO: 748987 - protein, 4365 aa, Homo sapiens
MAAQVAAREARDFREAPTLRLTSGAGLEAVGAVELEEEEENEEEAAARRARSFAQDARVRFLGGRLAMMLGFTEEKWSQYLESEDNRQVLGEFLESTSPACLVFSFAASGRLAASQEIPRDANHKLVFISKKITESIGVNDFSQVVLFGELPALSLGHVSAFLDEILVPVLSNKNNHKSWSCFTSQDMEYHIEVMKKKMYIFRGKMSRRTLLPIPTVAGKMDLDQNCSENKPPSNERIILHAIESVVIEWSHQIQEIIERDSVQRLLNGLHLSPQAELDFWMMRRENLSCIYDQLQAPVVLKMVKILTTKQSSYFPTLKDIFLAVENGNSLPFTWDLLRGEIEESLEKVQVAVNILKTFKNSFFNYRKKLASYFMGRKLRPWDFQSHLVFCRFDKFLDRLIKIEDIFATTLEFEKLERLEFGGTKGAILNGQVHEMSEELMELCKLFKQSTYDPSDCTNMEFESDYVAFKSKTLEFDRRLGTIICEAFFNCNGLEAAFKLLTIFGNFLEKPVVMEIFSLHYSTLVHMFNTELDVCKQLYNEHMKQIECGHVVLNKNMPFTSGNMKWAQQVLQRLQMFWSNFASLRYLFLGNPDHALVYQKYVEMTTLLDQFESRIYNEWKSNVDEICEFNLNQPLVKFSAINGLLCVNFDPKLVAVLREVKYLLMLKKQDIPDSALAIFKKRNTILKYIGNLDLLVQGYNKLKQTLLEVEYPLIEDELRAIDEQLTAATTWLTWQDDCWGYIERVRAATSELEHRVERTQKNVKVIQQTMRGWARCVLPPRREHRREAAFTLEDKGDLFTKKYKLIQGDGCKIHNLVEENRKLFKANPSLDTWKIYVEFIDDIVVEGFFQAIMHDLDFFLKNTEKQLKPAPFFQAQMILLPPEIVFKPSLDREAGDGFYDLVEEMLCNSFRMSAQMNRIATHLEIKNYQNDMDNMLGLAEVRQEIMNRVVNVINKVLDFRNTLETHTYLWVDDRAEFMKHFLLYGHAVSSDEMDAHANEEIPEQPPTLEQFKEQIDIYEALYVQMSKFEDFRVFDSWFKVDMKPFKVSLLTIIKKWSWMFQEHLLRFVIDSLNELQEFIKETDSGLQRELNEGDHDGLVDIMVHLLAVRSRQRATDELFEPLKETITLLESYGQKMPEQVYIQLEELPERWETTKKIAATVRHEVSPLHNAEVTLIRKKCILFDAKQAEFRERFRHYAPLGFNAENPYTALDKANEELEALEEEMLQMQESTRLFEVALPEYKQMKQCRKEIKLLKGLWDVIIYVRRSIDNWTKTQWRQIHVEQMDVELRRFAKASSITEIWSLNKEVRVWDAYTGLEGTVKDMTASLRAITELQSPALRDRHWHQLMKAIGVKFLINEATTLADLLALRLHRVEDDVRRIVDKAVKELGTEKVITEISQTWATMKFSYEVHYRTGIPLLKSDEQLFETLEHNQVQLQTLLQSKYVEYFIEQVLSWQNKLNIADLVIFTWMEVQRTWSHLESIFVCSEDIRIQLVKDARRFDGVDAEFKELMFKTAKVENVLEATCRPNLYEKLKDLQSRLSLCEKALAEYLETKRIAFPRFYFVSSADLLDILSKGAQPKQVTCHLAKLFDSIADLQFEDNQDVSAHRAVGMYSKEKEYVPFQAECECVGHVETWLLQLEQTMQETVRHSITEAIVAYEEKPRELWIFDFPAQVALTSSQIWWTTDVGIAFSRLEEGYETALKDFHKKQISQLNTLITLLLGELPPGDRQKIMTICTIDVHARDVVAKLISQKQVVVSPQAFTWLSQLRHRWEDTQKHCFVNICDAQFQYFYEYLGNSPRLVITPLTDRCYITLTQSLHLTMSGAPAGPAGTGKTETTKDLGRALGMMVYVFNCSEQMDYKSIGNIYKGLVQTGAWGCFDEFNRISVEVLSVVAVQVKMIHDAIRNRKKRFVFLGEAITLKPSVGIFITMNPGYAGRTELPENLKALFRPCAMVAPDIELICEILLVAEGFVDARALARKFITLYTLCKELLSKQDHYDWGLRAIKSVLVVAGSLKRGDKNRPEDQVLMRALRDFNMPKIVTDDIPVFLGLVGDLFPALDVPRRRKLHFEQMVRQSTLELRLQPEESFILKVVQLEELLAVRHSVFVVGNAGTGKSKILRTLNRTYVNMKQKPVWNDLNPKAVTTDELFGFIHHATREWKDGKIVYSYFIGLFSSILREQANLKHDGPKWIVLDGDIDPMWIESLNTVMDDNKVLTLASNERIALTPFMRLLFEIHHLRSATPATVSRAGILYVNPQDLGWNPYVASWIDRRRHQSEKANLTILFDKYVPACLDKLRTSFKTITSIPESSLVQTLCVLLECLLTPENVPSDSPKEVYEVYFVFACIWAFGGTLLQDQISDYQADFSRWWQKEMKAVKFPSQGTIFDYYVDHKTKKLLPWADKIAQFTMDPDVPLQTVLVHTTETARLRYFMELLLEKGKPLMLVGNAGVGKTVFVGDTLASLSEDYIVSRVPFNYYTTSTALQKILEKPLEKKAGHNYGPGGNKKLIYFIDDMNMPEVDLYGTVQPHTLIRQHIDYGHWYDRQKVMLKEIHNCQYVACMNPMVGSFTISPRLQRHFTVFAFNFPSLDALNTIYGQIFSFHFQQQAFAPSILRSGPTLIQATIAFHQTMMCNFLPTAIKFHYIFNLRDLSNVFQGILFASPECLKGPLDLIHLWLHESARVYGDKLIDKKDCDLFQRRMLETAYKYFEGIDSHMLLQQPLIYCHFADRGKDPHYMPVKDWEVLKTILTETLDNYNELNAAMHLVLFEDAMQHVCRISRILRTPQGCALLVGVGGSGKQSLSRLAAYLRGLEVFQITLTEGYGIQELRVDLANLYIRTGAKNMPTVFLLTDAQVLDESFLVLINDLLASGEIPDLFSDEDVDKIISGIHNEVHALGMVDSRENCWKFFMARVRLQLKIILCFSPVGRTLRVRARKFPAIVNCTAIDWFHAWPQEALVSVSRRFIEETKGIEPVHKDSISLFMAHVHTTVNEMSTRYYQNERRHNYTTPKSFLEQISLFKNLLKKKQNEVSEKKERLVNGIQKLKTTASQVGDLKARLASQEAELQLRNHDAEALITKIGLQTEKVSREKTIADAEERKVTAIQTEVFQKQRECEADLLKAEPALVAATAALNTLNRVNLSELKAFPNPPIAVTNVTAAVMVLLAPRGRVPKDRSWKAAKVFMGKVDDFLQALINYDKEHIPENCLKVVNEHYLKDPEFNPNLIRTKSFAAAGLCAWVINIIKFYEVYCDVEPKRQALAQANLELAAATEKLEAIRKKLVDLDRNLSRLTASFEKATAEKVRCQEEVNQTNKTIKLANRLVKELEAKKIRWGQSIKSFEAQEKTLCGDVLLTAAFVSYVGPFTRQYRQELVHCKWVPFLQQKVSIPLTEGLDLISMLTDDATIAAWNNEGLPSDRMSTENAAILTHCERWPLVIDPQQQGIKWIKNKYGMDLKVTHLGQKGFLNAIETALAFGDVILIENLEETIDPVLDPLLGRNTIKKGKYIRIGDKECEFNKNFRLILHTKLANPHYKPELQAQTTLLNFTVTEDGLEAQLLAEVVSIERPDLEKLKLVLTKHQNDFKIELKYLEDDLLLRLSAAEGSFLDDTKLVERLEATKTTVAEIEHKVIEAKENERKINEARECYRPLAARASLLYFVINDLQKINPLYQFSLKAFNVLFHRAIEQADKVEDMQGRISILMESITHAVFLYTSQALFEKDKLTFLSQMAFQILLRKKEIDPLELDFLLRFTVEHTHLSPVDFLTSQSWSAIKAIAVMEEFRGIDRDVEGSAKQWRKWVESECPEKEKLPQEWKKKSLIQKLILLRAMRPDRMTYALRNFVEEKLGAKYVERTRLDLVKAFEESSPATPIFFILSPGVDALKDLEILGKRLGFTIDSGKFHNVSLGQGQETVAEVALEKASKGGHWVILQNVHLVAKWLGTLEKLLERFSQGSHRDYRVFMSAESAPTPDEHIIPQGLLENSIKITNEPPTGMLANLHAALYNFDQDTLEICSKEQEFKSILFSLCYFHACVAGRLRFGPQGWSRSYPFNPGDLTICASVLYNYLEANSKVPWEDLRYLFGEIMYGGHITDDWDRKLCRVYLEEFVNPSLTEDELMLAPGFAAPPYLDYAGYHQYIEEMLPPESPALYGLHPNAEIEFLTVTSNTLFRTLLEMQPRNALSGDELGQSTEEKVKNVLDDILEKLPEEFNMAEIMQKNSNRSPYVLVCFQECERMNILIREIRISLEQLDLSLKGELALSPAVEAQQFALSYDTVPDTWSKLAYPSTYGLAQWFNDLLLRCRELDTWTQDLTLPAVVWLSGFFNPQSFLTAIMQTMARKNEWPLDKTRLTADVTKKTKEDYGHPPREGAYLH

SEQ ID NO: 748988 - protein, 416 aa, Homo sapiens
RPRVPSDGCPMAAQVAAREARDFREAPTLRLTSGAGLEAVGAVELEEEEENEEEAAARRARSFAQDARVRFLGGRLAMMLGFTEEKWSQYLESEDNRQVLGEFLESTSPACLVFSFAASGRLAASQEVRGDGQGDLPIQQNYPGETAQSLPFGFPRGAHSGTLTNWLEVPILRPAGLLPTCTHSAVQQLQIPRDANHKLVFISKKITESIGVNDFSQVVLFGELPALSLGHVSAFLDEILVPVLSNKNNHKSWSCFTSQDMEYHIEVMKKKMYIFRGKMSRRTLLPIPTVAGKMDLDQNCSENKPPSNERIILHAIESVVIEWSHQIQEIIERDSVQRLLNGLHLSPQAELDFWMMRRENLSCIYDQLQAPVVLKMVKILTTKQSSYFPTLKDIFLAVENGKTLVPQPGINITICS

SEQ ID NO: 748989 - protein, 57 aa, Homo sapiens
MLCAHFSDQGPAHLTTSKSAFLSNKKTSTLKHLLGETRSDGSACNSGISGGRGRKIP

SEQ ID NO: 748990 - protein, 57 aa, Homo sapiens; identical to SEQ ID NO: 748989

SEQ ID NO: 748991 - protein, 295 aa, Homo sapiens
MTGSLTLTTPLGWPPALALTAQAPGQPAFLGWLGAALFSGEKALLEELERCPTPAMLALLCSCLLLAAGASDAWTGEDSAEPNSDSAEWIRDMYAKVTEIWQEVMQRRDDDGALHAACQVQPSATLDAAQPRVTGVVLFRQLAPRAKLDAFFALEGFPTEPNSSSRAIHVHQFGDLSQGCESTGPHYNPLAVPHPQHPGDFGNFAVRDGSLWRYRAGLAASLAGPHSIVGRAVVVHAGEDDLGRGGNQASVENGNAGRRLACCVVGVCGPGLWERQAREHSERKKRRRESECKAA

SEQ ID NO: 748992 - protein, 295 aa, Homo sapiens; identical to SEQ ID NO: 748991

SEQ ID NO: 748993 - protein, 285 aa, Homo sapiens
MISLDLHGGRAGLQGQPAFLGWLGAALFSGEKALLEELERCPTPAMLALLCSCLLLAAGASDAWTGEDSAEPNSDSAEWIRDMYAKVTEIWQEVMQRRDDDGALHAACQVQPSATLDAAQPRVTGVVLFRQLAPRAKLDAFFALEGFPTEPNSSSRAIHVHQFGDLSQGCESTGPHYNPLAVPHPQHPGDFGNFAVRDGSLWRYRAGLAASLAGPHSIVGRAVVVHAGEDDLGRGGNQASVENGNAGRRLACCVVGVCGPGLWERQAREHSERKKRRRESECKAA

SEQ ID NO: 748994 - protein, 295 aa, Homo sapiens; identical to SEQ ID NO: 748991

SEQ ID NO: 748995 - protein, 263 aa, Homo sapiens
RTAPSSHGEKAFLEELERCPTPAMLALLCSCLLLAAGASDAWTGEDSAEPNSDSAEWIRDMYAKVTEIWQEVMQRRDDDGALHAACQVQPSATLDAAQPRVTGVVLFRQLAPRAKLDAFFALEGFPTEPNSSSRAIHVHQFGDLSQGCESTGPHYNPLAVPHPQHPGDFGNFAVRDGSLWRYRAGLAASLAGPHSIVGRAVVVHAGEDDLGRGGNQASVENGNAGRRLACCVVGVCGPGLWERQAREHSERKKRRRESECKAA

SEQ ID NO: 748996 - protein, 104 aa, Homo sapiens
LNATCVEPTELTGWPITRVGNPLRYMCITHLDHKDYIFLLLIGFCIFAAGTVAAWLTGVCAVLYQNTRHKSSEEDEDEAGTRVEVSRRIFQTQTSSVQEFPQLI

SEQ ID NO: 748997 - protein, 100 aa, Homo sapiens
TEEIASAEKLASEKQRGDLCGCSRGRPGRSAWWEGPDDTEFDRRQLKAGRHWMPDDEVDFQTGALLKRWDGQRHRRSVGASSITKWFNEDLELHGAGAEV

SEQ ID NO: 748998 - protein, 325 aa, Homo sapiens
MNSSFHLHFLDLNLNATEGNLSGPNVKNKSSPCEDMGIAVEVFLTLGVISLLENILVIGAIVKNKNLHSPMYFFVCSLAVADMLVSMSSAWETITIYLLNNKHLVIADAFVRHIDNVFDSMICISVVASMCSLLAIAVDRYVTIFYALRYHHIMTARRSGAIIAGIWAFCTGCGIVFILYSESTYVILCLISMFFAMLFLLVSLYIHMFLLARTHVKRIAALPGASSARQRTSMQGAVTVTMLLGVFTVCWAPFFLHLTLMLSCPQNLYCSRFMSHFNMYLILIMCNSVMDPLIYAFRSQEMRKTFKEIICCRGFRIACSFPRRD

SEQ ID NO: 748999 - protein, 186 aa, Homo sapiens
MASEDPRYSRHSSRRVLGGGTTPMLTWLQIRVGVDLDENLKEDPSSQHQEANNLDKNMTKAESARLFRMWYSFDHKYLKPILTHSGPPLTTTLPEWCGPISRLLTSPQAYGEQLKEDDVECIVNQDELAINYQEQASSPCSPPARLGLDQKASPQTPGKENIYEGDLGLGGYELKLEQTLGQSQLN

SEQ ID NO: 749000 - protein, 129 aa, Homo sapiens [sequence omitted]

SEQ ID NO: 749001 - protein, 186 aa, Homo sapiens; identical to SEQ ID NO: 748999

SEQ ID NO: 749002 - protein, 126 aa, Homo sapiens
LKVKIGFRYLWSKLYQYLKPILTHSGPPLTTTLPEWCGPISRLLTSPQAYGEQLKEDDVECIVNQDELAINYQEQASSPCSPPARLGLDQKASPQTPGKENIYEGDLGLGGYELKLEQTLGQSQLN

SEQ ID NO: 749003 - protein, 129 aa, Homo sapiens [sequence omitted]

SEQ ID NO: 749004 - protein, 80 aa, Homo sapiens
EDSPSSLLPSDPKYSYPVCCKKEKSCLGRTASPYRYRLGTLHMKQESQKFLEANLAFVTARPTGCVRHILNLITCESCIA

SEQ ID NO: 749005 - protein, 79 aa, Homo sapiens
MRQRGQEHLPTSVKSEPRACNNPTVAENRRVPSGLAAVIRNLTALWNPSLGVSERRGGDWEPSRIPRLWARVGWIQLPG

SEQ ID NO: 749006 - protein, 304 aa, Homo sapiens
MASETHNVKKRNFCNKIEDHFIDLPRKKISNFTNKNMKEVKKSPKQLAAYINRTVGQTVKSPDKLRKVIYRRKKVHHPFPNPCYRKKQSPGSGGCDMANKENELACAGHLPEKLHHDSRTYLVNSSDSGSSQTESPSSKYSGFFSEVSQDHETMAQVLFSRNMRLNVALTFWRKRSISELVAYLLRIEDLGVVVDCLPVLTNCLQEEKQYISLGCCVDLLPLVKSLLKSKFEEYVIVGLNWLQAVIKRWWSELSSKTEIINDGNIQILKQQLSGLWEQENHLTLVPGYTGNIAKDVDAYLLQLH

SEQ ID NO: 749007 - protein, 304 aa, Homo sapiens; identical to SEQ ID NO: 749006

SEQ ID NO: 749008 - protein, 263 aa, Homo sapiens
MASETHNVKKRNFCNKIEDHFIDLPRKKISNFTNKNMKEVKKSPKQLAAYINRTVGQTVKSPDKLRKVIYRRKKVHHPFPNPCYRKKQSPGSGGCDMANKENELACAGHLPEKLHHDSRTYLVNSSDSGSSQTESPSSKYSGFFSEVSQDHETMAQVLFSRNMRLNVALTFWRKRSISELVAYLLRIEDLGVVVDCLPVLTNCLQEEKQYISLGCCVDLLPLVKSLLKSKFEEYVIVGLNWLQAVIKRWWSELSSKTEIINDG

SEQ ID NO: 749009 - protein, 304 aa, Homo sapiens; identical to SEQ ID NO: 749006

SEQ ID NO: 749010 - protein, 304 aa, Homo sapiens; identical to SEQ ID NO: 749006

SEQ ID NO: 749011 - protein, 304 aa, Homo sapiens; identical to SEQ ID NO: 749006

SEQ ID NO: 749012 - protein, 304 aa, Homo sapiens; identical to SEQ ID NO: 749006

SEQ ID NO: 749013 - protein, 233 aa, Homo sapiens
MASETHNVKKRNFCNKIEDHFIDLPRKKISNFTNKNMKEVKKSPKQLAAYINRTVGQTVKSPDKLRKVIYRRKKVHHPFPNPCYRKKQSPGSGGCDMANKENELACAGHLPEKLHHDSRTYLVNSSDSGSSQTESPSSKYSGFFSEVSQDHETMAQVLFSRNMRLNVALTFWRKRSISELVAYLLRIEDLGVVVDCLPVLTNCLQEEKQYISLGCCVDLLPLVKSLLKSKFEE

SEQ ID NO: 749014 - protein, 263 aa, Homo sapiens; identical to SEQ ID NO: 749008

SEQ ID NO: 749015 - protein, 215 aa, Homo sapiens
MASETHNVKKRNFCNKIEDHFIDLPRKKISNFTNKNMKEVKKSPKQLAAYINRTVGQTVKSPDKLRKVIYRRKKVHHPFPNPCYRKKQSPGSGGCDMANKENELACAGHLPEKLHHDSRTYLVNSSDSGSSQTESPSSILFSRNMRLNVALTFWRKRSISELVAYLLRIEDLGVVVDCLPVLTNCLQEEKQYISLGCCVDLLPLVKSLLKSKFEE

SEQ ID NO: 749016 - protein, 208 aa, Homo sapiens [sequence omitted]

SEQ ID NO: 749017 - protein, 227 aa, Homo sapiens
MASETHNVKKRNFCNKIEDHFIDLPRKKISNFTNKNMKEVKKSPKQLAAYINRTVGQTVKSPDKLRKVIYRRKKVHHPFPNPCYRKKQSPGSGGCDMANKENELACAGHLPEKLHHDSRTYLVNSSDSGSSQTESPSSKYSGFFSEVSQDHETMAQVLFSRNMRLNVALTFWRKRSISELVAYLLRNIQILKQQLSGLWEQENHLTLVPGYTGNIAKDVDAYLLQLH

SEQ ID NO: 749018 - protein, 304 aa, Homo sapiens; identical to SEQ ID NO: 749006

SEQ ID NO: 749019 - protein, 263 aa, Homo sapiens; identical to SEQ ID NO: 749008

SEQ ID NO: 749020 - protein, 298 aa, Homo sapiens
MASETHNVKKRNFCNKIEDHFIDLPRKKISNFTNKNMKEVKKSPKQLAAYINRTVGQTVKSPDKLRKVIYRRKKVHHPFPNPCYRKKQSPGSGGCDMANKENELACAGHLPEKLHHDSRTYLVNSSDSGSSQTESPSSKYSGFFSEVSQDHETMAQVLFSRNMRLNVALTFWRKRSISELVAYLLRIEDLGVVVDCLPVLTNCLQEEKQYISLGCCVDLLPLVKSLLKSKFEEYVIVGLNWLQAVIKRWWSELSSKTEIINDGNIQILKQQLSGLWEQENHLTLVPGYTGNIAKVLCV

SEQ ID NO: 749021 - protein, 186 aa, Homo sapiens
MASETHNVKKRNFCNKIEDHFIDLPRKKISNFTNKNMKEVKKSPKQLAAYINRTVGQTVKSPDKLRKVIYRRKKVHHPFPNPCYRKKQSPGSGGCDMANKENELACAGHLPEKLHHDSRTYLVNSSDSGSSQTESPSSKYSGFFSEVSQDHETMAQVLFSRNMRLNVALTFWRKRSISELVAYLLR

SEQ ID NO: 749022 - protein, 84 aa, Homo sapiens
QTRGGGHAALGPVVGGRRGLPSRRRCLRLGGGSNFQWPGRERSEPPKKYPEVKPWIHLHVKKKPKLKNLSAELRRPNRNQPSRS

SEQ ID NO: 749023 - protein, 84 aa, Homo sapiens; identical to SEQ ID NO: 749022

SEQ ID NO: 749024 - protein, 318 aa, Homo sapiens
PRDTEHLEMETTSGELSDVSNDPTTSVCVASAPTKEAIDNTLLEHKERSENINLNEKQIPFQVPNIERNFRQSQPKSYLCHYELAEALPQGKMNETPTEWLRYNSGILNTQPPLPFKEAHVSGHTFVTAEQILAPLALPEQALLIPLENHDKFKNVPCEVYQHILQPNMLANKVKFTFPPAALPPPSTPLQPLPLQQSLCSTSVTTIHHTVLQQHAAAAAAAAAAAAAGTFKVLQPHQQFLSQIPALTRTSLPQLSVGPVGPRLCPGNQPTFVAPPQMPIIPASVLHPSHLAFPSLPHALFPSLLSPHPTVIPLQPLF

SEQ ID NO: 749025 - protein, 137 aa, Homo sapiens
MPSEMDTEKEDRRRVQSSTGPITGHSTEVILIPSTYIPELSNILGSLGNVIFPVSTGRGNEIGVDEYIVLLPQLTLLFATYIFPFLLSCKKHIYSLYKDENPKNQAVITTSLQDQNFLIIHEYSIWSRHGSSWSEDL

SEQ ID NO: 749026 - protein, 130 aa, Homo sapiens
MPSEMDTEKEDRRRVQSSTGPITGHSTEVILIPSTYIPELSNIHLPVSTGRGNEIGVDEYIVLLPQLTLLFATYIFPFLLSCKKHIYSLYKDENPKNQAVITTSLQDQNFLIIHEYSIWSRHGSSWSEDL

SEQ ID NO: 749027 - protein, 159 aa, Homo sapiens
MRQYGECLHSCPSGYYGHRAPDMNRCARCRIENCDSCFSKDFCTKCKVGFYLHRGRCFDECPDGFAPLEETMECVEGCEVGHWSEWGTCSRNNRTCGFKWGLETRTRQIVKKPVKDTIPCPTIAESRRCKMTMRHCPGGKRTPKAKEKRNKKKKRKLIE

SEQ ID NO: 749028 - protein, 226 aa, Homo sapiens
MQFRLFSFALIILNCMDYSHCQGNRWRRSKRASYVSNPICKGCLSCSKDNGCSRCQQKLFFFLRREGMRQYGECLHSCPSGYYGHRAPDMNRCARCRIENCDSCFSKDFCTKCKVGFYLHRGRCFDECPDGFAPLEETMECVEGCEVGHWSEWGTCSRNNRTCGFKWGLETRTRQIVKKPVKDTIPCPTIAESRRCKMTMRHCPGGKRTPKAKEKRNKKKKRKLIE

SEQ ID NO: 749029 - protein, 163 aa, Homo sapiens
MQFRLFSFALIILNCMDYSHCQGNRWRRSKRGCRIENCDSCFSKDFCTKCKVGFYLHRGRCFDECPDGFAPLEETMECVEGCEVGHWSEWGTCSRNNRTCGFKWGLETRTRQIVKKPVKDTIPCPTIAESRRCKMTMRHCPGGKRTPKAKEKRNKKKKRKLIE

SEQ ID NO: 749030 - protein, 125 aa, Homo sapiens
VKQVLEGSMLGKSHRHSLILSTQGHDTLRKAAGTSAQESQFSKDNGLQLRQCSCKGHDADFEDASFHIYSLKETNSANQLRELSLSCLKMRSQSAQHHDLDLVTPELRWKRMVLLRPFKIPSVIQ

SEQ ID NO: 749031 - protein, 143 aa, Homo sapiens
SPFSNLEYPGTRYTAEGCRDLCPGKPGSSICRRSPTFCYYYVLQMSRREWGGREQEEERKNNVLKLFSKDNGLQLRQCSCKGHDADFEDASFHIYSLKETNSANQLRELSLSCLKMRSQSAQHHDLDLVTPGMEDPVKFSPNS

SEQ ID NO: 749032 - protein, 105 aa, Homo sapiens
GRALAGCGRVKTHTQRAESRLQRPPWAKVHLPLSLCLGFAVAPMVSYTQLTKCRFLFLCLKHRLFCEICFPHFLVYKFLILIPEATRVHGNSGDLVSRCPSAPAQ

SEQ ID NO: 749033 - protein, 156 aa, Homo sapiens
MGGAAQGARTPRGAEAASAREPGGPGRSIRPGWKTFFIITSPGRSARLARRAGPALLPGVESPIFFSCGTAGPPRLAELDAGASTGRGAPREETNLTLGPGFRGGGRSPRGPKPPLPPPPPHSGGRQRRERGCPGRRAARSEHAQGELCPVVRRAL

SEQ ID NO: 749034 - protein, 373 aa, Homo sapiens
MDTLEEVTWANGSTALPPPLAPNISVPHRCLLLLYEDIGTSRVRYWDLLLLIPNVLFLIFLLWKLPSARAKIRITSSPIFITFYILVFVVALVGIARAVVSMTVSTSNAATVADKILWEITRFFLLAIELSVIILGLAFGTWESKSSIKRVLAITTVLSLAYSVTQGTLEILYPDAHLSAEDFNIYGHGGRQFWLVSSCFFFLVYSLVVILPKTPLKERISLPSRRSFYVYAGILALLNLLQGLGSVLLCFDIIEGLCCVDATTFLYFSFFAPLIYVAFLRGFFGSEPKILFSYKCQVDETEEPDVHLPQPYAVARREGLEAAGAAGASAASYSSTQFDSAGGVAYLDDIASMPCHTGSINSTDSERWKAINA

SEQ ID NO: 749035 - protein, 125 aa, Homo sapiens
ATVGQFLPYLVAPSAWRGRLFLNHSVRLPCPSFPFISSEPKILFSYKCQVDETEEPDVHLPQPYAVARREGLEAAGAAGASAASYSSTQFDSAGGVAYLDDIASMPCHTGSINSTDSERWKAINA

SEQ ID NO: 749036 - protein, 496 aa, Homo sapiens
MDTLEEVTWANGSTALPPPLAPNISVPHRCLLLLYEDIGTSRVRYWDLLLLIPNVLFLIFLLWKLPSARAKIRITSSPIFITFYILVFVVALVGIARAVVSMTVSTSNAATVADKILWEITRFFLLAIELSVIILGLAFGTWESKSSIKRVLAITTVLSLAYSVTQGTLEILYPDAHLSAEDFNIYGHGGRQFWLVSSCFFFLVYSLVVILPKTPLKERISLPSRRSFYVYAGILALLNLLQGLGSVLLCFDIIEGLCASSLRSSTWLSSGASSARSPRSSSPTNAKWTRQRSQMYTYPSPTLWPGGRAWRLQGLLGPQLPATRARSSTLPAGWPTWMTSLPCPATLAASTAQTASAGRPSMPEGSCQGLWRTGQRGGQQAQSPQGRRTRSRDVLWAVALCGPVPTMSLEAPPPWGSQSPLPSLLSLGTLLPFPPALILLSDMAQAFLPGPCLARLAEGTLLLCTLGTRAGLALPMPPSHPHGALASSKHPPWWMD

SEQ ID NO: 749037 - protein, 125 aa, Homo sapiens; identical to SEQ ID NO: 749035

SEQ ID NO: 749038 - protein, 222 aa, Homo sapiens
MCPGLSEAPELYSRGFLTIEQIAMLPPPAVMNYIFLLLCLCGLVGNGLVLWFFGFSIKRNPFSIYFLHLASADVGYLFSKAVFSILNTGGFLGTFADYIRSVCRVLGLCMFLTGVSLLPAVSAERCASVIFPAWYWRRRPKRLSAVVCALLWVLSLLVTCLHNYFCVFLGRGAPARPAGTWTSSWASSCSCSAARSWCCPAWPSSCTWSAGPDGARLCQAQA

SEQ ID NO: 749039 - protein, 237 aa, Homo sapiens
MAGNCSWEAHPGNRNKMCPGLSEAPELYSRGFLTIEQIAMLPPPAVMNYIFLLLCLCGLVGNGLVLWFFGFSIKRNPFSIYFLHLASADVGYLFSKAVFSILNTGGFLGTFADYIRSVCRVLGLCMFLTGVSLLPAVSAERCASVIFPAWYWRRRPKRLSAVVCALLWVLSLLVTCLHNYFCVFLGRGAPARPAGTWTSSWASSCSCSAARSWCCPAWPSSCTWSAGPDGPGSAKLK

SEQ ID NO: 749040 - protein, 104 aa, Homo sapiens
MAGNCSWEAHPGNRNKVSATGGGPWSCPDGCGWEGQTQPSISSPIPPFLAPLSSSGPTVGSGLLWAMWPGTSSLDPPTLLSSSVRQAPGLDLKVPRCADTVVAL

SEQ ID NO: 749041 - protein, 134 aa, Homo sapiens
MVGWSVALCESTSNGACRFPALRNKWDRRCRREHSRVQRGGRTGWFLFAPVETRNGPSQPSRCPLRDPQLHQKTIPDSPLPRFARRSEPEWDPALGPQRPFPPRRSGVYSRLSLLDDQCLARISANTVECHSAF

SEQ ID NO: 749042 - protein, 239 aa, Homo sapiens
LDIEFAAASKDQRRPVQVHDASSLLGGRGLGVAMAPSHLSVREMREDEKPLVLEMLKAGVKDTENRVALHALTRPPALLLLAAASSGLRFVLASFALALLLPVFLAVAAVKLGLRARWGSLPPPGGLGGPWVAVRGSGDVCGVLALAPGTNAGDGARVTRLSVSRWHRRRGVGRRLLAFAEARARAWAGGMGEPRARLVVPVAVAAWGVGGMLEGCGYQAEGGWGCLGYTLVREFSKDL

SEQ ID NO: 749043 - protein, 239 aa, Homo sapiens
SRPAPETLSKDQRRPVQVHDASSLLGGRGLGVAMAPSHLSVREMREDEKPLVLEMLKAGVKDTENRVALHALTRPPALLLLAAASSGLRFVLASFALALLLPVFLAVAAVKLGLRARWGSLPPPGGLGGPWVAVRGSGDVCGVLALAPGTNAGDGARVTRLSVSRWHRRRGVGRRLLAFAEARARAWAGGMGEPRARLVVPVAVAAWGVGGMLEGCGYQAEGGWGCLGYTLVREFSKDL

SEQ ID NO: 749044 - protein, 190 aa, Homo sapiens
MSHPSCPQAGVKDTENRVALHALTRPPALLLLAAASSGLRFVLASFALALLLPVFLAVAAVKLGLRARWGSLPPPGGLGGPWVAVRGSGDVCGVLALAPGTNAGDGARVTRLSVSRWHRRRGVGRRLLAFAEARARAWAGGMGEPRARLVVPVAVAAWGVGGMLEGCGYQAEGGWGCLGYTLVREFSKDL

SEQ ID NO: 749045 - protein, 239 aa, Homo sapiens; identical to SEQ ID NO: 749042

SEQ ID NO: 749046 - protein, 89 aa, Homo sapiens
AGTVGVYGSETLSKDQRRPVQVHDASSLLGGRGLGVAMAPSHLSVREMREDEKPLVLEMLKVRGRGPRGPGSGCSGGIASGFSHPLPPT

SEQ ID NO: 749047 - protein, 239 aa, Homo sapiens; identical to SEQ ID NO: 749042

SEQ ID NO: 749048 - protein, 239 aa, Homo sapiens; identical to SEQ ID NO: 749042

SEQ ID NO: 749049 - protein, 89 aa, Homo sapiens; identical to SEQ ID NO: 749046

SEQ ID NO: 749050 - protein, 129 aa, Homo sapiens
GDFSKVAEYCGGRLSCRDPRLGAPRVLSVLIWEVPLLLPTPRGSFGDRGAPLTLTYLCSHQVHDASSLLGGRGLGVAMAPSHLSVREMREDEKPLVLEMLKVRGRGPRGPGSGCSGGIASGFSHPLPPT

SEQ ID NO: 749051 - protein, 3031 aa, Homo sapiens
MWALSPTVFALLSKNLMIVHSDLAVHFPAIQYAVLYTLYSHCTRHDHFISSSLSSSSPSLFDGAVISTVTTATKKHFSIILNLLGILLKKDNLNQDTRKLLMTWALEAAVLMKKSETYAPLFSLPSFHKFCKGLLANTLVEDVNICLQACSSLHALSSSLPDDLLQRCVDVCRVQLVHSGTRIRQAFGKLLKSIPLDVVLSNNNHTEIQEISLALRSHMSKAPSNTFHPQDFSDVISFILYGNSHRTGKDNWLERLFYSCQRLDKRDQSTIPRNLLKTDAVLWQWAIWEAAQFTVLSKLRTPLGRAQDTFQTIEGIIRSLAAHTLNPDQDVSQWTTADNDEGHGNNQLRLVLLLQYLENLEKLMYNAYEGCANALTSPPKVIRTFFYTNRQTCQDWLTRIRLSIMRVGLLAGQPAVTVRHGFDLLTEMKTTSLSQGNELEVTIMMVVEALCELHCPEAIQGIAVWSSSIVGKNLLWINSVAQQAEGRFEKASVEYQEHLCAMTGVDCCISSFDKSVLTLANAGRNSASPKHSLNGESRKTVLSKPTDSSPEVINYLGNKACECYISIADWAAVQEWQNAIHDLKKSTSSTSLNLKADFNYIKSLSSFESGKFVECTEQLELLPGENINLLAGGSKEKIDMKKLLPNMLSPDPRELQKSIEVQLLRSSVCLATALNPIEQDQKWQSITENVVKYLKQTSRIAIGPLRLSTLTVSQSLPVLSTLQLYCSSALENTVSNRLSTEDCLIPLFSEALRSCKQHDVRPWMQALRYTMYQNQLLEKIKEQTVPIRSHLMELGLTAAKFARKRGNVSLATRLLAQCSEVQLGKTTTAQDLVQHFKKLSTQGQVDEKWGPELDIEKTKLLYTAGQSTHAMEMLSSCAISFCKSVKAEYAVAKSILTLAKWIQAEWKEISGQLKQVYRAQHQQNFTGLSTLSKNILTLIELPSVNTMEEEYPRIESESTVHIGVGEPDFILGQLYHLSSVQAPEVAKSWAALASWAYRWGRKVVDNASQGEGVRLLPREKSEVQNLLPDTITEEEKERIYGILGQAVCRPAGIQDEDITLQITESEDNEEDDMVDVIWRQLISSCPWLSELDESATEGVIKVWRKVVDRIFSLYKLSCSAYFTFLKLNAGQIPLDEDDPRLHLSHRVEQSTDDMIVMATLRLLRLLVKHAGELRQYLEHGLETTPTAPWRGIIPQLFSRLNHPEVYVRQSICNLLCRVAQDSPHLILYPAIVGTISLSSESQASGNKFSTAIPTLLGNIQGEELLVSECEGGSPPASQDSNKDEPKSGLNEDQAMMQDCYSKIVDKLSSANPTMVLQVQMLVAELRRVTVLWDELWLGVLLQQHMYVLRRIQQLEDEVKRVQNNNTLRKEEKIAIMREKHTALMKPIVFALEHVRSITAAPAETPHEKWFQDNYGDAIENALEKLKTPLNPAKPGSSWIPFKEIMLSLQQRAQKRASYILRLEEISPWLAAMTNTEIALPGEVSARDTVTIHSVGGTITILPTKTKPKKLLFLGSDGKSYPYLFKGLEDLHLDERIMQFLSIVNTMFATINRQETPRFHARHYSVTPLGTRSGLIQWVDGATPLFGLYKRWQQREAALQAQKAQDSYQTPQNPGIVPRPSELYYSKIGPALKTVGLSLDVSRRDWPLHVMKAVLEELMEATPPNLLAKELWSSCTTPDEWWRVTQSYARSTAVMSMVGYIIGLGDRHLDNVLIDMTTGEVVHIDYNVCFEKGKSLRVPEKVPFRMTQNIETALGVTGVEGVFRLSCEQVLHIMRRGRETLLTLLEAFVYDPLVDWTAGGEAGFAGAVYGGGGQQAESKQSKREMEREITRSLFSSRVAEIKVNWFKNRDEMLVVLPKLDGSLDEYLSLQEQLTDVEKLQGKLLEEIEFLEGAEGVDHPSHTLQHRYSEHTQLQTQQRAVQEAIQVKLNEFEQWITHYQAAFNNLEATQLASLLQEISTQMDLGPPSYVPATAFLQNAGQAHLISQCEQLEGEVGALLQQRRSVLRGCLEQLHHYATVALQYPKAIFQKHRIEQWKTWMEELICNTTVERCQELYRKYEMQYAPQPPPTVCQFITATEMTLQRYAADINSRLIRQVERLKQEAVTVPVCEDQLKEIERCIKVFLHENGEEGSLSLASVIISALCTLTRRNLMMEGAASSAGEQLVDLTSRDGAWFLEELCSMSGNVTCLVQLLKQCHLVPQDLDIPNPMEASETVHLANGVYTSLQELNSNFRQIIFPEALRCLMKGEYTLESMLHELDGLIEQTTDGVPLQTLVESLQAYLRNAAMGLEEETHAHYIDVARLLHAQYGELIQPRNGSVDETPKMSAGQMLLVAFDGMFAQVETAFSLLVEKLNKMEIPIAWRKIDIIREARSTQVNFFDDDNHRQVLEEIFFLKRLQTIKEFFRLCGTFSKTLSGSSSLEDQNTVNGPVQIVNVKTLFRNSCFSEDQMAKPIKAFTADFVRQLLIGLPNQALGLTLCSFISALGVDIIAQVEAKDFGAESKVSVDDLCKKAVEHNIQIGKFSQLVMNRATVLASSYDTAWKKHDLVRRLETSISSCKTSLQRVQLHIAMFQWQHEDLLINRPQAMSVTPPPRSAILTSMKKKLHTLSQIETSIATVQEKLAALESSIEQRLKWAGGANPALAPVLQDFEATIAERRNLVLKESQRASQVTFLCSNIIHFESLRTRTAEALNLDAALFELIKRCQQMCSFASQFNSSVSELELRLLQRVDTGLEHPIGSSEWLLSAHKQLTQDMSTQRAIQTEKEQQIETVCETIQNLVDNIKTVLTGHNRQLGDVKHLLKAMAKDEEAALADGEDVPYENSVRQFLGEYKSWQDNIQTVLFTLVQAMGQVRSQEHVEMLQEITPTLKELKTQSQSIYNNLVSFASPLVTDATNECSSPTSSATYQPSFAAAVRSNTGQKTQPDVMSQNARKLIQKNLATSADTPPSTVPGTGKSVACSPKKAVRDPKTGKAVQERNSYAVSVWKRVKAKLEGRDVDPNRRMSVAEQVDYVIKEATNLDNLAQLYEGWTAWV

SEQ ID NO: 749052 - protein, 3031 aa, Homo sapiens; identical to SEQ ID NO: 749051

SEQ ID NO: 749053 - protein, 3010 aa, Homo sapiens
MWALSPTVFALLSKNLMIVHSDLAVHFPAIQYAVLYTLYSHCTRHDHFISSSLSSSSPSLFDGAVISTVTTATKKHFSIILNLLGILLKKDNLNQDTRKLLMTWALEAAVLMKKSETYAPLFSLPSFHKFCKGLLANTLVEDVNICLQACSSLHALSSSLPDDLLQRCVDVCRVQLVHSGTRIRQAFGKLLKSIPLDVVLSNNNHTEIQEISLALRSHMSKAPSNTFHPQDFSDVISFILYGNSHRTGKDNWLERLFYSCQRLDKRDQSTIPRNLLKTDAVLWQWAIWEAAQFTVLSKLRTPLGRAQDTFQTIEGIIRSLAAHTLNPDQDVSQWTTADNDEGHGNNQLRLVLLLQYLENLEKLMYNAYEGCANALTSPPKVIRTFFYTNRQTCQDWLTRIRLSIMRVGLLAGQPAVTVRHGFDLLTEMKTTSLSQGNELEVTIMMVVEALCELHCPEAIQGIAVWSSSIVGKNLLWINSVAQQAEGRFEKASVEYQEHLCAMTGVDCCISSFDKSVLTLANAGRNSASPKHSLNGESRKTVLSKPTDSSPEVINYLGNKACECYISIADWAAVQEWQNAIHDLKKSTSSTSLNLKADFNYIKSLSSFESGKFVECTEQLELLPGENINLLAGGSKEKIDMKKLLPNMLSPDPRELQKSIEVQLLRSSVCLATALNPIEQDQKWQSITENVVKYLKQTSRIAIGPLRLSTLTVSQSLPVLSTLQLYCSSALENTVSNRLSTEDCLIPLFSEALRSCKQHDVRPWMQALRYTMYQNQLLEKIKEQTVPIRSHLMELGLTAAKFARKRGNVSLATRLLAQCSEVQLGKTTTAQDLVQHFKKLSTQGQVDEKWGPELDIEKTKLLYTAGQSTHAMEMLSSCAISFCKSVKAEYAVAKSILTLAKWIQAEWKEISGQLKQVYRAQHQQNFTGLSTLSKNILTLIELPSVNTMEEEYPRIESESTVHIGVGEPDFILGQLYHLSSVQAPEVAKSWAALASWAYRWGRKVVDNASQGEGVRLLPREKSEVQNLLPDTITEEEKERIYGILGQAVCRPAGIQDEDITLQITESEDNEEDDMVDVIWRQLISSCPWLSELDESATEGVIKVWRKVVDRIFSLYKLSCSAYFTFLKLNAGQIPLDEDDPRLHLSHRVEQSTDDMIVMATLRLLRLLVKHAGELRQYLEHGLETTPTAPWRGIIPQLFSRLNHPEVYVRQSICNLLCRVAQDSPHLILYPAIVGTISLSSESQASGNKFSTAIPTLLGNIQGEELLVSECEGGSPPASQDSNKDEPKSGLNEDQAMMQDCYSKIVDKLSSANPTMVLQVQMLVAELRRVTVLWDELWLGVLLQQHMYVLRRIQQLEDEVKRVQNNNTLRKEEKIAIMREKHTALMKPIVFALEHVRSITAAPAETPHEKWFQDNYGDAIENALEKLKTPLNPAKPGSSWIPFKEIMLSLQQRAQKRASYILRLEEISPWLAAMTNTEIALPGEVSARDTVTIHSVGGTITILPTKTKPKKLLFLGSDGKSYPYLFKGLEDLHLDERIMQFLSIVNTMFATINRQETPRFHARHYSVTPLGTRSGLIQWVDGATPLFGLYKRWQQREAALQAQKAQDSYQTPQNPGIVPRPSELYYSKIGPALKTVGLSLDVSRRDWPLHVMKAVLEELMEATPPNLLAKELWSSCTTPDEWWRVTQSYARSTAVMSMVGYIIGLGDRHLDNVLIDMTTGEVVHIDYNVCFEKGKSLRVPEKVPFRMTQNIETALGVTGVEGVFRLSCEQVLHIMRRGRETLLTLLEAFVYDPLVDWTAGGEAGFAGAVYGGGGQQAESKQSKREMEREITRSLFSSRVAEIKVNWFKNRDEMLVVLPKLDGSLDEYLSLQEQLTDVEKLQGKLLEEIEFLEGAEGVDHPSHTLQHRYSEHTQLQTQQRAVQEAIQVKLNEFEQWITHYQAAFNNLEATQLASLLQEISTQMDLGPPSYVPATAFLQNAGQAHLISQCEQLEGEVGALLQQRRSVLRGCLEQLHHYATVALQYPKAIFQKHRIEQWKTWMEELICNTTVERCQELYRKYEMQYAPQPPPTVCQFITATEMTLQRYAADINSRLIRQVERLKQEAVTVPVCEDQLKEIERCIKVFLHENGEEGSLSLASVIISALCTLTRRNLMMEGAASSAGEQLVDLTSRDGAWFLEELCSMSGNVTCLVQLLKQCHLVPQDLDIPNPMEASETVHLANGVYTSLQELNSNFRQIIFPEALRCLMKGEYTLESMLHELDGLIEQTTDGVPLQTLVESLQAYLRNAAMGLEEETHAHYIDVARLLHAQYGELIQPRNGSVDETPKMSAGQMLLVAFDGMFAQVETAFSLLVEKLNKMEIPIAWRKIDIIREARSTQVNFFDDDNHRQVLEEIFFLKRLQTIKEFFRLCGTFSKTLSGSSSLEDQNTVNGPVQIVNVKTLFRNSCFSEDQMAKPIKAFTADFVRQLLIGLPNQALGLTLCSFISALGVDIIAQVEAKDFGAESKVSVDDLCKKAVEHNIQIGKFSQLVMNRATVLASSYDTAWKKHDLVRRLETSISSCKTSLQRVQLHIAMFQWQHEDLLINRPQAMSVTPPPRSAILTSMKKKLHTLSQIETSIATVQEKLAALESSIEQRLKWAGGANPALAPVLQDFEATIAERRNLVLKESQRASQVTFLCSNIIHFESLRTRTAEALNLDAALFELIKRCQQMCSFASQFNSSVSELELRLLQRVDTGLEHPIGSSEWLLSAHKQLTQDMSTQRAIQTEKEQQIETVCETIQNLVDNIKTVLTGHNRQLGDVKHLLKAMAKDEEAALADGEDVPYENSVRQFLGEYKSWQDNIQTVLFTLVQAMGQVRSQEHVEMLQEITPTLKELKTQSQSIYNNLVSFASPLVTDATNECSSPTSSATYQPSFAAAVRSNTGQKTQPDVMSQNARKLIQKNLATSADTPPSTVPGTGKSVACSPKKAVRDPKTGKAVQERNSYAVSVWKRVKAKLEGRDVDPNRRMSVAEQVTVF

SEQ ID NO: 749054 - protein, 2240 aa, Homo sapiens
MWALSPTVFALLSKNLMIVHSDLAVHFPAIQYAVLYTLYSHCTRHDHFISSSLSSSSPSLFDGAVISTVTTATKKHFSIILNLLGILLKKDNLNQDTRKLLMTWALEAAVLMKKSETYAPLFSLPSFHKFCKGLLANTLVEDVNICLQACSSLHALSSSLPDDLLQRCVDVCRVQLVHSGTRIRQAFGKLLKSIPLDVVLSNNNHTEIQEISLALRSHMSKAPSNTFHPQDFSDVISFILYGNSHRTGKDNWLERLFYSCQRLDKRDQSTIPRNLLKTDAVLWQWAIWEAAQFTVLSKLRTPLGRAQDTFQTIEGIIRSLAAHTLNPDQDVSQWTTADNDEGHGNNQLRLVLLLQYLENLEKLMYNAYEGCANALTSPPKVIRTFFYTNRQTCQDWLTRIRLSIMRVGLLAGQPAVTVRHGFDLLTEMKTTSLSQGNELEVTIMMVVEALCELHCPEAIQGIAVWSSSIVGKNLLWINSVAQQAEGRFEKASVEYQEHLCAMTGVDCCISSFDKSVLTLANAGRNSASPKHSLNGESRKTVLSKPTDSSPEVINYLGNKACECYISIADWAAVQEWQNAIHDLKKSTSSTSLNLKADFNYIKSLSSFESGKFVECTEQLELLPGENINLLAGGSKEKIDMKKLLPNMLSPDPRELQKSIEVQLLRSSVCLATALNPIEQDQKWQSITENVVKYLKQTSRIAIGPLRLSTLTVSQSLPVLSTLQLYCSSALENTVSNRLSTEDCLIPLFSEALRSCKQHDVRPWMQALRYTMYQNQLLEKIKEQTVPIRSHLMELGLTAAKFARKRGNVSLATRLLAQCSEVQLGKTTTAQDLVQHFKKLSTQGQVDEKWGPELDIEKTKLLYTAGQSTHAMEMLSSCAISFCKSVKAEYAVAKSILTLAKWIQAEWKEISGQLKQVYRAQHQQNFTGLSTLSKNILTLIELPSVNTMEEEYPRIESESTVHIGVGEPDFILGQLYHLSSVQAPEVAKSWAALASWAYRWGRKVVDNASQGEGVRLLPREKSEVQNLLPDTITEEEKERIYGILGQAVCRPAGIQDEDITLQITESEDNEEDDMVDVIWRQLISSCPWLSELDESATEGVIKVWRKVVDRIFSLYKLSCSAYFTFLKLNAGQIPLDEDDPRLHLSHRVEQSTDDMIVMATLRLLRLLVKHAGELRQYLEHGLETTPTAPWRGIIPQLFSRLNHPEVYVRQSICNLLCRVAQDSPHLILYPAIVGTISLSSESQASGNKFSTAIPTLLGNIQGEELLVSECEGGSPPASQDSNKDEPKSGLNEDQAMMQDCYSKIVDKLSSANPTMVLQVQMLVAELRRVTVLWDELWLGVLLQQHMYVLRRIQQLEDEVKRVQNNNTLRKEEKIAIMREKHTALMKPIVFALEHVRSITAAPAETPHEKWFQDNYGDAIENALEKLKTPLNPAKPGSSWIPFKEIMLSLQQRAQKRASYILRLEEISPWLAAMTNTEIALPGEVSARDTVTIHSVGGTITILPTKTKPKKLLFLGSDGKSYPYLFKGLEDLHLDERIMQFLSIVNTMFATINRQETPRFHARHYSVTPLGTRSGLIQWVDGATPLFGLYKRWQQREAALQAQKAQDSYQTPQNPGIVPRPSELYYSKIGPALKTVGLSLDVSRRDWPLHVMKAVLEELMEATPPNLLAKELWSSCTTPDEWWRVTQSYARSTAVMSMVGYIIGLGDRHLDNVLIDMTTGEVVHIDYNVCFEKGKSLRVPEKVPFRMTQNIETALGVTGVEGVFRLSCEQVLHIMRRGRETLLTLLEAFVYDPLVDWTAGGEAGFAGAVYGGGGQQAESKQSKREMEREITRSLFSSRVAEIKVNWFKNRDEMLVVLPKLDGSLDEYLSLQEQLTDVEKLQGKLLEEIEFLEGAEGVDHPSHTLQHRYSEHTQLQTQQRAVQEAIQVKLNEFEQWITHYQAAFNNLEATQLASLLQEISTQMDLGPPSYVPATAFLQNAGQAHLISQCEQLEGEVGALLQQRRSVLRGCLEQLHHYATVALQYPKAIFQKHRIEQWKTWMEELICNTTVERCQELYRKYEMQYAPQPPPTVCQFITATEMTLQRYAADINSRLIRQVERLKQEAVTVPVCEDQLKEIERCIKVFLHENGEEGSLSLASVIISALCTLTRRNLMMEGAASSAGEQLVDLTSRDGAWFLEELCSMSGNVTCLVQLLKQCPTDSRDWTYTHDRGITSRYISSPHSCRGVKLCFLTASSLAMITLL

SEQ ID NO: 749055 - protein, 352 aa, Homo sapiens
GNEAELCSALANLQTSKPDAVEQTCILESTEIALLNNIPYHEGFKMAMSKVLSSLTPEKLYQTMDTHCQNEMSSGTGQSNTVQNILEPFYVLDVSEGFSVLPVIAGTLGQVKPYSSVEKDQHRIALDLISEANHFPKETLEFWLRHVEDESAMLQRPKSDKLWSIIILDVIEPSGLIQQEIMEKAAISRCLLQSGGKIFPQYVLMFGLLVESQTLLEENAVQGTERTLGLNIAPFINQFQVPIRVFLDLSSLPCIPLSKPVELLRLDLMTPYLNTSNREVKVYVCKSGRLTAIPFWYHMYLDEEIRLDTSSEASHWKQAAVVLDNPIQVEMGEELVLSIQHHKSNVSITVKQ

SEQ ID NO: 749056 - protein, 352 aa, Homo sapiens; identical to SEQ ID NO: 749055

SEQ ID NO: 749057 - protein, 148 aa, Homo sapiens [sequence omitted]

SEQ ID NO: 749058 - protein, 68 aa, Homo sapiens
AAAYYYYCLLLLNSRPLDEEIRLDTSSEASHWKQAAVVLDNPIQVEMGEELVLSIQHHKSNVSITVKQ

SEQ ID NO: 749059 - protein, 179 aa, Homo sapiens
MAVFKTTLWRLISGTLGIICLSLMATLGILLKNSFTKLSIEPAFTPGPNIELQKDSDCCSCQEKWVGYRCNCYFISSEQKTWNESRHLCASQKSSLLQLQNTDELDFMSSSQQFYWIGLSYSEEHTAWLWENGSALSQYLFPSFETFNTKNCIAYNPNGNALDESCEDKNRYICKQQLI

SEQ ID NO: 749060 - protein, 148 aa, Homo sapiens
MAAFTKLSIEPAFTPGPNIELQKDSDCCSCQEKWVGYRCNCYFISSEQKTWNESRHLCASQKSSLLQLQNTDELDFMSSSQQFYWIGLSYSEEHTAWLWENGSALSQYLFPSFETFNTKNCIAYNPNGNALDESCEDKNRYICKQQLI

SEQ ID NO: 749061 - protein, 184 aa, Homo sapiens
MAVFKTTLWRLISGTLGIICLSLMATLGILLKNSFTKLSIEPAFTPGPNIELQKDSDCCSCQEKWVGYRCNCYFISSEQKTWNESRHLCASQKSSLLQLQNTDELDFMSSSQQFYWIGLSYSEEHTAWLWENGSALSQYLFPSFETFNTKNCIAYNPNGNALDESCEDKNRYIYKVLLCCPGWS

SEQ ID NO: 749062 - protein, 103 aa, Homo sapiens
TRPPTRPKNNNLNGTTEEVTSEEEEEEEEMAEDIEDLDHYEMKEEEPISGKKSEDEGIEKENLAILEKIRKTQRQDHLNDNFPFDPPFVRVVLPVLSGGINII

SEQ ID NO: 749063 - protein, 340 aa, Homo sapiens
MSVSGLKAELKFLASIFDKNHERFRIVSWKLDELHCQFLVPQQGSPHSLPPPLTLHCNITESYPSSSPIWFVDSEDPNLTSVLERLEDTKNNNLNGTTEEVTSEEEEEEEEMAEDIEDLDHYEMKEEEPISGKKSEDEGIEKENLAILEKIRKTQRQDHLNGAVSGSVQASDRLMKELRDIYRSQSYKTGIYSVELINDSLYDWHVKLQKVDPDSPLHSDLQILKEKEGIEYILLNFSFKDNFPFDPPFVRVVLPVLSGGYVLGGGALCMELLTKQGWSSAYSIESVIMQINATLVKGKARVQFGANKNQYNLARAQQSYNSIVQIHEKNGWYTPPKEDG

SEQ ID NO: 749064 - protein, 160 aa, Homo sapiens
MRMDSLTEEKLECRLWCCLSDPSPPGLAARCCVLERSIVPSLRQESYPSSSPIWFVDSEDPNLTSVLERLEDTKNNNLLRQQLKWLICELCSLYNLPKHLDVEMLDQPLPTGQNGTTEEVTSEEEEEEEEMAEDNFPFDPPFVRVVLPVLSGGVLRGRKH

SEQ ID NO: 749065 - protein, 314 aa, Homo sapiens
MSVSGLKAELKFLASIFDKNHERFRIVSWKLDELHCQFLVPQQGSPHSLPPPLTLHCNITESYPSSSPIWFVDSEDPNLTSVLERLEDTKNNNLLRQQLKWLICELCSLYNLPKHLDVEMLDQPLPTGQNGTTEEVTSEEEEEEEEMAEDIEDLDHYEMKEEEPISGKKSEDEGIEKENLAILEKIRKTQRQDHLNGAVSGSVQASDRLMKELRDIYRSQSYKTGIYSVELINDSLYDWHVKLQKVDPDSPLHSDLQILKEKEGIEYILLNFSFKDNFPFDPPFVRVVLPVLSGGLVHPSKGRWLNMLTVVCLD

SEQ ID NO: 749066 - protein, 375 aa, Homo sapiens
MSVSGLKAELKFLASIFDKNHERFRIVSWKLDELHCQFLVPQQGSPHSLPPPLTLHCNITESYPSSSPIWFVDSEDPNLTSVLERLEDTKNNNLLRQQLKWLICELCSLYNLPKHLDVEMLDQPLPTGQNGTTEEVTSEEEEEEEEMAEDIEDLDHYEMKEEEPISGKKSEDEGIEKENLAILEKIRKTQRQDHLNGAVSGSVQASDRLMKELRDIYRSQSYKTGIYSVELINDSLYDWHVKLQKVDPDSPLHSDLQILKEKEGIEYILLNFSFKDNFPFDPPFVRVVLPVLSGGYVLGGGALCMELLTKQGWSSAYSIESVIMQINATLVKGKARVQFGANKNQYNLARAQQSYNSIVQIHEKNGWYTPPKEDG

SEQ ID NO: 749067 - protein, 245 aa, Homo sapiens
MSVSGLKAELKFLASIFDKNHERFRIVSWKLDELHCQFLVPQQGSPHSLPPPLTLHCNITESYPSSSPIWFVDSEDPNLTSVLERLEDTKNNNLLRQQLKWLICELCSLYNLPKHLDVEMLDQPLPTGQNGTTEEVTSEEEEEEEEMAEDIEDLDHYEMKEEEPISGKKSEDEGIEKENLAILEKIRKTQRQDHLNGAVSGSVQASDRLMKELRDIYRSQSYKTGIYSVELINDSLYDWHVKLQK

SEQ ID NO: 749068 - protein, 241 aa, Homo sapiens
MSVSGLKAELKFLASIFDKNHERFRIVSWKLDELHCQFLVPQQGSPHSLPPPLTLHCNITESYPSSSPIWFVDSEDPNLTSVLERLEDTKNNNLLRQQLKWLICELCSLYNLPKHLDVEMLDQPLPTGQNGTTEEVTSEEEEEEEEMAEDIEDLDHYEMKEEEPISGKKSEDEGIEKENLAILEKIRKTQRQDHLNVQCLDHAGTGLLEDVLEEVTSLSPKPSSGWLSSSHAPYKCHVAYL

SEQ ID NO: 749069 - protein, 208 aa, Homo sapiens
MSVSGLKAELKFLASIFDKNHERFRIVSWKLDELHCQFLVPQQGSPHSLPPPLTLHCNITESYPSSSPIWFVDSEDPNLTSVLERLEDTKNNNLLRQQLKWLICELCSLYNLPKHLDVEMLDQPLPTGQNGTTEEVTSEEEEEEEEMAEDIEDLDHYEMKEEEPISGKKSEDEGIEKENLAILEKIRKTQRQDHLNTSLANMAKPRLY

SEQ ID NO: 749070 - protein, 149 aa, Homo sapiens
MSVSGLKAELKFLASIFDKNHERFRIVSWKLDELHCQFLVPQQGSPHSLPPPLTLHCNITESYPSSSPIWFVDSEDPNLTSVLERLEDTKNNNLLRQQLKWLICELCSLYNLPKHLDVEMLDQPLPTGQYGTTDEVTSEVEEEEEVVWL

SEQ ID NO: 749071 - protein, 394 aa, Homo sapiens
ARGRHPSRSGLGRQGKMVDYSVWDHIEVSDDEDETHPNIDTASLFRWRHQARVERMEQFQKEKEELDRGCRECKRKVAECQRKLKELEVAEGGKAELERLQAEAQQLRKEERSWEQKLEEMRKKEKSMPWNVDTLSKDGFSKSMVNTKPEKTEEDSEEVREQKHKTFVEKYEKQIKHFGMLRRWDDSQKYLSDNVHLVCEETANYLVIWCIDLEVEEKCALMEQVAHQTIVMQFILELAKSLKVDPRACFRQFFTKIKTADRQYMEGFNDELEAFKERVRGRAKLRIEKAMKEYEEEERKKRLGPGGLDPVEVYESLPEELQKCFDVKDVQMLQDAISKMDPTDAKYHMQRCIDSGLWVPNSKASEAKEGEEAGPGDPLLEAVPKTGDEKDVSV

SEQ ID NO: 749072 - protein, 394 aa, Homo sapiens; identical to SEQ ID NO: 749071

SEQ ID NO: 749073 - protein, 309 aa, Homo sapiens
SLARGQGPCPRSRHLDAHGFVTTSAVDGMGAATTARPAALEASAALPQPTPPLTLPQSMVNTKPEKTEEDSEEVREQKHKTFVEKYEKQIKHFGMLRRWDDSQKYLSDNVHLVCEETANYLVIWCIDLEVEEKCALMEQVAHQTIVMQFILELAKSLKVDPRACFRQFFTKIKTADRQYMEGFNDELEAFKERVRGRAKLRIEKAMKEYEEEERKKRLGPGGLDPVEVYESLPEELQKCFDVKDVQMLQDAISKMDPTDAKYHMQRCIDSGLWVPNSKASEAKEGEEAGPGDPLLEAVPKTGDEKDVSV

SEQ ID NO: 749074 - protein, 111 aa, Homo sapiens
MPSRPLLTSSTCAARPSLGGPPSPPWPLHCLHSPAPIQVSALSQGASLPAAPHQHYAKGPGVRGRAEVTRLVYQVVGEGPQPRGRLSSLGSVFTVRLLSVSSIWQTAMIFQ

SEQ ID NO: 749075 - protein, 424 aa, Homo sapiens
ARGRHPSRSGLGRQGKMVDYSVWDHIEVSDDEDETHPNIDTASLFRWRHQARVERMEQFQKEKEELDRGCRECKRKVAECQRKLKELEVAEGGKAELERLQAEAQQLRKEERSWEQKLEEMRKKEKSMPWNVDTLSKDGFSKSMVNTKPEKTEEDSEEVREQKHKTFVEKYEKQIKHFGEWGLWVMGGKVEAGPLPPGPPAPCQHLPTGMLRRWDDSQKYLSDNVHLVCEETANYLVIWCIDLEVEEKCALMEQVAHQTIVMQFILELAKSLKVDPRACFRQFFTKIKTADRQYMEGFNDELEAFKERVRGRAKLRIEKAMKEYEEEERKKRLGPGGLDPVEVYESLPEELQKCFDVKDVQMLQDAISKMDPTDAKYHMQRCIDSGLWVPNSKASEAKEGEEAGPGDPLLEAVPKTGDEKDVSV

SEQ ID NO: 749076 - protein, 394 aa, Homo sapiens; identical to SEQ ID NO: 749071

SEQ ID NO: 749077 - protein, 394 aa, Homo sapiens; identical to SEQ ID NO: 749071

SEQ ID NO: 749078 - protein, 192 aa, Homo sapiens
RHLEDPGTSDLEVEEKCALMEQVAHQTIVMQFILELAKSLKVDPRACFRQFFTKIKTADRQYMEGFNDELEAFKERVRGRAKLRIEKAMKEYEEEERKKRLGPGGLDPVEVYESLPEELQKCFDVKDVQMLQDAISKMDPTDAKYHMQRCIDSGLWVPNSKASEAKEGEEAGPGDPLLEAVPKTGDEKDVSV

SEQ ID NO: 749079 - protein, 294 aa, Homo sapiens
ARGRHPSRSGLGRQGKMVDYSVWDHIEVSDDEDETHPNIDTASLFRWRHQARVERMEQFQKEKEELDRGCRECKRKVAECQRKLKELEVAEGGKAELERLQAEAQQLRKEERSWEQKLEEMRKKEKSMPWNVDTLSKDGFSKSMVNTKPEKTEEDSEETADRQYMEGFNDELEAFKERVRGRAKLRIEKAMKEYEEEERKKRLGPGGLDPVEVYESLPEELQKCFDVKDVQMLQDAISKMDPTDAKYHMQRCIDSGLWVPNSKASEAKEGEEAGPGDPLLEAVPKTGDEKDVSV

SEQ ID NO: 749080 - protein, 394 aa, Homo sapiens; identical to SEQ ID NO: 749071

SEQ ID NO: 749081 - protein, 394 aa, Homo sapiens; identical to SEQ ID NO: 749071

SEQ ID NO: 749082 - protein, 387 aa, Homo sapiens
ARGRHPSRSGLGRQGKMVDYSVWDHIEVSDDEDETHPNIDTASLFRWRHQARVERMEQFQKEKEELDRGCRECKRKVAECQRKLKELEVAEGGKAELERLQAEAQQLRKEERSWEQKLEEMRKKEKSMPWNVDTLSKDGFSKSMVNTKPEKTEEDSEEVREQKHKTFVEKYEKQIKHFGMLRRWDDSQKYLSDNVHLVCEETANYLVIWCIDLEVEEKCALMEQVAHQTIVMQFILELAKSLKVDPRACFRQFFTKIKTADRQYMEGFNDELEAFKERVRGRAKLRIEKAMKEYEEEERKKRLGPGGLDPVEELQKCFDVKDVQMLQDAISKMDPTDAKYHMQRCIDSGLWVPNSKASEAKEGEEAGPGDPLLEAVPKTGDEKDVSV

SEQ ID NO: 749083 - protein, 394 aa, Homo sapiens; identical to SEQ ID NO: 749071

SEQ ID NO: 749084 - protein, 394 aa, Homo sapiens; identical to SEQ ID NO: 749071

SEQ ID NO: 749085 - protein, 185 aa, Homo sapiens
ARGRHPSRSGLGRQGKMVDYSVWDHIEVSDDEDETHPNIDTASLFRWRHQARVERMEQFQKEKEELDRGCRECKRKVAECQRKLKELEVAEGGKAELERLQAEAQQLRKEERSWEQKLEEMRKKEKSSALERGHAQQRRLQQEHGKYQAREDGGGLRGGEGAETQDLRGKIRETDQALWHASPLG

SEQ ID NO: 749086 - protein, 474 aa, Homo sapiens
ARGRHPSRSGLGRQGKMVDYSVWDHIEVSDDEDETHPNIDTASLFRWRHQARVERMEQFQKEKEELDRGCRECKRKVAECQRKLKELEVAEGGKAELERLQAEAQQLRKEERSWEQKLEEMRKKEKSMPWNVDTLSKDGFSKSMVNTKPEKTEEDSEEVREQKHKTFVEKYEKQIKHFGMLRRWDDSQKYLSDNVHLVCEETANYLVIWCIDLEVEEKCALMEQVAHQTIVMQFILKLFPRRAMRRMSVCDLPQLPPPPASRPLCAPFQKTEDAISPAPDFLYLRCSAQPGGPAQPSLASPLSPLSSAHSSLCFESRGFTACFRQFFTKIKTADRQYMEGFNDELEAFKERVRGRAKLRIEKAMKEYEEEERKKRLGPGGLDPVEVYESLPEELQKCFDVKDVQMLQDAISKMDPTDAKYHMQRCIDSGLWVPNSKASEAKEGEEAGPGDPLLEAVPKTGDEKEGQRSPGWSTR

SEQ ID NO: 749087 - protein, 185 aa, Homo sapiens; identical to SEQ ID NO: 749085

SEQ ID NO: 749088 - protein, 483 aa, Homo sapiens
ARGRHPSRSGLGRQGKMVDYSVWDHIEVSDDEDETHPNIDTASLFRWRHQARVERMEQFQKEKEELDRGCRECKRKVAECQRKLKELEVAEGGKAELERLQAEAQQLRKEERSWEQKLEEMRKKEKSMPWNVDTLSKDGFSKSMVNTKPEKTEEDSEEVREQKHKTFVEKYEKQIKHFGMLRRWDDSQKYLSDNVHLVCEETANYLVIWCIDLEVEEKCALMEQVAHQTIVMQFILKLFPRRAMRRMSVCDLPQLPPPPASRPLCAPFQKTDEMPSRPLLTSSTCAARPSLGGPPSPPWPLHCLHSPAPIQVSALSQGASLPAAPPQHYACFRQFFTKIKTADRQYMEGFNDELEAFKERVRGRAKLRIEKAMKEYEEEERKKRLGPGGLDPVEVYESLPEELQKCFDVKDVQMLQDAISKMDPTDAKYHMQRCIDSGLWVPNSKASEAKEGEEAGPGDPLLEAVPKTGDEKEGQRSPGWSTR

SEQ ID NO: 749089 - protein, 371 aa, Homo sapiens
ARGRHPSRSGLGRQGKMVDYSVWDHIEVSDDEDETHPNIDTASLFRWRHQARVERMEQFQKEKEELDRGCRECKRKVAECQRKLKELEVAEGGKAELERLQAEAQQLRKEERSWEQKLEEMRKKEKSMPWNVDTLSKDGFSKSMVNTKPEKTEEDSEEVREQKHKTFVEKYEKQIKHFGMLRRWDDSQKYLSDNVHLVCEETANYLVIWCIDLEVEEKCALMEQVAHQTIVMQFILELAKSLKVDPRACFRQFFTKIKTADRQYMEGFNDELEAFKERVRGRAKLRIEKAMKEYEEEERKKRLGPGGLDPVEVYESLPEELQKCFDVKDVQMLQDAISKMDPTVSNPRAPCLPGGPCVSPSPVSQVSEAGW

SEQ ID NO: 749090 - protein, 33 aa, Homo sapiens
PAKPASTFKTSAHLTFTYILLAKRSQAFHHCTK

SEQ ID NO: 749091 - protein, 110 aa, Homo sapiens
ERERRKEGRNTERACVSGAPFQPEFPVLEQHHTGKRSIFSLELVCLTSLEQTPFRILPVTRTVYAGQRAGFHSCGLLRPGLQGLCGRGVHSPVWLECSGSTLSGEAMSSQ

SEQ ID NO: 749092 - protein, 387 aa, Homo sapiens
RGGRARVCCGRGGAEPPPARGSPRARPSSDTPSLGAAAGRVSGVAASGRWRQRDTRREEAGWGRRGECGGGGWQGALEAGAVRALPAPEGAGGSEAAAAPRGPGGGWGAGGRCRRRRRGRRWPRPLCSRALPLAAHSPAVARRRRWRRRLLPPEAVGLGAGGGRGRGEHASRREWGAMAKLRVAYEYTEAEDKSIRLGLFLIISGVVSLFIFGFCWLSPALQDLQATEANCTVLSVQQIGEVFECTFTCGADCRGTSQYPCVQVYVNNSESNSRALLHSDEHQLLTNPKCSYIPPCKRENQKNLESVMNWQQYWKDEIGSQPFTCYFNQHQRPDDVLLHRTHDEIVLLHCFLWPLVTFVVGVLIVVLTICAKSLAVKAEAMKKRKFS

SEQ ID NO: 749093 - protein, 119 aa, Homo sapiens
PFTCYFNQHQGPDDVLMHRTHCGPDHLCQELGGQGGSHEEAQVLLKGKEACRKQSTEAVLIGTRPPAEPVFPGAGDGQGHDRALRGSSLSGNRNRHNWKTWNLKACIPSAVAMAKGSRS

SEQ ID NO: 749094 - protein, 387 aa, Homo sapiens; identical to SEQ ID NO: 749092

SEQ ID NO: 749095 - protein, 387 aa, Homo sapiens; identical to SEQ ID NO: 749092

SEQ ID NO: 749096 - protein, 387 aa, Homo sapiens; identical to SEQ ID NO: 749092

SEQ ID NO: 749097 - protein, 210 aa, Homo sapiens
MAKLRVAYEYTEAEDKSIRLGLFLIISGVVSLFIFGFCWLSPALQDLQATEANCTVLSVQQIGEVFECTFTCGADCRGTSQYPCVQVYVNNSESNSRALLHSDEHQLLTNPKCSYIPPCKRENQKNLESVMNWQQYWKDEIGSQPFTCYFNQHQRPDDVLLHRTHDEIVLLHCFLWPLVTFVVGVLIVVLTICAKSLAVKAEAMKKRKFS

SEQ ID NO: 749098 - protein, 333 aa, Homo sapiens
RGGRARVCCGRGGAEPPPARGSPRARPSSDTPSLGAAAGRVSGVAASGRWRQRDTRREEAGWGRRGECGGGGWQGALEAGAVRALPAPEGAGGSEAAAAPRGPGGGWGAGGRCRRRRRGRRWPRPLCSRALPLAAHSPAVARRRRWRRRLLPPEAVGLGAGGGRGRGEHASRREWGAMAKLRVAYEYTEAEDKSIRLGLFLIISGVVSLFIFGFCWLSPALQDLQATEANCTVLSVQQIGEVFECTFTCGADCRGTSQYPCVQVYVNNSESNSRALLHSDEHQLLTNPKCSYIPPCKRENQKNLESVMNWQQYWKDEIGSQPFTCYFNQHQRS

SEQ ID NO: 749099 - protein, 153 aa, Homo sapiens
EVEDDDKMSISRPHPSTAESKPPTPKFDLLASNFPPLPGSSSRIPDKLILENRMSDVVKGVYKEKDNEVLRVSCPVPADEQTECTSAQQLSMSTSSPCAAEPTALSTTQPKKKKKKGSNRGFLCSEGWSQPDNYTSFSSKYYKAMEGKYCLTM

SEQ ID NO: 749100 - protein, 227 aa, Homo sapiens
ADYALLMDFIPLDDKRYRYAFHSSAWLVAGKADPATPGRVHFHPDSPAKGAQWMRQIVSFDKLKLTNNLLDDNGHIILNSMHRYQPRFHVVFVDPRKDSERYAQENFKSFIFTETQFTAVTAYQNHRITQLKIASNPFAKGFRESDLDSWPVAPRPLLSVPARSHSSLSPCVLKGATDREKDPNKASASTSKTPAWLHHQGGLASPSWAGAPVPHCGVPGAWPGLPV

SEQ ID NO: 749101 - protein, 470 aa, Homo sapiens
ALLDELQKVFTLEMAYTIYVPFSCLLGDIIRKHPQATSWLGSWRRCTWRASAPAVATLPAWSPPCPAPGPWDPHGGGCPQDDGHSGTFGSVLVGNRIQIPNDSRPENPGPLGPISGVGGGGLGSGSDDNALKQELPRSVHGLSGNWLAYWQYEIGVSQQDAHFHFHQIRLQSFPGHSGAVKCVAPLSSEDFFLSGSKDRTVRLWPLYNYGDGTSETAPRLVYTQHRKSVFFVGQLEAPQHVVSCDGAVHVWDPFTGKTLRTVEPLDSRVPLTAVAVMPAPHTSITMASSDSTLRFVDCRKPGLQHEFRLGGGLNPGLVRALAISPSGRSVVAGFSSGFMVLLDTRTGLVLRGWPAHEGDILQIKAVEGSVLVSSSSDHSLTVWKELEQKPTHHYKSASDPIHTFDLYGSEVVTGTVSNKIGVCSLLEPPSQATTKLSSENFRGTLTSLALLPTKRHLLLGSDNGVIRLLA

SEQ ID NO: 749102 - protein, 87 aa, Homo sapiens
YLSDTTLMDILPRISHEVLLPVLSFLTSLVTGFPSGAQARTILCVKTISLIALICLRIGQEGPAAPERARGPFSRSSLSCMSFGNRI

SEQ ID NO: 749103 - protein, 109 aa, Homo sapiens
TAPSRSPSQSSWLSPPLGGPILPLPQSQQWVLRASRMGESKGIWPQTPTPKVTHKQGLSSSQQERPRSWPVVSLGKAGESGRWTGGPQELGEREGVASCLRSFPSEPCT

SEQ ID NO: 749104 - protein, 201 aa, Homo sapiens
SKTRRQKKKKKDIFFSHHTQMVAHYKHSPASLNMIVYLGGDCISPNKTLPRFSTLWGGTIPDWYPCLAGGLGFCCYQQRCSEYPMCLSFCHFSHMWGLLPAHISRGRVAGLVHVKFGWPFLSQEPQFIHTQASSLCVLPTFCSLPGGWVTNDIMISWHWLWGLKKIFYGRVQWLTPVTPGLWEAEAGGSLEVRSLGPAWAT

SEQ ID NO: 749105 - protein, 72 aa, Homo sapiens
QEDKLLRVRRGSPHHRAQCLTIASVLYLFIHTNRTISLLSILPNSSRSLSLLTIHHLLLNVLHPSALHSIKC

SEQ ID NO: 749106 - protein, 96 aa, Homo sapiens
MTSALENYINRTVAVITSDGRMIVGTLKGFDQTINLILDESHERVFSSSQGVEQVVLGLYIVRGDNVAVIGEIDEETDSALDLGNIRAEPLNSVAH

SEQ ID NO: 749107 - protein, 115 aa, Homo sapiens
GRLLLLLLLEFKLLTMYGDMTSALENYINRTVAVITSDGRMIVGTLKGFDQTINLILDESHERVFSSSQGVEQVVLGLYIVRGDNVAVIGEIDEETDSALDLGNIRAEPLNSVAH

SEQ ID NO: 749108 - protein, 171 aa, Homo sapiens
MHAHSLVTAVRLLFGWPVRPNFRLTGLRSSNSHDICCDPQALSAAGFWRALSVLLAVRTAALPGTAGPNSMTSALENYINRILKLAAAGVSRGRGEAAVGDRWEVGRPGLGGILGAGEEMRAPERPRVRRRRLEPSRCCGPRGPFHFACKTQIKTQCDYSELFCLKKNVRS

SEQ ID NO: 749109 - protein, 96 aa, Homo sapiens; identical to SEQ ID NO: 749106

SEQ ID NO: 749110 - protein, 96 aa, Homo sapiens; identical to SEQ ID NO: 749106

SEQ ID NO: 749111 - protein, 144 aa, Homo sapiens
PPGALRKPALASCKVFSNHLRKKSYSSSLWQITAATFSPGVQSIKLLNARMANKVPVTLGEIYKPHQRLLTSTRIKVCRHCSSPASSTREASKTALPSFLSLFVEYRWKRRNPSKFCSFMKMGSCGQEICHYAPNLLYLRFSRE

SEQ ID NO: 749112 - protein, 963 aa, Homo sapiens
MPSLPAPPAPLLLLGLLLLGSRPARGAGPEPPVLPIRSEKEPLPVRGAAGCTFGGKVYALDETWHPDLGEPFGVMRCVLCACEATGTLRPREMKSLSRVTQLPQWGRRTRGPGRVSCKNIKPECPTPACGQPRQLPGHCCQTCPQERSSSERQPSGLSFEYPRDPEHRSYSDRGEPGAEERARGDGHTDFVALLTGPRSQAVARARVSLLRSSLRFSISYRRLDRPTRIRFSDSNGSVLFEHPAAPTQDGLVCGVWRAVPRLSLRLLRAEQLHVALVTLTHPSGEVWGPLIRHRALAAETFSAILTLEGPPQQGVGGITLLTLSDTEDSLHFLLLFRGLLEPRSGDSTPGAATRELQANVSAQEPGFAEVLPNLTVQEMDWLVLGELQMALEWAGRPGLRISGHIAARKSCDVLQSVLCGADALIPVQTGAAGSASLTLLGNGSLIYQVQVVGTSSEVVAMTLETKPQRRDQRTVLCHMAGLQPGGHTAVGICPGLGARGAHMLLQNELFLNVGTKDFPDGELRGHVAALPYCGHSARHDTLPVPLAGALVLPPVKSQAAGHAWLSLDTHCHLHYEVLLAGLGGSEQGTVTAHLLGPPGTPGPRRLLKGFYGSEAQGVVKDLEPELLRHLAKGMASLMITTKGSPRGELRGQVHIANQCEVGGLRLEAAGAEGVRALGAPDTASAAPPVVPGLPALAPAKPGGPGRPRDPNTCFFEGQQRPHGARWAPNYDPLCSLCTCQRRTVICDPVVCPPPSCPHPVQAPDQCCPVCPEKQDVRDLPGLPRSRDPGEGCYFDGDRSWRAAGTRWHPVVPPFGLIKCAVCTCKGGTGEVHCEKVQCPRLACAQPVRVNPTDCCKQCPVGSGAHPQLGDPMQADGPRGCRFAGQWFPESQSWHPSVPPFGEMSCITCRCGAGVPHCERDDCSLPLSCGSGKESRCCSRCTAHRRPAPETRTDPELEKEAEGS

SEQ ID NO: 749113 - protein, 955 aa, Homo sapiens
MPSLPAPPAPLLLLGLLLLGSRPARGAGPEPPVLPIRSEKEPLPVRGAAGCTFGGKVYALDETWHPDLGEPFGVMRCVLCACEAPQWGRRTRGPGRVSCKNIKPECPTPACGQPRQLPGHCCQTCPQERSSSERQPSGLSFEYPRDPEHRSYSDRGEPGAEERARGDGHTDFVALLTGPRSQAVARARVSLLRSSLRFSISYRRLDRPTRIRFSDSNGSVLFEHPAAPTQDGLVCGVWRAVPRLSLRLLRAEQLHVALVTLTHPSGEVWGPLIRHRALAAETFSAILTLEGPPQQGVGGITLLTLSDTEDSLHFLLLFRGLLEPRSGGLTQVPLRLQILHQGQLLRELQANVSAQEPGFAEVLPNLTVQEMDWLVLGELQMALEWAGRPGLRISGHIAARKSCDVLQSVLCGADALIPVQTGAAGSASLTLLGNGSLIYQVQVVGTSSEVVAMTLETKPQRRDQRTVLCHMAGLQPGGHTAVGICPGLGARGAHMLLQNELFLNVGTKDFPDGELRGHVAALPYCGHSARHDTLPVPLAGALVLPPVKSQAAGHAWLSLDTHCHLHYEVLLAGLGGSEQGTVTAHLLGPPGTPGPRRLLKGFYGSEAQGVVKDLEPELLRHLAKGMASLMITTKGSPRGELRGQVHIANQCEVGGLRLEAAGAEGVRALGAPDTASAAPPVVPGLPALAPAKPGGPGRPRDPNTCFFEGQQRPHGARWAPNYDPLCSLCTCQRRTVICDPVVCPPPSCPHPVQAPDQCCPVCPEKQDVRDLPGLPRSRDPGEGCYFDGDRSWRAAGTRWHPVVPPFGLIKCAVCTCKGGTGEVHCEKVQCPRLACAQPVRVNPTDCCKQCPVGSGAHPQLGDPMQADGPRGCRFAGQWFPESQSWHPSVPPFGEMSCITCRCGAGVPHCERDDCSLPLSCGSGKESRCCSRCTAHRRPAPETRTDPELEKEAEGS

SEQ ID NO: 749114 - protein, 945 aa, Homo sapiens
MPSLPAPPAPLLLLGLLLLGSRPARGAGPEPPVLPIRSEKEPLPVRGAAGCTFGGKVYALDETWHPDLGEPFGVMRCVLCACEAPQWGRRTRGPGRVSCKNIKPECPTPACGQPRQLPGHCCQTCPQERSSSERQPSGLSFEYPRDPEHRSYSDRGEPGAEERARGDGHTDFVALLTGPRSQAVARARVSLLRSSLRFSISYRRLDRPTRIRFSDSNGSVLFEHPAAPTQDGLVCGVWRAVPRLSLRLLRAEQLHVALVTLTHPSGEVWGPLIRHRALAAETFSAILTLEGPPQQGVGGITLLTLSDTEDSLHFLLLFRGLLEPRSGDSTQGQLLRELQANVSAQEPGFAEVLPNLTVQEMDWLVLGELQMALEWAGRPGLRISGHIAARKSCDVLQSVLCGADALIPVQTGAAGSASLTLLGNGSLIYQVQVVGTSSEVVAMTLETKPQRRDQRTVLCHMAGLQPGGHTAVGICPGLGARGAHMLLQNELFLNVGTKDFPDGELRGHVAALPYCGHSARHDTLPVPLAGALVLPPVKSQAAGHAWLSLDTHCHLHYEVLLAGLGGSEQGTVTAHLLGPPGTPGPRRLLKGFYGSEAQGVVKDLEPELLRHLAKGMASLMITTKGSPRGELRGQVHIANQCEVGGLRLEAAGAEGVRALGAPDTASAAPPVVPGLPALAPAKPGGPGRPRDPNTCFFEGQQRPHGARWAPNYDPLCSLCTCQRRTVICDPVVCPPPSCPHPVQAPDQCCPVCPEKQDVRDLPGLPRSRDPGEGCYFDGDRSWRAAGTRWHPVVPPFGLIKCAVCTCKGGTGEVHCEKVQCPRLACAQPVRVNPTDCCKQCPVGSGAHPQLGDPMQADGPRGCRFAGQWFPESQSWHPSVPPFGEMSCITCRCGAGVPHCERDDCSLPLSCGSGKESRCCSRCTAHRRPAPETRTDPELEKEAEGS

SEQ ID NO: 749115 - protein, 933 aa, Homo sapiens
MPSLPAPPAPLLLLGLLLLGSRPARGAGPEPPVLPIRSEKEPLPVRGAAGCTFGGKVYALDETWHPDLGEPFGVMRCVLCACEATGTLRPREMKSLSRVTQLPQWGRRTRGPGRVSCKNIKPECPTPACGQPRQLPGHCCQTCPQERSSSERQPSGLSFEYPRDPEHRSYSDRGEPGAEERARGDGHTDFVALLTGPRSQAVARARVSLLRSSLRFSISYRRLDRPTRIRFSDSNGSVLFEHPAAPTQDGLVCGVWRAVPRLSLRLLRAEQLHVALVTLTHPSGEVWGPLIRHRALAAETFSAILTLEGPPQQGVGGITLLTLSDTEDSLHFLLLFRGLLEPRSGGLTQVPLRLQILHQGQLLRELQANVSAQEPGFAEVLPNLTVQEMDWLVLGELQMALEWAGRPGLRISGHIAARKSCDVLQSVLCGADALIPVQTGAAGSASLTLLGNGSLIYQAVGICPGLGARGAHMLLQNELFLNVGTKDFPDGELRGHVAALPYCGHSARHDTLPVPLAGALVLPPVKSQAAGHAWLSLDTHCHLHYEVLLAGLGGSEQGTVTAHLLGPPGTPGPRRLLKGFYGSEAQGVVKDLEPELLRHLAKGMASLMITTKGSPRGELRGQVHIANQCEVGGLRLEAAGAEGVRALGAPDTASAAPPVVPGLPALAPAKPGGPGRPRDPNTCFFEGQQRPHGARWAPNYDPLCSLCTCQRRTVICDPVVCPPPSCPHPVQAPDQCCPVCPEKQDVRDLPGLPRSRDPGEGCYFDGDRSWRAAGTRWHPVVPPFGLIKCAVCTCKGGTGEVHCEKVQCPRLACAQPVRVNPTDCCKQCPVGSGAHPQLGDPMQADGPRGCRFAGQWFPESQSWHPSVPPFGEMSCITCRCGAGVPHCERDDCSLPLSCGSGKESRCCSRCTAHRRPAPETRTDPELEKEAEGS

SEQ ID NO: 749116 - protein, 808 aa, Homo sapiens
MPSLPAPPAPLLLLGLLLLGSRPARGAGPEPPVLPIRSEKEPLPVRGAAGCTFGGKVYALDETWHPDLGEPFGVMRCVLCACEATGTLRPREMKSLSRVTQLPQWGRRTRGPGRVSCKNIKPECPTPACGQPRQLPGHCCQTCPQERSSSERQPSGLSFEYPRDPEHRSYSDRGEPGAEERARGDGHTDFVALLTGPRSQAVARARVSLLRSSLRFSISYRRLDRPTRIRFSDSNGSVLFEHPAAPTQDGLVCGVWRAVPRLSLRLLRAEQLHVALVTLTHPSGEVWGPLIRHRALAAETFSAILTLEGPPQQGVGGITLLTLSDTEDSLHFLLLFRGLLEPRSGGLTQVPLRLQILHQGQLLRELQANVSAQEPGFAEVLPNLTVQEMDWLVLGELQMALEWAGRPGLRISGHIAARKSCDVLQSVLCGADALIPVQTGAAGSASLTLLGNGSLIYQVQVVGTSSEVVAMTLETKPQRRDQRTVLCHMAGLQPGGHTAVGICPGLGARGAHMLLQNELFLNVGTKDFPDGELRGHVAALPYCGHSARHDTLPVPLAGALVLPPVKSQAAGHAWLSLDTHCHLHYEVLLAGLGGSEQGTVTAHLLGPPGTPGPRRLLKGFYGSEAQGVVKDLEPELLRHLAKGMASLMITTKGSPRGELRGQVHIANQCEVGGLRLEAAGAEGVRALGAPDTASAAPPVVPGLPALAPAKPGGPGRPRDPNTCFFEGQQRPHGARWAPNYDPLCSLCTCQRRTVICDPVVCPPPSCPHPVQAPDQCCPVCPEKQDVRDLPGLPRSRDPGEGGHWRGAL

SEQ ID NO: 749117 - protein, 390 aa, Homo sapiens
VRSLAAPGLAGEPAMRGKTFRFEMQRDLVSFPLSPAVRVKLVSAGFQTAEELLEVKPSELSKEVGISKAEALETLQIIRRECLTNKPRYAGTSESHKKCTALELLEQEHTQGFIITFCSALDDILGGGVPLMKTTEICGAPGVGKTQLCMQLAVDVQIPECFGGVAGEAVFIDTEGSFMVDRVVDLATACIQHLQLIAEKHKGEEHRKALEDFTLDNILSHIYYFRCRDYTELLAQVYLLPDFLSEHSKVRLVIVDGIAFPFRHDLDDLSLRTRLLNGLAQQMISLANNHRLAVILTNQMTTKIDRNQALLVPALGESWGHAATIRLIFHWDRKQRLATLYKSPSQKECTVLFQIKPQGFRDTVVTSACSLQTEGSLSTRKRSRDPEEEL

SEQ ID NO: 749118 - protein, 148 aa, Homo sapiens
VRSLAAPGLAGEPAMRGKTFRFEMQRDLVSFPLSPAVRVKLVSAGFQTAEELLEVKPSELSKEVGISKAEALETLQIIRRECLTNKPRYAGTSESHKKCTALELLEQEHTQGFIITFCSALDDILGGGVPLMKTTEICGAPGVGKTQL

SEQ ID NO: 749119 - protein, 149 aa, Homo sapiens
VRSLAAPGLAGEPAMRGKTFRFEMQRDLVSFPLSPAVRVKLVSAGFQTAEELLEVKPSELSKEVGISKAEALETLQIIRRECLTNKPRYAGTSESHKKCTALELLEQEHTQGFIITFCSALDDILGGGVPLMKTTEICGAPGVGKTQLW

SEQ ID NO: 749120 - protein, 149 aa, Homo sapiens; identical to SEQ ID NO: 749119

SEQ ID NO: 749121 - protein, 80 aa, Homo sapiens
PGGGEPPPPPPPHPPHFPPLPPPPRGPFFFPKSPPPPEVPPLIFDPPPGPPPPLFFFPPKKKKKGKKPLYFWPEPPEEEL

SEQ ID NO: 749122 - protein, 66 aa, Homo sapiens [sequence omitted]

SEQ ID NO: 749123 - protein, 430 aa, Homo sapiens
VRSLAAPGLAGEPAMRGKTFRFEMQRDLVSFPLSPAVRVKLVSAGFQTAEELLEVKPSELSKEVGISKAEALETLQIIRRECLTNKPRYAGTSESHKKCTALELLEQEHTQGFIITFCSALDDILGGGVPLMKTTEICGAPGVGKTQLCMQLAVDVQIPECFGGVAGEAVFIDTEGSFMVDRVVDLATACIQHLQLIAEKHKGEEHRKALEDFTLDNILSHIYYFRCRDYTELLAQVYLLPDFLSEHSKAHCSSRITLLLCGVALPLPLSARAPPSETKDDIALPPGLMVRLVIVDGIAFPFRHDLDDLSLRTRLLNGLAQQMISLANNHRLAVILTNQMTTKIDRNQALLVPALGESWGHAATIRLIFHWDRKQRLATLYKSPSQKECTVLFQIKPQGFRDTVVTSACSLQTEGSLSTRKRSRDPEEEL

SEQ ID NO: 749124 - protein, 253 aa, Homo sapiens
VRSLAAPGLAGEPAMRGKTFRFEMQRDLVSFPLSPAVRVKLVSAGFQTAEELLEVKPSELSKEVGISKAEALETLQIIRRECLTNKPRYAGTSESHKKCTALELLEQEHTQGFIITFCSALDDILGGGVPLMKTTEICGAPGVGKTQLCMQLAVDVQIPECFGGVAGEAVFIDTEGSFMVDRVVDLATACIQHLQLIAEKHKGEEHRKALEDFTLDNILSHIYYFRCRDYTELLAQVYLLPDFLSEHSKPQTS

SEQ ID NO: 749125 - protein, 66 aa, Homo sapiens [sequence omitted]

SEQ ID NO: 749126 - protein, 319 aa, Homo sapiens
VRSLAAPGLAGEPAMRGKTFRFEMQRDLVSFPLSPAVRVKLVSAGFQTAEELLEVKPSELSKEVGISKAEALETLQIIRRECLTNKPRYAGTSESHKKCTALELLEQEHTQGFIITFCSALDDILGGGVPLMKTTEICGAPGVGKTQLCMQLAVDVQIPECFGGVAGEAVFIDTEGSFMVDRVVDLATACIQHLQLIAEKHKGEEHRKALEDFTLDNILSHIYYFRCRDYTELLAQVYLLPDFLSEHSKVRLVIVDGIAFPFRHDLDDLSLRTRLLNGLAQQMISLANNHRLAVILTNQMTTKIDRNQALLVPALASGI

SEQ ID NO: 749127 - protein, 66 aa, Homo sapiens [sequence omitted]

SEQ ID NO: 749128 - protein, 259 aa, Homo sapiens
MKTTEICGAPGVGKTQLCMQLAVDVQIPECFGGVAGEAVFIDTEGSFMVDRVVDLATACIQHLQLIAEKHKGEEHRKALEDFTLDNILSHIYYFRCRDYTELLAQVYLLPDFLSEHSKVRLVIVDGIAFPFRHDLDDLSLRTRLLNGLAQQMISLANNHRLAVILTNQMTTKIDRNQALLVPALGESWGHAATIRLIFHWDRKQRLATLYKSPSQKECTVLFQIKPQGFRDTVVTSACSLQTEGSLSTRKRSRDPEEEL

SEQ ID NO: 749129 - protein, 342 aa, Homo sapiens
AIWNDSLNPPPLTAEVGISKAEALETLQIIRRECLTNKPRYAGTSESHKKCTALELLEQEHTQGFIITFCSALDDILGGGVPLMKTTEICGAPGVGKTQLCMQLAVDVQIPECFGGVAGEAVFIDTEGSFMVDRVVDLATACIQHLQLIAEKHKGEEHRKALEDFTLDNILSHIYYFRCRDYTELLAQVYLLPDFLSEHSKVRLVIVDGIAFPFRHDLDDLSLRTRLLNGLAQQMISLANNHRLAVILTNQMTTKIDRNQALLVPALGESWGHAATIRLIFHWDRKQRLATLYKSPSQKECTVLFQIKPQGFRDTVVTSACSLQTEGSLSTRKRSRDPEEEL

SEQ ID NO: 749130 - protein, 356 aa, Homo sapiens
VRSLAAPGLAGEPAMRGKTFRFEMQRDLVSFPLSPAVRVKLVSAGFQTAEELLEVKPSELSKEVGISKAEALETLQIIRRECLTNKPRYAGTSESHKKCTALELLEQEHTQGFIITFCSALDDILGGGVPLMKTTEICGAPGVGKTQLCMQLAVDVQIPECFGGVAGEAVFIDTEGSFMVDRVVDLATACIQHLQLIAEKHKGEEHRKALEDFTLDNILSHIYYFRCRDYTELLAQVYLLPDFLSEHSKVRLVIVDGIAFPFRHDLDDLSLRTRLLNGLAQQMISLANNHRLAVILTNQMTTKIDRNQALLVPALGESWGHAATIRLIFHWDRKQSLRDLEILLLLLHVHCKQKVP

SEQ ID NO: 749131 - protein, 356 aa, Homo sapiens
VRSLAAPGLAGEPAMRGKTFRFEMQRDLVSFPLSPAVRVKLVSAGFQTAEELLEVKPSELSKEVGISKAEALETLQIIRRECLTNKPRYAGTSESHKKCTALELLEQEHTQGFIITFCSALDDILGGGVPLMKTTEICGAPGVGKTQLCMQLAVDVQIPECFGGVAGEAVFIDTEGSFMVDRVVDLATACIQHLQLIAEKHKGEEHRKALEDFTLDNILSHIYYFRCRDYTELLAQVYLLPDFLSEHSKVRLVIVDGIAFPFRHDLDDLSLRTRLLNGLAQQMISLANNHRLAVILTNQMTTKIDRNQALLVPALGWQHCTSHPARRNAQYCFKSNLRDLEILLLLLHVHCKQKVP

SEQ ID NO: 749132 - protein, 317 aa, Homo sapiens
VRSLAAPGLAGEPAMRGKTFRFEMQRDLVSFPLSPAVRVKLVSAGFQTAEELLEVKPSELSKEVGISKAEALETLQIIRRECLTNKPRYAGTSESHKKCTALELLEQEHTQGFIITFCSALDDILGGGVPLMKTTEICGAPGVGKTQLCMQLAVDVQIPECFGGVAGEAVFIDTEGSFMVDRVVDLATACIQHLQLIAEKHKGEEHRKALEDFTLDNILSHIYYFRCRDYTELLAQVYLLPDFLSEHSKVRLVIVDGIAFPFRHDLDDLSLRTRLLNGLAQQMISLANNHRLAVILTNQMTTKIDRNQALLVPALGG

SEQ ID NO: 749133 - protein, 233 aa, Homo sapiens
VRSLAAPGLAGEPAMRGKTFRFEMQRDLVSFPLSPAVRVKLVSAGFQTAEELLEVKPSELSKEVGISKAEALETLQIIRRECLTNKPRYAGTSESHKKCTALELLEQEHTQGFIITFCSALDDILGGGVPLMKTTEICGAPGVGKTQLCMQLAVDVQIPECFGGVAGEAVFIDTEGSFMVDRVVDLATACIQHLQLIAEKHKGEESGSTARAGVQWRNLGLLRPSPPRFKRFS

SEQ ID NO: 749134 - protein, 241 aa, Homo sapiens [sequence omitted]

SEQ ID NO: 749135 - protein, 148 aa, Homo sapiens; identical to SEQ ID NO: 749118

SEQ ID NO: 749136 - protein, 317 aa, Homo sapiens
VRSLAAPGLAGEPAMRGKTFRFEMQRDLVSFPLSPAVRVKLVSAGFQTAEELLEVKPSELSKEVGISKAEALETLQIIRRECLTNKPRYAGTSESHKKCTALELLEQEHTQGFIITFCSALDDILGGGVPLMKTTEICGAPGVGKTQLCMQLAVDVQIPECFGGVAGEAVFIDTEGSFMVDRVVDLATACIQHLQLIAEKHKGEEHRKALEDFTLDNILSHIYYFRCRDYTELLAQVYLLPDFLSEHSKVRLVIVDGIAFPFRHDLDDLSLRTRLLNGLAQQMISLANNHRLAVGNIVQVTQPEGMHSTVSNQTSGI

SEQ ID NO: 749137 - protein, 396 aa, Homo sapiens
VRSLAAPGLAGEPAMRGKTFRFEMQRDLVSFPLSPAVRVKLVSAGFQTAEELLEVKPSELSKEVGISKAEALETLQIIRRECLTNKPRYAGTSESHKKCTALELLEQEHTQGFIITFCSALDDILGGGVPLMKTTEICGAPGVGKTQLCMQLAVDVQIPECFGGVAGEAVFIDTEGSFMVDRVVDLATACIQHLQLIAEKHKGEEHRKALEDFTLDNILSHIYYFRCRDYTELLAQVYLLPDFLSEHSKAHCSSRITLLLCGVALPLPLSARAPPSETKDDIALPPGLMVRLVIVDGIAFPFRHDLDDLSLRTRLLNGLAQQMISLANNHRLAVILTNQMTTKIDRNQALLVPALGWQHCTSHPARRNAQYCFKSNLRDLEILLLLLHVHCKQKVP

SEQ ID NO: 749138 - protein, 66 aa, Homo sapiens [sequence omitted]

SEQ ID NO: 749139 - protein, 66 aa, Homo sapiens [sequence omitted]

SEQ ID NO: 749140 - protein, 66 aa, Homo sapiens [sequence omitted]

SEQ ID NO: 749141 - protein, 66 aa, Homo sapiens [sequence omitted]

SEQ ID NO: 749142 - protein, 66 aa, Homo sapiens [sequence omitted]

SEQ ID NO: 749143 - protein, 143 aa, Homo sapiens
RWQQLTAEQRELSLQAVIAWEIQNLPEEQRTGYMGPQECASKSAPVPNILFKSDASIDRNQALLVPALGESWGHAATIRLIFHWDRKQRLATLYKSPSQKECTVLFQIKPQGFRDTVVTSACSLQTEGSLSTRKRSRDPEEEL

SEQ ID NO: 749144 - protein, 177 aa, Homo sapiens
HLGGDTASQGGGRAGAPAGPAALREPGVAAPASLPPWRSSPAQPWHTPFLHTRTTCTSRTSSRGPYGALCRVPPQPHFTDSPLRPRDMQLSVHNHATCMGALKAVKVHLGPSPKPARGPAVNTGQALSGWDDHTLCFLATCQPPCNSVCLLPICCLCKQLLDPGTLGCWPGGVREGG

SEQ ID NO: 749145 - protein, 116 aa, Homo sapiens
PSSFFQGGGHSASTVSVFSSLGLPLEARGHACLGDPCPPKPSVCLCLFAVCPRLSVPTLVLAVNVNGPILSVLSDTHTPVSTPSVRHTLRLAGPPTAAAINARINTLCGSHSNWAS

SEQ ID NO: 749146 - protein, 298 aa, Homo sapiens
MAYMNPGPHYSVNALALSGPSVDLMHQAVPYPSAPRKQRRERTTFTRSQLEELEALFAKTQYPDVYAREEVALKINLPESRVQVWFKNRRAKCRQQRQQQKQQQQPPGGQAKARPAKRKAGTSPRPSTDVCPDPLGISDSYSPPLPGPSGSPTTAVATVSIWSPASESPLPEAQRAGLVASGPSLTSAPYAMTYAPASAFCSSPSAYGSPSSYFSGLDPYLSPMVPQLGGPALSPLSGPSVGPSLAQSPTSLSGQSYGAYSPVDSLEFKDPTGTWKFTYNPMDPLDYKDQSAWKFQIL

SEQ ID NO: 749147 - protein, 320 aa, Homo sapiens
MRPVLIPQPGPLTWASVSPKIMMAYMNPGPHYSVNALALSGPSVDLMHQAVPYPSAPRKQRRERTTFTRSQLEELEALFAKTQYPDVYAREEVALKINLPESRVQVWFKNRRAKCRQQRQQQKQQQQPPGGQAKARPAKRKAGTSPRPSTDVCPDPLGISDSYSPPLPGPSGSPTTAVATVSIWSPASESPLPEAQRAGLVASGPSLTSAPYAMTYAPASAFCSSPSAYGSPSSYFSGLDPYLSPMVPQLGGPALSPLSGPSVGPSLAQSPTSLSGQSYGAYSPVDSLEFKDPTGTWKFTYNPMDPLDYKDQSAWKFQIL

SEQ ID NO: 749148 - protein, 600 aa, Homo sapiens
MGKKLDLSKLTDEEAQHVLEVVQRDFDLRRKEEERLEALKGKIKKESSKRELLSDTAHLNETHCARCLQPYQLLVNSKRQCLECGLFTCKSCGRVHPEEQGWICDPCHLARVVKIGSLEWYYEHVKARFKRFGSAKVIRSLHGRLQGGAGPELISEERSGDSDQTDEDGEPGSEAQAQAQPFGSKKKRLLSVHDFDFEGDSDDSTQPQGHSLHLSSVPEARDSPQSLTDESCSEKAAPHKAEGLEEADTGASGCHSHPEEQPTSISPSRHGALAELCPPGGSHRMALGTAAALGSNVIRNEQLPLQYLADVDTSDEESIRAHVMASHHSKRRGRASSESQIFELNKHISAVECLLTYLENTVVPPLAKGLGAGVRTEADVEEEALRRKLEELTSNVSDQETSSEEEEAKDEKAEPNRDKSVGPLPQADPEVGTAAHQTNRQEKSPQDPGDPVQYNRTTDEELSELEDRVAVTASEVQQAESEVSDIESRIAALRAAGLTVKPSGKPRRKSNLPIFLPRVAGKLGKRPEDPNADPSSEAKAMAVPYLLRRKFSNSLKSQGKDDDSFDRKSVYRGSLTQRNPNARKGMASHTFAKPVVAHQS

SEQ ID NO: 749149 - protein, 572 aa, Homo sapiens
MGKKLDLSKLTDEEAQHVLEVVQRDFDLRRKEEERLEALKGKIKKESSKRELLSDTAHLNETHCARCLQPYQLLVNSKRQCLECGLFTCKSCGRVHPEEQGWICDPCHLARVVKIGSLEWYYEHVKARFKRFGSAKVIRSLHGRLQGGAGPELISEERSGDSDQTDEDGEPGSEAQAQAQPFGSKKKRLLSVHDFDFEGDSDDSTQPQGHSLHLSSVPEARDSPQSLTDESCSEKAAPHKAEGLEEADTGASGCHSHPEEQPTSISPSRHGALAELCPPGGSHRMALGTAAALGSNVIRNEQLPLQYLADVDTSDEESIRAHVMASHHSKRRGRASSESQGLGAGVRTEADVEEEALRRKLEELTSNVSDQETSSEEEEAKDEKAEPNRDKSVGPLPQADPEVGTAAHQTNRQEKSPQDPGDPVQYNRTTDEELSELEDRVAVTASEVQQAESEVSDIESRIAALRAAGLTVKPSGKPRRKSNLPIFLPRVAGKLGKRPEDPNADPSSEAKAMAVPYLLRRKFSNSLKSQGKDDDSFDRKSVYRGSLTQRNPNARKGMASHTFAKPVVAHQS

SEQ ID NO: 749150 - protein, 600 aa, Homo sapiens; identical to SEQ ID NO: 749148

SEQ ID NO: 749151 - protein, 600 aa, Homo sapiens; identical to SEQ ID NO: 749148

SEQ ID NO: 749152 - protein, 576 aa, Homo sapiens
MGIDSEGKKRTVEALKGKIKKESSKRELLSDTAHLNETHCARCLQPYQLLVNSKRQCLECGLFTCKSCGRVHPEEQGWICDPCHLARVVKIGSLEWYYEHVKARFKRFGSAKVIRSLHGRLQGGAGPELISEERSGDSDQTDEDGEPGSEAQAQAQPFGSKKKRLLSVHDFDFEGDSDDSTQPQGHSLHLSSVPEARDSPQSLTDESCSEKAAPHKAEGLEEADTGASGCHSHPEEQPTSISPSRHGALAELCPPGGSHRMALGTAAALGSNVIRNEQLPLQYLADVDTSDEESIRAHVMASHHSKRRGRASSESQIFELNKHISAVECLLTYLENTVVPPLAKGLGAGVRTEADVEEEALRRKLEELTSNVSDQETSSEEEEAKDEKAEPNRDKSVGPLPQADPEVGTAAHQTNRQEKSPQDPGDPVQYNRTTDEELSELEDRVAVTASEVQQAESEVSDIESRIAALRAAGLTVKPSGKPRRKSNLPIFLPRVAGKLGKRPEDPNADPSSEAKAMAVPYLLRRKFSNSLKSQGKDDDSFDRKSVYRGSLTQRNPNARKGMASHTFAKPVVAHQS

SEQ ID NO: 749153 - protein, 560 aa, Homo sapiens
MGKKLDLSKLTDEEAQHVLEVVQRDFDLRRKEEERLEALKGKIKKESSKRELLSDTAHLNETHCARCLQPYQLLVNSKRQCLECGLFTCKSCGRVHPEEQGWICDPCHLARVVKIGSLEWYYEHVKARFKRFGSAKVIRSLHGRLQGGAGPELISEERSGDSDQTDEDGEPGSEAQAQAQPFGSKSLTDESCSEKAAPHKAEGLEEADTGASGCHSHPEEQPTSISPSRHGALAELCPPGGSHRMALGTAAALGSNVIRNEQLPLQYLADVDTSDEESIRAHVMASHHSKRRGRASSESQIFELNKHISAVECLLTYLENTVVPPLAKGLGAGVRTEADVEEEALRRKLEELTSNVSDQETSSEEEEAKDEKAEPNRDKSVGPLPQADPEVGTAAHQTNRQEKSPQDPGDPVQYNRTTDEELSELEDRVAVTASEVQQAESEVSDIESRIAALRAAGLTVKPSGKPRRKSNLPIFLPRVAGKLGKRPEDPNADPSSEAKAMAVPYLLRRKFSNSLKSQGKDDDSFDRKSVYRGSLTQRNPNARKGMASHTFAKPVVAHQS

SEQ ID NO: 749154 - protein, 532 aa, Homo sapiens
MGKKLDLSKLTDEEAQHVLEVVQRDFDLRRKEEERLEALKGKIKKESSKRELLSDTAHLNETHCARCLQPYQLLVNSKRQCLECGLFTCKSCGRVHPEEQGWICDPCHLARVVKIGSLEWYYEHVKARFKRFGSAKVIRSLHGRLQGGAGPELISEERSGDSDQTDEDGEPGSEAQAQAQPFGSKSLTDESCSEKAAPHKAEGLEEADTGASGCHSHPEEQPTSISPSRHGALAELCPPGGSHRMALGTAAALGSNVIRNEQLPLQYLADVDTSDEESIRAHVMASHHSKRRGRASSESQGLGAGVRTEADVEEEALRRKLEELTSNVSDQETSSEEEEAKDEKAEPNRDKSVGPLPQADPEVGTAAHQTNRQEKSPQDPGDPVQYNRTTDEELSELEDRVAVTASEVQQAESEVSDIESRIAALRAAGLTVKPSGKPRRKSNLPIFLPRVAGKLGKRPEDPNADPSSEAKAMAVPYLLRRKFSNSLKSQGKDDDSFDRKSVYRGSLTQRNPNARKGMASHTFAKPVVAHQS

SEQ ID NO: 749155 - protein, 245 aa, Homo sapiens
YLEDPSGSVSESEGLGAGVRTEADVEEEALRRKLEELTSNVSDQETSSEEEEAKDEKAEPNRDKSVGPLPQADPEVGTAAHQTNRQEKSPQDPGDPVQYNRTTDEELSELEDRVAVTASEVQQAESEVSDIESRIAALRAAGLTVKPSGKPRRKSNLPIFLPRVAGKLGKRPEDPNADPSSEAKAMAVPYLLRRKFSNSLKSQGKDDDSFDRKSVYRGSLTQRNPNARKGMASHTFAKPVVAHQS

SEQ ID NO: 749156 - protein, 72 aa, Homo sapiens
DPIPSHSREAKAMAVPYLLRRKFSNSLKSQGKDDDSFDRKSVYRGSLTQRNPNARKGMASHTFAKPVVAHQS

SEQ ID NO: 749157 - protein, 75 aa, Homo sapiens
AVPEGKDEPYVRVMAMAVPYLLRRKFSNSLKSQGKDDDSFDRKSVYRGSLTQRNPNARKGMASHTFAKPVVAHQS

SEQ ID NO: 749158 - protein, 596 aa, Homo sapiens
MGKKLDLSKLTDEEAQHVLEVVQRDFDLRRKEEERLEALKGKIKKESSKRELLSDTAHLNETHCARCLQPYQLLVNSKRQCLECGLFTCKSCGRVHPEEQGWICDPCHLARVVKIGSLEWYYEHVKARFKRFGSAKVIRSLHGRLQGGAGPELISEERSGDSDQTDEDGEPGSEAQAQAQPFGSKKKRLLSVHDFDFEGDSDDSTQPQGHSLHLSSVPEARDSPQSLTDESCSEKAAPHKAEGLEEADTGASGCHSHPEEQPTSISPSRHGALAELCPPGGSHRMALGTAAALGSNVIRNEQLPLQYLADVDTSDEESIRAHVMASHHSKRRGRASSESQIFELNKHISAVECLLTYLENTVVPPLAKGLGAGVRTEADVEEEALRRKLEELTSNVSDQETSSEEEEAKDEKAEPNRDKSVGPLPQADPEVGTAAHQTNRQEKSPQDPGDPVQYNRTTDEELSELEDRVAVTASEVQQAESEVSDIESRIAALRAAGLTVKPSGKPRRKSNLPIFLPRVAGKLGKRPEDPNADPSSEAKAMAVPYLLRRKFSNSLKSQGKDDDSFDRKSVYRGSLTQRNPNARKGMASHTFASPSQ

SEQ ID NO: 749159 - protein, 506 aa, Homo sapiens
MGKKLDLSKLTDEEAQHVLEVVQRDFDLRRKEEERLEALKGKIKKESSKRELLSDTAHLNETHCARCLQPYQLLVNSKRQCLECGLFTCKSCGRVHPEEQGWICDPCHLARVVKIGSLEWYYEHVKARFKRFGSAKVIRSLHGRLQGGAGPELISEERSGDSDQTDEDGEPGSEAQAQAQPFGSKKKRLLSVHDFDFEGDSDDSTQPQGHSLHLSSVPEARDSPQSLTDESCSEKAAPHKAEGLEEADTGASGCHSHPEEQPTSISPSRHGALAELCPPGGSHRMALGTAAALGSNVIRNEQLPLQYLADVDTSDEESIRAHVMASHHSKRRGRASSESQIFELNKHISAVECLLTYLENTVVPPLAKGLGAGVRTEADVEEEALRRKLEELTSNVSDQETSSEEEEAKDEKAEPNRDKSVGPLPQADPEVGTAAHQTNRQEKSPQDPGDPVQYNRTTAILSLIGSVLSTIHSHRPNEKQEGAPSTWTPTCKWTATFSPALLTWVY

SEQ ID NO: 749160 - protein, 365 aa, Homo sapiens
MGKKLDLSKLTDEEAQHVLEVVQRDFDLRRKEEERLEALKGKIKKESSKRELLSDTAHLNETHCARCLQPYQLLVNSKRQCLECGLFTCKSCGRVHPEEQGWICDPCHLARVVKIGSLEWYYEHVKARFKRFGSAKVIRSLHGRLQGGAGPELISEERSGDSDQTDEDGEPGSEAQAQAQPFGSKKKRLLSVHDFDFEGDSDDSTQPQGHSLHLSSVPEARDSPQSLTDESCSEKAAPHKAEGLEEADTGASGCHSHPEEQPTSISPSRHGALAELCPPGGSHRMALGTAAALGSNVIRNEQLPLQYLADVDTSDEESIRAHVMASHHSKRRGRASSESQVTVAGKTSVLSFLWVESFYLHTKSL

SEQ ID NO: 749161 - protein, 248 aa, Homo sapiens
MGKKLDLSKLTDEEAQHVLEVVQRDFDLRRKEEERLEALKGKIKKESSKRELLSDTAHLNETHCARCLQPYQLLVNSKRQCLECGLFTCKSCGRVHPEEQGWICDPCHLARVVKIGSLEWYYEHVKARFKRFGSAKVIRSLHGRLQGGAGPELISEERSGDSDQTDEDGEPGSEAQAQAQPFGSKKKRLLSVHDFDFEGDSDDSTQPQGHSLHLSSVPEARDSPQVSGSSCLSPAPPRNLSGRCSGPR

SEQ ID NO: 749162 - protein, 163 aa, Homo sapiens [sequence omitted]

SEQ ID NO: 749163 - protein, 600 aa, Homo sapiens; identical to SEQ ID NO: 749148

SEQ ID NO: 749164 - protein, 548 aa, Homo sapiens
MGKKLDLSKLTDEEAQHVLEVVQRDFDLRRKEEERLEALKGKIKKESSKRELLSDTAHLNETHCARCLQPYQLLVNSKRQCLECGLFTCKSCGRVHPEEQGWICDPCHLARVVKIGSLEWYYEHVKARFKRFGSAKVIRSLHGRLQGGAGPELISEERSGDSDQTDEDGEPGSEAQAQAQPFGSKKKRLLSVHDFDFEGDSDDSTQPQGHSLHLSSVPEARDSPQSLTDESCSEKAAPHKAEGLEEADTGASGCHSHPEEQPTSISPSRHGALAELCPPGGSHRMALGTAAALGSNVIRNEQLPLQYLADVDTSDEESIRAHVMASHHSKRRGRASSESQIFELNKHISAVECLLTYLENTVVPPLAKGLGAGVRTEADVEEEALRRKLEELTSNVSDQETSSEEEEAKDEKAEPNRDKSVGPLPQADPEVSDIESRIAALRAAGLTVKPSGKPRRKSNLPIFLPRVAGKLGKRPEDPNADPSSEAKAMAVPYLLRRKFSNSLKSQGKDDDSFDRKSVYRGSLTQRNPNARKGMASHTFAKPVVAHQS

SEQ ID NO: 749165 - protein, 484 aa, Homo sapiens
MDRLVDGWVDGLTNGLFPDCLSLGGVMQVSIAAGPELISEERSGDSDQTDEDGEPGSEAQAQAQPFGSKKKRLLSVHDFDFEGDSDDSTQPQGHSLHLSSVPEARDSPQSLTDESCSEKAAPHKAEGLEEADTGASGCHSHPEEQPTSISPSRHGALAELCPPGGSHRMALGTAAALGSNVIRNEQLPLQYLADVDTSDEESIRAHVMASHHSKRRGRASSESQIFELNKHISAVECLLTYLENTVVPPLAKGLGAGVRTEADVEEEALRRKLEELTSNVSDQETSSEEEEAKDEKAEPNRDKSVGPLPQADPEVGTAAHQTNRQEKSPQDPGDPVQYNRTTDEELSELEDRVAVTASEVQQAESEVSDIESRIAALRAAGLTVKPSGKPRRKSNLPIFLPRVAGKLGKRPEDPNADPSSEAKAMAVPYLLRRKFSNSLKSQGKDDDSFDRKSVYRGSLTQRNPNARKGMASHTFAKPVVAHQS

SEQ ID NO: 749166 - protein, 123 aa, Homo sapiens
MAESEVSDIESRIAALRAAGLTVKPSGKPRRKSNLPIFLPRVAGKLGKRPEDPNADPSSEAKAMAVPYLLRRKFSNSLKSQGKDDDSFDRKSVYRGSLTQRNPNARKGMASHTFAKPVVAHQS

SEQ ID NO: 749167 - protein, 124 aa, Homo sapiens
GPIHKQPKGGVRVRRCISSQSTAESEFQTCISDFAGSRASGSPEESNSDDSPRVLELQRQRHKQTSEPGMVCLSLEKSVILKSKDDDSFDRKSVYRGSLTQRNPNARKGMASHTFAKPVVAHQS

SEQ ID NO: 749168 - protein, 600 aa, Homo sapiens; identical to SEQ ID NO: 749148

SEQ ID NO: 749169 - protein, 381 aa, Homo sapiens
MGKKLDLSKLTDEEAQHVLEVVQRDFDLRRKEEERLEALKGKIKKESSKRELLSDTAHLNETHCARCLQPYQLLVNSKRQCLECGLFTCKSCGRVHPEEQGWICDPCHLARVVKIGSLEWYYEHVKARFKRFGSAKVIRSLHGRLQGGAGPELISEERSGDSDQTDEDGEPGSEAQAQAQPFGSKKKRLLSVHDFDFEGDSDDSTQPQGHSLHLSSVPEARDSPQSLTDESCSEKAAPHKAEGLEEADTGASGCHSHPEEQPTSISPSRHGALAELCPPGGSHRMALGTAAALGSNVIRNEQLPLQYLADVDTSDEESIRAHVMASHHSKRRGRASSESQIFELNKHISAVECLLTYLENTVVPPLAKAERHSRSFHRGPL

SEQ ID NO: 749170 - protein, 192 aa, Homo sapiens
MGKKLDLSKLTDEEAQHVLEVVQRDFDLRRKEEERLEALKGKIKKESSKRELLSDTAHLNETHCARCLQPYQLLVNSKRQCLECGLFTCKSCGRVHPEEQGWICDPCHLARVVKIGSLEWYYEHVKARFKRFGSAKVIRSLHGRLQGGAGPELISEERSGDSDQTDEDGEPGSEAQAQAQPFGSKPTILSDL

SEQ ID NO: 749171 - protein, 126 aa, Homo sapiens
MGKKLDLSKLTDEEAQHVLEVVQRDFDLRRKEEERLEALKGKIKKESSKRELLSDTAHLNETHCARCLQPYQLLVNSKRQCLECGLFTCKSCGRVHPEEQGWICDPCHLARVVKIASLSVDNHVDQ

SEQ ID NO: 749172 - protein, 368 aa, Homo sapiens
GRARMPGPVEGGCRASQVLTGKKLAGPGRGRAAAVAPPGVEGSSEMESRVADAGTGETARAAGGSPAVGCTTRGPVVSAPLGAARWKLLRQVLKQKHLDDCLRHVSVRRFESFNLFSVTEGKERETEEEVGAWVQYTSIFCPEYSISLRHNSGSLNVEDVLTSFDNTGNVCIWPSEEVLAYYCLKHNNIFRALAVCELGGGMTCLAGLMVAISADVKEVLLTDGNEKAIRNVQDIITRNQKAGVFKTQKISSCVLRWDNETDVSQLEGHFDIVMCADCLFLDQYRASLVDAIKRLLQPRGKAMVFAPRRGNTLNQFCNLAEKAGFCIQRHENYDEHISNFHSKLKKENPDIYEENLHYPLLLILTKHG

SEQ ID NO: 749173 - protein, 177 aa, Homo sapiens
GRARMPGPVEGGCRASQVLTGKKLAGPGRGRAAAVAPPGVEGSSEMESRVADAGTGETARAAGGSPAVGCTTRGPVVSAPLGAARWKLLRQVLKQKHLDDCLRHVSVRRFESFNLFSVTEGKERETEEEVGAWVQYTSIFCPEYSISLRHNSGSLNVEDVLTSFDNTGNVWEATRGK

SEQ ID NO: 749174 - protein, 170 aa, Homo sapiens
GRARMPGPVEGGCRASQVLTGKKLAGPGRGRAAAVAPPGVEGSSEMESRVADAGTGETARAAGGSPAVGCTTRGPVVSAPLGAARWKLLRQVLKQKHLDDCLRHVSVRRFESFNLFSVTEGKERETEEEVGAWVQYTSIFCPEYSISLRHNSGSLNVEDVLTSFDNTGNV

SEQ ID NO: 749175 - protein, 184 aa, Homo sapiens
GRARMPGPVEGGCRASQVLTGKKLAGPGRGRAAAVAPPGVEGSSEMESRVADAGTGETARAAGGSPAVGCTTRGPVVSAPLGAARWKLLRQVLKQKHLDDCLRHVSVRRFESFNLFSVTEGKERETEEEVGAWVQYTSIFCPEYSISLRHNSGSLNVEDVLTSFDNTGNVYTGSHSVAQAGVQW

SEQ ID NO: 749176 - protein, 177 aa, Homo sapiens; identical to SEQ ID NO: 749173

SEQ ID NO: 749177 - protein, 184 aa, Homo sapiens; identical to SEQ ID NO: 749175

SEQ ID NO: 749178 - protein, 180 aa, Homo sapiens
GRARMPGPVEGGCRASQVLTGKKLAGPGRGRAAAVAPPGVEGSSEMESRVADAGTGETARAAGGSPAVGCTTRGPVVSAPLGAARWKLLRQVLKQKHLDDCLRHVSVRRFESFNLFSVTEGKERETEEEVGAWVQYTSIFCPEYSISLRHNSGSLNVEDVLTSFDNTGNVCLHPHHLTIE

SEQ ID NO: 749179 - protein, 180 aa, Homo sapiens; identical to SEQ ID NO: 749178

SEQ ID NO: 749180 - protein, 180 aa, Homo sapiens; identical to SEQ ID NO: 749178

SEQ ID NO: 749181 - protein, 170 aa, Homo sapiens; identical to SEQ ID NO: 749174

SEQ ID NO: 749182 - protein, 184 aa, Homo sapiens; identical to SEQ ID NO: 749175

SEQ ID NO: 749183 - protein, 439 aa, Homo sapiens
ARGRHRPVRTGRGSGLAHVYGGEAGGYMAGSVGLALCGQTLVVRGGSRFLATSIASSDDDSLFIYDCSAAEKKSQENKGEDAPLDQGSGAILASTFSKSGSYFALTDDSKRLILFRTKPWQCLSVRTVARRCTALTFIASEEKVLVADKSGDVYSFSVLEPHGCGRLELGHLSMLLDVAVSPDDRFILTADRDEKIRVSWAAAPHSIESFCLGHTEFVSRISVVPTQPGLLLSSSGDGTLRLWEYRSGRQLHCCHLASLQELVDPQAPQKFAASRIAFWCQENCVALLCDGTPVVYIFQLDARRQQLVYRQQLAFQHQVWDVAFEETQGLWVLQDCQEAPLVLYRPVGDQWQSVPESTVLKKVSGVLRGNWAMLEGSAGADASFSSLYKATFDNVTSYLKKKEERLQQQLEKKQRRRSPPPGPDGHAKKMRPGEATLSC

SEQ ID NO: 749184 - protein, 439 aa, Homo sapiens; identical to SEQ ID NO: 749183

SEQ ID NO: 749185 - protein, 349 aa, Homo sapiens
ARGRHRPVRTGRGSGLAHVYGGEAGGYMAGSVGLALCGQTLVVRGGSRFLATSIASSDDDSLFIYDCSAAEKKSQENKGEDAPLDQGSGAILASTFSKSGSYFALTDDSKRLILFRTKPWQCLSVRFVSRISVVPTQPGLLLSSSGDGTLRLWEYRSGRQLHCCHLASLQELVDPQAPQKFAASRIAFWCQENCVALLCDGTPVVYIFQLDARRQQLVYRQQLAFQHQVWDVAFEETQGLWVLQDCQEAPLVLYRPVGDQWQSVPESTVLKKVSGVLRGNWAMLEGSAGADASFSSLYKATFDNVTSYLKKKEERLQQQLEKKQRRRSPPPGPDGHAKKMRPGEATLSC

SEQ ID NO: 749186 - protein, 217 aa, Homo sapiens
ARGRHRPVRTGRGSGLAHVYGGEAGGYMAGSVGLALCGQTLVVRGGSRFLATSIASSDDDSLFIYDCSAAEKKSQENKGEDAPLDQGSGAILASTFSKSGSYFALTDDSKRLILFRTKPWQCLSVRTVARRCTALTFIASEEKVLVADKSGDVYSFSVLEPHGCGRLELGHLSMLLDVAVSPDDRFILTADRDEKIRVSWAAAPHSIESFCLGHTEW

SEQ ID NO: 749187 - protein, 102 aa, Homo sapiens
MNKVGPCCLVVPCEALFYQDSAENLAIPGGKAQNRPKEPEEVAIQEPRVGDTWLEGPRTRYRGKTVQRAVGPRAPPEHVRSEITDHETHPVGEQTRNTSRRT

SEQ ID NO: 749188 - protein, 105 aa, Homo sapiens
SQSAGIIGVSHCTQSIVFNSKHFLPDGLTLSPRLKCSGVISAHSSLNLPGSSSPPTLASQSAGITGTSHYAQPVFLHFDYSVRTVHPRSACEMLELGFQQLNARV

SEQ ID NO: 749189 - protein, 266 aa, Homo sapiens
MLLDVAVSPDDRFILTADRDEKIRVSWAAAPHSIESFCLGHTEFVSRISVVPTQPGLLLSSSGDGTLRLWEYRSGRQLHCCHLASLQELVDPQAPQKFAASRIAFWCQENCVALLCDGTPVVYIFQLDARRQQLVYRQQLAFQHQVWDVAFEETQGLWVLQDCQEAPLVLYRPVGDQWQSVPESTVLKKVSGVLRGNWAMLEGSAGADASFSSLYKATFDNVTSYLKKKEERLQQQLEKKQRRRSPPPGPDGHAKKMRPGEATLSC

SEQ ID NO: 749190 - protein, 439 aa, Homo sapiens; identical to SEQ ID NO: 749183

SEQ ID NO: 749191 - protein, 406 aa, Homo sapiens
ARGRHRPVRTGRGSGLAHVYGGEAGGYMAGSVGLALCGQTLVVRGGSRFLATSIASSDDDSLFIYDCSAAEKKSQENKGEDAPLDQGSGAILASTFSKSGSYFALTDDSKRLILFRTKPWQCLSVRTVARRCTALTFIASEEKVLVADKSGDVYSFSVLEPHGCGRLELGHLSMLLDVAVSPDDRFILTADRDEKIRVSWAAAPHSIESFCLGHTEFVSRISVVPTQPGLLLSSSGKFAASRIAFWCQENCVALLCDGTPVVYIFQLDARRQQLVYRQQLAFQHQVWDVAFEETQGLWVLQDCQEAPLVLYRPVGDQWQSVPESTVLKKVSGVLRGNWAMLEGSAGADASFSSLYKATFDNVTSYLKKKEERLQQQLEKKQRRRSPPPGPDGHAKKMRPGEATLSC

SEQ ID NO: 749192 - protein, 94 aa, Homo sapiens
LALLNFFGTTFSSWKTEHMARYRCLPPPTWPARLSRTLRCSWKLMGVSFWPSRTVARRCTALTFIASEEKVLVADKSGDVYSFSVLEPHGCGRL

SEQ ID NO: 749193 - protein, 132 aa, Homo sapiens
RRGLHRLGCWLQSGARGPAVLVIMLSFFVASTPVVYIFQLDARRQQLVYRQQLAFQHQVWDVAFEETQGLWVLQDCQEAPLVLYRPVGDQWQVRLGTFQMSYALPFHKPGGVGRQLCFLGPWVSLFQLSHFW

SEQ ID NO: 749194 - protein, 129 aa, Homo sapiens [sequence omitted]

SEQ ID NO: 749195 - protein, 128 aa, Homo sapiens
MLTWSRRRVRPACVRVWERASPLTRGPVMNRGCVFASRDLARCGALQKCGQAAAETASQEPPPASPASQRGGGTPGESLQTSSGRGEDAGSPRGRVGARAGGSLSPVRSCSCHLSRRAAGCSGWARAR

SEQ ID NO: 749196 - protein, 177 aa, Homo sapiens
QRQMIKEAFAGDDVIRDFLKEKREAVEASKPKDVDLTLPGWGEWGGVGLKPSAKKRRQFLIKAPEGPPRKDKNLPNVIISEKRNIHAAAHQVQVLPYPFTHHRQFERTIQTPIGSTWNTQRAFQKLTTPKVVTKPGHIIKPIKAEDVGYQSSSRSDLPVIQRNPKRITTRHNKEEKL

SEQ ID NO: 749197 - protein, 177 aa, Homo sapiens; identical to SEQ ID NO: 749196

SEQ ID NO: 749198 - protein, 177 aa, Homo sapiens; identical to SEQ ID NO: 749196

SEQ ID NO: 749199 - protein, 121 aa, Homo sapiens
MLALDSCRTHCWGHCSPLGQPSPWDLQLLISVSSLSLLKSSCGTFTHDADLMGPGTPVICRFKGDLTSICCQDMLGATLHHCQSHLKVHIHLSLPGSAPHLHTYLPGEASFICQDQPQHRL

SEQ ID NO: 749200 - protein, 117 aa, Homo sapiens
NVGENRREAIGVQNIWMCLQPAVSPIGPGGPKDAYSHPTSTCFLITSQSPAAVSWIVRENNCKLREAEGWKGPEAGLEKSIGPGEPALGQRLSPTQQHLAQQGPPPLALAHPTPALS

SEQ ID NO: 749201 - protein, 168 aa, Homo sapiens
WRSGPQSLSRRRGFSSLPLEPPRFPTFRSPLPAFSRHRRRRLPQAVSTEEKESYRMSAIQNLHSFDPFADASKGDDLLPAGTEDYIHIRIQQRNGRKTLTTVQGIADDYDKKKLVKAFKKKFACNGTVIEHPEYGEVIQLQGDQRKNICQFLVEIGLAKDDQLKVHGF

SEQ ID NO: 749202 - protein, 126 aa, Homo sapiens
LRLKGGDEKESYRMSAIQNLHSFDPFADASKGDDLLPAGTEDYIHIRIQQRNGRKTLTTVQGIADDYDKKKLVKAFKKKFACNGTVIEHPEYGEVIQLQGDQRKNICQFLVEIGLAKDDQLKVHGF

SEQ ID NO: 749203 - protein, 157 aa, Homo sapiens
MTCSGRASKGHIRPGPSPDDFSVVFCTRKTPGDRGDGSGILSLTALNELNLVFSDPFADASKGDDLLPAGTEDYIHIRIQQRNGRKTLTTVQGIADDYDKKKLVKAFKKKFACNGTVIEHPEYGEVIQLQGDQRKNICQFLVEIGLAKDDQLKVHGF

SEQ ID NO: 749204 - protein, 135 aa, Homo sapiens
WRSGPQSLSRRRGFSSLPLEPPRFPTFRSPLPAFSRHRRRRLPQAVSTEEKESYRMSAIQNLHSFDPFADASKGDDLLPAGTEDYIHIRIQQRNGRKTLTTVQGIADDYDKKKLVKAFKKFSYRVTNARTYASSS

SEQ ID NO: 749205 - protein, 68 aa, Homo sapiens
PSGDRGIQGEYHVMMKAEVGVMQLQAKECLRLPPSRQKLGRGKEGFPYRLQRKHGTTDILIQTQPSEL

SEQ ID NO: 749206 - protein, 112 aa, Homo sapiens
MSVSRTPLFRPFADASKGDDLLPAGTEDYIHIRIQQRNGRKTLTTVQGIADDYDKKKLVKAFKKKFACNGTVIEHPEYGEVIQLQGDQRKNICQFLVEIGLAKDDQLKVHGF

SEQ ID NO: 749207 - protein, 161 aa, Homo sapiens
MSVSRTPLFRPFADASKGDDLLPAGTEDYIHIRIQQRNGRKTLTTVQGIADDYDKKKLVKAFKKVESSVRFWESHNGFVHKGVPAVLYVLLAEGVINAFMLLLGLIRFPLCLQKFACNGTVIEHPEYGEVIQLQGDQRKNICQFLVEIGLAKDDQLKVHGF

SEQ ID NO: 749208 - protein, 110 aa, Homo sapiens
AQDKKWQKAQSCFSSLMGSQGTKQSRVLVSVTELREHTCLISQPDIGDLSGALQMLSSTVSGTEGSGNKDLFHWIKKKAFFNFYDGLFHPHSALTRRSHFSFFPTFVLSI

SEQ ID NO: 749209 - protein, 94 aa, Homo sapiens
KKVFFPRSADLVFNPRGSGRSGAGSTEPHRHLVTTRRHRPCPTPRFHLLLSGASCFCFGEKSRGDFAAQQVRRLHRLFYPFPFPTFRSAKGCLL

SEQ ID NO: 749210 - protein, 135 aa, Homo sapiens
MSVVHQLSAGWLLDHLSFINKINYQLHQHHEPCCRKKEFTTSVHFESLQMDSVSSSGVCAAFIASDSSTKPENDDGGNYEMFTRKFVFRPELFDVTKPYITPAVHKECQQSNEKEDLMNGVKKEISISIIGKVES

SEQ ID NO: 749211 - protein, 136 aa, Homo sapiens
MCVRTLVWEMKAFPHSLTCIGFLSSVSSFVYSNRTGTTEGFPTLFTFIGLFSSVNPFMNSKRTGTTKSFSTLLTFIGFFSNVSPLMSLKGLVIYEGFSTLFTFIGFFSSVTPFMSLKGFEITKGFLTLLTFIWLLK

SEQ ID NO: 749212 - protein, 107 aa, Homo sapiens
TVLPTSPSIAPSSSQASAHTGSDGRVTSYPGTSDLSPPHPTRRRLISPREGIRLTPVQGGCLESEPLSKSLRPGLTWWLCQSYLLTVKCSQNIWSKSANIGALRPTS

SEQ ID NO: 749213 - protein, 95 aa, Homo sapiens
TPTPATTCTRPRSPASDSPFWVPRSRPGLGQPRLGTGGSAKSPGTRHGVGGSDSGCGGQRRIPASLAHLHPQPTPSPKASLRLSLPNNNMMSEGL

SEQ ID NO: 749214 - protein, 541 aa, Homo sapiens
MDFESGQVDPLASVILPPNLLENLSPEDSVLVRRAQFTFFNKTGLFQDVGPQRKTLVSYVMACSIGNITIQNLKDPVQIKIKHTRTQEVHHPICAFWDLNKNKSFGGWNTSGCVAHRDSDASETVCLCNHFTHFGVLMDLPRSASQLDARNTKVLTFISYIGCGISAIFSAATLLTYVAFEKLRRDYPSKILMNLSTALLFLNLLFLLDGWITSFNVDGLCIAVAVLLHFFLLATFTWMGLEAIHMYIALVKVFNTYIRRYILKFCIIGWGLPALVVSVVLASRNNNEVYGKESYGKEKGDEFCWIQDPVIFYVTCAGYFGVMFFLNIAMFIVVMVQICGRNGKRSNRTLREEVLRNLRSVVSLTFLLGMTWGFAFFAWGPLNIPFMYLFSIFNSLQGLFIFIFHCAMKENVQKQWRRHLCCGRFRLADNSDWSKTATNIIKKSSDNLGKSLSSSSIGSNSTYLTSKSKSSSTTYFKRNSHTDSASMDKSLSKLAHADGDQTSIIPVHQVIDKVKGYCNAHSDNFYKNIIMSDTFSHSTKF

SEQ ID NO: 749215 - protein, 512 aa, Homo sapiens
MDFESGQVDPLASVILPPNLLENLSPEDSVLVRRAQFTFFNKTGLFQDVGPQRKTLVSYVMACSIGNITIQNLKDPVQIKIKHTRTQEVHHPICAFWDLNKNKSFGGWNTSGCVAHRDSDASETVCLCNHFTHFGVLMDLPRSASQLDARNTKVLTFISYIGCGISAIFSAATLLTYVAFEKLRRDYPSKILMNLSTALLFLNLLFLLDGWITSFNVDGLCIAVAVLLHFFLLATFTWMGLEAIHMYIALVKVFNTYIRRYILKFCIIGWGLPALVVSVVLASRNNNEVYGKESYGKEKGDEFCWIQDPVIFYVTCAGYFGVMFFLNIAMFIVVMVQICGRNGKRSNRTLREEVLRNLRSVVSLTFLLGMTWGFAFFAWGPLNIPFMYLFSIFNSLQGLFIFIFHCAMKENVQKQWRRHLCCGRFRLADNSDWSKTATNIIKKSSDNLGKSLSSSSIGSNSTYLTSKSKSSSTTYFKRNSHTDNVSYEHSFNKSGSLRQCFHGQVLVKTGPC

SEQ ID NO: 749216 - protein, 576 aa, Homo sapiens
FFVVTSRALKTIDELAFKIDLNSTSHVNITTRNLALSVSSLLPGTNAISNFSIGLPSNNESYFQMDFESGQVDPLASVILPPNLLENLSPEDSVLVRRAQFTFFNKTGLFQDVGPQRKTLVSYVMACSIGNITIQNLKDPVQIKIKHTRTQEVHHPICAFWDLNKNKSFGGWNTSGCVAHRDSDASETVCLCNHFTHFGVLMDLPRSASQLDARNTKVLTFISYIGCGISAIFSAATLLTYVAFEKLRRDYPSKILMNLSTALLFLNLLFLLDGWITSFNVDGLCIAVAVLLHFFLLATFTWMGLEAIHMYIALVKVFNTYIRRYILKFCIIGWGLPALVVSVVLASRNNNEVYGKESYGKEKGDEFCWIQDPVIFYVTCAGYFGVMFFLNIAMFIVVMVQICGRNGKRSNRTLREEVLRNLRSVVSLTFLLGMTWGFAFFAWGPLNIPFMYLFSIFNSLQGLFIFIFHCAMKENVQKQWRRHLCCGRFRLADNSDWSKTATNIIKKSSDNLGKSLSSSSIGSNSTYLTSKSKSSSTTYFKRNSHTDNVSYEHSFNKSGSLRQCFHGQVLVKTGPC

SEQ ID NO: 749217 - protein, 576 aa, Homo sapiens; identical to SEQ ID NO: 749216

SEQ ID NO: 749218 - protein, 403 aa, Homo sapiens
MDFESGQVDPLASVILPPNLLENLSPEDSVLVRRAQFTFFNKTGLFQDVGPQRKTLVSYVMACSIGNITIQNLKDPVQIKIKHTRTQEVHHPICAFWDLNKNKSFGGWNTSGCVAHRDSDASETVCLCNHFTHFGVLMDLPRSASQLDARNTKVLTFISYIGCGISAIFSAATLLTYVAFEKLRRDYPSKILMNLSTALLFLNLLFLLDGWITSFNVDGLCIAVAVLLHFFLLATFTWMGLEAIHMYIALVKVFNTYIRRYILKFCIIGWGLPALVVSVVLASRNNNEVYGKESYGKEKGDEFCWIQDPVIFYVTCAGYFGVMFFLNIAMFIVVMVQICGRNGKRSNRTLREEVLRNLRSVVSLTFLLGMTWGFAFFAWGPLNIPFMYLFSIFNSLQGKINCT

SEQ ID NO: 749219 - protein, 130 aa, Homo sapiens
MDRSNPVKPALDYFSNRLVNYQISVKCSNQFKLEVCLLNAENKVVDNQAGTQGQLKVLGANLWWPYLMHEHPAYLYSWEDGDCSHQSLGPLPACDLCDQLHLRSRQGGSVCGCDPCEQLLLLVSQLRAPG

SEQ ID NO: 749220 - protein, 50 aa, Homo sapiens
MVIAHTKALDPSQPVTFVTNSTYAADKGALYVDVIRVNSYYSWYRNYGHL

SEQ ID NO: 749221 - protein, 130 aa, Homo sapiens; identical to SEQ ID NO: 749219

SEQ ID NO: 749222 - protein, 199 aa, Homo sapiens
VIAHTKALDPSQPVTFVTNSTYAADKGALYVDVIRVNSYYSWYHNYGHLELIQLQLAAQFENWCKTSQSHYSERVWSGNACRVSPGLVNYQISVKCSNQFKLEVCLLNAENKVVDNQAGTQGQLKVLGANLWWPYLMHEHPAYLYSWEDGDCSHQSLGPLPACDLCDQLHLRSRQGGSVCGCDPCEQLLLLVSQLRAPG

SEQ ID NO: 749223 - protein, 114 aa, Homo sapiens
GDSLDGWGQNEERNGGSMWAQVSVLLIAPFAFKEIKLFLVCATAGETPEEAFPSLRSSGSCQVWSSARFWEPPRAGGRGVTIWGLWGQAGVCLLPEVLVALASLSRVALACREQ

SEQ ID NO: 749224 - protein, 112 aa, Homo sapiens
DPSRYLKRRRRRRKKEKGKRKRKRKKKEEEEEKEQEEEEEEEEQEEKKKKRKRKKKEERRKNKKKKEEKKWEESMNRSSFTKIGDNRETVFIASSCVGHLVSCGLRLTFYLV

SEQ ID NO: 749225 - protein, 439 aa, Homo sapiens
SGDLIPTSLCRRPFPILARPQGAQLLRTARYWESRRQGRGKGKGETVQTAWPPSCLCPRFARAPFSVTHTSPSPPPRLGLCIARLRRSAGAAPALPGLLSRVVEMSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQFDFLIDIVPRDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQTLATNAQQITQTEVQQGQQQFSQFTDGQQLYQIQQVTMPAGQDLAQPMFIQSANQPSDGQAPQVTGD

SEQ ID NO: 749226 - protein, 439 aa, Homo sapiens; identical to SEQ ID NO: 749225

SEQ ID NO: 749227 - protein, 446 aa, Homo sapiens
MQFPVVEMSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQFDFLIDIVPRDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQTLATNAQQITQTEVQQGQQQFSQFTDGQRNSVQQARVSELTGEAEPREVKATGNSTPCTSSLPTTHPPSHRAGASCVCCSQPQQSSTSPPPSDALQWVVVEVSGTPNQLETHRELHAPLPGMTSLSPLHPSQQLYQIQQVTMPAGQDLAQPMFIQSANQPSDGQAPQVTGD

SEQ ID NO: 749228 - protein, 165 aa, Homo sapiens
SGCKVSSGPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQNCIQRHLHPEGTS

SEQ ID NO: 749229 - protein, 562 aa, Homo sapiens
SGDLIPTSLCRRPFPILARPQGAQLLRTARYWESRRQGRGKGKGETVQTAWPPSCLCPRFARAPFSVTHTSPSPPPRLGLCIARLRRSAGAAPALPGLLSRVVEMSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQFDFLIDIVPRDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQTLATNAQQGQRNASQGKPRRCLKETLQITQTEVQQGQQQFSQFTDGQRNSVQQARVSELTGEAEPREVKATGNSTPCTSSLPTTHPPSHRAGASCVCCSQPQQSSTSPPPSDALQWVVVEVSGTPNQLETHRELHAPLPGMTSLSPLHPSQQLYQIQQVTMPAGQDLAQPMFIQSANQPSDGQAPQVTGD

SEQ ID NO: 749230 - protein, 458 aa, Homo sapiens
SGDLIPTSLCRRPFPILARPQGAQLLRTARYWESRRQGRGKGKGETVQTAWPPSCLCPRFARAPFSVTHTSPSPPPRLGLCIARLRRSAGAAPALPGLLSRVVEMSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQFDFLIDIVPRDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQTLATNAQQGQRNASQGKPRRCLKETLQITQTEVQQGQQQFSQFTDGQQLYQIQQVTMPAGQDLAQPMFIQSANQPSDGQAPQVTGD

SEQ ID NO: 749231 - protein, 439 aa, Homo sapiens; identical to SEQ ID NO: 749225

SEQ ID NO: 749232 - protein, 439 aa, Homo sapiens; identical to SEQ ID NO: 749225

SEQ ID NO: 749233 - protein, 377 aa, Homo sapiens
LASVQRYRPGNCASFSFDLSSLHGRLCQDEACPGTHAIKVVEMSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQFDFLIDIVPRDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQTLATNAQQITQTEVQQGQQQFSQFTDGQQLYQIQQVTMPAGQDLAQPMFIQSANQPSDGQAPQVTGD

SEQ ID NO: 749234 - protein, 484 aa, Homo sapiens
SGDLIPTSLCRRPFPILARPQGAQLLRTARYWESRRQGRGKGKGETVQTAWPPSCLCPRFARAPFSVTHTSPSPPPRLGLCIARLRRSAGAAPALPGLLSRDEVSLCCQGWCARLECRGLIMTHCSLHLLGLKQSSYFSLLSSWDTVVEMSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQFDFLIDIVPRDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQTLATNAQQITQTEVQQGQQQFSQFTDGQQLYQIQQVTMPAGQDLAQPMFIQSANQPSDGQAPQVTGD

SEQ ID NO: 749235 - protein, 421 aa, Homo sapiens
SGDLIPTSLCRRPFPILARPQGAQLLRTARYWESRRQGRGKGKGETVQTAWPPSCLCPRFARAPFSVTHTSPSPPPRLGLCIARLRRSAGAAPALPGLLSRVVEMSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQTLATNAQQITQTEVQQGQQQFSQFTDGQQLYQIQQVTMPAGQDLAQPMFIQSANQPSDGQAPQVTGD

SEQ ID NO: 749236 - protein, 417 aa, Homo sapiens
SGDLIPTSLCRRPFPILARPQGAQLLRTARYWESRRQGRGKGKGETVQTAWPPSCLCPRFARAPFSVTHTSPSPPPRLGLCIARLRRSAGAAPALPGLLSRVVEMSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQFDFLIDIVPRDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQTLATNAQQITQTEVQQGQQQFSQFTDGQVGYPTWAGQRVRICGAG

SEQ ID NO: 749237 - protein, 101 aa, Homo sapiens
IGPQLNVTGNVRRLPGNPPSFQPLWFEGNVDQIPRHLPPMLNITQTEVQQGQQQFSQFTDGQQLYQIQQVTMPAGQDLAQPMFIQSANQPSDGQAPQVTGD

SEQ ID NO: 749238 - protein, 355 aa, Homo sapiens
MSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQLIFLIDIVPRDELKPPKRQEEVRQSVTPAEPVQYYFTLAQQPTAVQVQGQQQGQQTTSSTTTIQPGQIIIAQPQQGQTTPVTMQVGEGQQVQMSRLSHRVKPNEAQSGTGQTMQVMQQIITNTGEIQQIPVQLKPAAAVYPLSPACIRHSSVQRTDPDTCTMSTDTQTEVQQTAASQPSSKMQGGLQIRKSMLGADLARRHPAATASREPQERLGVVGGGPKLDSPRGLPKGTREGTPRAKKISK

SEQ ID NO: 749239 - protein, 364 aa, Homo sapiens
LRVYLEPSESSMDKNRVAHGLPAKGHCGAALGRDSQLDFSIRPCNVSQHQLPTMLCPEEIEIMELTGRNSIDNIHRLTEARPSNYHETEAYRWRCFDWAGIIDTLLIHHFFYKAYVKRVLLKVEGQLPGSHELFHYLIRDLLAPGLVLCDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQTLATNAQQITQTEVQQGQQQFSQFTDGQQLYQIQQVTMPAGQDLAQPMFIQSANQPSDGQAPQVTGD

SEQ ID NO: 749240 - protein, 484 aa, Homo sapiens; identical to SEQ ID NO: 749234

SEQ ID NO: 749241 - protein, 109 aa, Homo sapiens
MQQFSQFTDGQQLTITQTEVQQGQQQFSQFTDGQQLYQIQQVTMPAGQDLAQQYEEKAAAYDKLEKTKNRQQQDSCDDLVVDLGQPCGNIVSNLEKKQRQILNPLLARA

SEQ ID NO: 749242 - protein, 342 aa, Homo sapiens
MQFPVVEMSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQFDFLIDIVPRDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQTLATNAQQITQTEVQQGQQQFSQFTDGQQLYQIQQVTMPAGQDLAQPMFIQSANQPSDGQAPQVTGD

SEQ ID NO: 749243 - protein, 439 aa, Homo sapiens; identical to SEQ ID NO: 749225

SEQ ID NO: 749244 - protein, 543 aa, Homo sapiens
SGDLIPTSLCRRPFPILARPQGAQLLRTARYWESRRQGRGKGKGETVQTAWPPSCLCPRFARAPFSVTHTSPSPPPRLGLCIARLRRSAGAAPALPGLLSRVVEMSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQFDFLIDIVPRDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQTLATNAQQITQTEVQQGQQQFSQFTDGQRNSVQQARVSELTGEAEPREVKATGNSTPCTSSLPTTHPPSHRAGASCVCCSQPQQSSTSPPPSDALQWVVVEVSGTPNQLETHRELHAPLPGMTSLSPLHPSQQLYQIQQVTMPAGQDLAQPMFIQSANQPSDGQAPQVTGD

SEQ ID NO: 749245 - protein, 417 aa, Homo sapiens; identical to SEQ ID NO: 749236

SEQ ID NO: 749246 - protein, 328 aa, Homo sapiens
PGPYSGLCKDFRVQELPLARIKKIMKLDEDVKMISAEAPVLFAKAAQIFITELTLRAWIHTEDNKRRTLQRNDIAMAITKFDQIDFLIDIVPRDELKPPKRQEEVRQSVTPAEPVQYYFTLAQQPTAVQVQGQQQGQQTTSSTTTIQPGQIIIAQPQQGQTTPVTMQVGEGQQVQMSRLSHRVKPNKAQSGTGQTMQVMQQIITNTGEIQQIPVQLKPAAAVYPLSPACIRHSSVQRTDPDTCTMSTDTQTEVQQTAASQPSSKMQGGLQIRKSMLGADLARRHPAATASREPQERLGVVGGGPKLDSPRGLPKGTREGTPRAKKISK

SEQ ID NO: 749247 - protein, 69 aa, Homo sapiens
KGSGEVGTARIMRTMTSMTVLETTVIRFSLEITEAGVGTIIRPVLWIWGAELCSAMSESRGLPLIHSVI

SEQ ID NO: 749248 - protein, 106 aa, Homo sapiens
MVRDMQLKITPVKMAPVTFANIHKLHNTLLASPRGGRCFCTFLVGVSSGVATEEGNLAVSINIKNACWLGVVAHAYNPSTLGGRGGWITRSRAQDHPGQHGENPFL

SEQ ID NO: 749249 - protein, 86 aa, Homo sapiens
GLSIGDVAKKLGEMWNNTAADDKQPYEKKAAKLKEKYEKELLHIELKESLMQQKREFQGRKSKKNKEDEEDEEDEEEEDEEDDDDE

SEQ ID NO: 749250 - protein, 65 aa, Homo sapiens
MLLGPPFEFLERVSRVRRVWEDADEVTWEVQARGQSLSAEPFPRIHPLWSSYWNPTEIPLAEEIS

SEQ ID NO: 749251 - protein, 110 aa, Homo sapiens
LQTLGSCCSVVCFVPCVVLLGAHVSLEASLEEVADLAVPAPFHAPPKPLLALHQILDCPSPAVSPPLCIVLPNGHLFISSLYVQSAVQRGGRDKSLKNRITEKPKRIERK

SEQ ID NO: 749252 - protein, 166 aa, Homo sapiens
MLLEEVRAGDRLSGAAARGDVQEVRRLLHRELVHPDALNRFGKTALQVMMFGSTAIALELLKQGASPNVQDTSGTSPVHDAARTGFLDTLKVLVEHGADVNVPDGTGALPIHLAVQEGHTAVVSFLAAESDLHRRDARGLTPLELALQRGAQDLVDILQGHMVAPL

SEQ ID NO: 749253 - protein, 166 aa, Homo sapiens; identical to SEQ ID NO: 749252

SEQ ID NO: 749254 - protein, 209 aa, Homo sapiens
QLRSGRGREHVGSAPWRLPQRRRRRRLRADPARRGGGRAASVDMLLEEVRAGDRLSGAAARGDVQEVRRLLHRELVHPDALNRFGKTALQVMMFGSTAIALELLKQGASPNVQDTSGTSPVHDAARTGFLDTLKVLVEHGADVNVPDGTGALPIHLAVQEGHTAVVSFLAAESDLHRRDARGLTPLELALQRGAQDLVDILQGHMVAPL

SEQ ID NO: 749255 - protein, 123 aa, Homo sapiens
GRAPGGLFGPAPAGCSALTAPGWGGAGGFAGRQCRHAAGGGSRRRPAEWGGGPGRRAGGAPPSAPRAGASRRPQPLRQDGAAGEAGPVQVGAGRLSGMRIETPELLSGLLALVVTHWEPVLLL

SEQ ID NO: 749256 - protein, 410 aa, Homo sapiens
RGPTAPPRGRAGRAATAAEVQVPRGAAGSPSSPSASRPGPAPRPASLPPSQMQAAALPEEIRWLLEDAEEFLAEGLRNENLSAVARDHRDHILRGFQQIKARYYWDFQPQGGDIGQDSSDDNHSGTLGLSLTSDAPFLSDYQDEGMEDIVKGAQELDNVIKQGYLEKKSKDHSFFGSEWQKRWCVVSRGLFYYYANEKSKQPKGTFLIKGYSVRMAPHLRRDSKKESCFELTSQDRRSYEFTATSPAEARDWVDQISFLLKDLSSLTIPYEEDEEEEEKEETYDDIDGFDSPSCGSQCRPTILPGSVGIKEPTEEKEEEDIYEVLPDEEHDLEEDESGTRRKGVDYASYYQGLWDCHGDQPDELSFQRGDLIRILSKEYNMYGWWVGELNSLVGIVPKEYLTTAFEVEER

SEQ ID NO: 749257 - protein, 410 aa, Homo sapiens; identical to SEQ ID NO: 749256

SEQ ID NO: 749258 - protein, 265 aa, Homo sapiens
MEDIVKGAQELDNVIKQGYLEKKSKDHSFFGSEWQKRWCVVSRGLFYYYANEKSKQPKGTFLIKGYSVRMAPHLRRDSKKESCFELTSQDRRSYEFTATSPAEARDWVDQISFLLKDLSSLTIPYEEDEEEEEKEETYDDIDGFDSPSCGSQCRPTILPGSVGIKEPTEEKEEEDIYEVLPDEEHDLEEDESGTRRKGVDYASYYQGLWDCHGDQPDELSFQRGDLIRILSKEYNMYGWWVGELNSLVGIVPKEYLTTAFEVEER

SEQ ID NO: 749259 - protein, 267 aa, Homo sapiens
MHLLLFQLLVLLPLGKTTRHQDGRQNQSSLSPVLLPRNQRELPTGNHEEAEEKPDLFVAVPHLVATSPAGEGQRQREKMLSRFGRFWKKPEREMHPSRDSDSEPFPPGTQSLIQPIDGMKMEKSPLREEAKKFWHHFMFRKTPASQGVILPIKSHEVHWETCRTVPFSQTITHEGCEKVVVQNNLCFGKCGSVHFPGAAQHSHTSCSHCLPAKFTTMHLPLNCTELSSVIKVVMLVEECQCKVKTEHEDGHILHAGSQDSFIPGVSA

SEQ ID NO: 749260 - protein, 573 aa, Homo sapiens
MTNSKGRSITDKTSGGPSSGGGFVDWTLRLNTIQSDKFLNLLLSMVPVIYQKNQEDRHKKANGIWQDGLSTAVQTFSNRSEQHMEYHSFSEQSFHANNGHASSSCSQKYDDYANYNYCDGRETSETTAMLQDEDISSDGDEDAIVEVTPKLPKESSGIMALQILVPFLLAGFGTVSAGMVLDIVQHWEVFRKVTEVFILVPALLGLKGNLEMTLASRLSTAVNIGKMDSPIEKWNLIIGNLALKQVQATVVGFLAAVAAIILGWIPEGKYYLDHSILLCSSSVATAFIASLLQGIIMVGVIVGSKKTGINPDNVATPIAASFGDLITLAILAWISQGLYSCLETYYYISPLVGVFFLALTPIWIIIAAKHPATRTVLHSGWEPVITAMVISSIGGLILDTTVSDPNLVGIVVYTPVINGIGGNLVAIQASRISTYLHLHSIPGELPDEPKGCYYPFRTFFGPGVNNKSAQVLLLLVIPGHLIFLYTIHLMKSGHTSLTIIFIVVYLFGAVLQVFTLLWIADWMVHHFWRKGKDPDSFSIPYLTALGDLLGTALLALSFHFLWLIGDRDGDVGD

SEQ ID NO: 749261 - protein, 81 aa, Homo sapiens
QAAAPPGAQNPLSYLPPGRVLLTLTLGSAWMVHHFWRKGKDPDSFSIPYLTALGDLLGTALLALSFHFLWLIGDRDGDVGD

SEQ ID NO: 749262 - protein, 423 aa, Homo sapiens
MTNSKGRSITDKTSGGPSSGGGFVDWTLRLNTIQSDKFLNLLLSMVPVIYQKNQEDRHKKANGIWQDGLSTAVQTFSNRSEQHMEYHSFSEQSFHANNGHASSSCSQKYDDYANYNYCDGRETSETTAMLQDEDISSDGDEDAIVEVTPKLPKESSGIMALQILVPFLLAGFGTVSAGMVLDIVQHWEVFRKVTEVFILVPALLGLKGNLEMTLASRLSTAVNIGKMDSPIEKWNLIIGNLALKQVQATVVGFLAAVAAIILGWIPEGKYYLDHSILLCSSSVATAFIASLLQGIIMVGVIVGSKKTGINPDNVATPIAASFGDLITLAILAWISQGLYSCLETYYYISPLVGVFFLALTPIWIIIAAKHPATRTVLHSGWEPVITAMVISSIGGLILDTTVSDPNLVGIVVYTPVINDDMRK

SEQ ID NO: 749263 - protein, 573 aa, Homo sapiens; identical to SEQ ID NO: 749260

SEQ ID NO: 749264 - protein, 289 aa, Homo sapiens
MTNSKGRSITDKTSGGPSSGGGFVDWTLRLNTIQSDKFLNLLLSMVPVIYQKNQEDRHKKANGIWQDGLSTAVQTFSNRSEQHMEYHSFSEQSFHANNGHASSSCSQKYDDYANYNYCDGRETSETTAMLQDEDISSDGDEDAIVEVTPKLPKESSGIMALQILVPFLLAGFGTVSAGMVLDIVQVNIGKMDSPIEKWNLIIGNLALKQVQATVVGFLAAVAAIILGWIPEGKYYLDHSILLCSSSVATAFIASLLQELRWGYRGQETYNLIVLTMCIGTISAMVVAAY

SEQ ID NO: 749265 - protein, 298 aa, Homo sapiens
GRVGRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLGNCPCSPWH

SEQ ID NO: 749266 - protein, 1176 aa, Homo sapiens
AHGLVSALMRRLAARGAAGDAGEVAAPAADSSDSAQGRSPSPWRLIDLCAIWDAGVYLPSAAWNRASSGVARKRLNEAEKLSAVQEAQLKRLEVTRPRVLGSREQGQVPRMARQPPPPWVHAAFLLCLLSLGGAIEIPMDPSIQNELTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTTRGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLADQATPTNRLAALPKGRPDRPRDLELTDLAERSVRLTWIPGDANNSPITDYVVQFEEDQFQPGVWHDHSKYPGSVNSAVLRLSPYVNYQFRVIAINEVGSSHPSLPSERYRTSGAPPESNPGDVKGEGTRKNNMEITWTPMNATSAFGPNLRYIVKWRRRETREAWNNVTVWGSRYVVGQTPVYVPYEIRVQAENDFGKGPEPESVIGYSGEDLPSAPRRFRVRQPNLETINLEWDHPEHPNGIMIGYTLKYVAFNGTKVGKQIVENFSPNQTKFTVQRTDPVSRYRFTLSARTQVGSGEAVTEESPAPPNEAYTNNQADIATQGWFIGLMCAIALLVLILLIVCFIKRSRGGKYPVREKKDVPLGPEDPKEEDGSFDYSDEDNKPLQGSQTSLDGTIKQQESDDSLVDYGEGGEGQFNEDGSFIGQYTVKKDKEETEGNESSEATSPVNAIYSLA

SEQ ID NO: 749267 - protein, 1140 aa, Homo sapiens
RARAGLCPNAAAGGERRCRGRGGSGGAGSGQLGQRPGPEPEPLELSAVQEAQLKRLEVTRPRVLGSREQGQVPRMARQPPPPWVHAAFLLCLLSLGGAIEIPMDPSIQNELTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTTRGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLADQATPTNRLAALPKGRPDRPRDLELTDLAERSVRLTWIPGDANNSPITDYVVQFEEDQFQPGVWHDHSKYPGSVNSAVLRLSPYVNYQFRVIAINEVGSSHPSLPSERYRTSGAPPESNPGDVKGEGTRKNNMEITWTPMNATSAFGPNLRYIVKWRRRETREAWNNVTVWGSRYVVGQTPVYVPYEIRVQAENDFGKGPEPESVIGYSGEDLPSAPRRFRVRQPNLETINLEWDHPEHPNGIMIGYTLKYVAFNGTKVGKQIVENFSPNQTKFTVQRTDPVSRYRFTLSARTQVGSGEAVTEESPAPPNEAYTNNQADIATQGWFIGLMCAIALLVLILLIVCFIKRSRGGKYPVREKKDVPLGPEDPKEEDGSFDYSDEDNKPLQGSQTSLDGTIKQQESDDSLVDYGEGGEGQFNEDGSFIGQYTVKKDKEETEGNESSEATSPVNAIYSLA

SEQ ID NO: 749268 - protein, 1170 aa, Homo sapiens
AHGLVSALMRRLAARGAAGDAGEVAAPAADSSDSAQGRSPSPWRLIDLCAIWDAGVYLPSAAWNRASSGVARKRLNEAEKLSAVQEAQLKRLEVTRPRVLGSREQGQVPRMARQPPPPWVHAAFLLCLLSLGGAIEIPMDLTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTTRGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLADQATPTNRLAALPKGRPDRPRDLELTDLAERSVRLTWIPGDANNSPITDYVVQFEEDQFQPGVWHDHSKYPGSVNSAVLRLSPYVNYQFRVIAINEVGSSHPSLPSERYRTSGAPPESNPGDVKGEGTRKNNMEITWTPMNATSAFGPNLRYIVKWRRRETREAWNNVTVWGSRYVVGQTPVYVPYEIRVQAENDFGKGPEPESVIGYSGEDLPSAPRRFRVRQPNLETINLEWDHPEHPNGIMIGYTLKYVAFNGTKVGKQIVENFSPNQTKFTVQRTDPVSRYRFTLSARTQVGSGEAVTEESPAPPNEAYTNNQADIATQGWFIGLMCAIALLVLILLIVCFIKRSRGGKYPVREKKDVPLGPEDPKEEDGSFDYSDEDNKPLQGSQTSLDGTIKQQESDDSLVDYGEGGEGQFNEDGSFIGQYTVKKDKEETEGNESSEATSPVNAIYSLA

SEQ ID NO: 749269 - protein, 1138 aa, Homo sapiens
AHGLVSALMRRLAARGAAGDAGEVAAPAADSSDSAQGRSPSPWRLIDLCAIWDAGVYLPSAAWNRASSGVARKRLNEAEKLSAVQEAQLKRLEVTRPRVLGSREQGQVPRMARQPPPPWVHAAFLLCLLSLGGAIEIPMDPSIQNELTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTTRGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLGRPDRPRDLELTDLAERSVRLTWIPGDANNSPITDYVVQFEEDQFQPGVWHDHSKYPGSVNSAVLRLSPYVNYQFRVIAINEVGSSHPSLPSERYRTSGAPPESNPGDVKGEGTRKNNMEITWTPMNATSAFGPNLRYIVKWRRRETREAWNNVTVWGSRYVVGQTPVYVPYEIRVQAENDFGKGPEPESVIGYSGEDYPRAAPTEVKVRVMNSTAISLQWNRVYSDTVQGQLREYRAYYWRESSLLKNLWVSQKRQQASFPGDRLRGVVSRLFPYSNYKLEMVVVNGRGDGPRSETKEFTTPEGVPSAPRRFRVRQPNLETINLEWDHPEHPNGIMIGYTLKYVAFNGTKVGKQIVENFSPNQTKFTVQRTDPVSRYRFTLSARTQVGSGEAVTEESPAPPNEGRCMAAAPGVKGPS

SEQ ID NO: 749270 - protein, 745 aa, Homo sapiens
GRVGRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLADQATPTNRLAALPKGRPDRPRDLELTDLAERSVRLTWIPGDANNSPITDYVVQFEEDQFQPGVWHDHSKYPGSVNSAVLRLSPYVNYQFRVIAINEVGSSHPSLPSERYRTSGAPPESNPGDVKGEGTRKNNMEITWTPMNATSAFGPNLRYIVKWRRRETREAWNNVTVWGSRYVVGQTPVYVPYEIRVQAENDFGKGPEPESVIGYSGEDLPSAPRRFRVRQPNLETINLEWDHPEHPNGIMIGYTLKYVAFNGTKVGKQIVENFSPNQTKFTVQRTDPVSRYRFTLSARTQVGSGEAVTEESPAPPNEAYTNNQADIATQGWFIGLMCAIALLVLILLIVCFIKRSRGGKYPVREKKDVPLGPEDPKEEDGSFDYSDEDNKPLQGSQTSLDGTIKQQESDDSLVDYGEGGEGQFNEDGSFIGQYTVKKDKEETEGNESSEATSPVNAIYSLA

SEQ ID NO: 749271 - protein, 309 aa, Homo sapiens
FTDTALLQERSSLINARLAKKKDWSYYSNQSHDGAAQINYKLEMVVVNGRGDGPRSETKEFTTPEGVPSAPRRFRVRQPNLETINLEWDHPEHPNGIMIGYTLKYVAFNGTKVGKQIVENFSPNQTKFTVQRTDPVSRYRFTLSARTQVGSGEAVTEESPAPPNEAYTNNQADIATQGWFIGLMCAIALLVLILLIVCFIKRSRGGKYPVREKKDVPLGPEDPKEEDGSFDYSDEDNKPLQGSQTSLDGTIKQQESDDSLVDYGEGGEGQFNEDGSFIGQYTVKKDKEETEGNESSEATSPVNAIYSLA

SEQ ID NO: 749272 - protein, 986 aa, Homo sapiens
AHGLVSALMRRLAARGAAGDAGEVAAPAADSSDSAQGRSPSPWRLIDLCAIWDAGVYLPSAAWNRASSGVARKRLNEAEKLSAVQEAQLKRLEVTRPRVLGSREQGQVPRMARQPPPPWVHAAFLLCLLSLGGAIEIPMDPSIQNELTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTTRGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLADQATPTNRLAALPKGRPDRPRDLELTDLAERSVRLTWIPGDANNSPITDYVVQFEEDQFQPGVWHDHSKYPGSVNSAVLRLSPYVNYQFRVIAINEVGSSHPSLPSERYRTSGAPPESNPGDVKGEGTRKNNMEITWTPMNATSAFGPNLRYIVKWRRRETREAWNNVTVWGSRYVVGQTPVYVPYEIRVQAENDFGKGPEPESVIGYSGEDYPRAAPTEVKVRVMNSTAISLQWNRVYSDTVQGQLREYRVRKPAPDSPNYPAH

SEQ ID NO: 749273 - protein, 329 aa, Homo sapiens
AHGLVSALMRRLAARGAAGDAGEVAAPAADSSDSAQGRSPSPWRLIDLCAIWDAGVYLPSAAWNRASSGVARKRLNEAEKLSAVQEAQLKRLEVTRPRVLGSREQGQVPRMARQPPPPWVHAAFLLCLLSLGGAIEIPMDLTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFQHLVLNSW

SEQ ID NO: 749274 - protein, 109 aa, Homo sapiens
RARAGLCPNAAAGGERRCRGRGGSGGAGSGQLGQRPGPEPEPLELSAVQEAQLKRLEVTRPRVLGSREQGQVPRMARQPPPPWVHAAFLLCLLSLGGAIEIPMDRPLWS

SEQ ID NO: 749275 - protein, 111 aa, Homo sapiens
VLPGNMKYDRGNMKYNSLAQCFLALCQLTTSLENNSHASSPGCRGRVSPMAGALHILIRVSPQNLHCVEGRKGEGDRGGRAAQEKPTVLGNWKWKSREKEWFREYPWFHCG

SEQ ID NO: 749276 - protein, 114 aa, Homo sapiens
HWVVWGWFPLTIPPPNKAAPNLLDGCLSSEVLREILMPSPHICSVGKSLVSQEGSGGFLDANETPATAGPQILDIITRKNSQMVHKVSPDAGLVILDFPASRTIMAAPSAWFLE

SEQ ID NO: 749277 - protein, 121 aa, Homo sapiens
HWVVWGWFPLTIPPPNKAAPNLLDGCLSSEVLREILMPSPHICSVGKSLVSQEGSGGFLDANETPATAGPQILDIITRKNSQVSQNEVKCKKLLLESKSLHLREKWVHARENESRKQSLGF

SEQ ID NO: 749278 - protein, 108 aa, Homo sapiens
AGQACCPQTPWAHFTCDSSLNLLRSSHSPVTSYRLLASCQAYNKLEICHWFLTLSKKLNKLKSQQLVKIPQRWLGTPSLSGLLTPSSLMTPSSTCYGAHILRSLSREF

SEQ ID NO: 749279 - protein, 834 aa, Homo sapiens
MEDPAAPGTGGPPANGNGNGGGKGKQAAPKGREAFRSQRRESEGSVDCPTLEFEYGDADGHAAELSELYSYTENLEFTNNRRCFEEDFKTQVQGKEWLELEEDAQKAYIMGLLDRLEVVSRERRLKVARAVLYLAQGTFGECDSEVDVLHWSRYNCFLLYQMGTFSTFLELLHMEIDNSQACSSALRKPAVSIADSTELRVLLSVMYLMVENIRLERETDPCGWRTARETFRTELSFSMHNEEPFALLLFSMVTKFCSGLAPHFPIKKVLLLLWKVVMFTLGGFEHLQTLKVQKRAELGLPPLAEDSIQVVKSMRAASPPSYTLDLGESQLAPPPSKLRGRRGSRRQLLTKQDSLDIYNERDLFKTEEPATEEEEESAGDGERTLDGELDLLEQDPLVPPPPSQAPLSAERVAFPKGLPWAPKVRQKDIEHFLEMSRNKFIGFTLGQDTDTLVGLPRPIHESVKTLKQHKYISIADVQIKNEEELEKCPMSLGEEVVPETPCEILYQGMLYSLPQYMIALLKILLAAAPTSKAKTDSINILADVLPEEMPITVLQSMKLGIDVNRHKEIIVKSISTLLLLLLKHFKLNHIYQFEYVSQHLVFANCIPLILKFFNQNILSYITAKNSISVLDYPCCTIQDLPELTTESLEAGDNSQFCWRNLFSCINLLRLLNKLTKWKHSRTMMLVVFKSAPILKRALKVKQAMLQLYVLKLLKLQTKYLGRQWRKSNMKTMSAIYQKVRHRMNDDWAYGNDIDARPWDFQAEECTLRANIEAFNSRRYDRPQDSEFSPVDNCLQSVLGQRLDLPEDFHYSYELWLEREVFSQPICWEELLQNH

SEQ ID NO: 749280 - protein, 532 aa, Homo sapiens
MFSQGLCSDSMFPEMWRPVDMGWPQTRMPRVRSLHAYPPFFPLQQLLTKQDSLDIYNERDLFKTEEPATEEEEESAGDGERTLDGELDLLEQDPLVPPPPSQAPLSAERVAFPKGLPWAPKVRQKDIEHFLEMSRNKFIGFTLGQDTDTLVGLPRPIHESVKTLKQHKYISIADVQIKNEEELEKCPMSLGEEVVPETPCEILYQGMLYSLPQYMIALLKILLAAAPTSKAKTDSINILADVLPEEMPITVLQSMKLGIDVNRHKEIIVKSISTLLLLLLKHFKLNHIYQFEYVSQHLVFANCIPLILKFFNQNILSYITAKNSISVLDYPCCTIQDLPELTTESLEAGDNSQFCWRNLFSCINLLRLLNKLTKWKHSRTMMLVVFKSAPILKRALKVKQAMLQLYVLKLLKLQTKYLGRQWRKSNMKTMSAIYQKVRHRMNDDWAYGNDIDARPWDFQAEECTLRANIEAFNSRRYDRPQDSEFSPVDNCLQSVLGQRLDLPEDFHYSYELWLEREVFSQPICWEELLQNH

SEQ ID NO: 749281 - protein, 834 aa, Homo sapiens; identical to SEQ ID NO: 749279

SEQ ID NO: 749282 - protein, 758 aa, Homo sapiens
MEDPAAPGTGGPPANGNGNGGGKGKQAAPKGREAFRSQRRESEGSVDCPTLEFEYGDADGHAAELSELYSYTENLEFTNNRRCFEEDFKTQVQGKEWLELEEDAQKAYIMGLLDRLEVVSRERRLKVARAVLYLAQGTFGECDSEVDVLHWSRYNCFLLYQMGTFSTFLELLHMEIDNSQACSSALRKPAVSIADSTELRVLLSVMYLMVENIRLERETDPCGWRTARETFRTELSFSMHNEEPFALLLFSMVTKFCSGLAPHFPIKKVLLLLWKVVMFTLGGFEHLQTLKVQKRAELGLPPLAEDSIQVVKSMRAASPPSYTLDLGESQLAPPPSKLRGRRGSRRQLLTKQDSLDIYNERDLFKTEEPATEEEEESAGDGERTLDGELDLLEQDPLVPPPPSQAPLSAERVAFPKGLPWAPKVRQKDIEHFLEMSRNKFIGFTLGQDTDTLVGLPRPIHESVKTLKQHKYISIADVQIKNEEELEKCPMSLGEEVVPETPCEILYQGMLYSLPQYMIALLKILLAAAPTSKAKTDSINILADVLPEEMPITVLQSMKLGIDVNRHKEIIVKSISTLLLLLLKHFKLNHIYQFEYVSQHLVFANCIPLILKFFNQNILSYITAKNSISVLDYPCCTIQDLPELTTESLEAGDNSQFCWRNLFSCINLLRLLNKLTKWKHSRTMMLVVFKSAPILKRALKVKQAMLQLYVLKLLKLQTKYLGRQWRKSNMKTMSAIYQKVRHRMNDDWAYGNGESSQSS

SEQ ID NO: 749283 - protein, 538 aa, Homo sapiens
MEDPAAPGTGGPPANGNGNGGGKGKQAAPKGREAFRSQRRESEGSVDCPTLEFEYGDADGHAAELSELYSYTENLEFTNNRRCFEEDFKTQVQGKEWLELEEDAQKAYIMGLLDRLEVVSRERRLKVARAVLYLAQGTFGECDSEVDVLHWSRYNCFLLYQMGTFSTFLELLHMEIDNSQACSSALRKPAVSIADSTELRVLLSVMYLMVENIRLERETDPCGWRTARETFRTELSFSMHNEEPFALLLFSMVTKFCSGLAPHFPIKKVLLLLWKVVMFTLGGFEHLQTLKVQKRAELGLPPLAEDSIQVVKSMRAASPPSYTLDLGESQLAPPPSKLRGRRGSRRQLLTKQDSLDIYNERDLFKTEEPATEEEEESAGDGERTLDGELDLLEQDPLVPPPPSQAPLSAERVAFPKGLPWAPKVRQKDIEHFLEMSRNKFIGFTLGQDTDTLVGLPRPIHESVKTLKQHKYISIADVQIKNEEELEKCPMSLVSQGSPTQEESRRKPVFSVVTEHVCMHSFSILGCNCVPGKTRSLLS

SEQ ID NO: 749284 - protein, 325 aa, Homo sapiens
MVCGSPGGMLLLRAGLLALAALCLLRVPGARAAACEPVRIPLCKSLPWNMTKMPNHLHHSTQANAILAIEQFEGLLGTHCSPDLLFFLCAMYAPICTIDFQHEPIKPCKSVCERARQGCEPILIKYRHSWPENLACEELPVYDRGVCISPEAIVTADGADFPMDSSNGNCRGASSERCKCKPIRATQKTYFRNNYNYVIRAKVKEIKTKCHDVTAVVEVKEILKSSLVNIPRDTVNLYTSSGCLCPPLNVNEEYIIMGYEDEERSRLLLVEGSIAEKWKDRLGKKVKRWDMKLRHLGLSKSDSSNSDSTQSQKSGRNSNPRQARN

SEQ ID NO: 749285 - protein, 150 aa, Homo sapiens
RGSRYILCTADGADFPMDSSNGNCRGASSERCKCKPIRATQKTYFRNNYNYVIRAKVKEIKTKCHDVTAVVEVKEILKSSLVNIPRDTVNLYTSSGCLCPPLNVNEEYIIMGYEDEERSRLLLVEGSIAEKWKDRLGKKVKPWMLRFRHF

SEQ ID NO: 749286 - protein, 325 aa, Homo sapiens; identical to SEQ ID NO: 749284

SEQ ID NO: 749287 - protein, 325 aa, Homo sapiens; identical to SEQ ID NO: 749284

SEQ ID NO: 749288 - protein, 325 aa, Homo sapiens; identical to SEQ ID NO: 749284

SEQ ID NO: 749289 - protein, 325 aa, Homo sapiens; identical to SEQ ID NO: 749284

SEQ ID NO: 749290 - protein, 325 aa, Homo sapiens; identical to SEQ ID NO: 749284

SEQ ID NO: 749291 - protein, 296 aa, Homo sapiens
MVCGSPGGMLLLRAGLLALAALCLLRVPGARAAACEPVRIPLCKSLPWNMTKMPNHLHHSTQANAILAIEQFEGLLGTHCSPDLLFFLCAMYAPICTIDFQHEPIKPCKSVCERARQGCEPILIKYRHSWPENLACEELPVYDRGVCISPEAIVTADGADFPMDSSNGNCRGASSERCKCKPIRATQKTYFRNNYNYVIRAKVKEIKTKCHDVTAVVEVKEILKSSLVNIPRDTVNLYTSSGCLCPPLNVNEEYIIMGYEDEERSRLLLVEGSIAEKWKDRLGKKVKPWMLRFRHF

SEQ ID NO: 749292 - protein, 400 aa, Homo sapiens
MGTPASGRKRTPVKDRFSAEDEALSNIAREAEARLAAKRAARAEARDIRMRELERQQKELDEKSDKQYAENYTRPSSRNSASATTPLSGNSSRRGSGDTSSLIDPDTSLSELRESLSEVEEKYKKAMVSNAQLDNEKNNLIYQVDTLKDVIEEQEEQMAEFYRENEEKSKELERQKHMCSVLQHKMEELKEGLRQRDELIEKHGLVIIPDGTPNGDVSHEPVAGAITVVSQEAAQVLESAGEGPLDVRLRKLAGEKEELLSQIRKLKLQLEEERQKCSRNDGTVGDLAGLQNGSDLQFIEMQRDANRQISEYKFKLSKAEQDITTLEQSISRLEGQVLRYKTAAENAEKVEDELKAEKRKLQRELRTALDKIEEMEMTNSHLAKRLEKMKANRTALLAQQ

SEQ ID NO: 749293 - protein, 721 aa, Homo sapiens
MGTPASGRKRTPVKDRFSAEDEALSNIAREAEARLAAKRAARAEARDIRMRELERQQKEYSLHSFDRKWGQIQKWLEDSERARYSHRSSHHRPYLGVEDALSIRSVGSHRYDMFKDRSSRLSSLNHSYSHSHGMKKRSSDSHKDLLSGLYFDQRNYSSLRHSKPTSAYYTRQSSSLYSDPLATYKSDRASPTANSGLLRSASLASLYNGGLYNPYGPRTPSECSYYSSRISSARSSPGFTNDDTASIVSSDRASRGRRESVVSAADYFSRSNRRGSVVSEVDDISIPDLSSLDEKSDKQYAENYTRPSSRNSASATTPLSGNSSRRGSGDTSSLIDPDTSLSELRDIYDLKDQIQDVEGRYMQGLKELKESLSEVEEKYKKAMVSNAQLDNEKNNLIYQVDTLKDVIEEQEEQMAEFYRENEEKSKELERQKHMCSVLQHKMEELKEGLRQRDELIEEKQRMQQKIDTMTKEVFDLQETLLWKDKKIGALEKQKEYIACLRNERDMLREELADLQETVKTGEKHGLVIIPDGTPNGDVSHEPVAGAITVVSQEAAQVLESAGEGPLDVRLRKLAGEKEELLSQIRKLKLQLEEERQKCSRNDGTVGDLAGLQNGSDLQFIEMQRDANRQISEYKFKLSKAEQDITTLEQSISRLEGQVLRYKTAAENAEKVEDELKAEKRKLQRELRTALDKIEEMEMTNSHLAKRLEKMKANRTALLAQQ

SEQ ID NO: 749294 - protein, 721 aa, Homo sapiens; identical to SEQ ID NO: 749293

SEQ ID NO: 749295 - protein, 721 aa, Homo sapiens; identical to SEQ ID NO: 749293

SEQ ID NO: 749296 - protein, 295 aa, Homo sapiens [sequence omitted]

SEQ ID NO: 749297 - protein, 424 aa, Homo sapiens
MGTPASGRKRTPVKDRFSAEDEALSNIAREAEARLAAKRAARAEARDIRMRELERQQKELDEKSDKQYAENYTRPSSRNSASATTPLSGNSSRRGSGDTSSLIDPDTSLSELRDIYDLKDQIQDVEGRYMQGLKELKESLSEVEEKYKKAMVSNAQLDNEKNNLIYQVDTLKDVIEEQEEQMAEFYRENEEKSKELERQKHMCSVLQHKMEELKEGLRQRDELIEKHGLVIIPDGTPNGDVSHEPVAGAITVVSQEAAQVLESAGEGPLDVRLRKLAGEKEELLSQIRKLKLQLEEERQKCSRNDGTVGDLAGLQNGSDLQFIEMQRDANRQISEYKFKLSKAEQDITTLEQSISRLEGQVLRYKTAAENAEKVEDELKAEKRKLQRELRTALDKIEEMEMTNSHLAKRLEKMKANRTALLAQQ

SEQ ID NO: 749298 - protein, 295 aa, Homo sapiens [sequence omitted]

SEQ ID NO: 749299 - protein, 295 aa, Homo sapiens [sequence omitted]

SEQ ID NO: 749300 - protein, 295 aa, Homo sapiens [sequence omitted]

SEQ ID NO: 749301 - protein, 216 aa, Homo sapiens [sequence omitted]

SEQ ID NO: 749302 - protein, 216 aa, Homo sapiens
MTRYLREDWLQEQEAGEKHGLVIIPDGTPNGDVSHEPVAGAITVVSQEAAQVLESAGEGPLDVRLRKLAGEKEELLSQIRKLKLQLEEERQKCSRNDGTVGDLAGLQNGSDLQFIEMQRDANRQISEYKFKLSKAEQDITTLEQSISRLEGQVLRYKTAAENAEKVEDELKAEKRKLQRELRTALDKIEEMEMTNSHLAKRLEKMKANRTALLAQQ

SEQ ID NO: 749303 - protein, 174 aa, Homo sapiens
RISGIVVLLRSVSSRRRALDVRLRKLAGEKEELLSQIRKLKLQLEEERQKCSRNDGTVGDLAGLQNGSDLQFIEMQRDANRQISEYKFKLSKAEQDITTLEQSISRLEGQVLRYKTAAENAEKVEDELKAEKRKLQRELRTALDKIEEMEMTNSHLAKRLEKMKANRTALLAQQ

SEQ ID NO: 749304 - protein, 316 aa, Homo sapiens
MQGLKELKESLSEVEEKYKKAMVSNAQLDNEKNNLIYQVDTLKDVIEEQEEQMAEFYRENEEKSKELERQKHMCSVLQHKMEELKEGLRQRDELIEKHGLVIIPDGTPNGDVSHEPVAGAITVVSQEAAQVLESAGEGPLDVRLRKLAGEKEELLSQIRKLKLQLEEERQKCSRNDGTVGDLAGLQNGSDLQFIEMQRDANRQISEYKFKLSKAEQDITTLEQSISRLEGQVLRYKTAAENAEKVEDELKAEKRKLQRELRTALDKIEEMEMTNSHLAKRLEKMKANRTALLAQHCLSNWALGGLGTGSGGQTAIL

SEQ ID NO: 749305 - protein, 106 aa, Homo sapiens
MSVERRATITKGLTLMPTLESSGMNTDHCSLDFLGSGDSPTSASQVAETTCIHHHTGPIFVFFVETGCPHVAHAGLYLLGSHRSPTLASQSAGITGMSHRSWLSLM

SEQ ID NO: 749306 - protein, 94 aa, Homo sapiens
MVGITILTQVFLTPKSEQHASPSGQVFKQACACHPVRASDSSATLVGASRKEMPSAPLESLGLKAKPWKTDQSLEGIRPAVASSEALHHASPER

SEQ ID NO: 749307 - protein, 58 aa, Homo sapiens
MSKPSEALFQSDLYKNAILITLFLYVRKKKSINGCLHCQSPNSFLSNGLIYPHYIIAY

SEQ ID NO: 749308 - protein, 550 aa, Homo sapiens
ENHRARGQGGGPQGVGRMAEGKAGGAAGLFAKQVQKKFSRAQEKVLQKLGKAVETKDERFEQSASNFYQQQAEGHKLYKDLKNFLSAVKVMHESSKRVSETLQEIYSSEWDGHEELKAIVWERIAKRGRKLVDYDSARHHLEAVQNAKKKDEAKTAKAEEEFNKAQTVFEDLNQELLEELPILYNSRIGCYVTIFQNISNLRDVFYREMSKLNHNLYEVMSKLEKQHSNKVFVVKGLSSSSRRSLVISPPVRTATVSSPLTSPTSPSTLSLKSESESVSATEDLAPDAAQGEDNSEIKELLEEEEIEKEGSEASSSEEDEPLPACNGPAQAQPSPTTERAKSQEEVLPSSTTPSPGGALSPSGQPSSSATEVVLRTRTASEGSEQPKKRASIQRTSAPPSRPPPPRATASPRPSSGNIPSSPTASGGGSPTSPRASLGTGTASPRTSLEVSPNPEPPEKPVRTPEAKENENIHNQNPEELCTSPTLMTSQVASEPGEAKKMEDKEKDNKLISADSSEGQDQLQVSMVPENNNLTAPEPQEEVSTSENPQL

SEQ ID NO: 749309 - protein, 85 aa, Homo sapiens
ENHRARGQGGGPQGVGRMAEGKAGGAAGLFAKQVQKKFSRAQEKNIFFASNLSLCSPPTNPLVDKAVWEDMSARRKSEGRKTRRT

SEQ ID NO: 749310 - protein, 125 aa, Homo sapiens
ENHRARGQGGGPQGVGRMAEGKAGGAAGLFAKQVQKKFSRAQEKVLQKLGKAVETKDERFEQSASNFYQQQAEGHKLYKDLKNFLSAVKVMHESSKRVSETLQEIYSSEWDGHEELKAIVWVRVA

SEQ ID NO: 749311 - protein, 136 aa, Homo sapiens
PASDSILQNNDLLWEDYEEKLADQAVRTMEIYVAQFSEIKERIAKRGRKLVDYDSARHHLEAVQNAKKKDEAKTAKLPPLSSGSGPQSHHLLSLPPRCLGPVVAGPPTSRRGRLYSPNPWSNALSGLQNQNKTGSL

SEQ ID NO: 749312 - protein, 492 aa, Homo sapiens
MHESSKRVSETLQEIYSSEWDGHEELKAIVWNNDLLWEDYEEKLADQAVRTMEIYVAQFSEIKERIAKRGRKLVDYDSARHHLEAVQNAKKKDEAKTAKAEEEFNKAQTVFEDLNQELLEELPILYNSRIGCYVTIFQNISNLRDVFYREMSKLNHNLYEVMSKLEKQHSNKVFVVKGLSSSSRRSLVISPPVRTATVSSPLTSPTSPSTLSLKSESESVSATEDLAPDAAQGEDNSEIKELLEEEEIEKEGSEASSSEEDEPLPACNGPAQAQPSPTTERAKSQEEVLPSSTTPSPGGALSPSGQPSSSATEVVLRTRTASEGSEQPKKRASIQRTSAPPSRPPPPRATASPRPSSGNIPSSPTASGGGSPTSPRASLGTGTASPRTSLEVSPNPEPPEKPVRTPEAKENENIHNQNPEELCTSPTLMTSQVASEPGEAKKMEDKEKDNKLISADSSEGQDQLQVSMVPENNNLTAPEPQEEVSTSENPQL

SEQ ID NO: 749313 - protein, 155 aa, Homo sapiens
CTATLILLASSDPPASASQGAGTTGVHPCTWSRLGFLHLGFPSQNLKFFPKKLFYHLLLLTACHELGSLKCESCSTFLRTVHLKVAGSNFKTSHSLIDTHPHHVTQITWCLIMETTQEFKDLVSCPSKSFYPLNLSLFICKRGWMKAFPDAFRLW

SEQ ID NO: 749314 - protein, 582 aa, Homo sapiens
ENHRARGQGGGPQGVGRMAEGKAGGAAGLFAKQVQKKFSRAQEKVLQKLGKAVETKDERFEQSASNFYQQQAEGHKLYKDLKNFLSAVKVMHESSKRVSETLQEIYSSEWDGHEELKAIVWNNDLLWEDYEEKLADQAVRTMEIYVAQFSEIKERIAKRGRKLVDYDSARHHLEAVQNAKKKDEAKTAKAEEEFNKAQTVFEDLNQELLEELPILYNSRIGCYVTIFQNISNLRDVFYREMSKLNHNLYEVMSKLEKQHSNKVFVVKGLSSSSRRSLVISPPVRTATVSSPLTSPTSPSTLSLKSESESVSATEDLAPDAAQGEDNSEIKELLEEEEIEKEGSEASSSEEDEPLPACNGPAQAQPSPTTERAKSQEEVLPSSTTPSPGGALSPSGQPSSSATEVVLRTRTASEGSEQPKKRASIQRTSAPPSRPPPPRATASPRPSSGNIPSSPTASGGGSPTSPRASLGTGTASPRTSLEVSPNPEPPEKPVRTPEAKENENIHNQNPEELCTSPTLMTSQVASEPGEAKKMEDKEKDNKLISADSSEGQDQLQVSMVPENNNLTAPEPQEEVSTSENPQL

SEQ ID NO: 749315 - protein, 128 aa, Homo sapiens
MPYSYVFVVLLPNSRIGCYVTIFQNISNLRDVFYREMSKLNHNLYEVMSKLEKQHSNKVFVVKGLSSSSRRSLVISPPVRTATVSSPLTSPTSPSTLSLKSESESVSATEDLAPDAAQGEDRRWWSYC

SEQ ID NO: 749316 - protein, 82 aa, Homo sapiens
TVHSPEVRFQNVRCLALNSQPTLQNEFTHRKETKMGRGPKHHKEQLRKPVRKAWSRAHASCLQACVEEKLDLLYEYRRPTQD

SEQ ID NO: 749317 - protein, 218 aa, Homo sapiens
ENHRARGQGGGPQGVGRMAEGKAGGAAGLFAKQVQKKFSRAQEKVLQKLGKAVETKDERFEQSASNFYQQQAEGHKLYKDLKNFLSAVKVMHESSKRVSETLQEIYSSEWDGHEELKAIVWNNDLLWEDYEEKLADQAVRTMEIYVAQFSEIKERIAKRGRKLVDYDSARHHLEAVQNAKKKDEAKTAKAEEEFNKAQTVFEDLNQELLEELPILYNS

SEQ ID NO: 749318 - protein, 31 aa, Homo sapiens
MCGKCKPEPSKSPGPSLGHAASHQDLKILRL

SEQ ID NO: 749319 - protein, 127 aa, Homo sapiens
SDYGLFLSDEDPRKGIWLEAGRTLDYYMLRNGDILEYKKKQRPQKIRMLDGSVKTVMVDDSKTVGELLVTICSRIGITNYEEYSLIQETIEEKKEEGTGTLKKDRTLLRDERKMEKLKAKLHTDDDR

SEQ ID NO: 749320 - protein, 109 aa, Homo sapiens [sequence omitted]

SEQ ID NO: 749321 - protein, 161 aa, Homo sapiens
DPFDGVLGDETEEEETKPIELPVKEEEPPEKTVDVAAEKKVVKITSEIPQTERMQKRAERFNVPVSLESKKAARAARFGISSVPTKGLSSDNKPMVNLDKLKERAQRFGLNVSSISRKSEDDEKLKKRKERFGIVTSSAGTGTTEDTEAKKRKRAERFGIA

SEQ ID NO: 749322 - protein, 239 aa, Homo sapiens
KAAVPSESRMREPAAAAAAMRQKHYLEAAARGLHDSCPGQARYLLWAYTSSHDDKSTFEETCPYCFQLLVLDNSRVRLKPKARLTPKIQKLLNREARNYTLSFKEAKMVKKFKDSKSVLLITCKTCNRTVKHHGKSRSFVSTLKSNPATPTSKLSLKTPERRTANPNHDMSGSKGKSPASVFRTPTSGQSVSTCSSKNTSKTKKHFSQLKMLLSQNESQKIPKVDFRNFLSSLKGGLLK

SEQ ID NO: 749323 - protein, 254 aa, Homo sapiens
LESGHQRRGRWEADFRRPIFSPGSRGEPAAAAAAMRQKHYLEAAARGLHDSCPGQARYLLWAYTSSHDDKSTFEETCPYCFQLLVLDNSRVRLKPKARLTPKIQKLLNREARNYTLSFKEAKMVKKFKDSKSVLLITCKTCNRTVKHHGKSRSFVSTLKSNPATPTSKLSLKTPERRTANPNHDMSGSKGKSPASVFRTPTSGQSVSTCSSKNTSKTKKHFSQLKMLLSQNESQKIPKVDFRNFLSSLKGGLLK

SEQ ID NO: 749324 - protein, 207 aa, Homo sapiens
KIQKNYLAWWCTPVIPATREDDKSTFEETCPYCFQLLVLDNSRVRLKPKARLTPKIQKLLNREARNYTLSFKEAKMVKKFKDSKSVLLITCKTCNRTVKHHGKSRSFVSTLKSNPATPTSKLSLKTPERRTANPNHDMSGSKGKSPASVFRTPTSGQSVSTCSSKNTSKTKKHFSQLKMLLSQNESQKIPKVDFRNFLSSLKGGLLK

SEQ ID NO: 749325 - protein, 132 aa, Homo sapiens
MVKKFKDSKSVLLITCKTCNRTVKHHGKSRSFVSTLKSNPATPTSKLSLKTPERRTANPNHDMSGSKGKSPASVFRTPTSGQSVSTCSSKNTSKTKKHFSQLKMLLSQNESQKIPKVDFRNFLSSLKGGLLK

SEQ ID NO: 749326 - protein, 69 aa, Homo sapiens
HETMSQYPVVSCCDEREPGQIARSLVEFRVPPARPSTEPRVPPMGLHSEPVGTDAPHSATNPPHPSLNW

SEQ ID NO: 749327 - protein, 117 aa, Homo sapiens
DLRLHDVHHGLVWEDPGVTGQNIGIFHDGEGCGGVFPNLQQCSSFGKVLLGELKGRGEYFAIKALKKDVVLIDDDVECTMVEKRVLTLAAENPFLTHLICTFQTKTTCLCDESSRGD

SEQ ID NO: 749328 - protein, 745 aa, Homo sapiens
MTRGSTHVVDPRRPPAARRPGPHLTGRLAHPSQRRAEPRPRAPGSGAPAAAAATLGACPCNGSPTAGPTMAPFLRIAFNSYELGSLQAEDEANQPFCAVKMKEALSTERGKTLVQKKPTMYPEWKSTFDAHIYEGRVIQIVLMRAAEEPVSEVTVGVSVLAERCKKNNGKAEFWLDLQPQAKVLMSVQYFLEDVDCKQSMRSEDEAKFPTMNRRGAIKQAKIHYIKNHEFIATFFGQPTFCSVCKDFVWGLNKQGYKCRQCNAAIHKKCIDKIIGRCTGTAANSRDTIFQKERFNIDMPHRFKVHNYMSPTFCDHCGSLLWGLVKQGLKCEDCGMNVHHKCREKVANLCGINQKLLAEALNQVTQRASRRSDSASSEPVGIYQGFEKKTGVAGEDMQDNSGTYGKIWEGSSKCNINNFIFHKVLGKGSFGKVLLGELKGRGEYFAIKALKKDVVLIDDDVECTMVEKRVLTLAAENPFLTHLICTFQTKDHLFFVMEFLNGGDLMYHIQDKGRFELYRATFYAAEIMCGLQFLHSKGIIYRDLKLDNVLLDRDGHIKIADFGMCKENIFGESRASTFCGTPDYIAPEILQGLKYTFSVDWWSFGVLLYEMLIGQSPFHGDDEDELFESIRVDTPHYPRWITKESKDILEKLFEREPTKRLGVTGNIKIHPFFKTINWTLLEKRRLEPPFRPKVKSPRDYSNFDQEFLNEKARLSYSDKNLIDSMDQSAFAGFSFVNPKFEHLLED

SEQ ID NO: 749329 - protein, 752 aa, Homo sapiens
CRGAGARGGCSPHLPSDPRRPPAARRPGPHLTGRLAHPSQRRAEPRPRAPGSGAPAAAAATLGACPCNGSPTAGPTMAPFLRIAFNSYELGSLQAEDEANQPFCAVKMKEALSTERGKTLVQKKPTMYPEWKSTFDAHIYEGRVIQIVLMRAAEEPVSEVTVGVSVLAERCKKNNGKAEFWLDLQPQAKVLMSVQYFLEDVDCKQSMRSEDEAKFPTMNRRGAIKQAKIHYIKNHEFIATFFGQPTFCSVCKDFVWGLNKQGYKCRQCNAAIHKKCIDKIIGRCTGTAANSRDTIFQKERFNIDMPHRFKVHNYMSPTFCDHCGSLLWGLVKQGLKCEDCGMNVHHKCREKVANLCGINQKLLAEALNQVTQRASRRSDSASSEPVGIYQGFEKKTGVAGEDMQDNSGTYGKIWEGSSKCNINNFIFHKVLGKGSFGKVLLGELKGRGEYFAIKALKKDVVLIDDDVECTMVEKRVLTLAAENPFLTHLICTFQTKDHLFFVMEFLNGGDLMYHIQDKGRFELYRATFYAAEIMCGLQFLHSKGIIYRDLKLDNVLLDRDGHIKIADFGMCKENIFGESRASTFCGTPDYIAPEILQGLKYTFSVDWWSFGVLLYEMLIGQSPFHGDDEDELFESIRVDTPHYPRWITKESKDILEKLFEREPTKRLGVTGNIKIHPFFKTINWTLLEKRRLEPPFRPKVKSPRDYSNFDQEFLNEKARLSYSDKNLIDSMDQSAFAGFSFVNPKFEHLLED

SEQ ID NO: 749330 - protein, 779 aa, Homo sapiens
AAAPEPEAAVAHISRATPGARPPRGGPGHTSLAAWPIPVSAAPNPVRARRGAAPPPLPPRPLAPAPATGGWSAVARSRLTATSTSRVQVILLPQPPSPTAGPTMAPFLRIAFNSYELGSLQAEDEANQPFCAVKMKEALSTERGKTLVQKKPTMYPEWKSTFDAHIYEGRVIQIVLMRAAEEPVSEVTVGVSVLAERCKKNNGKAEFWLDLQPQAKVLMSVQYFLEDVDCKQSMRSEDEAKFPTMNRRGAIKQAKIHYIKNHEFIATFFGQPTFCSVCKDFVWGLNKQGYKCRQCNAAIHKKCIDKIIGRCTGTAANSRDTIFQKERFNIDMPHRFKVHNYMSPTFCDHCGSLLWGLVKQGLKCEDCGMNVHHKCREKVANLCGINQKLLAEALNQVTQRASRRSDSASSEPVGIYQGFEKKTGVAGEDMQDNSGTYGKIWEGSSKCNINNFIFHKVLGKGSFGKVLLGELKGRGEYFAIKALKKDVVLIDDDVECTMVEKRVLTLAAENPFLTHLICTFQTKDHLFFVMEFLNGGDLMYHIQDKGRFELYRATFYAAEIMCGLQFLHSKGIIYRDLKLDNVLLDRDGHIKIADFGMCKENIFGESRASTFCGTPDYIAPEILQGLKYTFSVDWWSFGVLLYEMLIGQSPFHGDDEDELFESIRVDTPHYPRWITKESKDILEKLFEREPTKRLGVTGNIKIHPFFKTINWTLLEKRRLEPPFRPKVKSPRDYSNFDQEFLNEKARLSYSDKNLIDSMDQSAFAGFSFVNPKFEHLLED

SEQ ID NO: 749331 - protein, 593 aa, Homo sapiens
QPARKIADVSPASQGAPHRPAPRVGSIRPIVRCPRWAGWDRVDCKQSMRSEDEAKFPTMNRRGAIKQAKIHYIKNHEFIATFFGQPTFCSVCKDFVWGLNKQGYKCRQCNAAIHKKCIDKIIGRCTGTAANSRDTIFQKERFNIDMPHRFKVHNYMSPTFCDHCGSLLWGLVKQGLKCEDCGMNVHHKCREKVANLCGINQKLLAEALNQVTQRASRRSDSASSEPVGIYQGFEKKTGVAGEDMQDNSGTYGKIWEGSSKCNINNFIFHKVLGKGSFGKVLLGELKGRGEYFAIKALKKDVVLIDDDVECTMVEKRVLTLAAENPFLTHLICTFQTKDHLFFVMEFLNGGDLMYHIQDKGRFELYRATFYAAEIMCGLQFLHSKGIIYRDLKLDNVLLDRDGHIKIADFGMCKENIFGESRASTFCGTPDYIAPEILQGLKYTFSVDWWSFGVLLYEMLIGQSPFHGDDEDELFESIRVDTPHYPRWITKESKDILEKLFEREPTKRLGVTGNIKIHPFFKTINWTLLEKRRLEPPFRPKVKSPRDYSNFDQEFLNEKARLSYSDKNLIDSMDQSAFAGFSFVNPKFEHLLED

SEQ ID NO: 749332 - protein, 448 aa, Homo sapiens [sequence omitted]

SEQ ID NO: 749333 - protein, 361 aa, Homo sapiens
DLRLHDVHHGLVWEDPGVTGQNIGIFHDGEGCGGVFPNLQQCSSFGKVLLGELKGRGEYFAIKALKKDVVLIDDDVECTMVEKRVLTLAAENPFLTHLICTFQTKDHLFFVMEFLNGGDLMYHIQDKGRFELYRATFYAAEIMCGLQFLHSKGIIYRDLKLDNVLLDRDGHIKIADFGMCKENIFGESRASTFCGTPDYIAPEILQGLKYTFSVDWWSFGVLLYEMLIGQSPFHGDDEDELFESIRVDTPHYPRWITKESKDILEKLFEREPTKRLGVTGNIKIHPFFKTINWTLLEKRRLEPPFRPKVKSPRDYSNFDQEFLNEKARLSYSDKNLIDSMDQSAFAGFSFVNPKFEHLLED

SEQ ID NO: 749334 - protein, 761 aa, Homo sapiens
CRGAGARGGCSPHLPSDPRRPPAARRPGPHLTGRLAHPSQRRAEPRPRAPGSGAPAAAAATLGACPCNGSPTAGPTMAPFLRIAFNSYELGSLQAEDEANQPFCAVKMKEALSTERGKTLVQKKPTMYPEWKSTFDAHIYEGRVIQIVLMRAAEEPVSEVTVGVSVLAERCKKNNGKAEFWLDLQPQAKVLMSVQYFLEDVDCKQSMRSEDEAKFPTMNRRGAIKQAKIHYIKNHEFIATFFGQPTFCSVCKDFVWGLNKQGYKCRQCNAAIHKKCIDKIIGRCTGTAANSRDTIFQKERFNIDMPHRFKVHNYMSPTFCDHCGSLLWGLVKQGLKCEDCGMNVHHKCREKVANLCGINQKLLAEALNQVTQRASRRSDSASSEPVGIYQGFEKKTGVAGEDMQDNSGTYGKIWEGSSKCNINNFIFHKVLGKGSFGKVLLGELKGRGEYFAIKALKKDVVLIDDDVECTMVEKRVLTLAAENPFLTHLICTFQTKDHLFFVMEFLNGGDLMYHIQDKGRFELYRATFYAAEIMCGLQFLHSKGIIYRDLKLDNVLLDRDGHIKIADFGMCKENIFGESRASTFCGTPDYIAPEILQGLKYTFSVDWWSFGVLLYEMLIGQSPFHGDDEDELFESIRVDTPHYPRWITKESKDILEKLFEREPTKRLGVTGNIKIHPFFKTINWTLLEKRRLEPPFRPKVKSPRDYSNFDQEFLNEKARLSYSDKNLIDSMDQSAFAGLAPPLPPERPWLPSGRALMVLPL

SEQ ID NO: 749335 - protein, 145 aa, Homo sapiens
CHIYIFLKKINIHQSPFHGDDEDELFESIRVDTPHYPRWITKESKDILEKLFEREPTKRLGVTGNIKIHPFFKTINWTLLEKRRLEPPFRPKVKSPRDYSNFDQEFLNEKARLSYSDKNLIDSMDQSAFAGFSFVNPKFEHLLED

SEQ ID NO: 749336 - protein, 654 aa, Homo sapiens
CRGAGARGGCSPHLPSDPRRPPAARRPGPHLTGRLAHPSQRRAEPRPRAPGSGAPAAAAATLGACPCNGSPTAGPTMAPFLRIAFNSYELGSLQAEDEANQPFCAVKMKEALSTERGKTLVQKKPTMYPEWKSTFDAHIYEGRVIQIVLMRAAEEPVSEVTVGVSVLAERCKKNNGKAEFWLDLQPQAKVLMSVQYFLEDVDCKQSMRSEDEAKFPTMNRRGAIKQAKIHYIKNHEFIATFFGQPTFCSVCKDFVWGLNKQGYKCRQCNAAIHKKCIDKIIGRCTGTAANSRDTIFQKERFNIDMPHRFKVHNYMSPTFCDHCGSLLWGLVKQGLKCEDCGMNVHHKCREKVANLCGINQKLLAEALNQVTQRASRRSDSASSEPVGIYQGFEKKTGVAGEDMQDNSGTYGKIWEGSSKCNINNFIFHKVLGKGSFGKVLLGELKGRGEYFAIKALKKDVVLIDDDVECTMVEKRVLTLAAENPFLTHLICTFQTKDHLFFVMEFLNGGDLMYHIQDKGRFELYRATFYAAEIMCGLQFLHSKGIIYRDLKLDNVLLDRDGHIKIADFGMCKENIFGESRASTFCGTPDYIAPEILQGLKYTFSVDWWSFGVLLYEMLIGSWYFLCELCVNLLFLCLRREIVNPVFHYLNVVIY

SEQ ID NO: 749337 - protein, 565 aa, Homo sapiens
CRGAGARGGCSPHLPSDPRRPPAARRPGPHLTGRLAHPSQRRAEPRPRAPGSGAPAAAAATLGACPCNGSPTAGPTMAPFLRIAFNSYELGSLQAEDEANQPFCAVKMKEALSTERGKTLVQKKPTMYPEWKSTFDAHIYEGRVIQIVLMRAAEEPVSEVTVGVSVLAERCKKNNGKAEFWLDLQPQAKVLMSVQYFLEDVDCKQSMRSEDEAKFPTMNRRGAIKQAKIHYIKNHEFIATFFGQPTFCSVCKDFVWGLNKQGYKCRQCNAAIHKKCIDKIIGRCTGTAANSRDTIFQKERFNIDMPHRFKVHNYMSPTFCDHCGSLLWGLVKQGLKCEDCGMNVHHKCREKVANLCGINQKLLAEALNQVTQRASRRSDSASSEPVGIYQGFEKKTGVAGEDMQDNSGTYGKIWEGSSKCNINNFIFHKVLGKGSFGKVLLGELKGRGEYFAIKALKKDVVLIDDDVECTMVEKRVLTLAAENPFLTHLICTFQTKDHLFFVMEFLNGGDLMYHIQDKGRFELYRATYVRAMVGKGPVWRKGYWLRAHFQSALHAFFPLPRKASL

SEQ ID NO: 749338 - protein, 367 aa, Homo sapiens
CRGAGARGGCSPHLPSDPRRPPAARRPGPHLTGRLAHPSQRRAEPRPRAPGSGAPAAAAATLGACPCNGSPTAGPTMAPFLRIAFNSYELGSLQAEDEANQPFCAVKMKEALSTERGKTLVQKKPTMYPEWKSTFDAHIYEGRVIQIVLMRAAEEPVSEVTVGVSVLAERCKKNNGKAEFWLDLQPQAKVLMSVQYFLEDVDCKQSMRSEDEAKFPTMNRRGAIKQAKIHYIKNHEFIATFFGQPTFCSVCKDFVWGLNKQGYKCRQCNAAIHKKCIDKIIGRCTGTAANSRDTIFQKERFNIDMPHRFKVHNYMSPTFCDHCGCPLPTISTSGTVVTSAAGPAPAPRASLAAVWPGSHGTSSVNCV

SEQ ID NO: 749339 - protein, 77 aa, Homo sapiens
YVDEACMKCDDCGMNVHHKCREKVANLCGINQKLLAEALNQVTQRASRRSDSASSEPVGIYQGFEKKTGVAGEDMQG

SEQ ID NO: 749340 - protein, 201 aa, Homo sapiens
AAAPEPEAAVAHISRATPGARPPRGGPGHTSLAAWPIPVSAAPNPVRARRGAAPPPLPPRPLAPAPATGGWSAVARSRLTATSTSRVQVILLPQPPSPTAGPTMAPFLRIAFNSYELGSLQAEDEANQPFCAVKMKEALSTERGKTLVQKKPTMYPEWKSTFDAHIYEGRVIQIAGPAPAPRASLAAVWPGSHGTSSVNCV

SEQ ID NO: 749341 - protein, 107 aa, Homo sapiens
DSRVSQISQRGKTLVQKKPTMYPEWKSTFDAHIYEGRVIQIVLMRAAEEPVSEVTVGVSVLAERCKKNNGKAEFWLDLQPQAKVLMSVQYFLEDVDLQTVYAQMGYG

SEQ ID NO: 749342 - protein, 752 aa, Homo sapiens; identical to SEQ ID NO: 749329

SEQ ID NO: 749343 - protein, 752 aa, Homo sapiens; identical to SEQ ID NO: 749329

SEQ ID NO: 749344 - protein, 676 aa, Homo sapiens
MAPFLRIAFNSYELGSLQAEDEANQPFCAVKMKEALSTERGKTLVQKKPTMYPEWKSTFDAHIYEGRVIQIVLMRAAEEPVSEVTVGVSVLAERCKKNNGKAEFWLDLQPQAKVLMSVQYFLEDVDCKQSMRSEDEAKFPTMNRRGAIKQAKIHYIKNHEFIATFFGQPTFCSVCKDFVWGLNKQGYKCRQCNAAIHKKCIDKIIGRCTGTAANSRDTIFQKERFNIDMPHRFKVHNYMSPTFCDHCGSLLWGLVKQGLKCEDCGMNVHHKCREKVANLCGINQKLLAEALNQVTQRASRRSDSASSEPVGIYQGFEKKTGVAGEDMQDNSGTYGKIWEGSSKCNINNFIFHKVLGKGSFGKVLLGELKGRGEYFAIKALKKDVVLIDDDVECTMVEKRVLTLAAENPFLTHLICTFQTKDHLFFVMEFLNGGDLMYHIQDKGRFELYRATFYAAEIMCGLQFLHSKGIIYRDLKLDNVLLDRDGHIKIADFGMCKENIFGESRASTFCGTPDYIAPEILQGLKYTFSVDWWSFGVLLYEMLIGQSPFHGDDEDELFESIRVDTPHYPRWITKESKDILEKLFEREPTKRLGVTGNIKIHPFFKTINWTLLEKRRLEPPFRPKVKSPRDYSNFDQEFLNEKARLSYSDKNLIDSMDQSAFAGFSFVNPKFEHLLED

SEQ ID NO: 749345 - protein, 655 aa, Homo sapiens
ELATCFWILKMQDALSTERGKTLVQKKPTMYPEWKSTFDAHIYEGRVIQIVLMRAAEEPVSEVTVGVSVLAERCKKNNGKAEFWLDLQPQAKVLMSVQYFLEDVDCKQSMRSEDEAKFPTMNRRGAIKQAKIHYIKNHEFIATFFGQPTFCSVCKDFVWGLNKQGYKCRQCNAAIHKKCIDKIIGRCTGTAANSRDTIFQKERFNIDMPHRFKVHNYMSPTFCDHCGSLLWGLVKQGLKCEDCGMNVHHKCREKVANLCGINQKLLAEALNQVTQRASRRSDSASSEPVGIYQGFEKKTGVAGEDMQDNSGTYGKIWEGSSKCNINNFIFHKVLGKGSFGKVLLGELKGRGEYFAIKALKKDVVLIDDDVECTMVEKRVLTLAAENPFLTHLICTFQTKDHLFFVMEFLNGGDLMYHIQDKGRFELYRATFYAAEIMCGLQFLHSKGIIYRDLKLDNVLLDRDGHIKIADFGMCKENIFGESRASTFCGTPDYIAPEILQGLKYTFSVDWWSFGVLLYEMLIGQSPFHGDDEDELFESIRVDTPHYPRWITKESKDILEKLFEREPTKRLGVTGNIKIHPFFKTINWTLLEKRRLEPPFRPKVKSPRDYSNFDQEFLNEKARLSYSDKNLIDSMDQSAFAGFSFVNPKFEHLLED

SEQ ID NO: 749346 - protein, 342 aa, Homo sapiens
KASARLVCESAEEHFIFHKVLGKGSFGKVLLGELKGRGEYFAIKALKKDVVLIDDDVECTMVEKRVLTLAAENPFLTHLICTFQTKDHLFFVMEFLNGGDLMYHIQDKGRFELYRATFYAAEIMCGLQFLHSKGIIYRDLKLDNVLLDRDGHIKIADFGMCKENIFGESRASTFCGTPDYIAPEILQGLKYTFSVDWWSFGVLLYEMLIGQSPFHGDDEDELFESIRVDTPHYPRWITKESKDILEKLFEREPTKRLGVTGNIKIHPFFKTINWTLLEKRRLEPPFRPKVKSPRDYSNFDQEFLNEKARLSYSDKNLIDSMDQSAFAGFSFVNPKFEHLLED

SEQ ID NO: 749347 - protein, 310 aa, Homo sapiens
SSSQSVMKGRGTTAQKDVVLIDDDVECTMVEKRVLTLAAENPFLTHLICTFQTKDHLFFVMEFLNGGDLMYHIQDKGRFELYRATFYAAEIMCGLQFLHSKGIIYRDLKLDNVLLDRDGHIKIADFGMCKENIFGESRASTFCGTPDYIAPEILQGLKYTFSVDWWSFGVLLYEMLIGQSPFHGDDEDELFESIRVDTPHYPRWITKESKDILEKLFEREPTKRLGVTGNIKIHPFFKTINWTLLEKRRLEPPFRPKVKSPRDYSNFDQEFLNEKARLSYSDKNLIDSMDQSAFAGFSFVNPKFEHLLED

SEQ ID NO: 749348 - protein, 433 aa, Homo sapiens
CRGAGARGGCSPHLPSDPRRPPAARRPGPHLTGRLAHPSQRRAEPRPRAPGSGAPAAAAATLGACPCNGSPTAGPTMAPFLRIAFNSYELGSLQAEDEANQPFCAVKMKEALSTERGKTLVQKKPTMYPEWKSTFDAHIYEGRVIQIVLMRAAEEPVSEVTVGVSVLAERCKKNNGKAEFWLDLQPQAKVLMSVQYFLEDVDCKQSMRSEDEAKFPTMNRRGAIKQAKIHYIKNHEFIATFFGQPTFCSVCKDFVWGLNKQGYKCRQCNAAIHKKCIDKIIGRCTGTAANSRDTIFQKERFNIDMPHRFKVHNYMSPTFCDHCGSLLWGLVKQGLKCEDCGMNVHHKCREKVANLCGINQKLLAEALNQVTQRASRRSDSASSEPVGIYQGFEKKTGVAGEDMQDNSGTYGKIWEGSSKCNINKSKSTPSSRP

SEQ ID NO: 749349 - protein, 597 aa, Homo sapiens
CRGAGARGGCSPHLPSDPRRPPAARRPGPHLTGRLAHPSQRRAEPRPRAPGSGAPAAAAATLGACPCNGSPTAGPTMAPFLRIAFNSYELGSLQAEDEANQPFCAVKMKEALSTERGKTLVQKKPTMYPEWKSTFDAHIYEGRVIQIVLMRAAEEPVSEVTVGVSVLAERCKKNNGKAEFWLDLQPQAKVLMSVQYFLEDVDCKQSMRSEDEAKFPTMNRRGAIKQAKIHYIKNHEFIATFFGQPTFCSVCKDFVWGLNKQGYKCRQCNAAIHKKCIDKIIGRCTGTAANSRDTIFQKERFNIDMPHRFKVHNYMSPTFCDHCGSLLWGLVKQGLKCEDCGMNVHHKCREKVANLCGINQKLLAEALNQVTQRASRRSDSASSEPVGIYQGFEKKTGVAGEDMQDNSGTYGKIWEGSSKCNINNFIFHKVLGKGSFGKVLLGELKGRGEYFAIKALKKDVVLIDDDVECTMVEKRVLTLAAENPFLTHLICTFQTKDHLFFVMEFLNGGDLMYHIQDKGRFELYRATFYAAEIMCGLQFLHSKGIIYRDLKLDNVLLDRDGHIKIADFGMCKENIFGESRASTFCGTVWTLGTVWTL

SEQ ID NO: 749350 - protein, 513 aa, Homo sapiens
CRGAGARGGCSPHLPSDPRRPPAARRPGPHLTGRLAHPSQRRAEPRPRAPGSGAPAAAAATLGACPCNGSPTAGPTMAPFLRIAFNSYELGSLQAEDEANQPFCAVKMKEALSTERGKTLVQKKPTMYPEWKSTFDAHIYEGRVIQIVLMRAAEEPVSEVTVGVSVLAERCKKNNGKAEFWLDLQPQAKVLMSVQYFLEDVDCKQSMRSEDEAKFPTMNRRGAIKQAKIHYIKNHEFIATFFGQPTFCSVCKDFVWGLNKQGYKCRQCNAAIHKKCIDKIIGRCTGTAANSRDTIFQKERFNIDMPHRFKVHNYMSPTFCDHCGSLLWGLVKQGLKCEDCGMNVHHKCREKVANLCGINQKLLAEALNQVTQRASRRSDSASSEPVGIYQGFEKKTGVAGEDMQDNSGTYGKIWEGSSKCNINNFIFHKVLGKGSFGKVLLGELKGRGEYCDEGRGSCPFGGNCFYKHAYPDAVERSHRDRKWEHQADTGPNEGYHFWELIEERENSNPFDIR

SEQ ID NO: 749351 - protein, 287 aa, Homo sapiens
MAPFLRIAFNSYELGSLQAEDEANQPFCAVKMKEALSTERGKTLVQKKPTMYPEWKSTFDAHIYEGRVIQIVLMRAAEEPVSEVTVGVSVLAERCKKNNGKAEFWLDLQPQAKVLMSVQYFLEDVDCKQSMRSEDEAKFPTMNRRGAIKQAKIHYIKNHEFIATFFGQPTFCSVCKDFVWGLNKQGYKCRQCNAAIHKKCIDKIIGRCTGTAANSRDTILPAPHDKHQWDCGDFCCWPRPCPQSVLGCRLAGLSWYFLCELCVNLLFLCLRREIVNPVFHYLNVVIY

SEQ ID NO: 749352 - protein, 112 aa, Homo sapiens
MPHVAAGRKEVIRSLPRVAATTHCWRTQCQAALMARQRLTQEVGHILGVTSEMWRAGRKVGFLHLSPSASSHGSKPPRPVPTHPGSLGSHLQVLQTGGRRQPGRPRGTASQD

SEQ ID NO: 749353 - protein, 112 aa, Homo sapiens
WGEEQRESKPIVVLNIISGINLFSNHFSPSPHLLALRPKKPYRNNQNDQLFPTGLNLPTDFKKSPSKLPVSLPFPKHTHIPKLWSIFSIYGGGAPAHAPIKSKGGYQFSVIV

SEQ ID NO: 749354 - protein, 361 aa, Homo sapiens
MASLLAKDAYLQSLAKKICSHSAPEQQARTRAGKTQGSETAGPPKKKRKKTQKKFRKREEKAAEHKAKSLGEKSPAASGARRPEAAKEEAAWASSSAGNPADGLATEPESVFALDVLRQRLHEKIQEARGQGSAKELSPAALEKRRRRKQERDRKKRKRKELRAKEKARKAEEATEAQEVVEATPEGACTEPREPPGLIFNKVEVSEDEPASKAQRRKEKRQRVKGNLTPLTGRNYRQLLERLQARQSRLDELRGQDEGKAQELEAKMKWTNLLYKAEGVKIRDDERLLQEALKRKEKRRAQRQRRWEKRTAGVVEKMQQRQDRRRQNLRRKKAARAERRLLRARKKGRILPQDLERAGLV

SEQ ID NO: 749355 - protein, 365 aa, Homo sapiens
SSSAGNPADGLATEPESVFALDVLRQRLHEKIQEARGQGSAKELSPAALEKRKKTQKKFRKREEKAAEHKAKSLGEKSPAASGARRPEAAKEEAAWASSSAGNPADGLATEPESVFALDVLRQRLHEKIQEARGQGSAKELSPAALEKRRRRKQERDRKKRKRKELRAKEKARKAEEATEAQEVVEATPEGACTEPREPPGLIFNKVEVSEDEPASKAQRRKEKRQRVKGNLTPLTGRNYRQLLERLQARQSRLDELRGQDEGKAQELEAKMKWTNLLYKAEGVKIRDDERLLQEALKRKEKRRAQRQRRWEKRTAGVVEKMQQRQDRRRQNLRRKKAARAERRLLRARKKGRILPQDLERAGLV

SEQ ID NO: 749356 - protein, 365 aa, Homo sapiens; identical to SEQ ID NO: 749355

SEQ ID NO: 749357 - protein, 365 aa, Homo sapiens; identical to SEQ ID NO: 749355

SEQ ID NO: 749358 - protein, 365 aa, Homo sapiens; identical to SEQ ID NO: 749355

SEQ ID NO: 749359 - protein, 116 aa, Homo sapiens [sequence omitted]

SEQ ID NO: 749360 - protein, 115 aa, Homo sapiens
MAPLTRGLLLRGRRLPSSRKALPSPTRNRQPRPRSRLLWPQVSTLPAAQSLVYSRRLINTGWANTTHPSCSDVGVGLIAECRPAPPCLLALKGWAGPRPAPWSSPGRAGVGMFAQ

SEQ ID NO: 749361 - protein, 113 aa, Homo sapiens
ERELERENLSHHVVPKEFKLNLCPREICSASLSTHLSLLEMPGRANASGASQYIHIWNFHLAPLFTSTHHPGQVCFLPGKPGFTARTAQCGCEIMIKCQKHSDIRELVKVDLT

SEQ ID NO: 749362 - protein, 109 aa, Homo sapiens
MWSTRSPNSTAWPLSLEPDPGMSGWPDGRMETSTPTIMDIVVIAGVIAAVAIVLVSLLFVMLRYMYRHKGTYHTNEAKGTEFAESADAALQGDPALQDAGDSSRKEYFI

SEQ ID NO: 749363 - protein, 128 aa, Homo sapiens
MWSTRSPNSTAWPLSLEPDPGMASASTTMHTTTIAEPDPGMSGWPDGRMETSTPTIMDIVVIAGVIAAVAIVLVSLLFVMLRYMYRHKGTYHTNEAKGTEFAESADAALQGDPALQDAGDSSRKEYFI

SEQ ID NO: 749364 - protein, 91 aa, Homo sapiens
LRARAPPLGPRGRSVTQVPLPLAAEGQEPGSATLPRPGLARPGQSPRSLPGLTPRNVVDEKPQQHGVASQPRSWVKGTGATVIIPIQSLRR

SEQ ID NO: 749365 - protein, 128 aa, Homo sapiens; identical to SEQ ID NO: 749363

SEQ ID NO: 749366 - protein, 128 aa, Homo sapiens; identical to SEQ ID NO: 749363

SEQ ID NO: 749367 - protein, 128 aa, Homo sapiens; identical to SEQ ID NO: 749363

SEQ ID NO: 749368 - protein, 128 aa, Homo sapiens; identical to SEQ ID NO: 749363

SEQ ID NO: 749369 - protein, 128 aa, Homo sapiens; identical to SEQ ID NO: 749363

SEQ ID NO: 749370 - protein, 128 aa, Homo sapiens; identical to SEQ ID NO: 749363

SEQ ID NO: 749371 - protein, 128 aa, Homo sapiens; identical to SEQ ID NO: 749363

SEQ ID NO: 749372 - protein, 180 aa, Homo sapiens
MLRRRYAGFVIPFHGAGVFLVLFHVPAVSARADAQECGRREAPTARRGLSASFPECLPHLHQEKYTPSPSTPADTTRQRERALDSSRDSHLETLGACPGRNGGGLALTRGHSQGPREAMATPEATFCSTEVGENLGTWGPLGKVAGQHAHCAGQHQLTGRKVLVEGEGVLGYPGAGEARK

SEQ ID NO: 749373 - protein, 213 aa, Homo sapiens
GFPAEAAAMAASSLTVTLGRLASACSHSILRPSGPGAASLWSASRRFNSQSTSYLPGYVPKTSLSSPPWPEVVLPDPVEETRHHAEVVKKVNEMIVTGQYGRLFAVVHFASRQWKVTSEDLILIGNELDLACGERIRLEKVLLVGADNFTLLGKPLLGKDLVRVEATVIEKTESWPRIIMRFRKRKNFKKKRIVTTPQTVLRINSIEIAPCLL

SEQ ID NO: 749374 - protein, 213 aa, Homo sapiens; identical to SEQ ID NO: 749373

SEQ ID NO: 749375 - protein, 213 aa, Homo sapiens; identical to SEQ ID NO: 749373

SEQ ID NO: 749376 - protein, 202 aa, Homo sapiens
GFPAEAAAMAASSLTVTLGRLASACSHSILRPSGPGAASLWSASRRYVPKTSLSSPPWPEVVLPDPVEETRHHAEVVKKVNEMIVTGQYGRLFAVVHFASRQWKVTSEDLILIGNELDLACGERIRLEKVLLVGADNFTLLGKPLLGKDLVRVEATVIEKTESWPRIIMRFRKRKNFKKKRIVTTPQTVLRINSIEIAPCLL

SEQ ID NO: 749377 - protein, 195 aa, Homo sapiens
GFPAEAAAMAASSLTVTLGRLASACSHSILRPSGPGAASLWSASRRFNSQSTSYLPGYVPEETRHHAEVVKKVNEMIVTGQYGRLFAVVHFASRQWKVTSEDLILIGNELDLACGERIRLEKVLLVGADNFTLLGKPLLGKDLVRVEATVIEKTESWPRIIMRFRKRKNFKKKRIVTTPQTVLRINSIEIAPCLL

SEQ ID NO: 749378 - protein, 146 aa, Homo sapiens
MCFTDMFLYVPEETRHHAEVVKKVNEMIVTGQYGRLFAVVHFASRQWKVTSEDLILIGNELDLACGERIRLEKVLLVGADNFTLLGKPLLGKDLVRVEATVIEKTESWPRIIMRFRKRKNFKKKRIVTTPQTVLRINSIEIAPCLL

SEQ ID NO: 749379 - protein, 188 aa, Homo sapiens
MPAYLDLLGPGAASLWSASRRFNSQSTSYLPGYVPKTSLSSPPWPEVVLPDPVEETRHHAEVVKKVNEMIVTGQYGRLFAVVHFASRQWKVTSEDLILIGNELDLACGERIRLEKVLLVGADNFTLLGKPLLGKDLVRVEATVIEKTESWPRIIMRFRKRKNFKKKRIVTTPQTVLRINSIEIAPCLL

SEQ ID NO: 749380 - protein, 181 aa, Homo sapiens
LFLLHLLQKVQVCRFNSQSTSYLPGYVPKTSLSSPPWPEVVLPDPVEETRHHAEVVKKVNEMIVTGQYGRLFAVVHFASRQWKVTSEDLILIGNELDLACGERIRLEKVLLVGADNFTLLGKPLLGKDLVRVEATVIEKTESWPRIIMRFRKRKNFKKKRIVTTPQTVLRINSIEIAPCLL

SEQ ID NO: 749381 - protein, 158 aa, Homo sapiens
GFPAEAAAMAASSLTVTLGRLASACSHSILRPSGPGAASLWSASRRFNSQSTSYLPGYVPKTSLSSPPWPEVVLPDPVEETRHHAEVVKKVNEMIVTGQYGRLFAVVHFASRQWKVTSEDLILIGNELDLACGERIRLEKVLLVGADNFTLLGKPLLG

SEQ ID NO: 749382 - protein, 207 aa, Homo sapiens
TQESALEGEARGTRPHQPNIKDTIGTAAPAAPTPHRRLHLHGHPLRRTVDHQPPHHHSILRPSGPGAASLWSASRRFNSQSTSYLPGYVPKTSLSSPPWPEVVLPDPVEVTSEDLILIGNELDLACGERIRLEKVLLVGADNFTLLGKPLLGKDLVRVEATVIEKTESWPRIIMRFRKRKNFKKKRIVTTPQTVLRINSIEIAPCLL

SEQ ID NO: 749383 - protein, 392 aa, Homo sapiens
MELVAGCYEQVLFGFAVHPEPEACGDHEQWTLVADFTHHAHTASLSAVAVNSRFVVTGSKDETIHIYDMKKKIEHGALVHHSGTITCLKFYGNRHLISGAEDGLICIWDAKKWECLKSIKAHKGQVTFLSIHPSGKLALSVGTDKTLRTWNLVEGRSAFIKNIKQNAHIVEWSPRGEQYVVIIQNKIDIYQLDTASISGTITNEKRISSVKFLSESVLAVAGDEEVIRFFDCDSLVCLCEFKAHENRVKDMFSFEIPEHHVIVSASSDGFIKMWKLKQDKKVPPSLLCEINTNARLTCLGVWLDKVADMKESLPPAAEPSPVSKEQSKIGKKEPGDTVHKEEKRSKPNTKKRGLTGDSKKATKESGLISTKKRKMVEMLEKKRKKKKIKTMQ

SEQ ID NO: 749384 - protein, 131 aa, Homo sapiens
MLSSNPVKQYLNCSRTSRRQNPSASEFKKEGLYSAGIFGKTHVSNNQAPQRRGFTMFGQGWSRSLDLVKSAGITGMREPLRLAILFYFLRQSPDLKQSACLGLAKCWDYRSEPPCPAKKDFGRVNEYKDFH

SEQ ID NO: 749385 - protein, 392 aa, Homo sapiens; identical to SEQ ID NO: 749383

SEQ ID NO: 749386 - protein, 392 aa, Homo sapiens; identical to SEQ ID NO: 749383

SEQ ID NO: 749387 - protein, 324 aa, Homo sapiens [sequence omitted]

SEQ ID NO: 749388 - protein, 335 aa, Homo sapiens
RQAKAKVEAGCNIGRGEHGALVHHSGTITCLKFYGNRHLISGAEDGLICIWDAKKWECLKSIKAHKGQVTFLSIHPSGKLALSVGTDKTLRTWNLVEGRSAFIKNIKQNAHIVEWSPRGEQYVVIIQNKIDIYQLDTASISGTITNEKRISSVKFLSESVLAVAGDEEVIRFFDCDSLVCLCEFKAHENRVKDMFSFEIPEHHVIVSASSDGFIKMWKLKQDKKVPPSLLCEINTNARLTCLGVWLDKVADMKESLPPAAEPSPVSKEQSKIGKKEPGDTVHKEEKRSKPNTKKRGLTGDSKKATKESGLISTKKRKMVEMLEKKRKKKKIKTMQ

SEQ ID NO: 749389 - protein, 142 aa, Homo sapiens
MFSFEIPEHHVIVSASSDGFIKMWKLKQDKKVPPSLLCEINTNARLTCLGVWLDKVADMKESLPPAAEPSPVSKEQSKIGKKEPGDTVHKEEKRSKPNTKKRGLTGDSKKATKESGLISTKKRKMVEMLEKKRKKKKIKTMQ

SEQ ID NO: 749390 - protein, 217 aa, Homo sapiens
MELVAGCYEQVLFGFAVHPEPEACGDHEQWTLVADFTHHAHTASLSAVAVNSRFVVTGSKDETIHIYDMKKKIEHGALVHHSGTITCLKFYGNRHLISGAEDGLICIWDAKKWECLKSIKAHKGQVTFLSIHPSGKLALSVGTDKTLRTWNLVEGRSAFIKNIKQNAHIVEWSPRGEQYVVIIQNKIDIYQLDTASISGTITNEKRISSVKFLSELA

SEQ ID NO: 749391 - protein, 124 aa, Homo sapiens
RTPGKRTVVQPSVGAAAGPVVPPCPGRIRHFKVWLDKVADMKESLPPAAEPSPVSKEQSKIGKKEPGDTVHKEEKRSKPNTKKRGLTGDSKKATKESGLISTKKRKMVEMLEKKRKKKKIKTMQ

SEQ ID NO: 749392 - protein, 231 aa, Homo sapiens
MELVAGCYEQVLFGFAVHPEPEACGDHEQWTLVADFTHHAHTASLSAVAVNSRFVVTGSKDETIHIYDMKKKIEHGALVHHSGTITCLKFYGNRHLISGAEDGLICIWDAKKWECLKSIKAHKGQVTFLSIHPSGKLALSVGTDKTLRTWNLVEGRSAFIKNIKQNAHIVEWSPRGEQYVVIIQNKIDIYQLDTASISGTITNEKRISSVKFLSESGLAGAGKTMKQGKAL

SEQ ID NO: 749393 - protein, 256 aa, Homo sapiens
MELVAGCYEQVLFGFAVHPEPEACGDHEQWTLVADFTHHAHTASLSAVAVNSRFVVTGSKDETIHIYDMKKKIEHGALVHHSGTITCLKFYGNRHLISGAEDGLICIWDAKKWECLKSIKAHKGQVTFLSIHPSGKLALSVGTDKTLRTWNLVEGRSAFIKNIKQNAHIVEWSPRGEQYVVIIQNKIDIYQLDTASISGTITKKKKKKKKLGAAGLKIKPLVGRARVRTVQGPKNGRRAGPKKRGPAEPGGAVKAA

SEQ ID NO: 749394 - protein, 111 aa, Homo sapiens
YLLNCRSGGDPDNFTLLTACVYFIQRGKQSFFKSTLFCVLVSKEQSKIGKKEPGDTVHKEEKRSKPNTKKRGLTGDSKKATKESGLISTKKRKMVEMLEKKRKKKKIKTMQ

SEQ ID NO: 749395 - protein, 30 aa, Homo sapiens
YPETCRSLLAPGVETFSMIRRVSCSKGPLR

SEQ ID NO: 749396 - protein, 71 aa, Homo sapiens
ELLVATSDPHRQSLLENKANMQEEEEESWMHINPSIDKEPGGILRPRMQLCCNRKHLCISRLRQATDSLFD

SEQ ID NO: 749397 - protein, 72 aa, Homo sapiens
RRHMVSVGSKLRISFPDKLHHILTVHEEGSRPLSREASRLSRPGWCHHLQFAHEEHSAYEEDLRETLQGSWG

SEQ ID NO: 749398 - protein, 87 aa, Homo sapiens
LRRSGGGGEAHTLRRLKPGFTHWRRELALRCQPCAPGAVHPDARGAPGAAADRARTDCRSYSPCRRRPGPGDIEVFVYRRWADRASF

SEQ ID NO: 749399 - protein, 35 aa, Homo sapiens
MFYNPSAAAPDLHSSSFSYIHLTLNSYIKSLYSRI

SEQ ID NO: 749400 - protein, 218 aa, Homo sapiens
MFLVPCPKPSRTLGPLVIVRAGSPQGLGACGQNQWAGAQHSKPEKGLRRHHLHRGRGREKAPPSDPPLPRQELQAVDTSLAEDGQQRLSKSSLPSQKETLPGRTHCSPLEENPMQGAMGLNPHIVIRVLSHTVSPPLSQHPSSLSPGDPWMEDWASPEWEAGPACLRAHVCACRHAPRPQRRPGPSHMVSELPWQLAFLVQSKLGSEAPGICRETHCT

SEQ ID NO: 749401 - protein, 205 aa, Homo sapiens
EGQPHQGTGAPRLLAFDWRPLSASSAPWGTRQDCQPLSWQVTSAFKLTVPSPFHAPQGPGHVFSWVSSQDRHWHWSPGTCFWVPCFPGVMVNAECQLDWIEGCKVLVTGCVCEGVARGDSHLSQWAGRGRPTLNPGGHHLIGCQHSQDTSRQRNVERLDWLNLASIFLPCWMLPALARRPPGSSAFGLSDLHQWLAGALQPLATG

SEQ ID NO: 749402 - protein, 106 aa, Homo sapiens
SLELLTSSDLLTSASQSSGITGVSHCAWPPPLHFNSTDTLELFMDYAPFRRRQIVVIAKTFFTCHRTNFCPLGDDTASPHSAIGVISSILLGKNNNLCKRLHTHGF

SEQ ID NO: 749403 - protein, 72 aa, Homo sapiens
EQERAQQKLQATTQVAMRCGTDELAEPKVPEVSVVGTDACEVYDKTLQENHNVDTWGSGAGHAICSQEFYTS

SEQ ID NO: 749404 - protein, 309 aa, Homo sapiens
MVGFKATDVPPTATVKFLGAGTAACIADLITFPLDTAKVRLQIQGESQGPVRATASAQYRGVMGTILTMVRTEGPRSLYNGLVAGLQRQMSFASVRIGLYDSVKQFYTKGSEHASIGSRLLAGSTTGALAVAVAQPTDVVKVRFQAQARAGGGRRYQSTVNAYKTIAREEGFRGLWKGTSPNVARNAIVNCAELVTYDLIKDALLKANLMTDDLPCHFTSAFGAGFCTTVIASPVDVVKTRYMNSALGQYSSAGHCALTMLQKEGPRAFYKGFMPSFLRLGSWNVVMFVTYEQLKRALMAACTSREAPF

SEQ ID NO: 749405 - protein, 309 aa, Homo sapiens; identical to SEQ ID NO: 749404

SEQ ID NO: 749406 - protein, 309 aa, Homo sapiens; identical to SEQ ID NO: 749404

SEQ ID NO: 749407 - protein, 309 aa, Homo sapiens; identical to SEQ ID NO: 749404

SEQ ID NO: 749408 - protein, 309 aa, Homo sapiens; identical to SEQ ID NO: 749404

SEQ ID NO: 749409 - protein, 309 aa, Homo sapiens; identical to SEQ ID NO: 749404

SEQ ID NO: 749410 - protein, 309 aa, Homo sapiens; identical to SEQ ID NO: 749404

SEQ ID NO: 749411 - protein, 309 aa, Homo sapiens; identical to SEQ ID NO: 749404

SEQ ID NO: 749412 - protein, 309 aa, Homo sapiens; identical to SEQ ID NO: 749404

SEQ ID NO: 749413 - protein, 309 aa, Homo sapiens; identical to SEQ ID NO: 749404

SEQ ID NO: 749414 - protein, 309 aa, Homo sapiens; identical to SEQ ID NO: 749404

SEQ ID NO: 749415 - protein, 309 aa, Homo sapiens; identical to SEQ ID NO: 749404

SEQ ID NO: 749416 - protein, 309 aa, Homo sapiens; identical to SEQ ID NO: 749404

SEQ ID NO: 749417 - protein, 294 aa, Homo sapiens
MVGFKATDVPPTATVKFLGAGTAACIADLITFPLDTAKVRLQIQGESQGPVRATASAQYRGVMGTILTMVRTEGPRSLYNGLVAGLQRQMSFASVRIGLYDSVKQFYTKGSEHASIGSRLLAGSTTGALAVAVAQPTDVVKVRFQAQARAGGGRRYQSTVNAYKTIAREEGFRGLWKGTSPNVARNAIVNCAELVTYDLIKDALLKANLMTDDLPCHFTSAFGAGFCTTVIASPVDVVKTRYMNSALGQYSSAGHCALLKANLMTDDLPCHFTSAFGQIALTPCNVSDETSSIA

SEQ ID NO: 749418 - protein, 299 aa, Homo sapiens
MVGFKATDVPPTATVKFLGAGTAACIADLITFPLDTAKVRLQIQGESQGPVRATASAQYRGVMGTILTMVRTEGPRSLYNGLVAGLQRQMSFASVRIGLYDSVKQFYTKGSEHASIGSRLLAGSTTGALAVAVAQPTDVVKVRFQAQARAGGGRRYQSTVNAYKTIAREEGFRGLWKGTSPNVARNAIVNCAELVTYDLIKDALLKANLMTVGAGFCTTVIASPVDVVKTRYMNSALGQYSSAGHCALTMLQKEGPRAFYKGFMPSFLRLGSWNVVMFVTYEQLKRALMAACTSREAPF

SEQ ID NO: 749419 - protein, 299 aa, Homo sapiens; identical to SEQ ID NO: 749418

SEQ ID NO: 749420 - protein, 225 aa, Homo sapiens
MVGFKATDVPPTATVKFLGAGTAACIADLITFPLDTAKVRLQIQGESQGPVRATASAQYRGVMGTILTMVRTEGPRSLYNGLVAGLQRQMSFASVRIGLYDSVKQFYTKGSEHASIGSRLLAGSTTGALAVAVAQPTDVVKVRFQAQARAGGGRRYQSTVNAYKTIAREEGFRGLWKGTSPNVARNAIVNCAELVTYDLIKDALLKANLMTGSCPPFSAWVPGTW

SEQ ID NO: 749421 - protein, 329 aa, Homo sapiens
TTLLLSFHRDLELSLGLYHLRLLCKLQRRGEGCSGNTGWGQPPGQLRQWGVQAGSVLHGRPRGGVILLLTLPLSSELRGRGVMGTILTMVRTEGPRSLYNGLVAGLQRQMSFASVRIGLYDSVKQFYTKGSEHASIGSRLLAGSTTGALAVAVAQPTDVVKVRFQAQARAGGGRRYQSTVNAYKTIAREEGFRGLWKGTSPNVARNAIVNCAELVTYDLIKDALLKANLMTDDLPCHFTSAFGAGFCTTVIASPVDVVKTRYMNSALGQYSSAGHCALTMLQKEGPRAFYKGFMPSFLRLGSWNVVMFVTYEQLKRALMAACTSREAPF

SEQ ID NO: 749422 - protein, 269 aa, Homo sapiens
MVGFKATDVPPTATVKFLGAGTAACIADLITFPLDTAKVRLQIQGESQGPVRATASAQYRGVMGTILTMVRTEGPRSLYNGLVAGLQRQMSFASVRIGLYDSVKQFYTKGSEHASIGSRLLAGSTTGALAVAVAQPTDVVKVRFQAQARAGGGRRYQSTVNAYKTIAREEGFRGLWKGTSPNVARNAIVNCAELVTYDLIKDALLKANLMTDDLPCHFTSAFGAGFCTTVIASPEFCFLWELILFPKAHMLLASALCTHAHTRMGSSRT

SEQ ID NO: 749423 - protein, 299 aa, Homo sapiens; identical to SEQ ID NO: 749418

SEQ ID NO: 749424 - protein, 225 aa, Homo sapiens; identical to SEQ ID NO: 749420

SEQ ID NO: 749425 - protein, 225 aa, Homo sapiens
MVGFKATDVPPTATVKFLGAGTAACIADLITFPLDTAKVRLQIQGESQGPVRATASAQYRGVMGTILTMVRTEGPRSLYNGLVAGLQRQMSFASVRIGLYDSVKQFYTKGSEHASIGSRLLAGSTTGALAVAVAQPTDVVKVRFQAQARAGGGRRYQSTVNAYKTIAREEGFRGLWKGTSPNVARNAIVNCAELVTYDLIKDALLKANLMTASLATSLLPLGRLH

SEQ ID NO: 749426 - protein, 212 aa, Homo sapiens
MSASPLATDPSGSPTDASIGSRLLAGSTTGALAVAVAQPTDVVKVRFQAQARAGGGRRYQSTVNAYKTIAREEGFRGLWKGTSPNVARNAIVNCAELVTYDLIKDALLKANLMTDDLPCHFTSAFGAGFCTTVIASPVDVVKTRYMNSALGQYSSAGHCALTMLQKEGPRAFYKGFMPSFLRLGSWNVVMFVTYEQLKRALMAACTSREAPF

SEQ ID NO: 749427 - protein, 229 aa, Homo sapiens
MVGFKATDVPPTATVKFLGAGTAACIADLITFPLDTAKVRLQIQGESQGPVRATASAQYRGVMGTILTMVRTEGPRSLYNGLVAGLQRQMSFASVRIGLYDSVKQFYTKGSEHASIGSRLLAGSTTGALAVAVAQPTDVVKVRFQAQARAGGGRRYQSTVNAYKTIAREEGFRGLWKGTSPNVARNAIVSVLVELTFDSVGGLVPARIPSVPSLGKFSQNLRPAPDSPA

SEQ ID NO: 749428 - protein, 200 aa, Homo sapiens
MVGFKATDVPPTATVKFLGAGTAACIADLITFPLDTAKVRLQIQGESQGPVRATASAQYRGVMGTILTMVRTEGPRSLYNGLVAGLQRQMSFASVRIGLYDSVKQFYTKGSEHASIGSRLLAGSTTGALAVAVAQPTDVVKVRFQVSSRAMLSFSSFFLFPPSLLSFPLSPPLPSAPLPTTFPLSTFSSTHCLSAGGVDI

SEQ ID NO: 749429 - protein, 144 aa, Homo sapiens
MGRTETGVEKVMERTLGGAVPAERRLLQGLRTQVGAGRPGPAPQAPPRAPPPRLKPRRRLRGAPLRSPAARALGLTVHARPARPTRPPPADRHSRTHCRVLPAARTHSMTIRCFVSHPFSMENQGDRAMIATGSFEERDTFREA

SEQ ID NO: 749430 - protein, 163 aa, Homo sapiens
AGYLPLGHGLVGIDGCFGISDHLQPGPELGKGTSPNVARNAIVNCAELVTYDLIKDALLKANLMTDDLPCHFTSAFGAGFCTTVIASPVDVVKTRYMNSALGQYSSAGHCALTMLQKEGPRAFYKGFMPSFLRLGSWNVVMFVTYEQLKRALMAACTSREAPF

SEQ ID NO: 749431 - protein, 138 aa, Homo sapiens
RGGLDSASAQRTCRLDLRRVSSEVTYDLIKDALLKANLMTDDLPCHFTSAFGAGFCTTVIASPVDVVKTRYMNSALGQYSSAGHCALTMLQKEGPRAFYKGFMPSFLRLGSWNVVMFVTYEQLKRALMAACTSREAPF

SEQ ID NO: 749432 - protein, 144 aa, Homo sapiens; identical to SEQ ID NO: 749429

SEQ ID NO: 749433 - protein, 144 aa, Homo sapiens; identical to SEQ ID NO: 749429

SEQ ID NO: 749434 - protein, 144 aa, Homo sapiens; identical to SEQ ID NO: 749429

SEQ ID NO: 749435 - protein, 80 aa, Homo sapiens
QSPRLLIAIIIRGIVRDTLGSSLQQKEPGRRTSVGGLGAGGRDGRVQNLLFLTTHVIFMDPQASVTTALIHAHRLSWGHL

SEQ ID NO: 749436 - protein, 122 aa, Homo sapiens
GLQLESQDKDVCWRIVKNAYKFSKHQESASFFSSLESSMPGNINVFWPDKGQGVKGAMPSKKNLQVVKVPVQGWGQGLGQNVQTSASLQEVQSAFSSDSEAPGIKEFHAAEAMLHARARTAF

SEQ ID NO: 749437 - protein, 111 aa, Homo sapiens
PHACLPILPGSRGRPEDPGILQWLCPVALFQSSAWCLHPLFLFLFPVSPLYTSVSNTVAIITMKENNTFSPSVPLAIFPVLGSHMWLMAVKLDSMVGNMSIIKESSRVSAP

SEQ ID NO: 749438 - protein, 70 aa, Homo sapiens
QSQDVCKTQMRAGIRVLWKLQSCVFSNVIHGPEAAESGNLLECSLSLSQRAAGSGQEGDSPLERQLPSEA

SEQ ID NO: 749439 - protein, 156 aa, Homo sapiens
QAPTITKIQIIFVFLVQTGFHHVGQAGLTLLASSDPPASASQSAGITGVSHRTQPPPTLFEGLMFQVCELWMGLAFSPPVSAALRIPMNTTPRTCLSYLELKMLTFRSEKPQNLPWGYWTVMSLEPSLVEREPPRKVDRAAGCSPEHGRVLTRGPV

SEQ ID NO: 749440 - protein, 138 aa, Homo sapiens
RRVGPAGPRAGRGRGEGCRVVFRPAARSPLRPGPRLPAVGGGGPHSVPGPSRPRQPPARGAPPFVWVSAPRTRGRELRSAASPAGCAMGCGNSTATSAGAGQGPAGAAKDVNYGGVYVGLPSEAVNMVSSQTKTVRKN

SEQ ID NO: 749441 - protein, 150 aa, Homo sapiens
RRVGPAGPRAGRGRGEGCRVVFRPAARSPLRPGPRLPAVGGGGPHSVPGPSRPRQPPARGAPPFVWVSAPRTRGRELRSAASPAGCAMGCGNSTATSAGAGQGPAGAAKDVTEESVTEDDKRRNYGGVYVGLPSEAVNMVSSQTKTVRKN

SEQ ID NO: 749442 - protein, 150 aa, Homo sapiens; identical to SEQ ID NO: 749441

SEQ ID NO: 749443 - protein, 138 aa, Homo sapiens; identical to SEQ ID NO: 749440

SEQ ID NO: 749444 - protein, 150 aa, Homo sapiens; identical to SEQ ID NO: 749441

SEQ ID NO: 749445 - protein, 150 aa, Homo sapiens; identical to SEQ ID NO: 749441

SEQ ID NO: 749446 - protein, 111 aa, Homo sapiens
RRVGPAGPRAGRGRGEGCRVVFRPAARSPLRPGPRLPAVGGGGPHSVPGPSRPRQPPARGAPPFVWVSAPRTRGRELRSAASPAGCAMGCGNSTATSAGAGQGPAGAAKDV

SEQ ID NO: 749447 - protein, 842 aa, Homo sapiens
MVTVGNYCEAEGPVGPAWMQDGLSPCFFFTLVPSTRMALGTLALVLALPCRRRERPAGADSLSWGAGPRISPYVLQLLLATLQAALPLAGLAGRVGTARGAPLPSYLLLASVLESLAGACGLWLLVVERSQARQRLAMGIWIKFRHSPGLLLLWTVAFAAENLALVSWNSPQWWWARADLGQQVQFSLWVLRYVVSGGLFVLGLWAPGLRPQSYTLQVHEEDQDVERSQVRSAAQQSTWRDFGRKLRLLSGYLWPRGSPALQLVVLICLGLMGLERALNVLVPIFYRNIVNLLTEKAPWNSLAWTVTSYVFLKFLQGGGTGSTGFVSNLRTFLWIRVQQFTSRRVELLIFSHLHELSLRWHLGRRTGEVLRIADRGTSSVTGLLSYLVFNVIPTLADIIIGIIYFSMFFNAWFGLIVFLCMSLYLTLTIVVTEWRTKFRRAMNTQENATRARAVDSLLNFETVKYYNAESYEVERYREAIIKYQGLEWKSSASLVLLNQTQNLVIGLGLLAGSLLCAYFVTEQKLQVGDYVLFGTYIIQLYMPLNWFGTYYRMIQTNFIDMENMFDLLKEETEVKDLPGAGPLRFQKGRIEFENVHFSYADGRETLQDVSFTVMPGQTLALVGPSGAGKSTILRLLFRFYDISSGCIRIDGQDISQVTQASLRSHIGVVPQDTVLFNDTIADNIRYGRVTAGNDEVEAAAQAAGIHDAIMAFPEGYRTQVGERGLKLSGGEKQRVAIARTILKAPGIILLDEATSALDTSNERAIQASLAKVCANRTTIVVAHRLSTVVNADQILVIKDGCIVERGRHEALLSRGGVYADMWQLQQGQEETSEDTKPQTMER

SEQ ID NO: 749448 - protein, 100 aa, Homo sapiens
LKVPGLFWWGGKFGVENFKERPIQAFSAKVRANRTTIVGATLLSTVVNADQILVIKDGCIVERGRHEALLSRGGVYADMWQLQQGQEETSEDTKPQTMER

SEQ ID NO: 749449 - protein, 842 aa, Homo sapiens; identical to SEQ ID NO: 749447

SEQ ID NO: 749450 - protein, 842 aa, Homo sapiens; identical to SEQ ID NO: 749447

SEQ ID NO: 749451 - protein, 436 aa, Homo sapiens
MFFNAWFGLIVFLCMSLYLTLTIVVTEWRTKFRRAMNTQENATRARAVDSLLNFETVKYYNAESYEVERYREAIIKYQGLEWKSSASLVLLNQTQNLVIGLGLLAGSLLCAYFVTEQKLQVGDYVLFGTYIIQLYMPLNWFGTYYRMIQTNFIDMENMFDLLKEETEVKDLPGAGPLRFQKGRIEFENVHFSYADGRETLQDVSFTVMPGQTLALVGPSGAGKSTILRLLFRFYDISSGCIRIDGQDISQVTQASLRSHIGVVPQDTVLFNDTIADNIRYGRVTAGNDEVEAAAQAAGIHDAIMAFPEGYRTQVGERGLKLSGGEKQRVAIARTILKAPGIILLDEATSALDTSNERAIQASLAKVCANRTTIVVAHRLSTVVNADQILVIKDGCIVERGRHEALLSRGGVYADMWQLQQGQEETSEDTKPQTMER

SEQ ID NO: 749452 - protein, 842 aa, Homo sapiens; identical to SEQ ID NO: 749447

SEQ ID NO: 749453 - protein, 851 aa, Homo sapiens
MVTVGNYCEAEGPVGPAWMQDGLSPCFFFTLVPSTRMALGTLALVLALPCRRRERPAGADSLSWGAGPRISPYVLQLLLATLQAALPLAGLAGRVGTARGAPLPSYLLLASVLESLAGACGLWLLVVERSQARQRLAMGIWIKFRHSPGLLLLWTVAFAAENLALVSWNSPQWWWARADLGQQVQFSLWVLRYVVSGGLFVLGLWAPGLRPQSYTLQVHEEDQDVERSQVRSAAQQSTWRDFGRKLRLLSGYLWPRGSPALQLVVLICLGLMGLERALNVLVPIFYRNIVNLLTEKAPWNSLAWTVTSYVFLKFLQGGGTGSTGFVSNLRTFLWIRVQQFTSRRVELLIFSHLHELSLRWHLGRRTGEVLRIADRGTSSVTGLLSYLVFNVIPTLADIIIGIIYFSMFFNAWFGLIVFLCMSLYLTLTIVVTEWRTKFRRAMNTQENATRARAVDSLLNFETVKYYNAESYEVERYREAIIKYQGLEWKSSASLVLLNQTQNLVIGLGLLAGSLLCAYFVTEQKLQVGDYVLFGTYIIQLYMPLNWFGTYYRMIQTNFIDMENMFDLLKEETEVKDLPGAGPLRFQKGRIEFENVHFSYADGRETLQDVSFTVMPGQTLALVGPSGAGKSTILRLLFRFYDISSGCIRIDGQDISQVTQASLRSHIGVVPQDTVLFNDTIADNIRYGRVTAGNDEVEAAAQAAGIHDAIMAFPEGNVWWVISTGYRTQVGERGLKLSGGEKQRVAIARTILKAPGIILLDEATSALDTSNERAIQASLAKVCANRTTIVVAHRLSTVVNADQILVIKDGCIVERGRHEALLSRGGVYADMWQLQQGQEETSEDTKPQTMER

SEQ ID NO: 749454 - protein, 692 aa, Homo sapiens
MVTVGNYCEAEGPVGPAWMQDGLSPCFFFTLVPSTRMALGTLALVLALPCRRRERPAGADSLSWGAGPRISPYVLQLLLATLQAALPLAGLAGRVGTARGAPLPSYLLLASVLESLAGACGLWLLVVERSQARQRLAMGIWIKFRHSPGLLLLWTVAFAAENLALVSWNSPQWWWARADLGQQVQFSLWVLRYVVSGGLFVLGLWAPGLRPQSYTLQVHEEDQDVERSQVRSAAQQSTWRDFGRKLRLLSGYLWPRGSPALQLVVLICLGLMGLERALNVLVPIFYRNIVNLLTEKAPWNSLAWTVTSYVFLKFLQGGGTGSTGFVSNLRTFLWIRVQQFTSRRVELLIFSHLHELSLRWHLGRRTGEVLRIADRGTSSVTGLLSYLVFNVIPTLADIIIGIIYFSMFFNAWFGLIVFLCMSLYLTLTIVVTEWRTKFRRAMNTQENATRARAVDSLLNFETVKYYNAESYEVERYREAIIKYQGLEWKSSASLVLLNQTQNLVIGLGLLAGSLLCAYFVTEQKLQVGDYVLFGTYIIQLYMPLNWFGTYYRMIQTNFIDMENMFDLLKEETEVKDLPGAGPLRFQKGRIEFENVHFSYADGRETLQDVSFTVMPGQTLALVGPSGAGKSTILRLLFRFYDISSGCIRIDGQDISQVQDTGGRAGTEAERRGEAARRHCPHHPQGSGHHSAG

SEQ ID NO: 749455 - protein, 985 aa, Homo sapiens
MVTVGNYCEAEGPVGPAWMQDGLSPCFFFTLVPSTRMALGTLALVLALPCRRRERPAGADSLSWGAGPRISPYVLQLLLATLQAALPLAGLAGRVGTARGAPLPSYLLLASVLESLAGACGLWLLVVERSQARQRLAMGIWIKFRHSPGLLLLWTVAFAAENLALVSWNSPQWWWARADLGQQVQFSLWVLRYVVSGGLFVLGLWAPGLRPQSYTLQVHEEDQDVERSQVRSAAQQSTWRDFGRKLRLLSGYLWPRGSPALQLVVLICLGLMGLERALNVLVPIFYRNIVNLLTEKAPWNSLAWTVTSYVFLKFLQGGGTGSTGFVSNLRTFLWIRVQQFTSRRVELLIFSHLHELSLRWHLGRRTGEVLRIADRGTSSVTGLLSYLVFNVIPTLADIIIGIIYFSMFFNAWFGLIVFLCMSLYLTLTIVVTEWRTKFRRAMNTQENATRARAVDSLLNFETVKYYNAESYEVERYREAIIKYQGLEWKSSASLVLLNQTQNLVIGLGLLAGSLLCAYFVTEQKLQVGDYVLFGTYIIQLYMPLNWFGTYYRMIQTNFIDMENMFDLLKEETEVKDLPGAGPLRFQKGRIEFENVHFSYADGEAFLLLPLLFRSFAHCLPASQCSESLLLEKSLGRGGAGPTSSSGDGRCLLSNPTFPCRRETLQDVSFTVMPGQTLALVRGDPATWPRCLKLPSFSAHGELVTQAVESESPVTIGNRMNGAASMDTGDLLEREPQKPVGLGRLRWHMPVIPALWEAEVARSPKVGPSGAGKSTILRLLFRFYDISSGCIRIDGQDISQVTQASLRSHIGVVPQDTVLFNDTIADNIRYGRVTAGNDEVEAAAQAAGIHDAIMAFPEGYRTQVGERGLKLSGGEKQRVAIARTILKAPGIILLDEATSALDTSNERAIQASLAKVCANRTTIVVAHRLSTVVNADQILVIKDGCIVERGRHEALLSRGGVYADMWQLQQGQEETSEDTKPQTMER

SEQ ID NO: 749456 - protein, 399 aa, Homo sapiens
MTRVPCAVPMPNKFGLNSQVKYYNAESYEVERYREAIIKYQGLEWKSSASLVLLNQTQNLVIGLGLLAGSLLCAYFVTEQKLQVGDYVLFGTYIIQLYMPLNWFGTYYRMIQTNFIDMENMFDLLKEETEVKDLPGAGPLRFQKGRIEFENVHFSYADGRETLQDVSFTVMPGQTLALVGPSGAGKSTILRLLFRFYDISSGCIRIDGQDISQVTQASLRSHIGVVPQDTVLFNDTIADNIRYGRVTAGNDEVEAAAQAAGIHDAIMAFPEGYRTQVGERGLKLSGGEKQRVAIARTILKAPGIILLDEATSALDTSNERAIQASLAKVCANRTTIVVAHRLSTVVNADQILVIKDGCIVERGRHEALLSRGGVYADMWQLQQGQEETSEDTKPQTMER

SEQ ID NO: 749457 - protein, 565 aa, Homo sapiens
MVTVGNYCEAEGPVGPAWMQDGLSPCFFFTLVPSTRMALGTLALVLALPCRRRERPAGADSLSWGAGPRISPYVLQLLLATLQAALPLAGLAGRVGTARGAPLPSYLLLASVLESLAGACGLWLLVVERSQARQRLAMGIWIKFRHSPGLLLLWTVAFAAENLALVSWNSPQWWWARADLGQQVQFSLWVLRYVVSGGLFVLGLWAPGLRPQSYTLQVHEEDQDVERSQVRSAAQQSTWRDFGRKLRLLSGYLWPRGSPALQLVVLICLGLMGLERALNVLVPIFYRNIVNLLTEKAPWNSLAWTVTSYVFLKFLQGGGTGSTGFVSNLRTFLWIRVQQFTSRRVELLIFSHLHELSLRWHLGRRTGEVLRIADRGTSSVTGLLSYLVFNVIPTLADIIIGIIYFSMFFNAWFGLIVFLCMSLYLTLTIVVTEWRTKFRRAMNTQENATRARAVDSLLNFETVKYYNAESYEVERYREAIIKYQGLEWKSSASLVLLNQTQNLVIGLGLLAGSLLCAYFVTEQKLQVGDYVLFGTYIIQLYMPLNWFGTYYRMIRPLLDMRLFDC

SEQ ID NO: 749458 - protein, 462 aa, Homo sapiens
MVTVGNYCEAEGPVGPAWMQDGLSPCFFFTLVPSTRMALGTLALVLALPCRRRERPAGADSLSWGAGPRISPYVLQLLLATLQAALPLAGLAGRVGTARGAPLPSYLLLASVLESLAGACGLWLLVVERSQARQRLAMGIWIKFRHSPGLLLLWTVAFAAENLALVSWNSPQWWWARADLGQQVQFSLWVLRYVVSGGLFVLGLWAPGLRPQSYTLQVHEEDQDVERSQVRSAAQQSTWRDFGRKLRLLSGYLWPRGSPALQLVVLICLGLMGLERALNVLVPIFYRNIVNLLTEKAPWNSLAWTVTSYVFLKFLQGGGTGSTGFVSNLRTFLWIRVQQFTSRRVELLIFSHLHELSLRWHLGRRTGEVLRIADRGTSSVTGLLSYLVFNVIPTLADIIIGIIYFSMFFNAWFGLIVFLCMSLYLTLTIVVTEWRTKFRRAMNTQENATRARAVDSLLNFET

SEQ ID NO: 749459 - protein, 302 aa, Homo sapiens
MPMGEAFLLLPLLFRSFAHCLPASQCSESLLLEKSLGRGGAGPTSSSGDGRCLLSNPTFPCRRETLQDVSFTVMPGQTLALVGPSGAGKSTILRLLFRFYDISSGCIRIDGQDISQVTQASLRSHIGVVPQDTVLFNDTIADNIRYGRVTAGNDEVEAAAQAAGIHDAIMAFPEGYRTQVGERGLKLSGGEKQRVAIARTILKAPGIILLDEATSALDTSNERAIQASLAKVCANRTTIVVAHRLSTVVNADQILVIKDGCIVERGRHEALLSRGGVYADMWQLQQGQEETSEDTKPQTMER

SEQ ID NO: 749460 - protein, 514 aa, Homo sapiens
MDLANHGLILLQQLNAQREFGFLCDCTVAIGDVYFKAHKSVLASFSNYFKMLFVHQTSECVRLKPTDIQPDIFSYLLHLMYTGKMAPQLIDPVRLEQGIKFLHAYPLIQEASLASQGAFSHPDQVFPLASSLYGIQIADHQLRQATKIASAPEKLGRDPRPQTSRISQEQVPEASQLSQLTSNLAQVNRTNMTPSDPLQTSLSPELVSTPVPPPPPGEETNLEASSSDEQPASLTIAHVKPSIMKRNGSFPKYYACHLCGRRFTLRSSLREHLQIHTGVPFTSSQQGESRVPLTLCSNAADLGKDAMEVPEAGMISDSELQHISDSPIIDGQQQSETPPPSDIADIDNLEQADQEREVKRRKYECTICGRKFIQKSHWREHMYIHTGKPFKCSTCDKSFCRANQAARHVCLNQSIDTYTMVDKQTLELCTFEEGSQMDNMLVQTNKPYKCNLCDKTFSTPNEVVKHSCQNQNSDVFALDEGRSILLGSGDSEVTEPDHPVLASIKKEQETVLLD

SEQ ID NO: 749461 - protein, 514 aa, Homo sapiens; identical to SEQ ID NO: 749460

SEQ ID NO: 749462 - protein, 232 aa, Homo sapiens
MPSLWDRFSSSSTSSSPSSLPRTPTPDRPPRSAWGSATREEGFDRSTSLESSDCESLDSSNSGFGPEEDTAYLDGVSLPDFELLSDPEDEHLCANLMQLLQESLAQARLGSRRPARLLMPSQLVSQVGKELLRLAYSEPCGLRGALLDVCVEQGKSCHSVGQLALDPSLVPTFQLTLVLRLDSRLWPKIQGLFSSANSPFLPGFSQSLTLSTGFRVIKKKLYSSEQLLIEEC

SEQ ID NO: 749463 - protein, 148 aa, Homo sapiens
MPSLWDRFSSSSTSSSPSSLPRTPTPDRPPRSAWGSATREEGFDRSTSLESSDCESLDSSNSGFGPEEDTAYLDGVSLPDFELLSDPEDEHLCANLMQLLQESLAQARLGSRRPARLLMPSQSGKNMAGYTSVARGCEFVTKSTGTDH

SEQ ID NO: 749464 - protein, 232 aa, Homo sapiens; identical to SEQ ID NO: 749462

SEQ ID NO: 749465 - protein, 232 aa, Homo sapiens; identical to SEQ ID NO: 749462

SEQ ID NO: 749466 - protein, 232 aa, Homo sapiens; identical to SEQ ID NO: 749462

SEQ ID NO: 749467 - protein, 232 aa, Homo sapiens; identical to SEQ ID NO: 749462

SEQ ID NO: 749468 - protein, 232 aa, Homo sapiens; identical to SEQ ID NO: 749462

SEQ ID NO: 749469 - protein, 232 aa, Homo sapiens; identical to SEQ ID NO: 749462

SEQ ID NO: 749470 - protein, 136 aa, Homo sapiens
MQLLQESLAQARLGSRRPARLLMPSQLVSQVGKELLRLAYSEPCGLRGALLDVCVEQGKSCHSVGQLALDPSLVPTFQLTLVLRLDSRLWPKIQGLFSSANSPFLPGFSQSLTLSTGFRVIKKKLYSSEQLLIEEC

SEQ ID NO: 749471 - protein, 106 aa, Homo sapiens
MRAFWGSMEAGPGRCHRAGENVAYVRPESIGQGGPHSRVWIGSWRREGVASPRYVLIGCSALVLGGSRPRGRCERGPGTGLGGSRWLARVRTPIQAAGRTCLSSSR

SEQ ID NO: 749472 - protein, 119 aa, Homo sapiens
MPSLWDRFSSSSTSSSPSSLPRTPTPDRPPRSAWGSATREEGFDRSTSLESSDCESLDSSNSGFGPEEDTAYLDGVSLPDFELLSDPEAGFSQSLTLSTGFRVIKKKLYSSEQLLIEEC

SEQ ID NO: 749473 - protein, 106 aa, Homo sapiens; identical to SEQ ID NO: 749471

SEQ ID NO: 749474 - protein, 116 aa, Homo sapiens
RERERERERERERERERESPQYCSMKQRLRGQQGFQLDVCVACTLLFLLLTVNSGVTSREQLGCSRPSPAQGEGRGTCSSEQPEGGGRSEVVEVVCVSYWSEGTKCVCCLFCILFF

SEQ ID NO: 749475 - protein, 189 aa, Homo sapiens
MPSLWDRFSSSSTSSSPSSLPRTPTPDRPPRSAWGSATREEGFDRSTSLESSDCESLDSSNSGFGPEEDTAYLDGVSLPDFELLSDPEDEHLCANLMQLLQESLAQARLGSRRPARLLMPSQLVSQVGKELLRLAYSEPCGPFSSSQYLPHFPSFTLPHPFSHPSYPLSSPLLTTLSQYPFFYLLQPPV

SEQ ID NO: 749476 - protein, 232 aa, Homo sapiens; identical to SEQ ID NO: 749462

SEQ ID NO: 749477 - protein, 232 aa, Homo sapiens; identical to SEQ ID NO: 749462

SEQ ID NO: 749478 - protein, 232 aa, Homo sapiens; identical to SEQ ID NO: 749462

SEQ ID NO: 749479 - protein, 232 aa, Homo sapiens; identical to SEQ ID NO: 749462

SEQ ID NO: 749480 - protein, 136 aa, Homo sapiens; identical to SEQ ID NO: 749470

SEQ ID NO: 749481 - protein, 229 aa, Homo sapiens
MYQRTSGRVRTRKSLARDRACERQTCEVVGKIGEGGGLDQDRQSLEEHERGDPWRGGTVGCGPEEDTAYLDGVSLPDFELLSDPEDEHLCANLMQLLQESLAQARLGSRRPARLLMPSQLVSQVGKELLRLAYSEPCGLRGALLDVCVEQGKSCHSVGQLALDPSLVPTFQLTLVLRLDSRLWPKIQGLFSSANSPFLPGFSQSLTLSTGFRVIKKKLYSSEQLLIEEC

SEQ ID NO: 749482 - protein, 106 aa, Homo sapiens; identical to SEQ ID NO: 749471

SEQ ID NO: 749483 - protein, 170 aa, Homo sapiens
MEDPNPEENMKQQDSPKERSPQSPGGNICHLGAPKCTRCLITFADSKFQERHMKREHPADFVAQKLQGVLFICFTCARSFPSSKALITHQRSHGPAAKPTLPVATTTAQPTFPCPDCGKTFGQAVSLRRHRQMHEVRAPPGTFACTECGQDFAQEAGLHQHYIRHARGEL

SEQ ID NO: 749484 - protein, 170 aa, Homo sapiens; identical to SEQ ID NO: 749483

SEQ ID NO: 749485 - protein, 170 aa, Homo sapiens; identical to SEQ ID NO: 749483

SEQ ID NO: 749486 - protein, 170 aa, Homo sapiens; identical to SEQ ID NO: 749483

SEQ ID NO: 749487 - protein, 170 aa, Homo sapiens; identical to SEQ ID NO: 749483

SEQ ID NO: 749488 - protein, 124 aa, Homo sapiens [sequence omitted]

SEQ ID NO: 749489 - protein, 124 aa, Homo sapiens [sequence omitted]

SEQ ID NO: 749490 - protein, 119 aa, Homo sapiens
MSTVGLFHFPTPLTRICPAPWGLRLWEKLTLLSPGIAVTPVQMAGKKDYPALLSLDENELEEQFVKGHGPGGQATNKTSNCVVLKHIPSGIVVKVDHRRPLRGEAPPKGSTASRDFSQV

SEQ ID NO: 749491 - protein, 124 aa, Homo sapiens [sequence omitted]

SEQ ID NO: 749492 - protein, 119 aa, Homo sapiens; identical to SEQ ID NO: 749490

SEQ ID NO: 749493 - protein, 728 aa, Homo sapiens
MCLQKHENHFYIANLIEFYHEHKLSVRLVCGAGSVRQAHTLMCAFSINIFGRLPTFSLQTCHKSFLLTEECDYCSIRAIMPAEEALDSLQTLMEVGHISQAGGMLARSRSTLKGHVESRSHFMFPLGEKLKPMDAVICLTAKKEPRIVSRSSRVLISGMFPWLHGISQFDIVGAEKCHMASKEINPCTFKCFPRFSDASTLAELITSCISREVLWGNSLDFWQVMNGWISFIYSYIVIQFFEIQSYPKVVVKVKHIKKVFVFSSPTNSSQSHSNCDYNFWNLYHFLALYGVIIYGIFNNFVAELITSGLHFFHVSLKKLPLSTRIGEMTFLHYNTLYIRFFLIIFSRQGFKLTEVLIRNMLKLLNNMKTTLYFNFQTLFSYLKILTSCEILIFEGERKNTFVVEIFPQQFCLTSKFFLSYLPCLLPKSELHIPVVRRMNGFKFSNHYFGPMLAVETIKFLTLSCFRMILDCEHKINPFCQHRIEHRMEQGLHSQPVAVLMLGLNCSINSLKRPTASKELLIIRCPKFRNPKSGKEGNSDNDFNFFKSLQDFSQRKHLKMVEKVVQIINYFTEGLKARENKEQNDSEYLDIKFASEMSKICQYEIFEIKFRFTCIVHSSRNNAYSCKKKNIYIYMYQQVECGSSNFVVKADNRDMILSSYKILYYFSYSKQYINDSQQLRLLPDIKASSIFTADDRRLSKTCRGPLHPNLSACSHTHTHTHTHTHIFGF

SEQ ID NO: 749494 - protein, 728 aa, Homo sapiens; identical to SEQ ID NO: 749493

SEQ ID NO: 749495 - protein, 202 aa, Homo sapiens
RTEQKNPLGLDDLGIQNLGQTVSLAPAVEAASMLKMEPLNSTHPGTAASSSPLESRAAGGGSGNGNEYFYILVVMSFYGIFLIGIMLGYMKSKRREKKSSLLLLYKDEERLWGEAMKPLPVVSGLRSVQVPLMLNMLQESVAPALSCTLCSMEGDSVSSESSSPDVHLTIQEEGADEELEETSETPLNESSEGSSENIHQNS

SEQ ID NO: 749496 - protein, 76 aa, Homo sapiens
AGQSRRTLLDWTIWEFKTWDKLSALLQRQSGSHSTLLPQCRELPRLMTPEGKPWRFSFSLRFQGFRGNRAASVFSH

SEQ ID NO: 749497 - protein, 481 aa, Homo sapiens [sequence omitted]

SEQ ID NO: 749498 - protein, 103 aa, Homo sapiens [sequence omitted]

SEQ ID NO: 749499 - protein, 339 aa, Homo sapiens
MYDAERGWSLSFAGCGFLGFYHVGATRCLSEHAPHLLRDARMLFGASAGALHCVGVLSGIPLEQTLQVLSDLVRKARSRNIGIFHPSFNLSKFLRQGLCKCLPANVHQLISGKIGISLTRVSDGENVLVSDFRSKDEVVDALVCSCFMPFYSGLIPPSFRGVRYVDGGVSDNVPFIDAKTTITVSPFYGEYDICPKVKSTNFLHVDITKLSLRLCTGNLYLLSRAFVPPDLKVLGEICLRGYLDAFRFLEEKGICNRPQPGLKSSSEGMDPEVAMPSWANMSLDSSPESAALAVRLEGDELLDHLRLSILPWDESILDTLSPRLATAMILEMDMSFQGK

SEQ ID NO: 749500 - protein, 144 aa, Homo sapiens
SCFKAPYPFLRVTNTCARSLPFPSSPCIWLITGQLPASLQFGRWVGNDHHSHVRLMGLFSVPFTGICNRPQPGLKSSSEGMDPEVAMPSWANMSLDSSPESAALAVRLEGDELLDHLRLSILPWDESILDTLSPRLATGTHSSG

SEQ ID NO: 749501 - protein, 162 aa, Homo sapiens
MADEKDREEIIVAEFHKKIKEAFEVFDHESNNTVDVREIGTIIRSLGCCPTEGELHDLIAEVEEEEPTGYIRFEKFLPVMTEILLERKYRPIPEDVLLRAFEVLDSAKRGFLTKDELIKYMTEEGEPFSQEEMEEMLSAAIDPESNSINYKDYITMMVIDEN

SEQ ID NO: 749502 - protein, 162 aa, Homo sapiens; identical to SEQ ID NO: 749501

SEQ ID NO: 749503 - protein, 172 aa, Homo sapiens
MEGGRRDHHTMTVLWGTQEIIVAEFHKKIKEAFEVFDHESNNTVDVREIGTIIRSLGCCPTEGELHDLIAEVEEEEPTGYIRFEKFLPVMTEILLERKYRPIPEDVLLRAFEVLDSAKRGFLTKDELIKYMTEEGEPFSQEEMEEMLSAAIDPESNSINYKDYITMMVIDEN

SEQ ID NO: 749504 - protein, 115 aa, Homo sapiens
MTEILLERKYRPIPEDVLLRAFEVLDSAKRGFLTKDELIKYMTEEDGVSLRPQAEVQWRDLGSLQPPPPGFKRFSCLSLLSSWDDRHTPPRLANFCIFSRDGVSPWSGDLLVSNS

SEQ ID NO: 749505 - protein, 175 aa, Homo sapiens
MADEKDREEIIVAEFHKKIKEAFEVFDHESNNTVDVREIGTIIRSLGCCPTEGELHDLIAEEEKPGVIRALVFQVEEEEPTGYIRFEKFLPVMTEILLERKYRPIPEDVLLRAFEVLDSAKRGFLTKDELIKYMTEEGEPFSQEEMEEMLSAAIDPESNSINYKDYITMMVIDEN

SEQ ID NO: 749506 - protein, 135 aa, Homo sapiens
MADEKDREEIIVAEFHKKIKEAFEVFDHESNNTVDVREIGTIIRSLGCCPTEGELHDLIAEVEEEEPTGYIRFEKFLPVMTEILLERKYRPIPEDVLLRAFEVLDSAKRGFLTKDELIKYMTEEETGKLRWGAVK

SEQ ID NO: 749507 - protein, 144 aa, Homo sapiens
MADEKDREEIIVAEFHKKIKEAFEVFDHESNNTVDVREIGTIIRSLGCCPTEGELHDLIAEVEEEEPTGYIRFEKFLPVMTEILLERKYRPIPEDVLLRAFEVLDSAKRGFLTKDELIKYMTEEGGVVITPILETGKLRWGAVK

SEQ ID NO: 749508 - protein, 702 aa, Homo sapiens
MIPVKHKKNYCTLIFFMKLNDFENTIKNRGEGLARWLMLVIPALWKAEVVDNLRSRVQDQPGQHDETLSLLKIQKLAGRVARACNSSYLERLRQETRLNLGVGGCSENEIAPLHSSLSEEAKSVSQKQNKTNRIEGRCVLKNHTHENLIISTTGKRWSRSKRKVKCKLKVLLDLGRGCLNTDELELIVFLKINFKYVKVSTIFKGNCKISDFTQHTFIISWFLRMKNSDMAELGPLLQDLCMAAVKMEPGLGSQGWSQGDGQGWASSLSEEGHAFQAHVVVGIWFPPADGLRALVGSCPSAEGHLQFVSTCTSSTWPLPSSKHVNQEGSGESNKTAVTTLCSVIMEVTSRGLCWILMVRRKSQVSSTLRSRGTLKGVSTRRLGSLGAVLELTHYHSSFIIRPVRQGRLGHTPELYKSSSSLPMVDKVSCSYASVPGVRCSHIINHCLLNEHELLQIKAVLKKQFGAINRLFLICIVKWVWQFCILKGQNVMPGKIKQELKHSRTKFSTGCPCVCLSHLDCCHSPAIRSNLHLSHISLLRSKYSTVLPFKCPLLKEKNVFGVHIFTTILAINFKICVQMGGDCIMLGCSENVFKMTGLRIDSLTLLLFFQSSFRKTMSESQEVWILVPVPQPMAEWPWQVTQSAPVFLSVECWAWMNSKFKDLSLCSVLSGDHEWMLSVDALVLFTVLVQLPPTVRKMSPSGL

SEQ ID NO: 749509 - protein, 144 aa, Homo sapiens
MVTTEVAGEPPGQGRKWAAHGTMAAPRVHTDYHPGGGSACSSVKVRSHVGHTGVFFFVDQDPLAVSLTSQSLIPPLIKPGLLKAWGFLLLCAQPSANGHSLCCLLYTDLVSSHELSPFRALCLGPSDAPSACASCNCLASTYYL

SEQ ID NO: 749510 - protein, 290 aa, Homo sapiens
MEAAAEPGNLAGVRHIILVLSGKGGVGKSTISTELALALRHAGKKVGILDVDLCGPSIPRMLGAQGRAVHQCDRGWAPVFLDREQSISLMSVGFLLEKPDEAVVWRGPKKNALIKQFVSDVAWGELDYLVVDTPPGTSDEHMATIEALRPYQPLGALVVTTPQAVSVGDVRRELTFCRKTGLRVMGIVENMSGFTCPHCTECTSVFSRGGGEELAQLAGVPFLGSVPLDPALMRTLEEGHDFIQEFPGSRLCWIPHRQKFGATRWLPDMDSETFRHRLAPKKNAADGPRA

SEQ ID NO: 749511 - protein, 271 aa, Homo sapiens
MEAAAEPGNLAGVRHIILVLSGKGGVGKSTISTELALALRHAGKKVGILDVDLCGPSIPRMLGAQGRAVHQCDRGWAPVFLDREQSISLMSVGFLLEKPDEAVVWRGPKKNALIKQFVSDVAWGELDYLVVDTPPGTSDEHMATIEALRPYQPLGALVVTTPQAVSVGDVRRELTFCRKTGLRVMGIVENMSGFTCPHCTECTSVFSRGGGEELAQLAGVPFLGSVPLDPALMRTLEEGHDFIQEFPGSPAFAALTSIAQKILDATPACLP

SEQ ID NO: 749512 - protein, 271 aa, Homo sapiens; identical to SEQ ID NO: 749511

SEQ ID NO: 749513 - protein, 271 aa, Homo sapiens; identical to SEQ ID NO: 749511

SEQ ID NO: 749514 - protein, 271 aa, Homo sapiens; identical to SEQ ID NO: 749511

SEQ ID NO: 749515 - protein, 271 aa, Homo sapiens; identical to SEQ ID NO: 749511

SEQ ID NO: 749516 - protein, 359 aa, Homo sapiens
MEAAAGVWGWGCLFRVPWRRPQAASVGLRTRLHARFSGRLWTWEPLNVPLRGGSEGGRFYASCVEPLTCTLQGPVGDGAACWRQGAWPQRWRREPGNLAGVRHIILVLSGKGGVGKSTISTELALALRHAGKKVGILDVDLCGPSIPRMLGAQGRAVHQCDRGWAPVFLDREQSISLMSVGFLLEKPDEAVVWRGPKKNALIKQFVSDVAWGELDYLVVDTPPGTSDEHMATIEALRPYQPLGALVVTTPQAVSVGDVRRELTFCRKTGLRVMGIVENMSGFTCPHCTECTSVFSRGGGEELAQLAGVPFLGSVPLDPALMRTLEEGHDFIQEFPGSPAFAALTSIAQKILDATPACLP

SEQ ID NO: 749517 - protein, 292 aa, Homo sapiens
MKVRRTPESHMLLSSLWKWRSQCSEKEPGNLAGVRHIILVLSGKGGVGKSTISTELALALRHAGKKVGILDVDLCGPSIPRMLGAQGRAVHQCDRGWAPVFLDREQSISLMSVGFLLEKPDEAVVWRGPKKNALIKQFVSDVAWGELDYLVVDTPPGTSDEHMATIEALRPYQPLGALVVTTPQAVSVGDVRRELTFCRKTGLRVMGIVENMSGFTCPHCTECTSVFSRGGGEELAQLAGVPFLGSVPLDPALMRTLEEGHDFIQEFPGSPAFAALTSIAQKILDATPACLP

SEQ ID NO: 749518 - protein, 237 aa, Homo sapiens [sequence omitted]

SEQ ID NO: 749519 - protein, 255 aa, Homo sapiens
MVRPGVKSDEEEEPRAGTHCPLVGRPFALAGRLTARGRKRTAAASSWRRRDGGGGRAWKPGRRQAHHPGPLRKGGRWEKHHLHGAGPGTAPCRQEALIKQFVSDVAWGELDYLVVDTPPGTSDEHMATIEALRPYQPLGALVVTTPQAVSVGDVRRELTFCRKTGLRVMGIVENMSGFTCPHCTECTSVFSRGGGEELAQLAGVPFLGSVPLDPALMRTLEEGHDFIQEFPGSPAFAALTSIAQKILDATPACLP

SEQ ID NO: 749520 - protein, 269 aa, Homo sapiens
MEAAAEPGNLAGVRHIILVLSGKGGVGKSTISTELALALRHAGKKVGILDVDLCGPSIPRMLGAQGRAVHQCDRGWAPVFLDREQSISLMSVGFLLEKPDEAVVWRGPKKNALIKQFVSDVAWGELDYLVVDTPPGTSDEHMATIEALRPYQPLGALVVTTPQAVSVGDVRRELTFCRKTGLRVMGIVENMSGFTCPHCTECTSVFSRGGGEELAQLAGVPFLGSVPLDPALMRTLEEGHDFIQEFPGSPAFAALTSIAQKILDEGRCS

SEQ ID NO: 749521 - protein, 214 aa, Homo sapiens
MILPLWPLRVLGLLAAWKPGRRQAHHPGPLRKGGRWEKHHLHGAGPGTAPCRQEALIKQFVSDVAWGELDYLVVDTPPGTSDEHMATIEALRPYQPLGALVVTTPQAVSVGDVRRELTFCRKTGLRVMGIVENMSGFTCPHCTECTSVFSRGGGEELAQLAGVPFLGSVPLDPALMRTLEEGHDFIQEFPGSPAFAALTSIAQKILDATPACLP

SEQ ID NO: 749522 - protein, 218 aa, Homo sapiens
PEEKPGKACPYYQDGFTTKAWKPGRRQAHHPGPLRKGGRWEKHHLHGAGPGTAPCRQEALIKQFVSDVAWGELDYLVVDTPPGTSDEHMATIEALRPYQPLGALVVTTPQAVSVGDVRRELTFCRKTGLRVMGIVENMSGFTCPHCTECTSVFSRGGGEELAQLAGVPFLGSVPLDPALMRTLEEGHDFIQEFPGSPAFAALTSIAQKILDATPACLP

SEQ ID NO: 749523 - protein, 347 aa, Homo sapiens
MVRPGVKSDEEEEPRAGTHCPLVGRPFALAGRLTARGRKRTAAASSWRRRDGGGGRAWKPGRRQAHHPGPLRKGGRWEKHHLHGAGPGTAPCRQEALIKQFVSDVAWGELDYLVVDTPPGTSDEHMATIEALRPYQPLGALVVTTPQAVSVGDVRRELTFCRKTGLRVMGIVENMSGFTCPHCTGRRRGAGPARRGALLRLRAPGPCAHEDPGGGPRLHPGVPREPRLRCTHLHSPEDSGRDARVPPLTKATLQPLSRATKGSAPASQRNRGLGSVPGPCRGRPRQRQRESFSPTSPAPGCVAPAALPGWPAVPWSACSAAVRRGRPGLSSHPCCLPVPLAAACPHS

SEQ ID NO: 749524 - protein, 215 aa, Homo sapiens
PVLNRHSGGGGWRRRRAWKPGRRQAHHPGPLRKGGRWEKHHLHGAGPGTAPCRQEALIKQFVSDVAWGELDYLVVDTPPGTSDEHMATIEALRPYQPLGALVVTTPQAVSVGDVRRELTFCRKTGLRVMGIVENMSGFTCPHCTECTSVFSRGGGEELAQLAGVPFLGSVPLDPALMRTLEEGHDFIQEFPGSPAFAALTSIAQKILDATPACLP

SEQ ID NO: 749525 - protein, 172 aa, Homo sapiens
MQARRLCRSLQVGILDVDLCGPSIPRMLGAQGRAVHQCDRGWAPVFLDREQSISLMSVGFLLEKPDEAVVWRGPKKNALIKQFVSDVAWGELDYLVVDTPPGTSDEHMATIEALRPYQPLGALVVTTPQAVSVGDVRRELTFCRKTGLRVMGIVENMSGFTCPHCTVSPGGC

SEQ ID NO: 749526 - protein, 210 aa, Homo sapiens
MEAAAGVWGWGCLFRVPWRRPQAASVGLRTRLHARFSGRLWTWEPLNVPLRGGSEGGRFYASCVEPLTCTLQGPVGDGAACWRQGAWPQRWRREPGNLAGVRHIILVLSGKGGVGKSTISTELALALRHAGKKVGILDVDLCGPSIPRMLGAQGRAVHQCDRGWAPVFLDREQSISLMSVGFLLEKPDEAVVWRGPKKNGNGRAARPPSW

SEQ ID NO: 749527 - protein, 159 aa, Homo sapiens [sequence omitted]

SEQ ID NO: 749528 - protein, 176 aa, Homo sapiens
MEAAAEPGNLAGVRHIILVLSGKGGVGKSTISTELALALRHAGKKVSALPLTGRSPGQLPASPWRPGGAPGLGCAAPCRWESWMWTCVAPVYPACSGRRAGLCIHHGECGCSHVWVQTPGGSWLRVLIWGLGESAGALWAGARHCRKGRCNGPGPIFALLQRARASREPVMEAGGK

SEQ ID NO: 749529 - protein, 158 aa, Homo sapiens
HGATASTVPCRLRAPGPCAHEDPGGGPRLHPGVPREPRLRCTHLHSPEDSGRDARVPPLTKATLQPLSRATKGSAPASQRNRGLGSVPGPCRGRPRQRQRESFSPTSPAPGCVAPAALPGWPAVPWSACSAAVRRGRPGLSSHPCCLPVPLAAACPHS

SEQ ID NO: 749530 - protein, 106 aa, Homo sapiens [sequence omitted]

SEQ ID NO: 749531 - protein, 106 aa, Homo sapiens [sequence omitted]

SEQ ID NO: 749532 - protein, 103 aa, Homo sapiens
QKPPPPSSLPCLPQAEQLLLGTHLHESTSSPPTPPSCLRRAQGMCSMKPVAWGLQVQASEKPTSLVQPSPQVAYHRATFSLLLFLSPSWFWAGGGLDRTPSCR

SEQ ID NO: 749533 - protein, 90 aa, Homo sapiens
ENNCHRGNYSLPELQQDEGFGELIPLSPSTTDQLLLPMGQPQTEARKQVTLSNAICRGQPSREQSRAVKSGEWIGWGKQNNQNHHGQKNG

SEQ ID NO: 749534 - protein, 116 aa, Homo sapiens
PTLYVWFNNGYWQQCPSSLGQLQIRGIQGGPSEEGGNISGSLGLKAPYHCKRPTPLQCPTPIPQTRPFLGESVPLKPNSRLKVCDDPSTFLFIHCPWNSSSKMRIPSPEQFLVINL

SEQ ID NO: 749535 - protein, 159 aa, Homo sapiens
MRNARSIRPARAESWRLSLCFLNWQDAIISKPHCPAGRTCPTAAASHGPRGAGHSDKDQGRSPKHVVCHVEHKKQCPAEFTDSRGVHNAAASISSQVGFPGHLTARTAAHKREALAVSPTPTLQVNAPGAKLRAPKAPRTPEALGRGPKRAGEWKTGCF

SEQ ID NO: 749536 - protein, 103 aa, Homo sapiens
MSVARGGTLYTKKVAVIQPRFLAERGGMPFSPGRSRRYTIMILRRNRNDTVTLLQVLIPGLVLHEHTFGYDTRTGKNRQTSGLCSGNGPRMNVLTLNLGKRGL

SEQ ID NO: 749537 - protein, 72 aa, Homo sapiens
KGWEDLAAQPGARRALGESEREIRLKSESEGGLTTDRFRSDYSLKGTRHCQENGARGPRAGTGGAGGARQLY

SEQ ID NO: 749538 - protein, 330 aa, Homo sapiens
MEAVAKFDFTASGEDELSFHTGDVLKILSNQEEWFKAELGSQEGYVPKNFIDIQFPKWFHEGLSRHQAENLLMGKEVGFFIIRASQSSPGDFSISVRHEDDVQHFKVMRDNKGNYFLWTEKFPSLNKLVDYYRTNSISRQKQIFLRDRTREDQGHRGNSLDRRSQGGPHLSGAVGEEIRPSMNRKLSDHPPTLPLQQHQHQPQPPQYAPAPQQLQQPPQQRYLQHHHFHQERRGGSLDINDGHCGTGLGSEMNAALMHRRHTDPVQLQAAGRVRWARALYDFEALEDDELGFHSGEVVEVLDSSNPSWWTGRLHNKLGLFPANYVAPMTR

SEQ ID NO: 749539 - protein, 78 aa, Homo sapiens
RHPRSGETTKPRSPPRGLSILSNQEEWFKAELGSQEGYVPKNFIDIQFPNPAWATERDSDSKRNLHLLSEVSLLSETL

SEQ ID NO: 749540 - protein, 330 aa, Homo sapiens; identical to SEQ ID NO: 749538

SEQ ID NO: 749541 - protein, 427 aa, Homo sapiens
DDERRRERLRMAFISCSWHLGIPRMIPGPRSYRFRQLFLQTQALVVCLSLALRPGDIHLPTLLGTADYQEAPSALLPSPWQRGTMTTLFLLPASRYSMEAVAKFDFTASGEDELSFHTGDVLKILSNQEEWFKAELGSQEGYVPKNFIDIQFPKWFHEGLSRHQAENLLMGKEVGFFIIRASQSSPGDFSISVRHEDDVQHFKVMRDNKGNYFLWTEKFPSLNKLVDYYRTNSISRQKQIFLRDRTREDQGHRGNSLDRRSQGGPHLSGAVGEEIRPSMNRKLSDHPPTLPLQQHQHQPQPPQYAPAPQQLQQPPQQRYLQHHHFHQERRGGSLDINDGHCGTGLGSEMNAALMHRRHTDPVQLQAAGRVRWARALYDFEALEDDELGFHSGEVVEVLDSSNPSWWTGRLHNKLGLFPANYVAPMTR

SEQ ID NO: 749542 - protein, 119 aa, Homo sapiens
RTQPGPNSAFPSSPRLETPYGHSCGLSHLTLQAPLISPIPPPSLPTHQEQPYNSFPCCPMETSSLCASEGLPSPCGPPLHPLPVDALAWPASSLRHLSPSWHTPGSAHTSDLPPHPPIP

SEQ ID NO: 749543 - protein, 325 aa, Homo sapiens
MVSPATRKSLPKVKAMDFITSTAILPLLFGCLGVFGLFRLLQWVRGKAYLRNAVVVITGATSGLGKECAKVFYAAGAKLVLCGRNGGALEELIRELTASHATKVQTHKPYLVTFDLTDSGAIVAAAAEILQCFGYVDILVNNAGISYRGTIMDTTVDVDKRVMETNYFGPVALTKALLPSMIKRRQGHIVAISSIQGKMSIPFRSAYAASKHATQAFFDCLRAEMEQYEIEVTVISPGYIHTNLSVNAITADGSRYGVMDTTTAQGRSPVEVAQDVLAAVGKKKKDVILADLLPSLAVYLRTLAPGLFFSLMASRARKERKSKNS

SEQ ID NO: 749544 - protein, 350 aa, Homo sapiens
KLGRGRVLNRQRLSGYRKSLPKVKAMDFITSTAILPLLFGCLGVFGLFRLLQWVRGKAYLRNAVVVITGATSGLGKECAKVFYAAGAKLVLCGRNGGALEELIRELTASHATKVQTHKPYLVTFDLTDSGAIVAAAAEILQCFGYVDILVNNAGISYRGTIMDTTVDVDKRVMETNYFGPVALTKALLPSMIKRRQGHIVAISSIQGKMSIPFRSAYAASKHATQAFFDCLRAEMEQYEIEVTVISPGYIHTNLSVNAITADGSRYGVMDTTQPGEACGGGRCLLWAESKKMCLVNRLLVVFQPGRVFTSGSAKKESNLSATRRGKALGSPGGLEGGRRKLAGANPGGMG

SEQ ID NO: 749545 - protein, 325 aa, Homo sapiens; identical to SEQ ID NO: 749543

SEQ ID NO: 749546 - protein, 174 aa, Homo sapiens [sequence omitted]

SEQ ID NO: 749547 - protein, 297 aa, Homo sapiens
MVSPATRKSLPKVKAMDFITSTAILPLLFGCLGVFGLFRLLQWVRGKAYLRNAVVVITGATSGLGKECAKVFYAAGAKLVLCGRNGGALEELIRELTASHATKVQTHKPYLVTFDLTDSGAIVAAAAEILQCFGYVDILVNNAGISYRGTIMDTTVDVDKRVMETNYFGPVALTKALLPSMIKRRQGHIVAISSIQGKMSIPFRSAYAASKHATQAFFDCLRAEMEQYEIEVTVITQGRSPVEVAQDVLAAVGKKKKDVILADLLPSLAVYLRTLAPGLFFSLMASRARKERKSKNS

SEQ ID NO: 749548 - protein, 148 aa, Homo sapiens
QGLELESTEGDLGFISDERKSLGKSPELCYFVTGVFGFGSSRKSLPKVKAMDFITSTAILPLLFGCLGVFGLFRLLQWVRGKAYLRNAVVVITGATSGLGKGGSWRQCCQGAGVSQPGMRSGPAAQGPPAQMPEAAAEGQIREVGRMA

SEQ ID NO: 749549 - protein, 118 aa, Homo sapiens
MGAAFLCPRASCPRWEARSGGGWSSCTSGAPCTRPPPPAATRIARAALPGPCRYMDPWGFSSFLHGCSFSSCWARCCLPWSLCGGQGLQGKLGRGWELAQAGQAEPQGGPSRTNHGVK

SEQ ID NO: 749550 - protein, 158 aa, Homo sapiens
MPDQISVSEFIAETTEDYNSPTTSSFTTRLHNCRNTVTLLEEALDQDRTALQKVKKSVKAIYNSGQDHVQNEENYAQVLDKFGSNFLSRDNPDLGTAFVKFSTLTKELSTLLKNLLQGLSHNVIFTLDSLLKGDLKGVKGDLKKPFDKAWKDYETKFT

SEQ ID NO: 749551 - protein, 169 aa, Homo sapiens
MPDQISVSEFIAETTEDYNSPTTSSFTTRLHNCRNTVTLLEEALDQDRTALQKVKKSVKAIYNSGQDHVQNEENYAQVLDKFGSNFLSRDNPDLGTAFVKFSTLTKELSTLLKNLLQGLSHNVIFTLDSLLKGDLKGVKGVSVQKFDFHFNLKGLIFFFLFQDHSSTCI

SEQ ID NO: 749552 - protein, 74 aa, Homo sapiens
MTPGSPFGCAPDFSSLLPLLSARDTHASVQVEAYQGREVHREISTLLKKAAALPRKSSRETSFLRTAGSAEQGD

SEQ ID NO: 749553 - protein, 126 aa, Homo sapiens
QHLGKGMAGAAPQPSFRTPACWGAVRIQPPSCDSLPSSLPGDWTVWTRVPVQPGSQSLWHSFIPQKCVCPFTQEHLPSVSNGPCLLGARKPNTIEAPPWRTSPRTGVSWARRQTSSQVNPGAGQEP

SEQ ID NO: 749554 - protein, 544 aa, Homo sapiens
MRVAVAGCCHGELDKIYETLALAERRGPGPVDLLLCCGDFQAVRNEADLRCMAVPPKYRHMQTFYRYYSGEKKAPVLTLFIGGNHEASNHLQELPYGGWVAPNIYYLGLAGVVKYRGVRIGGISGIFKSHDYRKGHFECPPYNSSTIRSIYHVRNIEVYKLKQLKQPIDIFLSHDWPRSIYHYGNKKQLLKTKSFFRQEVENNTLGSPAASELLEHLKPTYWFSAHLHVKFAALMQHQAKDKGQTARATKFLALDKCLPHRDFLQILEIEHDPSAPDYLEYDIEWLTILRATDDLINVTGRLWNMPENNGLHARWDYSATEEGMKEVLEKLNHDLKVPCNFSVTAACYDPSKPQTQMQLIHRINPQTTEFCAQLGIIDINVRLQKSKEEHHVCGEYEEQDDVESNDSGEDQSEYNTDTSALSSINPDEIMLDEEEDEDSIVSAHSGMNTPSVEPSDQASEFSASFSDVRILPGSMIVSSDDTVDSTIDREGKPGGTVESGNGEDLTKVPLKRLSDEHEPEQRKKIKRRNQAIYAAVDDDDDDAA

SEQ ID NO: 749555 - protein, 312 aa, Homo sapiens
MIHIVQAKDKGQTARATKFLALDKCLPHRDFLQILEIEHDPSAPDYLEYDIEWLTILRATDDLINVTGRLWNMPENNGLHARWDYSATEEGMKEVLEKLNHDLKVPCNFSVTAACYDPSKPQTQMQLIHRINPQTTEFCAQLGIIDINVRLQKSKEEHHVCGEYEEQDDVESNDSGEDQSEYNTDTSALSSINPDEIMLDEEEDEDSIVSAHSGMNTPSVEPSDQASEFSASFSDVRILPGSMIVSSDDTVDSTIDREGKPGGTVESGNGEDLTKVPLKRLSDEHEPEQRKKIKRRNQAIYAAVDDDDDDAA

SEQ ID NO: 749556 - protein, 544 aa, Homo sapiens; identical to SEQ ID NO: 749554

SEQ ID NO: 749557 - protein, 507 aa, Homo sapiens
MRRWRWQSGAARGLSTSCCAAATSRRCATRRIYAAWPCRPSIVTCKPSTASNHLQELPYGGWVAPNIYYLGLAGVVKYRGVRIGGISGIFKSHDYRKGHFECPPYNSSTIRSIYHVRNIEVYKLKQLKQPIDIFLSHDWPRSIYHYGNKKQLLKTKSFFRQEVENNTLGSPAASELLEHLKPTYWFSAHLHVKFAALMQHQAKDKGQTARATKFLALDKCLPHRDFLQILEIEHDPSAPDYLEYDIEWLTILRATDDLINVTGRLWNMPENNGLHARWDYSATEEGMKEVLEKLNHDLKVPCNFSVTAACYDPSKPQTQMQLIHRINPQTTEFCAQLGIIDINVRLQKSKEEHHVCGEYEEQDDVESNDSGEDQSEYNTDTSALSSINPDEIMLDEEEDEDSIVSAHSGMNTPSVEPSDQASEFSASFSDVRILPGSMIVSSDDTVDSTIDREGKPGGTVESGNGEDLTKVPLKRLSDEHEPEQRKKIKRRNQAIYAAVDDDDDDAA

SEQ ID NO: 749558 - protein, 544 aa, Homo sapiens; identical to SEQ ID NO: 749554

SEQ ID NO: 749559 - protein, 207 aa, Homo sapiens
ARPKMAEVQVLVLDGRGHLLGRLAAIVAKQVLLGRKVVVVRCEGINISGNFYRNKLKYLAFLRKRMNTNPSRGPYHFRAPSRIFWRTVRGMLPHKTKRGQAALDRLKVFDGIPPPYDKKKRMVVPAALKVVRLKPTRKFAYLGRLAHEVGWKYQAVTATLEEKRKEKAKIHYRKKKQLMRLRKQAEKNVEKKIDKYTEVLKTHGLLV

SEQ ID NO: 749560 - protein, 208 aa, Homo sapiens
NSRPVTAEVQVLVLDGRGHLLGRLAAIVAKQVLLGRKVVVVRCEGINISGNFYRNKLKYLAFLRKRMNTNPSRGPYHFRAPSRIFWRTVRGMLPHKTKRGQAALDRLKVFDGIPPPYDKKKRMVVPAALKVVRLKPTRKFAYLGRLAHEVGWKYQAVTATLEEKRKEKAKIHYRKKKQLMRLRKQAEKNVEKKIDKYTEVLKTHGLLV

SEQ ID NO: 749561 - protein, 222 aa, Homo sapiens
ARPKMAEVQVLVLDGRGHLLGRLAAIVAKQVLLGRKVVVVRCEGINISGNFYRNKLKYLAFLRKRMNTNPSRGPYHFRAPSRIFWRTVRGMLPHKTKRGQAALDRLKVFDGIPPPYDKKKRMVVPAALKVVRLKPTRKFAYLGRLAHEVGWKYQAVLGRLAHEVGWKYQAVTATLEEKRKEKAKIHYRKKKQLMRLRKQAEKNVEKKIDKYTEVLKTHGLLV

SEQ ID NO: 749562 - protein, 143 aa, Homo sapiens
ARPKMAEVQVLVLDGRGHLLGRLAAIVAKQVLLGRKVVVVRCEGINISGNFYRNKLKYLAFLRKRMNTNPSRGPYHFRAPSRIFWRTVRGMLPHKTKRGQAALDRLKVFDGIPPPYDKKKRMVVPAALIWGAWLTRLAGSTRQ

SEQ ID NO: 749563 - protein, 110 aa, Homo sapiens
ARPKMAEVQVLVLDGRGHLLGRLAAIVAKQVLLGRKVVVVRCEGINISGNFYRNKLKYLAFLRKRMNTNPSRGPYHFRAPSRIFWRTVRGMLPHKTKRGQAALDRLRSCV

SEQ ID NO: 749564 - protein, 81 aa, Homo sapiens
VLVLDGRGHLLGRLAAIVAKQVLLGEVAARGPSVMGPRWRSVMSNIHHLSFESHGHEINPMHRSETCQPLFPRVGDSRLKK

SEQ ID NO: 749565 - protein, 74 aa, Homo sapiens
LHSRRRLQKTGSEKGLCPPGLHRGWCGQDRAGYSGQASGRAGAESLHSVESTICRMPGTPDKDVVQAGHGGSHL

SEQ ID NO: 749566 - protein, 244 aa, Homo sapiens
MEESGYESVLCVKPDVHVYRIPPRATNRGYRAAEWQLDQPSWSGRLRITAKGQMAYIKLEDRTSGELFAQAPVDQFPGTAVESVTDSSRYFVIRIEDGNGRRAFIGIGFGDRGDAFDFNVALQDHFKWVKQQCEFAKQAQNPDQGPKLDLGFKEGQTIKLNIANMKKKEGAAGNPRVRPASTGGLSLLPPPPGGKTSTLIPPPGEQLAVGGSLVQPAVAPSSRLNFQADPSQGNKGLGSQVPEP

SEQ ID NO: 749567 - protein, 61 aa, Homo sapiens
MPNIRAQPIILSLTNCCSGRWSLKLSDLPTVTKARNLDFYMKHLDFELLTTNLKADKTQFD

SEQ ID NO: 749568 - protein, 71 aa, Homo sapiens
TLISDVSSYTSEMSCTKCTDGLFCQGAIFLISRNSMIGFRDSYFLQIMEQLSYPCVKLFSHKGELNSPCQI

SEQ ID NO: 749569 - protein, 98 aa, Homo sapiens
MKVSAVLLCLLLMTAAFNPQGLAQPDALNVPSTCCFTFSSKKISLQRLKSYVITTSRCPQKAVIFRTKLGKEICADPKEKWVQNYMKHLGRKAHTLKT

SEQ ID NO: 749570 - protein, 98 aa, Homo sapiens; identical to SEQ ID NO: 749569

SEQ ID NO: 749571 - protein, 48 aa, Homo sapiens
MATTCKMASRPWSSRSVALRAQSAHDTRVCQSRKWAERRTVPAVMAKL

SEQ ID NO: 749572 - protein, 134 aa, Homo sapiens
HPLQRLPPPGRTPGQFTSSLLCPSPLCPSPKCLALPMQDPHRLGPLPGALSGGGDESGGAAGALCVWAGDRGGHPGDGDPWARLLVSGPKAAPPHCFPIGRGSREPGSGGLSTEPGGCGWCPGPMPRSAAWCLT

SEQ ID NO: 749573 - protein, 328 aa, Homo sapiens
HPTAPQVRAFLQPPLKGVVMETFGSGNGPTKPDLLQELRVATERGLVIVNCTHCLQGAVTTDYAAGMAMAGAGVISGFDMTSEAALAKLSYVLGQPGLSLDVRKELLTKDLRGEMTPPSVEERRPSLQGNTLGGGVSWLLSLSGSQEADALRNALVPSLACAAAHAGDVEALQALVELGSDLGLVDFNGQTPLHAAARGGHTEAVTMLLQRGVDVNTRDTDGFSPLLLAVRGRHPGVIGLLREAGASLSTQELEEAGTELCRLAYRADLEGLQVWWQAGADLGQPGYDGHSALHVAEAAGNLAVVAFLQSLEGAVGAQAPCPEVLPGV

SEQ ID NO: 749574 - protein, 250 aa, Homo sapiens
PSQTAWRPEAPLTVARKSSPALHSSSRLLTKDLRGEMTPPSVEERRPSLQGNTLGGGVSWLLSLSGSQEADALRNALVPSLACAAAHAGDVEALQALVELGSDLGLVDFNGQTPLHAAARGGHTEAVTMLLQRGVDVNTRDTDGFSPLLLAVRGRHPGVIGLLREAGASLSTQELEEAGTELCRLAYRADLEGLQVWWQAGADLGQPGYDGHSALHVAEAAGNLAVVAFLQSLEGAVGAQAPCPEVLPGV

SEQ ID NO: 749575 - protein, 218 aa, Homo sapiens
PSQTAWRPEAPLTVARKSSPALHSSSRLLTKDLRGEMTPPSVEERRPSLQGNTLGGGVSWLLSLSGSQGSDLGLVDFNGQTPLHAAARGGHTEAVTMLLQRGVDVNTRDTDGFSPLLLAVRGRHPGVIGLLREAGASLSTQELEEAGTELCRLAYRADLEGLQVWWQAGADLGQPGYDGHSALHVAEAAGNLAVVAFLQSLEGAVGAQAPCPEVLPGV

SEQ ID NO: 749576 - protein, 334 aa, Homo sapiens
HPTAPQVRAFLQPPLKGVVMETFGSGNGPTKPDLLQELRVATERGLVIVNCTHCLQGAVTTDYAAGMAMAGAGVISGFDMTSEAALAKLSYVLGQPGLSLDVRKELLTKDLRGEMTPPSVEERRPSLQGNTLGGGVSWLLSLSGSQEADALRNALVPSLACAAAHAGDVEALQALVELGSDLGLVDFNGQTPLHAAARGGHTEAVTMLLQRGVDVNTRDTDGFSPLLLAVRGRHPGVIGLLREAGASLSTQELEEAGTELCRLAYRADLEGLQVWWQAGADLGQPGYDGHSALHVAEAAGNLAVVAFLQSLEGAVGAQAPCPEPSCFQEVLPGV

SEQ ID NO: 749577 - protein, 310 aa, Homo sapiens
HPTAPQVRAFLQPPLKGVVMETFGSGNGPTKPDLLQELRVATERGLVIVNCTHCLQGAVTTDYAAGMAMAGAGVISGFDMTSEAALAKLSYVLGQPGLSLDVRKELLTKDLRGEMTPPSVEERRPSLQGNTLGGGVSWLLSLSGSQEADALRNALVPSLACAAAHAGDVEALQALVELGSDLGLVDFNGQTPLHAAARGGHTEAVTMLLQRGVDVNTRDTDGFSPLLLAVRGRHPGVIGLLREAGASLSTQELEEAGTELCRQRQPGTWQWWPFYRAWRVRLVPRPHAQKCCLVSNLKASCCSISHSFLP

SEQ ID NO: 749578 - protein, 1466 aa, Homo sapiens
PAGLSSLLSRFLSSRLQLPARVGAMYAVYKQAHPPTGLEFSMYCNFFNNSERNLVVAGTSQLYVYRLNRDAEALTKNDRSTEGKAHREKLELAASFSFFGNVMSMASVQLAGAKRDALLLSFKDAKLSVVEYDPGTHDLKTLSLHYFEEPELRDGFVQNVHTPRVRVDPDGRCAAMLVYGTRLVVLPFRRESLAEEHEGLVGEGQRSSFLPSYIIDVRALDEKLLNIIDLQFLHGYYEPTLLILFEPNQTWPGRVAVRQDTCSIVAISLNITQKVHPVIWSLTSLPFDCTQALAVPKPIGGVVVFAVNSLLYLNQSVPPYGVALNSLTTGTTAFPLRTQEGVRITLDCAQATFISYDKMVISLKGGEIYVLTLITDGMRSVRAFHFDKAAASVLTTSMVTMEPGYLFLGSRLGNSLLLKYTEKLQEPPASAVREAADKEEPPSKKKRVDATAGWSAAGKSVPQDEVDEIEVYGSEAQSGTQLATYSFEVCDSILNIGPCANAAVGEPAFLSEEFQNSPEPDLEIVVCSGHGKNGALSVLQKSIRPQVVTTFELPGCYDMWTVIAPVRKEEEDNPKGEGTEQEPSTTPEADDDGRRHGFLILSREDSTMILQTGQEIMELDTSGFATQGPTVFAGNIGDNRYIVQVSPLGIRLLEGVNQLHFIPVDLGAPIVQCAVADPYVVIMSAEGHVTMFLLKSDSYGGRHHRLALHKPPLHHQSKVITLCLYRDLSGMFTTESRLGGARDELGGRSGPEAEGLGSETSPTVDDEEEMLYGDSGSLFSPSKEEARRSSQPPADRDPAPFRAEPTHWCLLVRENGTMEIYQLPDWRLVFLVKNFPVGQRVLVDSSFGQPTTQGEARREEATRQGELPLVKEVLLVALGSRQSRPYLLVHVDQELLIYEAFPHDSQLGQGNLKVRFKKVPHNINFREKKPKPSKKKAEGGGAEEGAGARGRVARFRYFEDIYGYSGVFICGPSPHWLLVTGRGALRLHPMAIDGPVDSFAPFHNVNCPRGFLYFNRQGELRISVLPAYLSYDAPWPVRKIPLRCTAHYVAYHVESKVYAVATSTNTPCARIPRMTGEEKEFETIERDERYIHPQQEAFSIQLISPVSWEAIPNARIELQEWEHVTCMKTVSLRSEETVSGLKGYVAAGTCLMQGEEVTCRGRILIMDVIEVVPEPGQPLTKNKFKVLYEKEQKGPVTALCHCNGHLVSAIGQKIFLWSLRASELTGMAFIDTQLYIHQMISVKNFILAADVMKSISLLRYQEESKTLSLVSRDAKPLEVYSVDFMVDNAQLGFLVSDRDRNLMVYMYLPEAKESFGGMRLLRRADFHVGAHVNTFWRTPCRATEGLSKKSVVWENKHITWFATLDGGIGLLLPMQEKTYRRLLMLQNALTTMLPHHAGLNPRAFRMLHVDRRTLQNAVRNVLDGELLNRYLYLSTMERSELAKKIGTTPDIILDDLLETDRVTAHF

SEQ ID NO: 749579 - protein, 1489 aa, Homo sapiens
PAGLSSLLSRFLSSRLQLPARVGAMYAVYKQAHPPTGLEFSMYCNFFNNSERNLVVAGTSQLYVYRLNRDAEALTKNDRSTEGKAHREKLELAASFSFFGNVMSMASVQLAGAKRDALLLSFKDAKLSVVEYDPGTHDLKTLSLHYFEEPELRDGFVQNVHTPRVRVDPDGRCAAMLVYGTRLVVLPFRRESLAEEHEGLVGEGQRSSFLPSYIIDVRALDEKLLNIIDLQFLHGYYEPTLLILFEPNQTWPGRVAVRQDTCSIVAISLNITQKVHPVIWSLTSLPFDCTQALAVPKPIGGVVVFAVNSLLYLNQSVPPYGVALNSLTTGTTAFPLRTQEGVRITLDCAQATFISYDKMVISLKGGEIYVLTLITDGMRSVRAFHFDKAAASVLTTSVVGTRGWVWVQTRPSHHTPALPQMVTMEPGYLFLGSRLGNSLLLKYTEKLQEPPASAVREAADKEEPPSKKKRVDATAGWSAAGKSVPQDEVDEIEVYGSEAQSGTQLATYSFEVCDSILNIGPCANAAVGEPAFLSEEFQNSPEPDLEIVVCSGHGKNGALSVLQKSIRPQVVTTFELPGCYDMWTVIAPVRKEEEDNPKGEGTEQEPSTTPEADDDGRRHGFLILSREDSTMILQTGQEIMELDTSGFATQGPTVFAGNIGDNRYIVQVSPLGIRLLEGVNQLHFIPVDLGAPIVQCAVADPYVVIMSAEGHVTMFLLKSDSYGGRHHRLALHKPPLHHQSKVITLCLYRDLSGMFTTESRLGGARDELGGRSGPEAEGLGSETSPTVDDEEEMLYGDSGSLFSPSKEEARRSSQPPADRDPAPFRAEPTHWCLLVRENGTMEIYQLPDWRLVFLVKNFPVGQRVLVDSSFGQPTTQGEARREEATRQGELPLVKEVLLVALGSRQSRPYLLVHVDQELLIYEAFPHDSQLGQGNLKVRFKKVPHNINFREKKPKPSKKKAEGGGAEEGAGARGRVARFRYFEDIYGYSGVFICGPSPHWLLVTGRGALRLHPMAIDGPVDSFAPFHNVNCPRGFLYFNRQGELRISVLPAYLSYDAPWPVRKIPLRCTAHYVAYHVESKVYAVATSTNTPCARIPRMTGEEKEFETIERDERYIHPQQEAFSIQLISPVSWEAIPNARIELQEWEHVTCMKTVSLRSEETVSGLKGYVAAGTCLMQGEEVTCRGRILIMDVIEVVPEPGQPLTKNKFKVLYEKEQKGPVTALCHCNGHLVSAIGQKIFLWSLRASELTGMAFIDTQLYIHQMISVKNFILAADVMKSISLLRYQEESKTLSLVSRDAKPLEVYSVDFMVDNAQLGFLVSDRDRNLMVYMYLPEAKESFGGMRLLRRADFHVGAHVNTFWRTPCRATEGLSKKSVVWENKHITWFATLDGGIGLLLPMQEKTYRRLLMLQNALTTMLPHHAGLNPRAFRMLHVDRRTLQNAVRNVLDGELLNRYLYLSTMERSELAKKIGTTPDIILDDLLETDRVTAHF

SEQ ID NO: 749580 - protein, 424 aa, Homo sapiens
PAGLSSLLSRFLSSRLQLPARVGAMYAVYKQAHPPTGLEFSMYCNFFNNSERNLVVAGTSQLYVYRLNRDAEALTKNDRSTEGKAHREKLELAASFSFFGNVMSMASVQLAGAKRDALLLSFKDAKLSVVEYDPGTHDLKTLSLHYFEEPELRDGFVQNVHTPRVRVDPDGRCAAMLVYGTRLVVLPFRRESLAEEHEGLVGEGQRSSFLPSYIIDVRALDEKLLNIIDLQFLHGYYEPTLLILFEPNQTWPGRVAVRQDTCSIVAISLNITQKVHPVIWSLTSLPFDCTQALAVPKPIGGVVVFAVNSLLYLNQSVPPYGVALNSLTTGTTAFPLRTQEGVRITLDCAQATFISYDKMVISLKGGEIYVLTLITDGMRSVRAFHFDKAAASVLTTSMVTMEPGYLFLGSRLGNSLLLKYNLPW

SEQ ID NO: 749581 - protein, 1505 aa, Homo sapiens
PGRTEFAAVPVPLESAPTARWAAGRAAEAAARGRGGARCGAGLLRGRPRSPFLSRPCAARVGAMYAVYKQAHPPTGLEFSMYCNFFNNSERNLVVAGTSQLYVYRLNRDAEALTKNDRSTEGKAHREKLELAASFSFFGNVMSMASVQLAGAKRDALLLSFKDAKLSVVEYDPGTHDLKTLSLHYFEEPELRDGFVQNVHTPRVRVDPDGRCAAMLVYGTRLVVLPFRRESLAEEHEGLVGEGQRSSFLPSYIIDVRALDEKLLNIIDLQFLHGYYEPTLLILFEPNQTWPGRVAVRQDTCSIVAISLNITQKVHPVIWSLTSLPFDCTQALAVPKPIGGVVVFAVNSLLYLNQSVPPYGVALNSLTTGTTAFPLRTQEGVRITLDCAQATFISYDKMVISLKGGEIYVLTLITDGMRSVRAFHFDKAAASVLTTSMVTMEPGYLFLGSRLGNSLLLKYTEKLQEPPASAVREAADKEEPPSKKKRVDATAGWSAAGKSVPQDEVDEIEVYGSEAQSGTQLATYSFEVCDSILNIGPCANAAVGEPAFLSEEFQNSPEPDLEIVVCSGHGKNGALSVLQKSIRPQVVTTFELPGCYDMWTVIAPVRKEEEDNPKGEGTEQEPSTTPEADDDGRRHGFLILSREDSTMILQTGQEIMELDTSGFATQGPTVFAGNIGDNRYIVQVSPLGIRLLEGVNQLHFIPVDLGAPIVQCAVADPYVVIMSAEGHVTMFLLKSDSYGGRHHRLALHKPPLHHQSKVITLCLYRDLSGMFTTESRLGGARDELGGRSGPEAEGLGSETSPTVDDEEEMLYGDSGSLFSPSKEEARRSSQPPADRDPAPFRAEPTHWCLLVRENGTMEIYQLPDWRLVFLVKNFPVGQRVLVDSSFGQPTTQGEARREEATRQGELPLVKEVLLVALGSRQSRPYLLVHVDQELLIYEAFPHDSQLGQGNLKVRFKKVPHNINFREKKPKPSKKKAEGGGAEEGAGARGRVARFRYFEDIYGYSGVFICGPSPHWLLVTGRGALRLHPMAIDGPVDSFAPFHNVNCPRGFLYFNRQGELRISVLPAYLSYDAPWPVRKIPLRCTAHYVAYHVESKVYAVATSTNTPCARIPRMTGEEKEFETIERDERYIHPQQEAFSIQLISPVSWEAIPNARIELQEWEHVTCMKTVSLRSEETVSGLKGYVAAGTCLMQGEEVTCRGRILIMDVIEVVPEPGQPLTKNKFKVLYEKEQKGPVTALCHCNGHLVSAIGQKIFLWSLRASELTGMAFIDTQLYIHQMISVKNFILAADVMKSISLLRYQEESKTLSLVSRDAKPLEVYSVDFMVDNAQLGFLVSDRDRNLMVYMYLPEAKESFGGMRLLRRADFHVGAHVNTFWRTPCRATEGLSKKSVVWENKHITWFATLDGGIGLLLPMQEKTYRRLLMLQNALTTMLPHHAGLNPRAFRMLHVDRRTLQNAVRNVLDGELLNRYLYLSTMERSELAKKIGTTPDIILDDLLETDRVTAHF

SEQ ID NO: 749582 - protein, 1364 aa, Homo sapiens
MSMASVQLAGAKRDALLLSFKDAKLSVVEYDPGTHDLKTLSLHYFEEPELRDGFVQNVHTPRVRVDPDGRCAAMLVYGTRLVVLPFRRESLAEEHEGLVGEGQRSSFLPSYIIDVRALDEKLLNIIDLQFLHGYYEPTLLILFEPNQTWPGRVAVRQDTCSIVAISLNITQKVHPVIWSLTSLPFDCTQALAVPKPIGGVVVFAVNSLLYLNQSVPPYGVALNSLTTGTTAFPLRTQEGVRITLDCAQATFISYDKMVISLKGGEIYVLTLITDGMRSVRAFHFDKAAASVLTTSMVTMEPGYLFLGSRLGNSLLLKYTEKLQEPPASAVREAADKEEPPSKKKRVDATAGWSAAGKSVPQDEVDEIEVYGSEAQSGTQLATYSFEVCDSILNIGPCANAAVGEPAFLSEEFQNSPEPDLEIVVCSGHGKNGALSVLQKSIRPQVVTTFELPGCYDMWTVIAPVRKEEEDNPKGEGTEQEPSTTPEADDDGRRHGFLILSREDSTMILQTGQEIMELDTSGFATQGPTVFAGNIGDNRYIVQVSPLGIRLLEGVNQLHFIPVDLGAPIVQCAVADPYVVIMSAEGHVTMFLLKSDSYGGRHHRLALHKPPLHHQSKVITLCLYRDLSGMFTTESRLGGARDELGGRSGPEAEGLGSETSPTVDDEEEMLYGDSGSLFSPSKEEARRSSQPPADRDPAPFRAEPTHWCLLVRENGTMEIYQLPDWRLVFLVKNFPVGQRVLVDSSFGQPTTQGEARREEATRQGELPLVKEVLLVALGSRQSRPYLLVHVDQELLIYEAFPHDSQLGQGNLKVRFKKVPHNINFREKKPKPSKKKAEGGGAEEGAGARGRVARFRYFEDIYGYSGVFICGPSPHWLLVTGRGALRLHPMAIDGPVDSFAPFHNVNCPRGFLYFNRQGELRISVLPAYLSYDAPWPVRKIPLRCTAHYVAYHVESKVYAVATSTNTPCARIPRMTGEEKEFETIERDERYIHPQQEAFSIQLISPVSWEAIPNARIELQEWEHVTCMKTVSLRSEETVSGLKGYVAAGTCLMQGEEVTCRGRILIMDVIEVVPEPGQPLTKNKFKVLYEKEQKGPVTALCHCNGHLVSAIGQKIFLWSLRASELTGMAFIDTQLYIHQMISVKNFILAADVMKSISLLRYQEESKTLSLVSRDAKPLEVYSVDFMVDNAQLGFLVSDRDRNLMVYMYLPEAKESFGGMRLLRRADFHVGAHVNTFWRTPCRATEGLSKKSVVWENKHITWFATLDGGIGLLLPMQEKTYRRLLMLQNALTTMLPHHAGLNPRAFRMLHVDRRTLQNAVRNVLDGELLNRYLYLSTMERSELAKKIGTTPDIILDDLLETDRVTAHF

SEQ ID NO: 749583 - protein, 1364 aa, Homo sapiens; identical to SEQ ID NO: 749582

SEQ ID NO: 749584 - protein, 1546 aa, Homo sapiens
PGRTEFAAVPVPLESAPTARWAAGRAAEAAARGRGGARCGAGLLRGRPRSPFLSRPCAARVGAMYAVYKQAHPPTGLEFSMYCNFFNNSERNLVVAGTSQLYVYRLNRDAEHGKFSDGCSCGNLVLRSWNNSTQLCYNTPACHWAHLRRFEEALTKNDRSTEGKAHREKLELAASFSFFGNVMSMASVQLAGAKRDALLLSFKDAKLSVVEYDPGTHDLKTLSLHYFEEPELRDGFVQNVHTPRVRVDPDGRCAAMLVYGTRLVVLPFRRESLAEEHEGLVGEGQRSSFLPSYIIDVRALDEKLLNIIDLQFLHGYYEPTLLILFEPNQTWPGRVAVRQDTCSIVAISLNITQKVHPVIWSLTSLPFDCTQALAVPKPIGGVVVFAVNSLLYLNQSVPPYGVALNSLTTGTTAFPLRTQEGVRITLDCAQATFISYDKMVISLKGGEIYVLTLITDGMRSVRAFHFDKAAASVLTTSMVTMEPGYLFLGSRLGNSLLLKYTEKLQEPPASAVREAADKEEPPSKKKRVDATAGWSAAGKSVPQDEVDEIEVYGSEAQSGTQLATYSFEVCDSILNIGPCANAAVGEPAFLSEEFQNSPEPDLEIVVCSGHGKNGALSVLQKSIRPQVVTTFELPGCYDMWTVIAPVRKEEEDNPKGEGTEQEPSTTPEADDDGRRHGFLILSREDSTMILQTGQEIMELDTSGFATQGPTVFAGNIGDNRYIVQVSPLGIRLLEGVNQLHFIPVDLGAPIVQCAVADPYVVIMSAEGHVTMFLLKSDSYGGRHHRLALHKPPLHHQSKVITLCLYRDLSGMFTTESRLGGARDELGGRSGPEAEGLGSETSPTVDDEEEMLYGDSGSLFSPSKEEARRSSQPPADRDPAPFRAEPTHWCLLVRENGTMEIYQLPDWRLVFLVKNFPVGQRVLVDSSFGQPTTQGEARREEATRQGELPLVKEVLLVALGSRQSRPYLLVHVDQELLIYEAFPHDSQLGQGNLKVRFKKVPHNINFREKKPKPSKKKAEGGGAEEGAGARGRVARFRYFEDIYGYSGVFICGPSPHWLLVTGRGALRLHPMAIDGPVDSFAPFHNVNCPRGFLYFNRQGELRISVLPAYLSYDAPWPVRKIPLRCTAHYVAYHVESKVYAVATSTNTPCARIPRMTGEEKEFETIERDERYIHPQQEAFSIQLISPVSWEAIPNARIELQEWEHVTCMKTVSLRSEETVSGLKGYVAAGTCLMQGEEVTCRGRILIMDVIEVVPEPGQPLTKNKFKVLYEKEQKGPVTALCHCNGHLVSAIGQKIFLWSLRASELTGMAFIDTQLYIHQMISVKNFILAADVMKSISLLRYQEESKTLSLVSRDAKPLEVYSVDFMVDNAQLGFLVSDRDRNLMVYMYLPEAKESFGGMRLLRRADFHVGAHVNTFWRTPCRATEGLSKKSVVWENKHITWFATLDGGIGLLLPMQEKTYRRLLMLQNALTTMLPHHAGLNPRAFRMLHVDRRTLQNAVRNVLDGELLNRYLYLSTMERSELAKKIGTTPDIILDDLLETDRVTAHF

SEQ ID NO: 749585 - protein, 1364 aa, Homo sapiens; identical to SEQ ID NO: 749582

SEQ ID NO: 749586 - protein, 1367 aa, Homo sapiens
SSVPVLLHKQLAGAKRDALLLSFKDAKLSVVEYDPGTHDLKTLSLHYFEEPELRDGFVQNVHTPRVRVDPDGRCAAMLVYGTRLVVLPFRRESLAEEHEGLVGEGQRSSFLPSYIIDVRALDEKLLNIIDLQFLHGYYEPTLLILFEPNQTWPGRVAVRQDTCSIVAISLNITQKVHPVIWSLTSLPFDCTQALAVPKPIGGVVVFAVNSLLYLNQSVPPYGVALNSLTTGTTAFPLRTQEGVRITLDCAQATFISYDKMVISLKGGEIYVLTLITDGMRSVRAFHFDKAAASVLTTSMVTMEPGYLFLGSRLGNSLLLKYTEKLQEPPASAVREAADKEEPPSKKKRVDATAGWSAAGKSVPQDEVDEIEVYGSEAQSGTQLATYSFEVCDSILNIGPCANAAVGEPAFLSEEFQNSPEPDLEIVVCSGHGKNGALSVLQKSIRPQVVTTFELPGCYDMWTVIAPVRKEEEDNPKGEGTEQEPSTTPEADDDGRRHGFLILSREDSTMILQTGQEIMELDTSGFATQGPTVFAGNIGDNRYIVQVSPLGIRLLEGVNQLHFIPVDLGAPIVQCAVADPYVVIMSAEGHVTMFLLKSDSYGGRHHRLALHKPPLHHQSKVITLCLYRDLSGMFTTESRLGGARDELGGRSGPEAEGLGSETSPTVDDEEEMLYGDSGSLFSPSKEEARRSSQPPADRDPAPFRAEPTHWCLLVRENGTMEIYQLPDWRLVFLVKNFPVGQRVLVDSSFGQPTTQGEARREEATRQGELPLVKEVLLVALGSRQSRPYLLVHVDQELLIYEAFPHDSQLGQGNLKVRFKKVPHNINFREKKPKPSKKKAEGGGAEEGAGARGRVARFRYFEDIYGYSGVFICGPSPHWLLVTGRGALRLHPMAIDGPVDSFAPFHNVNCPRGFLYFNRQGELRISVLPAYLSYDAPWPVRKIPLRCTAHYVAYHVESKVYAVATSTNTPCARIPRMTGEEKEFETIERDERYIHPQQEAFSIQLISPVSWEAIPNARIELQEWEHVTCMKTVSLRSEETVSGLKGYVAAGTCLMQGEEVTCRGRILIMDVIEVVPEPGQPLTKNKFKVLYEKEQKGPVTALCHCNGHLVSAIGQKIFLWSLRASELTGMAFIDTQLYIHQMISVKNFILAADVMKSISLLRYQEESKTLSLVSRDAKPLEVYSVDFMVDNAQLGFLVSDRDRNLMVYMYLPEAKESFGGMRLLRRADFHVGAHVNTFWRTPCRATEGLSKKSVVWENKHITWFATLDGGIGLLLPMQEKTYRRLLMLQNALTTMLPHHAGLNPRAFRMLHVDRRTLQNAVRNVLDGELLNRYLYLSTMERSELAKKIGTTPDIILDDLLETDRVTAHF

SEQ ID NO: 749587 - protein, 649 aa, Homo sapiens
MAQYGHPSPLGMAAREELYSKVTPRRNRQQRPGTIKHGSALDVLLSMGFPRARAQKALASTGGRSVQAACDWLFSHVGDPFLDDPLPREYVLYLRPTGPLAQKLSDFWQQSKQICGKNKAHNIFPHITLCQFFMCEDSKVDALGEALQTTVSRWKCKFSAPLPLELYTSSNFIGLFVKEDSAEVLKKFAADFAAEAASKTEVHVEPHKKQLHVTLAYHFQASHLPTLEKLAQNIDVKLGCDWVATIFSRDIRFANHETLQVIYPYTPQNDDELELVPGDFIFMSPMEQTSTSEGWIYGTSLTTGCSGLLPENYITKADECSTWIFHGSYSILNTSSSNSLTFGDGVLERRPYEDQGLGETTPLTIICQPMQPLRVNSQPGPQKRCLFVCRHGERMDVVFGKYWLSQCFDAKGRYIRTNLNMPHSLPQRSGGFRDYEKDAPITVFGCMQARLVGEALLESNTIIDHVYCSPSLRCVQTAHNILKGLQQENHLKIRVEPGLFEWTKWVAGSTLPAWIPPSELAAANLSVDTTYRPHIPISKLVVSESYDTYISRSFQVTKEIISECKSKGNNILIVAHASSLEACTCQLQGLSPQNSKDFVQMVRKIPYLGFCSCEELGETGIWQLTDPPILPLTHGPTGGFNWRETLLQE

SEQ ID NO: 749588 - protein, 338 aa, Homo sapiens
LIANSRTARRGEGRGRRRQGYCRRRAGGSRGPEWLRLVPQRPLAGVLAPVASPGSVRVPTLGKLGAPPPLPPPPAWLWVPEPPPLAQPDSLLLPEPSGSGSFPGDGWPLSHGSVRPPQSARHGCERGAVQQSHPPEEPPTAPRHHQAWIGAGRAPLHGVPQSPRVSGRARSPRRPLPRARPALGFAPARLPAPAGQAARSPLPETCWGRDGRAGNPGLGSGRGCGGRRGAGALGQARRGMPKAGGRGRGVRVPGIVLSLRPSRVELSVSLARSPEVSSAERLGRRGPAEDSGTLSVWNTGLVWDPPVSGKGRETAGQGGRRPRCSGFQLRMSLSGSVS

SEQ ID NO: 749589 - protein, 649 aa, Homo sapiens; identical to SEQ ID NO: 749587

SEQ ID NO: 749590 - protein, 516 aa, Homo sapiens
MCEDSKVDALGEALQTTVSRWKCKFSAPLPLELYTSSNFIGLFVKEDSAEVLKKFAADFAAEAASKTEVHVEPHKKQLHVTLAYHFQASHLPTLEKLAQNIDVKLGCDWVATIFSRDIRFANHETLQVIYPYTPQNDDELELVPGDFIFMSPMEQTSTSEGWIYGTSLTTGCSGLLPENYITKADECSTWIFHGSYSILNTSSSNSLTFGDGVLERRPYEDQGLGETTPLTIICQPMQPLRVNSQPGPQKRCLFVCRHGERMDVVFGKYWLSQCFDAKGRYIRTNLNMPHSLPQRSGGFRDYEKDAPITVFGCMQARLVGEALLESNTIIDHVYCSPSLRCVQTAHNILKGLQQENHLKIRVEPGLFEWTKWVAGSTLPAWIPPSELAAANLSVDTTYRPHIPISKLVVSESYDTYISRSFQVTKEIISECKSKGNNILIVAHASSLEACTCQLQGLSPQNSKDFVQMVRKIPYLGFCSCEELGETGIWQLTDPPILPLTHGPTGGFNWRETLLQE

SEQ ID NO: 749591 - protein, 516 aa, Homo sapiens; identical to SEQ ID NO: 749590

SEQ ID NO: 749592 - protein, 649 aa, Homo sapiens; identical to SEQ ID NO: 749587

SEQ ID NO: 749593 - protein, 649 aa, Homo sapiens; identical to SEQ ID NO: 749587

SEQ ID NO: 749594 - protein, 527 aa, Homo sapiens
MAQYGHPSPLGMAAREELYSKVTPRRNRQQRPGTIKHGSALDVLLSMGFPRARAQKALASTGGRSVQAACDWLFSHVGDPFLDDPLPREYVLYLRPTGPLAQKLSDFWQQSKQICGKNKAHNIFPHITLCQFFMCEDSKVDALGEALQTTVSRWKCKFSAPLPLELYTSSNFIGLFVKEDSAEVLKKFAADFAAEAASKTEVHVEPHKKQLHVTLAYHFQASHLPTLEKLAQNIDVKLGCDWVATIFSRDIRFANHETLQVIYPYTPQNDDELELVPGDFIFMSPMEQTSTSEGWIYGTSLTTGCSGLLPENYITKADECSTWIFHGSYSILNTSSSNSLTFGDGVLERRPYEDQGLGETTPLTIICQPMQPLRVNSQPGPQKRCLFVCRHGERMDVVFGKYWLSQCFDAKGRYIRTNLNMPHSLPQRSGGFRDYEKDAPITVFGCMQARLVGKYPGVTALQAFLASSFKTLVPWICKTLPVGFYNFPTSFLNSKGTYYTTIKFRTLCSALGWLTKVNEVWSLLRST

SEQ ID NO: 749595 - protein, 1239 aa, Homo sapiens
MLLVLECVLFSVAQGYFRMDSSATQFHIETHENTSGLWSIWYRNHFDRSVVLNDVFLSKETKHMLKILNFTGPLFLPPGCWNIFSLKLAVKDIAINLFTNVFLTTNIGAIFAIPLQIYSAPTKEGSLGFEVIAHCGMHYFMGKSKAGNPNWNGSLSLDQSTWNVDSELANKLYERWKKYKNGDVCKRNVLGTTRFAHLKKSKESESFVFFLPRLIAEPGLMLNFSATALRSRMIKYFVVQNPSSWPVSLQLLPLSLYPKPEALVHLLHRWFGTDMQMINFTTGEFQLTEACPYLGTHSEESRFGILHLHLQPLEMKRVGVVFTPADYGKVTSLILIRNNLTVIDMIGVEGFGARELLKVGGRLPGAGGSLRFKVPESTLMDCRRQLKDSKQILSITKNFKVENIGPLPITVSSLKINGYNCQGYGFEVLDCHQFSLDPNTSRDISIVFTPDFTSSWVIRDLSLVTAADLEFRFTLNVTLPHHLLPLCADVVPGPSWEESFWRLTVFFVSLSLLGVILIAFQQAQYILMEFMKTRQRQNASSSSQQNNGPMDVISPHSYKSNCKNFLDTYGPSDKGRGKNCLPVNTPQSRIQNAAKRSPATYGHSQKKHKCSVYYSKHKTSTAAASSTSTTTEEKQTSPLGSSLPAAKEDICTDAMRENWISLRYASGINVNLQKNLTLPKNLLNKEENTLKNTIVFSNPSSECSMKEGIQTCMFPKETDIKTSENTAEFKERELCPLKTSKKLPENHLPRNSPQYHQPDLPEISRKNNGNNQQVPVKNEVDHCENLKKVDTKPSSEKKIHKTSREDMFSEKQDIPFVEQEDPYRKKKLQEKREGNLQNLNWSKSRTCRKNKKRGVAPVSRPPEQSDLKLVCSDFERSELSSDINVRSWCIQESTREVCKADAEIASSLPAAQREAEGYYQKPEKKCVDKFCSDSSSDCGSSSGSVRASRGSWGSWSSTSSSDGDKKPMVDAQHFLPAGDSVSQNDFPSEAPISLNLSHNICNPMTVNSLPQYAEPSCPSLPAGPTGVEEDKGLYSPGDLWPTPPVCVTSSLNCTLENGVPCVIQESAPVHNSFIDWSATCEGQFSSAYCPLELNDYNAFPEENMNYANGFPCPADVQTDFIDHNSQSTWNTPPNMPAAWGHASFISSPPYLTSTRSLSPMSGLFGSIWAPQSDVYENCCPINPTTEHSTHMENQAVVCKEYYPGFNPFRAYMNLDIWTTTANRNANFPLSRDSSYCGNV

SEQ ID NO: 749596 - protein, 1239 aa, Homo sapiens; identical to SEQ ID NO: 749595

SEQ ID NO: 749597 - protein, 1019 aa, Homo sapiens
MLNFSATALRSRMIKYFVVQNPSSWPVSLQLLPLSLYPKPEALVHLLHRWFGTDMQMINFTTGEFQLTEACPYLGTHSEESRFGILHLHLQPLEMKRVGVVFTPADYGKVTSLILIRNNLTVIDMIGVEGFGARELLKVGGRLPGAGGSLRFKVPESTLMDCRRQLKDSKQILSITKNFKVENIGPLPITVSSLKINGYNCQGYGFEVLDCHQFSLDPNTSRDISIVFTPDFTSSWVIRDLSLVTAADLEFRFTLNVTLPHHLLPLCADVVPGPSWEESFWRLTVFFVSLSLLGVILIAFQQAQYILMEFMKTRQRQNASSSSQQNNGPMDVISPHSYKSNCKNFLDTYGPSDKGRGKNCLPVNTPQSRIQNAAKRSPATYGHSQKKHKCSVYYSKHKTSTAAASSTSTTTEEKQTSPLGSSLPAAKEDICTDAMRENWISLRYASGINVNLQKNLTLPKNLLNKEENTLKNTIVFSNPSSECSMKEGIQTCMFPKETDIKTSENTAEFKERELCPLKTSKKLPENHLPRNSPQYHQPDLPEISRKNNGNNQQVPVKNEVDHCENLKKVDTKPSSEKKIHKTSREDMFSEKQDIPFVEQEDPYRKKKLQEKREGNLQNLNWSKSRTCRKNKKRGVAPVSRPPEQSDLKLVCSDFERSELSSDINVRSWCIQESTREVCKADAEIASSLPAAQREAEGYYQKPEKKCVDKFCSDSSSDCGSSSGSVRASRGSWGSWSSTSSSDGDKKPMVDAQHFLPAGDSVSQNDFPSEAPISLNLSHNICNPMTVNSLPQYAEPSCPSLPAGPTGVEEDKGLYSPGDLWPTPPVCVTSSLNCTLENGVPCVIQESAPVHNSFIDWSATCEGQFSSAYCPLELNDYNAFPEENMNYANGFPCPADVQTDFIDHNSQSTWNTPPNMPAAWGHASFISSPPYLTSTRSLSPMSGLFGSIWAPQSDVYENCCPINPTTEHSTHMENQAVVCKEYYPGFNPFRAYMNLDIWTTTANRNANFPLSRDSSYCGNV

SEQ ID NO: 749598 - protein, 1155 aa, Homo sapiens
MLLVLECVLFSVAQGYFRMDSSATQFHIETHENTSGLWSIWYRNHFDRSVVLNDVFLSKETKHMLKILNFTGPLFLPPGCWNIFSLKLAVKDIAINLFTNVFLTTNIGAIFAIPLQIYSAPTKEGSLGFEVIAHCGMHYFMGKSKAGNPNWNGSLSLDQSTWNVDSELANKLYERWKKYKNGDVCKFGTDMQMINFTTGEFQLTEACPYLGTHSEESRFGILHLHLQPLEMKRVGVVFTPADYGKVTSLILIRNNLTVIDMIGVEGFGARELLKVGGRLPGAGGSLRFKVPESTLMDCRRQLKDSKQILSITKNFKVENIGPLPITVSSLKINGYNCQGYGFEVLDCHQFSLDPNTSRDISIVFTPDFTSSWVIRDLSLVTAADLEFRFTLNVTLPHHLLPLCADVVPGPSWEESFWRLTVFFVSLSLLGVILIAFQQAQYILMEFMKTRQRQNASSSSQQNNGPMDVISPHSYKSNCKNFLDTYGPSDKGRGKNCLPVNTPQSRIQNAAKRSPATYGHSQKKHKCSVYYSKHKTSTAAASSTSTTTEEKQTSPLGSSLPAAKEDICTDAMRENWISLRYASGINVNLQKNLTLPKNLLNKEENTLKNTIVFSNPSSECSMKEGIQTCMFPKETDIKTSENTAEFKERELCPLKTSKKLPENHLPRNSPQYHQPDLPEISRKNNGNNQQVPVKNEVDHCENLKKVDTKPSSEKKIHKTSREDMFSEKQDIPFVEQEDPYRKKKLQEKREGNLQNLNWSKSRTCRKNKKRGVAPVSRPPEQSDLKLVCSDFERSELSSDINVRSWCIQESTREVCKADAEIASSLPAAQREAEGYYQKPEKKCVDKFCSDSSSDCGSSSGSVRASRGSWGSWSSTSSSDGDKKPMVDAQHFLPAGDSVSQNDFPSEAPISLNLSHNICNPMTVNSLPQYAEPSCPSLPAGPTGVEEDKGLYSPGDLWPTPPVCVTSSLNCTLENGVPCVIQESAPVHNSFIDWSATCEGQFSSAYCPLELNDYNAFPEENMNYANGFPCPADVQTDFIDHNSQSTWNTPPNMPAAWGHASFISSPPYLTSTRSLSPMSGLFGSIWAPQSDVYENCCPINPTTEHSTHMENQAVVCKEYYPGFNPFRAYMNLDIWTTTANRNANFPLSRDSSYCGNV

SEQ ID NO: 749599 - protein, 1239 aa, Homo sapiens; identical to SEQ ID NO: 749595

SEQ ID NO: 749600 - protein, 136 aa, Homo sapiens
MNYANGFPCPADVQTDFIDHNSQSTWNTPPNMPAAWGHASFISSPPYLTSTRSLSPMSGLFGSIWAPQSDVYENCCPINPTTEHSTHMENQAVVCKEYYPGFNPFRAYMNLDIWTTTANRNANFPLSRDSSYCGNV

SEQ ID NO: 749601 - protein, 392 aa, Homo sapiens
MLLVLECVLFSVAQGYFRMDSSATQFHIETHENTSGLWSIWYRNHFDRSVVLNDVFLSKETKHMLKILNFTGPLFLPPGCWNIFSLKLAVKDIAINLFTNVFLTTNIGAIFAIPLQIYSAPTKEGSLGFEVIAHCGMHYFMGKSKAGNPNWNGSLSLDQSTWNVDSELANKLYERWKKYKNGDVCKRNVLGTTRFAHLKKSKESESFVFFLPRLIAEPGLMLNFSATALRSRMIKYFVVQNPSSWPVSLQLLPLSLYPKPEALVHLLHRWFGTDMQMINFTTGEFQLTEACPYLGTHSEESRFGILHLHLQPLEMKRVGVVFTPADYGKVTSLILIRNNLTVIDMIGVEGFGARELLKVGGRLPGAGGSLRFKVPESTLMDCRRREFICVAL

SEQ ID NO: 749602 - protein, 308 aa, Homo sapiens
MLLVLECVLFSVAQGYFRMDSSATQFHIETHENTSGLWSIWYRNHFDRSVVLNDVFLSKETKHMLKILNFTGPLFLPPGCWNIFSLKLAVKDIAINLFTNVFLTTNIGAIFAIPLQIYSAPTKEGSLGFEVIAHCGMHYFMGKSKAGNPNWNGSLSLDQSTWNVDSELANKLYERWKKYKNGDVCKRNVLGTTRFAHLKKSKESESFVFFLPRLIAEPGLMLNFSATALRSRMIKYFVVQNPSSWPVSLQLLPLSLYPKPEALVHLLHRWFGTDMQMINFTTGEFQLTEACPYLVGCYPKTEKRMPTN

SEQ ID NO: 749603 - protein, 154 aa, Homo sapiens
DICTDAMRENWISLRYASGINVNLQKNLTLPKNLLNKEENTLKNTIVFSNPSSECSMKEGIQTCMFPKETDIKTSENTAEFKERELCPLKTSKKLPENHLPRNSPQYHQPDLPEISRKNNGNLFIPFDNSLLFVPSLFLMELFSPVTVSFNCGC

SEQ ID NO: 749604 - protein, 168 aa, Homo sapiens
MNSKGQYPTQPTYPVQPPGNPVYPQTLHLPQAPPYTDAPPAYSELYRPSFVHPGAATVPTMSAAFPGASLYLPMAQSVAVGPLGSTIPMAYYPVGPIYPPGSTVLVEGGYDAGARFGAGATAGNIPPPPPGCPPNAAQLAVMQGANVLVTQRKGNFFMGGSDGGYTIW

SEQ ID NO: 749605 - protein, 168 aa, Homo sapiens; identical to SEQ ID NO: 749604

SEQ ID NO: 749606 - protein, 168 aa, Homo sapiens; identical to SEQ ID NO: 749604

SEQ ID NO: 749607 - protein, 168 aa, Homo sapiens; identical to SEQ ID NO: 749604

SEQ ID NO: 749608 - protein, 168 aa, Homo sapiens; identical to SEQ ID NO: 749604

SEQ ID NO: 749609 - protein, 168 aa, Homo sapiens; identical to SEQ ID NO: 749604

SEQ ID NO: 749610 - protein, 168 aa, Homo sapiens; identical to SEQ ID NO: 749604

SEQ ID NO: 749611 - protein, 168 aa, Homo sapiens; identical to SEQ ID NO: 749604

SEQ ID NO: 749612 - protein, 108 aa, Homo sapiens
MSAAFPGASLYLPMAQSVAVGPLGSTIPMAYYPVGPIYPPGSTVLVEGGYDAGARFGAGATAGNIPPPPPGCPPNAAQLAVMQGANVLVTQRKGNFFMGGSDGGYTIW

SEQ ID NO: 749613 - protein, 144 aa, Homo sapiens
MNSKGQYPTQPTYPVQPPGNPVYPQTLHLPQAPPYTDASTSWMPSQCCSACSHAGSQRPRNSAEGELLHGWFRWWLHHLVRNQGHLCAGKDITYLQHFSQCNCFSHINLKLQFRHMLLGCLSGAQTFRHFSNLIRNHVMVAVPP

SEQ ID NO: 749614 - protein, 181 aa, Homo sapiens
RQGGKSAEANRKRTKKITVRDAETNRTRNHHEQQRSISNTANLPCAASWESSIPSDLASSSGSTLYRCSTCLLRASTSWMPSQCCSACSHAGSQRPRNSAEGELLHGWFRWWLHHLVRNQGHLCAGKDITYLQHFSQCNCFSHINLKLQFRHMLLGCLSGAQTFRHFSNLIRNHVMVAVPP

SEQ ID NO: 749615 - protein, 168 aa, Homo sapiens; identical to SEQ ID NO: 749604

SEQ ID NO: 749616 - protein, 33 aa, Homo sapiens
MGIRTGATERPTPPNQLWIRAREPPLVTSGGTV

SEQ ID NO: 749617 - protein, 135 aa, Homo sapiens
VDLAGWHSQVQPVQALRVLQRGSCKQPQSWPWWGSVPMRLQILDCATLTLKQEYTLLAGTDCFCWTPPGRATPLPVAVLYIRKILLSDLLGYQESSMGRNAIPRPGNLGRCTRWPDLGTPRCPNPAFQRLRTEWT

SEQ ID NO: 749618 - protein, 98 aa, Homo sapiens
LGQRTVLGQRTVLGQRTGLGQRTVLGQRTVLGQRTVLGQRTVLGQRTVEDNILNGFLEQGDGIGACSVHSTHRPGIAVPPGTVHPLRGYNVFPKSRGR

SEQ ID NO: 749619 - protein, 194 aa, Homo sapiens
MGHRKDRPDGQHFRGSEPQLGQNHPPGLKPLLLPQPEQVGELCFSLRYVPSSGRLTVVVLEARGLRPGLAEPYVKVQLMLNQRKWKKRKTATKKGTAAPYFNEAFTFLVPFSQVQNVDLVLAVWDRSLPLRTEPVGKVHLGARASGQPLQHWADMLAHARRPIAQRHPLRPAREVDRMLALQPRLRLRLPLPHS

SEQ ID NO: 749620 - protein, 608 aa, Homo sapiens
MGHPPVSPSAPAPAGTTAIPGLIPDLVAGTPCELWDSQEGCGDNPAKWGLQLSTDALSLASTPGPRWALIAGALAAGVLLVSCLLCAACCCCRRHRKKPRDKESVGLGSARGTTTTHLVRSGSLLTQSREGLKSRLQSPGQRGEFSPRDGLTPTEAGRGGPSWQGKWVNRGEKEAMQQGLPHGPEGATAGFLRKAGGTPDATFWVGLAGLTERSRRFVPVGWPGLEAGGLDPCHARAAREPRALMRHDVSTTCPLSQLTQVQPDVDGLESSPGDAQQWGCLQLSLEFDFGSQEVKGPAAQDQRFCEFPERVTGEGQTPCPGWWGADRAGALGWAHPAGSQIRVGLRQAADLRPGGTVDPYARVSVSTQAGHRHETKVHRGTLCPVFDETCCFHIPQAELPGATLQVQLFNFKRFSGHEPLGELRLPLGTVDLQHVLEHWYLLGPPAATQPEQVGELCFSLRYVPSSGRLTVVVLEARGLRPGLAEPYVKVQLMLNQRKWKKRKTATKKGTAAPYFNEAFTFLVPFSQVQNVDLVLAVWDRSLPLRTEPVGKVHLGARASGQPLQHWADMLAHARRPIAQRHPLRPAREVDRMLALQPRLRLRLPLPHS

SEQ ID NO: 749621 - protein, 103 aa, Homo sapiens
MSAIQNLHSFDPFADASKGDDLLPAGTEDYIHIRIQQRNGRKTLTTVQGIADDYDKKKLVKAFKKKFACNGTVIEHPEYGEVIQLQGDQRKNIMPVPRRDWTG

SEQ ID NO: 749622 - protein, 92 aa, Homo sapiens
DSAASPLGPVASLLSVPSARLLPPPPPPPSAGRFHRGKGIVSYVRYPEPPLFRKKFACNGTVIEHPEYGEVIQLQGDQRKNIMPVPRRDWTG

SEQ ID NO: 749623 - protein, 112 aa, Homo sapiens
GTIGTSGSPDSPDMCSSQGGREARAFPEPGEAGRPGLTCSGRASKGHIRPGPSPDDFSVVFCTRKTPGDRGDGSGILSLTALNELNLFFQTPLLMQVRVMTCFLLALRIISI

SEQ ID NO: 749624 - protein, 75 aa, Homo sapiens
TTKFAAASTRNGRKTLTTVQGIADDYDKKKLVKAFKKKFACNGTVIEHPEYGEVIQLQGDQRKNIMPVPRRDWTG

SEQ ID NO: 749625 - protein, 112 aa, Homo sapiens; identical to SEQ ID NO: 749623

SEQ ID NO: 749626 - protein, 103 aa, Homo sapiens; identical to SEQ ID NO: 749621

SEQ ID NO: 749627 - protein, 103 aa, Homo sapiens; identical to SEQ ID NO: 749621

SEQ ID NO: 749628 - protein, 103 aa, Homo sapiens; identical to SEQ ID NO: 749621

SEQ ID NO: 749629 - protein, 94 aa, Homo sapiens
LVLARDLELAHASADVPFPPARLLPPPPPPPSAGRFHRGKGIVSYVRYPEPPLFRKKFACNGTVIEHPEYGEVIQLQGDQRKNIMPVPRRDWTG

SEQ ID NO: 749630 - protein, 103 aa, Homo sapiens; identical to SEQ ID NO: 749621

SEQ ID NO: 749631 - protein, 103 aa, Homo sapiens; identical to SEQ ID NO: 749621

SEQ ID NO: 749632 - protein, 103 aa, Homo sapiens; identical to SEQ ID NO: 749621

SEQ ID NO: 749633 - protein, 103 aa, Homo sapiens; identical to SEQ ID NO: 749621

SEQ ID NO: 749634 - protein, 112 aa, Homo sapiens; identical to SEQ ID NO: 749623

SEQ ID NO: 749635 - protein, 103 aa, Homo sapiens; identical to SEQ ID NO: 749621

SEQ ID NO: 749636 - protein, 94 aa, Homo sapiens
THKEQVPPALNSDPGRIAEVVPLPASPPPPPSAGRFHRGKGIVSYVRYPEPPLFRKKFACNGTVIEHPEYGEVIQLQGDQRKNIMPVPRRDWTG

SEQ ID NO: 749637 - protein, 103 aa, Homo sapiens; identical to SEQ ID NO: 749621

SEQ ID NO: 749638 - protein, 76 aa, Homo sapiens
AAAFGAPPSSRNRPGRVAARSCGLARGRGGLPRWGCLTRTPSWPQPGALRELMLAAVGMSSSRNGDEFPWIQPWLG

SEQ ID NO: 749639 - protein, 536 aa, Homo sapiens
KKGRGGCVGQGAPDRRMPQLSLSSLGLWPMAASPWLLLLLVGASWLLARILAWTYTFYDNCCRLRCFPQPPKRNWFLGHLGLIHSSEEGLLYTQSLACTFGDMCCWWVGPWHAIVRIFHPTYIKPVLFAPAAIVPKDKVFYSFLKPWLGDGLLLSAGEKWSRHRRMLTPAFHFNILKPYMKIFNESVNIMHAKWQLLASEGSARLDMFEHISLMTLDSLQKCVFSFDSHCQEKPSEYIAAILELSALVTKRHQQILLYIDFLYYLTPDGQRFRRACRLVHDFTDAVIQERRRTLPSQGVDDFLQAKAKSKTLDFIDVLLLSKDEDGKKLSDEDIRAEADTFMFEGHDTTASGLSWVLYHLAKHPEYQERCRQEVQELLKDREPKEIEWDDLAQLPFLTMCIKESLRLHPPVPAVSRCCTQDIVLPDGRVIPKGIICLISVFGTHHNPAVWPDPEVYDPFRFDPKNIKERSPLAFIPFSAGPRNCIGQAFAMAEMKVVLGLTLLAFRVLPDHTEPRRKPELVLRAEGGLWLRVEPLS

SEQ ID NO: 749640 - protein, 536 aa, Homo sapiens; identical to SEQ ID NO: 749639

SEQ ID NO: 749641 - protein, 536 aa, Homo sapiens; identical to SEQ ID NO: 749639

SEQ ID NO: 749642 - protein, 328 aa, Homo sapiens
KKGRGGCVGQGAPDRRMPQLSLSSLGLWPMAASPWLLLLLVGASWLLARILAWTYTFYDNCCRLRCFPQPPKRNWFLGHLGLIHSSEEGLLYTQSLACTFGDMCCWWVGPWHAIVRIFHPTYIKPVLFAPAAIVPKDKVFYSFLKPWLGDGLLLSAGEKWSRHRRMLTPAFHFNILKPYMKIFNESVNIMHAKWQLLASEGSARLDMFEHISLMTLDSLQKCVFSFDSHCQEKPSEYIAAILELSALVTKRHQQILLYIDFLYYLTPDGQRFRRACRLVHDFTDAVIQERRRTLPSQGVDDFLQAKAKSKTLDFIDVLLLSKVGLSGI

SEQ ID NO: 749643 - protein, 536 aa, Homo sapiens; identical to SEQ ID NO: 749639

SEQ ID NO: 749644 - protein, 530 aa, Homo sapiens
PHSPPHLPCRMPQLSLSSLGLWPMAASPWLLLLLVGASWLLARILAWTYTFYDNCCRLRCFPQPPKRNWFLGHLGLVTPTEQGMRVLTQLVATYPQGFKVWMGPIFPVIRFCHPNIIRSVINASAAIVPKDKVFYSFLKPWLGDGLLLSAGEKWSRHRRMLTPAFHFNILKPYMKIFNESVNIMHAKWQLLASEGSARLDMFEHISLMTLDSLQKCVFSFDSHCQEKPSEYIAAILELSALVTKRHQQILLYIDFLYYLTPDGQRFRRACRLVHDFTDAVIQERRRTLPSQGVDDFLQAKAKSKTLDFIDVLLLSKDEDGKKLSDEDIRAEADTFMFEGHDTTASGLSWVLYHLAKHPEYQERCRQEVQELLKDREPKEIEWDDLAQLPFLTMCIKESLRLHPPVPAVSRCCTQDIVLPDGRVIPKGIICLISVFGTHHNPAVWPDPEVYDPFRFDPKNIKERSPLAFIPFSAGPRNCIGQAFAMAEMKVVLGLTLLAFRVLPDHTEPRRKPELVLRAEGGLWLRVEPLS

SEQ ID NO: 749645 - protein, 330 aa, Homo sapiens
MFEHISLMTLDSLQKCVFSFDSHCQEKPSEYIAAILELSALVTKRHQQILLYIDFLYYLTPDGQRFRRACRLVHDFTDAVIQERRRTLPSQGVDDFLQAKAKSKTLDFIDVLLLSKDEDGKKLSDEDIRAEADTFMFEGHDTTASGLSWVLYHLAKHPEYQERCRQEVQELLKDREPKEIEWDDLAQLPFLTMCIKESLRLHPPVPAVSRCCTQDIVLPDGRVIPKGIICLISVFGTHHNPAVWPDPEVYDPFRFDPKNIKERSPLAFIPFSAGPRNCIGQAFAMAEMKVVLGLTLLAFRVLPDHTEPRRKPELVLRAEGGLWLRVEPLS

SEQ ID NO: 749646 - protein, 328 aa, Homo sapiens; identical to SEQ ID NO: 749642

SEQ ID NO: 749647 - protein, 355 aa, Homo sapiens
MAGCCCLSAEEKESQRISAEIERQLRRDKKDARRELKLLLLGTGESGKSTFIKQMRIIHGSGYSDEDRKGFTKLVYQNIFTAMQAMIRAMDTLRIQYVCEQNKENAQIIREVEVDKVSMLSREQVEAIKQLWQDPGIQECYDRRREYQLSDSAKYYLTDIDRIATPSFVPTQQDVLRVRVPTTGIIEYPFDLENIIFRMVDVGGQRSERRKWIHCFESVTSIIFLVALSEYDQVLAECDNENRMEESKALFKTIITYPWFLNSSVILFLNKKDLLEEKIMYSHLISYFPEYTGPKQDVRAARDFILKLYQDQNPDKEKVIYSHFTCATDTDNIRFVFAAVKDTILQLNLREFNLV

SEQ ID NO: 749648 - protein, 240 aa, Homo sapiens
MEFVCLCGAHCEWGVTSFEVGWTFPPALKGESVPRSLIYSYLTDIDRIATPSFVPTQQDVLRVRVPTTGIIEYPFDLENIIFRMVDVGGQRSERRKWIHCFESVTSIIFLVALSEYDQVLAECDNENRMEESKALFKTIITYPWFLNSSVILFLNKKDLLEEKIMYSHLISYFPEYTGPKQDVRAARDFILKLYQDQNPDKEKVIYSHFTCATDTDNIRFVFAAVKDTILQLNLREFNLV

SEQ ID NO: 749649 - protein, 38 aa, Homo sapiens
MEESKALFKTIITYPWFLNSSVILFLNKKDLLEEKIMY

SEQ ID NO: 749650 - protein, 118 aa, Homo sapiens
MSCVHYKFSSKLNYDTVTFDGLHISLCDLKKQIMGREKLKAADCDLQITNAQTKEEYTDDNALIPKNSSVIVRRIPIGGVKSTSKTYVISRTEPAMATTKAVCKNTISHFFYTLLLPL

SEQ ID NO: 749651 - protein, 71 aa, Homo sapiens
MSCVHYKFSSKLNYDTVTFDGLHISLCDLKKQIMGREKLKAADCDLQITNAQTKEGKGRLVLRYLVAGERY

SEQ ID NO: 749652 - protein, 63 aa, Homo sapiens
MSCVHYKFSSKLNYDTVTFDGLHISLCDLKKQIMGREKLKAADCDWSYQGRTCRFSVGAICLR

SEQ ID NO: 749653 - protein, 171 aa, Homo sapiens
IKKIRGPQTSTGPRAGGDPKKRSVPKFPGPPFRDGEPRVTHRPVAKLVTSHMLATPGHFGQMEVPEDDFALLQIHRQEGWATWGAMLLLDERHDPHLLITNSIKNGLGLGKLTPVVRKPGGGVRPLVDSGPRPSPLNLLPGPGSPQSTERETRREVRPRYGPLTPWGRSDS

SEQ ID NO: 749654 - protein, 118 aa, Homo sapiens; identical to SEQ ID NO: 749650

SEQ ID NO: 749655 - protein, 434 aa, Homo sapiens
MALRVTRNSKINAENKAKINMAGAKRVPTAPAATSKPGLRPRTALGDIGNKVSEQLQAKMPMKKEAKPSATGKVIDKKLPKPLEKVPMLVPVPVSEPVPEPEPEPEPEPVKEEKLSPEPILVDTASPSPMETSGCAPAEEDLCQAFSDVILAVNDVDAEDGADPNLCSEYVKDIYAYLRQLEEEQAVRPKYLLGREVTGNMRAILIDWLVQVQMKFRLLQETMYMTVSIIDRFMQNNCVPKKMLQLVGVTAMFIASKYEEMYPPEIGDFAFVTDNTYTKHQIRQMEMKILRALNFGLGRPLPLHFLRRASKIGEVDVEQHTLAKYLMELTMLDYDMVHFPPSQIAAGAFCLALKILDNGEWTPTLQHYLSYTGRNLFFQLCQHLAQNVVMVNQGLTKHLTVKNKYATSKHAKISTLPQLNSALVQDLAKAVAKV

SEQ ID NO: 749656 - protein, 411 aa, Homo sapiens
MALRVTRNSKINAENKAKINMAGAKRVPTAPAATSKPGLRPRTALGDIGNKVSEQLQAKMPMKKEAKPSATGKVIDKKLPKPLEKVPMLVPVPVSEPVPEPEPEPEPEPVKEEKLSPEPILVDTASPSPMETSGCAPAEEDLCQAFSDVILAVNDVDAEDGADPNLCSEYVKDIYAYLRQLEEEQAVRPKYLLGREVTGNMRAILIDWLVQVQMKFRLLQETMYMTVSIIDRFMQNNCVPKKMLQLVGVTAMFIASKYEEMYPPEIGDFAFVTDNTYTKHQIRQMEMKILRALNFGLGRPLPLHFLRRASKIGEVDVEQHTLAKYLMELTMLDYDMVHFPPSQIAAGAFCLALKILDNGEWTPTLQHYLSYTGRNLFFQLCQHLAQNVVHGKSRTYKAPDCQEQVCHIEAC

SEQ ID NO: 749657 - protein, 280 aa, Homo sapiens
MALRVTRNSKINAENKAKINMAGAKRVPTAPAATSKPGLRPRTALGDIGNKVSEQLQAKMPMKKEAKPSATGKVIDKKLPKPLEKVPMLVPVPVSEPVPEPEPEPEPEPVKEEKLSPEPILVDTASPSPMETSGCAPAEEDLCQAFSDVILAVNDVDAEDGADPNLCSEYVKDIYAYLRQLEEEQAVRPKYLLGREVTGNMRAILIDWLVQVQMKFRLLQETMYMTVSIIDRFMQNNVCPKICWWVLPFCGIEKSPMGCLGHFISYGRSQYWGAQAEKGG

SEQ ID NO: 749658 - protein, 480 aa, Homo sapiens
NYTAVGTRPGVEGERLLVSAGCRSLAGRASGVLLLPAELLPGEEEAMALRVTRNSKINAENKAKINMAGAKRVPTAPAATSKPGLRPRTALGDIGNKVSEQLQAKMPMKKEAKPSATGKVIDKKLPKPLEKVPMLVPVPVSEPVPEPEPEPEPEPVKEEKLSPEPILVDTASPSPMETSGCAPAEEDLCQAFSDVILAVNDVDAEDGADPNLCSEYVKDIYAYLRQLEEEQAVRPKYLLGREVTGNMRAILIDWLVQVQMKFRLLQETMYMTVSIIDRFMQNNCVPKKMLQLVGVTAMFIASKYEEMYPPEIGDFAFVTDNTYTKHQIRQMEMKILRALNFGLGRPLPLHFLRRASKIGEVDVEQHTLAKYLMELTMLDYDMVHFPPSQIAAGAFCLALKILDNGEWTPTLQHYLSYTGRNLFFQLCQHLAQNVVMVNQGLTKHLTVKNKYATSKHAKISTLPQLNSALVQDLAKAVAKV

SEQ ID NO: 749659 - protein, 256 aa, Homo sapiens
MALRVTRNSKINAENKAKINMAGAKRVPTAPAATSKPGLRPRTALGDIGNKVSEQLQAKMPMKKEAKPSATGKVIDKKLPKPLEKVPMLVPVPVSEPVPEPEPEPEPEPVKEEKLSPEPILVDTASPSPMETSGCAPAEEDLCQAFSDVILAVNDVDAEDGADPNLCSEYVKDIYAYLRQLEEEQAVRPKYLLGREVTGNMRAILIDWLVQVQMKSVCAGPVCGPIDGPAKLGAQIAGGPAVWPLKGPRGRWGTLA

SEQ ID NO: 749660 - protein, 96 aa, Homo sapiens
GFATSAASLLGQLSHCPCCSQFFSPPELGFKGCSPGSPVQFLPYSTIWSGLSEFYHEHPSPLSSFQPLVSDPSSQTGNFHIENLTKCLLTACYSRF

SEQ ID NO: 749661 - protein, 113 aa, Homo sapiens
KQTVEKLPHLIKTKQNETRKLLMPADPPLSTAKMAAECCHYIQKQDNLKLNGCHCRVNRPSLTVQVLSYRPSKRHLLHSLDAKQGASEFVSFVLFFLQIYIYIYTHTHTQLIT

SEQ ID NO: 749662 - protein, 131 aa, Homo sapiens
CWALFLQEALTGCWALFLQEALTHCWALFFQEALTRYWALFLQEALICCWALFLQEALICCWALFLQEALTLLGLLSGHLMAAGSLAHLVPPEGRGVLEIGGAQGCNKASFPHWAWLMRAILLLLFGGRHP

SEQ ID NO: 749663 - protein, 112 aa, Homo sapiens [sequence omitted]

SEQ ID NO: 749664 - protein, 150 aa, Homo sapiens
IFFMCRRCSCCGGQGMVLRLANGVMFPGGLWLPLLHHTGYHRSGEKPVVTGLTAEPEGPVLLPPCPTNSTEFIYRQLVSRAENLPQATSLPAEKASRAFRFPASPHATVSVLVSVLLGCPLPWIRSRKLRLQSKVLQSLSGNFLLPLVFL

SEQ ID NO: 749665 - protein, 37 aa, Homo sapiens
MSHVEAVPFVSCEKSSTSATLSLPSASASVAAPAFVG

SEQ ID NO: 749666 - protein, 104 aa, Homo sapiens
MRAHLHLPAWKQPWQMGCVPLPPFGATVGFILTAANPRAGLHSCLNEAGACRTNCMECHVGFSTLAHSELAMPGHVCSVVFELDLGGQNFKRKMKAPAREVFLS

SEQ ID NO: 749667 - protein, 167 aa, Homo sapiens
TQTPNRNLFSPSTEVFWQDGQGVPLTGNVTTSQMANEQGLFDVHSILRVVLGANGTYSCLVRNPVLQQDAHSSVTITPQRSPTGSLLKCPLGGGGFCFCRQGLGAPNLAPPSISQNSKLPPNDREKDNGEVGMFTGGVGGGEITGLLKALLTSRLWKPLGRMEPHLG

SEQ ID NO: 749668 - protein, 393 aa, Homo sapiens
GLRTHRSRLSGPQADSPARPARPSDSPGRPRPPFGPGLAAAATEPGCGRGPESQSRRGAAGAAFHHGEPSCQPPHRKMLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 749669 - protein, 611 aa, Homo sapiens
GLRTHRSRLSGPQADSPARPARPSDSPGRPRPPFGPGLAAAATEPGCGRGPESQSRRGAAGAAFHHGEPSCQPPHRKMLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDMVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 749670 - protein, 153 aa, Homo sapiens
MASCFHDVNPSTVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 749671 - protein, 383 aa, Homo sapiens
LVAGARDGHRVPWPQVPVGLQGQEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 749672 - protein, 287 aa, Homo sapiens
GLRTHRSRLSGPQADSPARPARPSDSPGRPRPPFGPGLAAAATEPGCGRGPESQSRRGAAGAAFHHGEPSCQPPHRKMLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDMVTITCSSYQGYPEAEVFWQDGQGVPLTGNVTTSQMANEQGLFDVHSIGSL

SEQ ID NO: 749673 - protein, 101 aa, Homo sapiens
GANGAVLRDMGPGMTVSLLLLFLRQPMTFPPEALWVTVGLSVCLIALLVALAFVCWRKIKQSCEEENAGAEDQDGEGEGSKTALQPLKHSDSKEDDGQEIA

SEQ ID NO: 749674 - protein, 393 aa, Homo sapiens; identical to SEQ ID NO: 749668

SEQ ID NO: 749675 - protein, 393 aa, Homo sapiens; identical to SEQ ID NO: 749668

SEQ ID NO: 749676 - protein, 393 aa, Homo sapiens; identical to SEQ ID NO: 749668

SEQ ID NO: 749677 - protein, 393 aa, Homo sapiens; identical to SEQ ID NO: 749668

SEQ ID NO: 749678 - protein, 393 aa, Homo sapiens; identical to SEQ ID NO: 749668

SEQ ID NO: 749679 - protein, 393 aa, Homo sapiens; identical to SEQ ID NO: 749668

SEQ ID NO: 749680 - protein, 393 aa, Homo sapiens; identical to SEQ ID NO: 749668

SEQ ID NO: 749681 - protein, 393 aa, Homo sapiens; identical to SEQ ID NO: 749668

SEQ ID NO: 749682 - protein, 393 aa, Homo sapiens; identical to SEQ ID NO: 749668

SEQ ID NO: 749683 - protein, 112 aa, Homo sapiens
MLDNHRGSAQMGELFSSPQGHTEPQEWVRERAGEGPKPFFPSLHSASDAEWGLKDESLGWPSTWRQEAQGKEEGPCRVTLRETSVEGTLGRLPAGRGSWARPWRVDGMDKQE

SEQ ID NO: 749684 - protein, 125 aa, Homo sapiens [sequence omitted]

SEQ ID NO: 749685 - protein, 393 aa, Homo sapiens; identical to SEQ ID NO: 749668

SEQ ID NO: 749686 - protein, 393 aa, Homo sapiens; identical to SEQ ID NO: 749668

SEQ ID NO: 749687 - protein, 638 aa, Homo sapiens
GLRTHRSRLSGPQADSPARPARPSDSPGRPRPPFGPGLAAAATEPGCGRGPESQSRRGAAGAAFHHGEPSCQPPHRKMLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDMVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGECVCMCVRAHAHLCVLGYVAVFDVNRVSLSSDRTSVCVQMGLDLSVCDLESTSCVCEQA

SEQ ID NO: 749688 - protein, 317 aa, Homo sapiens
MKRLSLVTTNRLSPHGNFFTLCTFPLAVDMAALFQEASSCPVCSDYLEKPMSLECGCAVCLKCINSLQKEPHGEDLLCCCSSMVSRKNKIRRNRQLERLASHIKELEPKLKKILQMNPRMRKFQVDMTLDANTANNFLLISDDLRSVRSGRIRQNRQDLAERFDVSVCILGSPRFTCGRHCWEVDVGTSTEWDLGVCRESVHRKGRIQLTTELGFWTVSLRDGGRLSASTVPLTFLFVDRKLQRVGIFLDMGMQNVSFFDAEGGSHVYTFRSVSAEEPLCPFLAPSVPPNGDQGVLSICPLMNSGTTDAPVRPGEAK

SEQ ID NO: 749689 - protein, 288 aa, Homo sapiens
MAALFQEASSCPVCSDYLEKPMSLECGCAVCLKCINSLQKEPHGEDLLCCCSSMVSRKNKIRRNRQLERLASHIKELEPKLKKILQMNPRMRKFQVDMTLDANTANNFLLISDDLRSVRSGRIRQNRQDLAERFDVSVCILGSPRFTCGRHCWEVDVGTSTEWDLGVCRESVHRKGRIQLTTELGFWTVSLRDGGRLSASTVPLTFLFVDRKLQRVGIFLDMGMQNVSFFDAEGGSHVYTFRSVSAEEPLCPFLAPSVPPNGDQGVLSICPLMNSGTTDAPVRPGEAK

SEQ ID NO: 749690 - protein, 288 aa, Homo sapiens; identical to SEQ ID NO: 749689

SEQ ID NO: 749691 - protein, 264 aa, Homo sapiens
MDTPSPDPLPSPLPGEEEKPLALSPPVPRGRRGRRPGGATSSNRTLKASLPRKRGRPPKSGQEPPLVQVQGVTAPVGSSGGSDLLLIDDQGVPYTVSEGSAAGPEGSGPRKAPHFCPVCLRAFPYLSDLERHSISHSELKPHQCKVCGKTFKRSSHLRRHCNIHAGLRPFRCPLCPRRFREAGELAHHHRVHSGERPYQCPICRLRFTEANTLRRHAKRKHPEAMGVPLCAPDPGSEPPWDEEGIPATAGAEEEEETEGKGEPA

SEQ ID NO: 749692 - protein, 264 aa, Homo sapiens; identical to SEQ ID NO: 749691

SEQ ID NO: 749693 - protein, 312 aa, Homo sapiens
TKLEPESYLDDMVTCSQIVYNYNPEKTKKDSGWRTAICPDYCPNMYEEMETLASVLQSDIGQDMRVHNSTFLWFIPFVQSLMDLKDLGVAYIAQVVNHLYSEVKEVLNQTDAVCDKVTEFFLLILVSVIELHRNKKCLHLLWVSSQQWVEAVVKCAKLPTTAFTRSSEKSSGNCSKGTAMISSLSLHSMPSNSVQLAYVQLIRSLLKEGYQLGQQSLCKRFWDKLNLFLRGNLSLGWQLTSQETHELQSCLKQIIRNIKFKAPPCNTFVDLTSACKISPASYNKEESEQMGKTSRKDMHCLEASSPTFSKEP

SEQ ID NO: 749694 - protein, 74 aa, Homo sapiens
HPGSYTVDAGAQACAPFSRVTQQDGITARTGSDGSRGPGSETHSETKCHLIPPLANSSFLRGPPPSIRSGSVLS

SEQ ID NO: 749695 - protein, 42 aa, Homo sapiens
IFHESSSLKSPPQVHHDMASCLQFVLTILILEALKMIPWNIG

SEQ ID NO: 749696 - protein, 112 aa, Homo sapiens
LPPRMPFPSFSHIAIFDISLKTELSHQPGRPGLIWKTVQHVFLCCHSAGFLSIFSRSFQTASLWRAVTRSHSAPYPHYQHGMHWGCPYIYRTETFRVWPILLFLSMYYHKVM

SEQ ID NO: 749697 - protein, 111 aa, Homo sapiens [sequence omitted]

SEQ ID NO: 749698 - protein, 196 aa, Homo sapiens [sequence omitted]

SEQ ID NO: 749699 - protein, 196 aa, Homo sapiens [sequence omitted]

SEQ ID NO: 749700 - protein, 152 aa, Homo sapiens [sequence omitted]

SEQ ID NO: 749701 - protein, 956 aa, Homo sapiens
MAPVQKTGKNLPGSLANLSSSPRSTTISWVTLPARFPRLETEDGNPHPRRAGGKTQSDVGKCQAHMVKYPTNLAPLRTYRGRVLHLITGKRSFPGRLTAHPLRPGCSLPGPASRSSAAGRTSAAPRDARCEDTLGLCPPTSTALLSAVANQHEACRLPFLDWLRLYLRPPHLATVSGGEAAASGLGRSCSGTVTARAAPRVSRRGRVGGKDNRAGTRGVRVTAASREQTSVGTVRRNGAAGQELFWAGEGRLVAEGPPSYLPQGLEVKTPVGVYVVVVLLLFVFAFLVCGTDFAETATDLKVSSYCSWGGGCLRRCGSLYPGLLGPPSFSSAAFIPRGVYPQALLLFPILVTFEEAMETPTPLPPVPASPTCNPAPRTIQIEFPQHSSSLLESLNRHRLEGKFCDVSLLVQGRELRAHKAVLAAASPYFHDKLLLGDAPRLTLPSVIEADAFEGLLQLIYSGRLRLPLDALPAHLLVASGLQMWQVVDQCSEILRELETSGGGISARGGNSYHALLSTTSSTGGWCIRSSPFQTPVQSSASTESPASTESPVGGEGSELGEVLQIQVEEEEEEEEDDDDEDQGSATLSQTPQPQRVSGVFPRPHGPHPLPMTATPRKLPEGESAPLELPAPPALPPKIFYIKQEPFEPKEEISGSGTQPGGAKEETKVFSGGDTEGNGELGFLLPSGPGPTSGGGGPSWKPVDLHGNEILSGGGGPGGAGQAVHGPVKLGGTPPADGKRFGCLCGKRFAVKPKRDRHIMLTFSLRPFGCGICNKRFKLKHHLTEHMKTHAGALHACPHCGRRFRVHACFLRHRDLCKGQGWATAHWTYKWLLRLYTSFYNKITTAADGYFSLTAMAHQSWILESCQENRYIMDLLFLDMGLSAWQMWKLKFLVPLQVLASQPCRKVVYRPFILKLITCPWWTFLWWRCPLRKPDFQLFSERRVRAKDSGKCFIPSP

SEQ ID NO: 749702 - protein, 872 aa, Homo sapiens
MAPVQKTGKNLPGSLANLSSSPRSTTISWVTLPARFPRLETEDGNPHPRRAGGKTQSDVGKCQAHMVKYPTNLAPLRTYRGRVLHLITGKRSFPGRLTAHPLRPGCSLPGPASRSSAAGRTSAAPRDARCEDTLGLCPPTSTALLVCSSQINTRLVGCRSSIGYGSSSARRTWRRCPAEEAAASGLGRSCSGTVTARAAPRVSRRGRVGGKDNRAGTRGVRVTAASREQTSVGTVRRNGAAGQELFWAAFIPRGVYPQALLLFPILVTFEEAMETPTPLPPVPASPTCNPAPRTIQIEFPQHSSSLLESLNRHRLEGKFCDVSLLVQGRELRAHKAVLAAASPYFHDKLLLGDAPRLTLPSVIEADAFEGLLQLIYSGRLRLPLDALPAHLLVASGLQMWQVVDQCSEILRELETSGGGISARGGNSYHALLSTTSSTGGWCIRSSPFQTPVQSSASTESPASTESPVGGEGSELGEVLQIQVEEEEEEEEDDDDEDQGSATLSQTPQPQRVSGVFPRPHGPHPLPMTATPRKLPEGESAPLELPAPPALPPKIFYIKQEPFEPKEEISGSGTQPGGAKEETKVFSGGDTEGNGELGFLLPSGPGPTSGGGGPSWKPVDLHGNEILSGGGGPGGAGQAVHGPVKLGGTPPADGKRFGCLCGKRFAVKPKRDRHIMLTFSLRPFGCGICNKRFKLKHHLTEHMKTHAGALHACPHCGRRFRVHACFLRHRDLCKGQGWATAHWTYKWLLRLYTSFYNKITTAADGYFSLTAMAHQSWILESCQENRYIMDLLFLDMGLSAWQMWKLKFLVPLQVLASQPCRKVVYRPFILKLITCPWWTFLWWRCPLRKPDFQLFSERRVRAKDSGKCFIPSP

SEQ ID NO: 749703 - protein, 872 aa, Homo sapiens; identical to SEQ ID NO: 749702

SEQ ID NO: 749704 - protein, 196 aa, Homo sapiens [sequence omitted]

SEQ ID NO: 749705 - protein, 198 aa, Homo sapiens
MPASERTVAWVSNMPHLSADIESAHIEREEYKLKEYSKSMDESRLDRVKEYEEEIHSLKERLHMSNRKLEEYERRLLSQEEQTSKILMQYQARLEQSEKRLRQQQAEKDSQIKSIIGRLMLVEEELRRDHPAMAEPLPEPKKRLLDAQVEITMSFIFSVSHPHPSHCLSCTHYTSHLAPSPSVSHSLLFVHWLLLAAP

SEQ ID NO: 749706 - protein, 561 aa, Homo sapiens
PGAPLALSPLLPARPAPRSAVSSPPAPPPAPGTARPQPEPGPPPSSGPGQQAGRGQVRAPTMRGELWLLVLVLREAARALSPQPGAGHDEGPGSGWAAKGTVRGWNRRARESPGHVSEPDRTQLSQDLGGGTLAMDTLPDNRTRVVEDNHSYYVSRLYGPSEPHSRELWVDVAEANRSQVKIHTILSNTHRQASRVVLSFDFPFYGHPLRQITIATGGFIFMGDVIHRMLTATQYVAPLMANFNPGYSDNSTVVYFDNGTVFVVQWDHVYLQGWEDKGSFTFQAALHHDGRIVFAYKEIPMSVPEISSSQHPVKTGLSDAFMILNPSPDVPESRRRSIFEYHRIELDPSKVTSMSAVEFTPLPTCLQHRSCDACMSSDLTFNCSWCHVLQRCSSGFDRYRQEWMDYGCAQEAEGRMCEDFQDEDHDSASPDTSFSPYDGDLTTTSSSLFIDSLTTEDDTKLNPYAGGDGLQNNLSPKTKGTPVHLGTIVGIVLAVLLVAAIILAGIYINGHPTSNAALFFIERRPHHWPAMKFRSHPDHSTYAEVEPSGHEKEGFMEAEQC

SEQ ID NO: 749707 - protein, 561 aa, Homo sapiens; identical to SEQ ID NO: 749706

SEQ ID NO: 749708 - protein, 427 aa, Homo sapiens
MDTLPDNRTRVVEDNHSYYVSRLYGPSEPHSRELWVDVAEANRSQVKIHTILSNTHRQASRVVLSFDFPFYGHPLRQITIATGGFIFMGDVIHRMLTATQYVAPLMANFNPGYSDNSTVVYFDNGTVFVVQWDHVYLQGWEDKGSFTFQAALHHDGRIVFAYKEIPMSVPEISSSQHPVKTGLSDAFMILNPSPDVPESRRRSIFEYHRIELDPSKVTSMSAVEFTPLPTCLQHRSCDACMSSDLTFNCSWCHVLQRCSSGFDRYRQEWMDYGCAQEAEGRMCEDFQDEDHDSASPDTSFSPYDGDLTTTSSSLFIDSLTTEDDTKLNPYAGGDGLQNNLSPKTKGTPVHLGTIVGIVLAVLLVAAIILAGIYINGHPTSNAALFFIERRPHHWPAMKFRSHPDHSTYAEVEPSGHEKEGFMEAEQC

SEQ ID NO: 749709 - protein, 427 aa, Homo sapiens; identical to SEQ ID NO: 749708

SEQ ID NO: 749710 - protein, 146 aa, Homo sapiens
MDYGCAQEAEGRMCEDFQDEDHDSASPDTSFSPYDGDLTTTSSSLFIDSLTTEGLQNNLSPKTKGTPVHLGTIVGIVLAVLLVAAIILAGIYINGHPTSNAALFFIERRPHHWPAMKFRSHPDHSTYAEVEPSGHEKEGFMEAEQC

SEQ ID NO: 749711 - protein, 366 aa, Homo sapiens
PGAPLALSPLLPARPAPRSAVSSPPAPPPAPGTARPQPEPGPPPSSGPGQQAGRGQVRAPTMRGELWLLVLVLREAARALSPQPGAGHDEGPGSGWAAKGTVRGWNRRARESPGHVSEPDRTQLSQDLGGGTLAMDTLPDNRTRVVEDNHSYYVSRLYGPSEPHSRELWVDVAEANRSQVKIHTILSNTHRQASRVVLSFDFPFYGHPLRQITIATGGFIFMGDVIHRMLTATQYVAPLMANFNPGYSDNSTVVYFDNGTVFVVQWDHVYLQGWEDKGSFTFQAALHHDGRIVFAYKEIPMSVPEISSSQHPVKTGLSDAFMILNPSPDVPAFQQSLQSIFGEKKSHVQLAASGLQRHSKHTGQDP

SEQ ID NO: 749712 - protein, 142 aa, Homo sapiens
MWNVGVLRPAESESDSQEDNHSYYVSRLYGPSEPHSRELWVDVAEANRSQVKIHTILSNTHRQASRVVLSFDFPFYGHPLRQITIATGGFIFMGDVIHRMLTATQYVAPLMANFNPGYSDNSTVVYFDNGTVLVGQWDTYIS

SEQ ID NO: 749713 - protein, 107 aa, Homo sapiens
KNMNALLIMIPTPTQPLPVLDEVDPKALSAFISETLLEPKTPWFDLPCSPAAPVCPNDLSTGLQNNLSPKTKGTPVHLGTIVGIVLAVLLVAAIILAGIYINGHPTS

SEQ ID NO: 749714 - protein, 146 aa, Homo sapiens
PGAPLALSPLLPARPAPRSAVSSPPAPPPAPGTARPQPEPGPPPSSGPGQQAGRGQVRAPTMRGELWLLVLVLREAARALSPQPGAGRTGGSRPGWAGGGEGRAVRCGHGQVWTAWRCPRGGHCPQEARRAVGCGQVDRDPTFPNT

SEQ ID NO: 749715 - protein, 432 aa, Homo sapiens
MWNVGVLRPAESESDSQEDNHSYYVSRLYGPSEPHSRELWVDVAEANRSQVKIHTILSNTHRQASRVVLSFDFPFYGHPLRQITIATGGFIFMGDVIHRMLTATQYVAPLMANFNPGYSDNSTVVYFDNGTVFVVQWDHVYLQGWEDKGSFTFQAALHHDGRIVFAYKEIPMSVPEISSSQHPVKTGLSDAFMILNPSPDVPESRRRSIFEYHRIELDPSKVTSMSAVEFTPLPTCLQHRSCDACMSSDLTFNCSWCHVLQRCSSGFDRYRQEWMDYGCAQEAEGRMCEDFQDEDHDSASPDTSFSPYDGDLTTTSSSLFIDSLTTEDDTKLNPYAGGDGLQNNLSPKTKGTPVHLGTIVGIVLAVLLVAAIILAGIYINGHPTSNAALFFIERRPHHWPAMKFRSHPDHSTYAEVEPSGHEKEGFMEAEQC

SEQ ID NO: 749716 - protein, 419 aa, Homo sapiens
PGAPLALSPLLPARPAPRSAVSSPPAPPPAPGTARPQPEPGPPPSSGPGQQAGRGQVRAPTMRGELWLLVLVLREAARALSPQPGAGHDEGPGSGWAAKGTVRGWNRRARESPGHVSEPDRTQLSQDLGGGTLAMDTLPDNRTRVVEDNHSYYVSRLYGPSEPHSRELWVDVAEANRSQVKIHTILSNTHRQASRVVLSFDFPFYGHPLRQITIATGGFIFMGDVIHRMLTATQYVAPLMANFNPGYSDNSTVVYFDNGTVFVVQWDHVYLQGWEDKGSFTFQAALHHDGRIVFAYKEIPMSVPEISSSQHPVKTGLSDAFMILNPSPDVPESRRRSIFEYHRIELDPSKVTSMSAVEFTPLPTCLQHRSCDACMSSDLTFNCSWCHVLQRSLNNQDENTYVNCLDSQQCHGSSESRRP

SEQ ID NO: 749717 - protein, 143 aa, Homo sapiens
MVPDWSPFIKINCPAQLSAGPPQSQSLVLGPKAGPRGCRKQSVASKWGLSYPLQCVGAERSLGDFSAGPPYSRDPSVFKTKQEGKEEWRNSSVLTLFPLVSAVLGPLCTSYHFPLESAPQGRVRDEDSGCKEVSQLGNGSGQL

SEQ ID NO: 749718 - protein, 88 aa, Homo sapiens
RAETACAHGPVLPTQRHSQLKEAQGRGQKVSEGVRDGEPRHVVYRLPLEEGLPEVPRLRDPQAEGLRALSRSCPGLPLQVLERAFPTE

SEQ ID NO: 749719 - protein, 42 aa, Homo sapiens
MAKRNDRDYATACIQNQSQVSSPTITIDTSSGKCSSTTNQIQ

SEQ ID NO: 749720 - protein, 79 aa, Homo sapiens
MGPSPKAWIFVMVLPMSLNFCLKTSCLMHHAALWLFKRDEHVNRHCLNKIPSTGWLKQPEFISHNSGDWKSKIKVLVGS

SEQ ID NO: 749721 - protein, 478 aa, Homo sapiens
MLLWVQQALLALLLPTLLAQGEARRSRNTTRPALLRLSDYLLTNYRKGVRPVRDWRKPTTVSIDVIVYAILNVDEKNQVLTTYIWYRQYWTDEFLQWNPEDFDNITKLSIPTDSIWVPDILINEFVDVGKSPNIPYVYIRHQGEVQNYKPLQVVTACSLDIYNFPFDVQNCSLTFTSWLHTIQDINISLWRLPEKVKSDRSVFMNQGEWELLGVLPYFREFSMESSNYYAEMKFYVVIRRRPLFYVVSLLLPSIFLMVMDIVGFYLPPNSGERVSFKITLLLGYSVFLIIVSDTLPATAIGTPLIGVYFVVCMALLVISLAETIFIVRLVHKQDLQQPVPAWLRHLVLERIAWLLCLREQSTSQRPPATSQATKTDDCSAMGNHCSHMGGPQDFEKSPRDRCSPPPPPREASLAVCGLLQELSSIRQFLEKRDEIREVARDWLRVGSVLDKLLFHIYLLAVLAYSITLVMLWSIWQYA

SEQ ID NO: 749722 - protein, 510 aa, Homo sapiens
MLLWVQQALLALLLPTLLAQGEARRSRNTTRPALLRLSDYLLTNYRKGVRPVRDWRKPTTVSIDVIVYAILNVDEKNQVLTTYIWYRQYWTDEFLQWNPEDFDNITKLSIPTDSIWVPDILINEFVDVGKSPNIPYVYIRHQGEVQNYKPLQVVTACSLDIYNFPFDVQNCSLTFTSWLHTIQDINISLWRLPEKVKSDRSVFMNQGEWELLGVLPYFREFSMESSNYYAEMKFYVVIRRRPLFYVVSLLLPSIFLMVMDIVGFYLPPNSGERVSFKITLLLGYSVFLIIVSDTLPATAIGTPLIGKAPPGSRAQSGEKPAPSHLLHVSLASALGCTGVYFVVCMALLVISLAETIFIVRLVHKQDLQQPVPAWLRHLVLERIAWLLCLREQSTSQRPPATSQATKTDDCSAMGNHCSHMGGPQDFEKSPRDRCSPPPPPREASLAVCGLLQELSSIRQFLEKRDEIREVARDWLRVGSVLDKLLFHIYLLAVLAYSITLVMLWSIWQYA

SEQ ID NO: 749723 - protein, 220 aa, Homo sapiens
MDIVGFYLPPNSGERVSFKITLLLGYSVFLIIVSDTLPATAIGTPLIGVYFVVCMALLVISLAETIFIVRLVHKQDLQQPVPAWLRHLVLERIAWLLCLREQSTSQRPPATSQATKTDDCSAMGNHCSHMGGPQDFEKSPRDRCSPPPPPREASLAVCGLLQELSSIRQFLEKRDEIREVARDWLRVGSVLDKLLFHIYLLAVLAYSITLVMLWSIWQYA

SEQ ID NO: 749724 - protein, 369 aa, Homo sapiens
MLLWVQQALLALLLPTLLAQGEARRSRNTTRPALLRLSDYLLTNYRKGVRPVRDWRKPTTVSIDVIVYAILNVDEKNQVLTTYIWYRQYWTDEFLQWNPEDFDNITKLSIPTDSIWVPDILINEFVDVGKSPNIPYVYIRHQGEVQNYKPLQVVTACSLDIYNFPFDVQNCSLTFTSWLHTIQDINISLWRLPEKVKSDRSVFMNQGEWELLGVLPYFREFSMESSNYYAEMKFYVVIRRRPLFYVVSLLLPSIFLMVMDIVGFYLPPNSGERVSFKITLLLGYSVFLIIVSDTLPATAIGTPLIGVYFVVCMALLVISLAETIFIVRCCRSCPPSGNSWKSGMRSERWPETGCAWAPCWTSCYSTFTC

SEQ ID NO: 749725 - protein, 426 aa, Homo sapiens
MPTCCLGTEGEVCLSCRRPSLEMEGAACDHPCSSPEYWTDEFLQWNPEDFDNITKLSIPTDSIWVPDILINEFVDVGKSPNIPYVYIRHQGEVQNYKPLQVVTACSLDIYNFPFDVQNCSLTFTSWLHTIQDINISLWRLPEKVKSDRSVFMNQGEWELLGVLPYFREFSMESSNYYAEMKFYVVIRRRPLFYVVSLLLPSIFLMVMDIVGFYLPPNSGERVSFKITLLLGYSVFLIIVSDTLPATAIGTPLIGVYFVVCMALLVISLAETIFIVRLVHKQDLQQPVPAWLRHLVLERIAWLLCLREQSTSQRPPATSQATKTDDCSAMGNHCSHMGGPQDFEKSPRDRCSPPPPPREASLAVCGLLQELSSIRQFLEKRDEIREVARDWLRVGSVLDKLLFHIYLLAVLAYSITLVMLWSIWQYA

SEQ ID NO: 749726 - protein, 463 aa, Homo sapiens
MHRSFLQARRSRNTTRPALLRLSDYLLTNYRKGVRPVRDWRKPTTVSIDVIVYAILNVDEKNQVLTTYIWYRQYWTDEFLQWNPEDFDNITKLSIPTDSIWVPDILINEFVDVGKSPNIPYVYIRHQGEVQNYKPLQVVTACSLDIYNFPFDVQNCSLTFTSWLHTIQDINISLWRLPEKVKSDRSVFMNQGEWELLGVLPYFREFSMESSNYYAEMKFYVVIRRRPLFYVVSLLLPSIFLMVMDIVGFYLPPNSGERVSFKITLLLGYSVFLIIVSDTLPATAIGTPLIGVYFVVCMALLVISLAETIFIVRLVHKQDLQQPVPAWLRHLVLERIAWLLCLREQSTSQRPPATSQATKTDDCSAMGNHCSHMGGPQDFEKSPRDRCSPPPPPREASLAVCGLLQELSSIRQFLEKRDEIREVARDWLRVGSVLDKLLFHIYLLAVLAYSITLVMLWSIWQYA

SEQ ID NO: 749727 - protein, 440 aa, Homo sapiens
MLLWVQQALLALLLPTLLAQGEARRSRNTTRPALLRLSDYLLTNYRKGVRPVRDWRKPTTVSIDVIVYAILNVDEKNQVLTTYIWYRQYWTDEFLQWNPEDFDNITKLSIPTDSIWVPDILINEFVDVGKSPNIPYVYIRHQGEVQNYKPLQVVTACSLDIYNFPFDVQNCSLTFTSWLHTIQDINISLWRLPEKVKSDRSVFMNQGEWELLGVLPYFREFSMESSNYYAEMKFYVVIRRRPLFYVVSLLLPSIFLMVMDIVGFYLPPNSGERVSFKITLLLGYSVFLIIVSDTLPATAIGTPLIGKAPPGSRAQSGEKPAPSHLLHVSLASALGCTGVYFVVCMALLVISLAETIFIVRLVHKQDLQQPVPAWLRHLVLERIAWLLCLREQSTSQRPPATSQATKTDDCSVHSSCGLFPIDPHLNKGLWNSASLSQLCF

SEQ ID NO: 749728 - protein, 446 aa, Homo sapiens [sequence omitted]

SEQ ID NO: 749729 - protein, 231 aa, Homo sapiens
MALPSYMFMRQGFDTQVLYLSARGFLNYHRFKHMLSKVGMWDFDIFLFDRLTNGNSLVTLLCHLFNTHGLIHHFKLDMVTLHRFLVMVQEDYHSQNPYHNAVHAADVTQAMHCYLKEPKLASFLTPLDIMLGLLAAAAHDVDHPGVNQPFLIKTNHHLANLYQVREPNLEPATVWSIALGPVLKPESCPWRKPCFRVLEVQRRMKHNLCPQKFVQTQMLKMSKIQANLIPV

SEQ ID NO: 749730 - protein, 446 aa, Homo sapiens [sequence omitted]

SEQ ID NO: 749731 - protein, 187 aa, Homo sapiens
MALPSYMFMRQGFDTQVLYLSARGFLNYHRFKHMLSKVGMWDFDIFLFDRLTNGNSLVTLLCHLFNTHGLIHHFKLDMVTLHRFLVMVQEDYHSQNPYHNAVHAADVTQAMHCYLKEPKLASFLTPLDIMLGLLAAAAHDVDHPGVNQPFLIKTNHHLANLYQNMSVLENHHWRSTIGMLRESRRIA

SEQ ID NO: 749732 - protein, 407 aa, Homo sapiens
VHVRLRQRIILYELKVELEETVVRRQAAVRTLGQQARVWLVRVLLNLLVVALLGAAFYGVYWATGCTVELQEMPLVQELPLLKLLGVNYLPSIFIAGVNFVLPPVFKLIAPLEGYTRSRQIVFILLRTVFLRLASLVVLLFSLWNQITCGGDSEAEDCKTCGYNYKQLPCWETVLGQEMYKLLLFDLLTVLAVALLIQFPRKLLCGLCPGALGRLAGTQEFQVPDEVLGLIYAQTVVWVGSFFCPLLPLLNTVKFLLLFYLKKLTLFSTCSPAARTFRASAANFFFPLVLLLGLAISSVPLLYSIFLIPPSKLCGPFRGQSSIWAQIPESISSLPETTQNFLFFLGTQAFAVPLLLISSILMAYTVALANSYGRLISELKRQRETEAQNKVFLARRAVALTSTKPAL

SEQ ID NO: 749733 - protein, 382 aa, Homo sapiens
VHVRLRQRIILYELKVELEETVVRRQAAVRTLGQQARVWLVRVLLNLLVVALLGAAFYGVYWATGCTVELQEMPLVQELPLLKLLGVNYLPSIFIAGVNFVLPPVFKLIAPLEGYTRSRQIVFILLRTVFLRLASLVVLLFSLWNQITCGGDSEAEDCKTCGYNYKQLPCWETVLGQEMYKLLLFDLLTVLAVALLIQFPRKLLCGLCPGALGRLAGTQEFQVPDEVLGLIYAQTVVWVGSFFCPLLPLLNTVKFLLLFYLKKLTLFSTCSPAARTFRASAANFFFPLVLLLGLAISSVPLLYSIFLIPPSKLCGPFRGQSSIWAQIPESISSLPETTQNFLFFLGTQAFAVPLLLISRSQTFGYNGRACQEWLPFLSPSAS

SEQ ID NO: 749734 - protein, 407 aa, Homo sapiens; identical to SEQ ID NO: 749732

SEQ ID NO: 749735 - protein, 407 aa, Homo sapiens; identical to SEQ ID NO: 749732

SEQ ID NO: 749736 - protein, 89 aa, Homo sapiens
LNLLVVALLGAAFYGVYWATGCTVELQVRTVLEEEARGSWNLHFQRWREGTEVWDARDLREEVWERVCSDPGLRDFKGKREAGRGGLHL

SEQ ID NO: 749737 - protein, 128 aa, Homo sapiens
TLCICASVSLATYSLLPFSASLSAVWVLFSAASSPFIYSPLSHWFLALATHYFLPFATSPQCSCTPFSHIILLAASCSCLSRSPACHCFCFVLAFSLHPLLSPFPLPLGIEEALISFCLSLEKQIIDH

SEQ ID NO: 749738 - protein, 85 aa, Homo sapiens
NAPGLSTTPYAQGLKELNQGIISLLLPSSDMGGGDQSQTAEVGMTQEDPETRGRLRELQEMTSGRPGMVAHDCDLRTYGRQGGRI

SEQ ID NO: 749739 - protein, 128 aa, Homo sapiens
HSWDSNPGLSGCLPHRVACSLAAGSLPIYLRLWLCVCDVVSGPSTMSAVCLAGLSLCLGPCLFCRATGLGPPSEAPPPLLQVLSARLFSLTIEYVLGSQNLCLLHLSPLQLGPPSTGPGTDGAPINIF

SEQ ID NO: 749740 - protein, 890 aa, Homo sapiens
MDSNTAPLGPSCPQPPPAPQPQARSRLNATASLEQERSERPRAPGPQAGPGPGVRDAAAPAEPQAQHTRSRERADGTGPTKGDMEIPFEEVLERAKAGDPKAQTEVGKHYLQLAGDTDEELNSCTAVDWLVLAAKQGRREAVKLLRRCLADRRGITSENEREVRQLSSETDLERAVRKAALVMYWKLNPKKKKQVAVAELLENVGQVNEHDGGAQPGPVPKSLQKQRRMLERLVSSESKNYIALDDFVEITKKYAKGVIPSSLFLQDDEDDDELAGKSPEDLPLRLKVVKYPLHAIMEIKEYLIDMASRAGMHWLSTIIPTHHINALIFFFIISNLTIDFFAFFIPLVIFYLSFISMVICTLKVFQDSKAWENFRTLTDLLLRFEPNLDVEQAEVNFGWNHLEPYAHFLLSVFFVIFSFPIASKDCIPCSELAVITGFFTVTSYLSLSTHAEPYTRRALATEVTAGLLSLLPSMPLNWPYLKVLGQTFITVPVGHLVVLNVSVPCLLYVYLLYLFFRMAQLRNFKGTYCYLVPYLVCFMWCELSVVILLESTGLGLLRASIGYFLFLFALPILVAGLALVGVLQFARWFTSLELTKIAVTVAVCSVPLLLRWWTKASFSVVGMVKSLTRSSMVKLILVWLTAIVLFCWFYVYRSEGMKVYNSTLTWQQYGALCGPRAWKETNMARTQILCSHLEGHRVTWTGRFKYVRVTDIDNSAESAINMLPFFIGDWMRCLYGEAYPACSPGNTSTAEEELCRLKLLAKHPCHIKKFDRYKFEITVGMPFSSGADGSRSREEDDVTKDIVLRASSEFKSVLLSLRQGSLIEFSTILEGRLGSKWPVFELKAISCLNCMAQLSPTRRHVKIEHDWRSTVHGAVKFAFDFFFFPFLSAA

SEQ ID NO: 749741 - protein, 199 aa, Homo sapiens
REGHLGWGTAHPGAGGQEWRLALGKPAPFLLTQPGPQPSGRPGKGFLHLNPLSSFLSLAPRHRPQPIALCEGGSGAAVWGAHAVFSHASAKNYIALDDFVEITKKYAKGVIPSSLFLQDDEDDDELAGKSPEDLPLRLKVVKYPLHAIMEIKEYLIDMASRAGMHWLSTIIPTHHINALIFFFIISNRITRSRVMRLRL

SEQ ID NO: 749742 - protein, 890 aa, Homo sapiens; identical to SEQ ID NO: 749740

SEQ ID NO: 749743 - protein, 742 aa, Homo sapiens
REGHLGWGTAHPGAGGQEWRLALGKPAPFLLTQPGPQPSGRPGKGFLHLNPLSSFLSLAPRHRPQPIALCEGGSGAAVWGAHAVFSHASAKNYIALDDFVEITKKYAKGVIPSSLFLQDDEDDDELAGKSPEDLPLRLKVVKYPLHAIMEIKEYLIDMASRAGMHWLSTIIPTHHINALIFFFIISNLTIDFFAFFIPLVIFYLSFISMVICTLKVFQDSKAWENFRTLTDLLLRFEPNLDVEQAEVNFGWNHLEPYAHFLLSVFFVIFSFPIASKDCIPCSELAVITGFFTVTSYLSLSTHAEPYTRRALATEVTAGLLSLLPSMPLNWPYLKVLGQTFITVPVGHLVVLNVSVPCLLYVYLLYLFFRMAQLRNFKGTYCYLVPYLVCFMWCELSVVILLESTGLGLLRASIGYFLFLFALPILVAGLALVGVLQFARWFTSLELTKIAVTVAVCSVPLLLRWWTKASFSVVGMVKSLTRSSMVKLILVWLTAIVLFCWFYVYRSEGMKVYNSTLTWQQYGALCGPRAWKETNMARTQILCSHLEGHRVTWTGRFKYVRVTDIDNSAESAINMLPFFIGDWMRCLYGEAYPACSPGNTSTAEEELCRLKLLAKHPCHIKKFDRYKFEITVGMPFSSGADGSRSREEDDVTKDIVLRASSEFKSVLLSLRQGSLIEFSTILEGRLGSKWPVFELKAISCLNCMAQLSPTRRHVKIEHDWRSTVHGAVKFAFDFFFFPFLSAA

SEQ ID NO: 749744 - protein, 339 aa, Homo sapiens
RYNRANDRPVVNRTRLFALPILVAGLALVGVLQFARWFTSLELTKIAVTVAVCSVPLLLRWWTKASFSVVGMVKSLTRSSMVKLILVWLTAIVLFCWFYVYRSEGMKVYNSTLTWQQYGALCGPRAWKETNMARTQILCSHLEGHRVTWTGRFKYVRVTDIDNSAESAINMLPFFIGDWMRCLYGEAYPACSPGNTSTAEEELCRLKLLAKHPCHIKKFDRYKFEITVGMPFSSGADGSRSREEDDVTKDIVLRASSEFKSVLLSLRQGSLIEFSTILEGRLGSKWPVFELKAISCLNCMAQLSPTRRHVKIEHDWRSTVHGAVKFAFDFFFFPFLSAA

SEQ ID NO: 749745 - protein, 286 aa, Homo sapiens
MCNEQGTLQTKASFSVVGMVKSLTRSSMVKLILVWLTAIVLFCWFYVYRSEGMKVYNSTLTWQQYGALCGPRAWKETNMARTQILCSHLEGHRVTWTGRFKYVRVTDIDNSAESAINMLPFFIGDWMRCLYGEAYPACSPGNTSTAEEELCRLKLLAKHPCHIKKFDRYKFEITVGMPFSSGADGSRSREEDDVTKDIVLRASSEFKSVLLSLRQGSLIEFSTILEGRLGSKWPVFELKAISCLNCMAQLSPTRRHVKIEHDWRSTVHGAVKFAFDFFFFPFLSAA

SEQ ID NO: 749746 - protein, 890 aa, Homo sapiens; identical to SEQ ID NO: 749740

SEQ ID NO: 749747 - protein, 347 aa, Homo sapiens
MDSNTAPLGPSCPQPPPAPQPQARSRLNATASLEQERSERPRAPGPQAGPGPGVRDAAAPAEPQAQHTRSRERADGTGPTKGDMEIPFEEVLERAKAGDPKAQTEVGKHYLQLAGDTDEELNSCTAVDWLVLAAKQGRREAVKLLRRCLADRRGITSENEREVRQLSSETDLERAVRKAALVMYWKLNPKKKKQVAVAELLENVGQVNEHDGGAQPGPVPKSLQKQRRMLERLVSSESKNYIALDDFVEITKKYAKGVIPSSLFLQDDEDDDELAGKSPEDLPLRLKVVKYPLHAIMEIKEYLIDMASRAGMHWLSTIIPTHHINALIFFFIISNRITRSRVMRLRL

SEQ ID NO: 749748 - protein, 141 aa, Homo sapiens
FFFWETESRSVAQAVVQWYDLAHCNLHLLGSRDYPASASQEAKTTGVHYHARLIFIFLVETGFHHVGRAGLELLTSSDAPASASQSAGITGMSNHSWSNSSLLPLFYTAQLLNFRELKRIIKFHLVHPRSSFRFTKLSYFL

SEQ ID NO: 749749 - protein, 73 aa, Homo sapiens
AVLFMWMVTRPTAGQTQVLPLDFPVPQHQPGDHVLIKEGKEGKLEPAREGPYLVLLTTETAVRKVGKRWTHHT

SEQ ID NO: 749750 - protein, 44 aa, Homo sapiens
MAIHRISPTRLWLLVDVGLTFGGIRAWTQPLDKLIQTSWPSPKE

SEQ ID NO: 749751 - protein, 123 aa, Homo sapiens
YTAGKITELERKLTFEQQRRISGKDVCVRQKIKMENKEQMDITHLDGHKVHISRDKITRPGAKLWKKGEGLPNFDNNNIKGSLIITFDVDFPKEQLTEEAREGIKQLLKQGSVQKVYNGLQGY

SEQ ID NO: 749752 - protein, 144 aa, Homo sapiens
VLTKDPQLTLTGEGEPHVDGEPGDLRFRIKVVKHPIFERRGDDLYTNVTISLVESLVGFEMDITHLDGHKVHISRDKITRPGAKLWKKGEGLPNFDNNNIKGSLIITFDVDFPKEQLTEEAREGIKQLLKQGSVQKVYNGLQGY

SEQ ID NO: 749753 - protein, 144 aa, Homo sapiens; identical to SEQ ID NO: 749752

SEQ ID NO: 749754 - protein, 358 aa, Homo sapiens
MAPQNLSTFCLLLLYLIGAVIAGRDFYKILGVPRSASIKDIKKAYRKLALQLHPDRNPDDPQAQEKFQDLGAAYEVLSDSEKRKQYDTYGEEGLKDGHQSSHGDIFSHFFGDFGFMFGGTPRQQDRNIPRGSDIIVDLEVTLEEVYAGNFVEVVRNKPVARQAPGKRKCNCRQEMRTTQLGPGRFQMTQEVVCDECPNVKLVNEERTLEVEIEPGVRDGMEYPFIGEGEPHVDGEPGDLRFRIKVVKHPIFERRGDDLYTNVTISLVESLVGFEMDITHLDGHKVHISRDKITRPGAKLWKKGEGLPNFDNNNIKGSLIITFDVDFPKEQLTEEAREGIKQLLKQGSVQKVYNGLQGY

SEQ ID NO: 749755 - protein, 358 aa, Homo sapiens; identical to SEQ ID NO: 749754

SEQ ID NO: 749756 - protein, 358 aa, Homo sapiens; identical to SEQ ID NO: 749754

SEQ ID NO: 749757 - protein, 358 aa, Homo sapiens; identical to SEQ ID NO: 749754

SEQ ID NO: 749758 - protein, 242 aa, Homo sapiens
MAPQNLSTFCLLLLYLIGAVIAGRDFYKILGVPRSASIKDIKKAYRKLALQLHPDRNPDDPQAQEKFQDLGAAYEVLSDSEKRKQYDTYGEEGLKDGHQSSHGDIFSHFFGDFGFMFGGTPRQQDRNIPRGSDIIVDLEVTLEEVYAGNFVEVVRNKPVARQAPGKRKCNCRQEMRTTQLGPGRFQMTQEVVCDECPNVKLVNEERTLEVEIEPGVRDGMEYPFIGEGTQYLKGEEMICTQM

SEQ ID NO: 749759 - protein, 327 aa, Homo sapiens
MAPQNLSTFCLLLLYLIGAVIAGRDFYKILGVPRSASIKDIKKAYRKLALQLHPDRNPDDPQAQEKFQDLGAAYEVLSDSEKRKQYDTYGEEGLKDGHQSSHGDIFSHFFGDFGFMFGGTPRQQDRNIPRGSDIIVDLEVTLEEVYAGNFVEVVRNKPVARQAPGKRKCNCRQEMRTTQLGPGRFQMTQEVVCDECPNVKLVNEERTLEVEIEPGVRDGMEYPFIGEGPHCGWGSPGDFTVPECKRSKHPKYFEKERTRHTPPPHTPPPPPPPTPSPPPPPPPPMPSPPPSQGPPHPPPTPPTPTTPTGIQWTARILRVNKIGLCLK

SEQ ID NO: 749760 - protein, 337 aa, Homo sapiens
MAPQNLSTFCLLLLYLIGAVIAGRDFYKILGVPRSASIKDIKKAYRKLALQLHPDRNPDDPQAQEKFQDLGAAYEVLSDSEKRKQYDTYGEEGLKDGHQSSHGDIFSHFFGDFGFMFGGTPRQQDRNIPRGSDIIVDLEVTLEEVYAGNFVEVVRNKPVARQAPGKRKCNCRQEMRTTQLGPGRFQMTQEVVCDECPNVKLVNEERTLEVEIEPGVRDGMEYPFIGEGEPHVDGEPGDLRFRIKVVKHPIFERRGDDLYTNVTISLVESLVGFEMDITHLDGHKGYIISRDKIYRRSYGRTGAAPPFGDTYPGPGNPLGGFPKKGSKERRRSYRLDG

SEQ ID NO: 749761 - protein, 289 aa, Homo sapiens
MAPQNLSTFCLLLLYLIGAVIAGRDFYKILGVPRSASIKDIKKAYRKLALQLHPDRNPDDPQAQEKFQDLGAAYEVLSDSEKRKQYDTYGEEGLKDGHQSSHGDIFSHFFGDFGFMFGGTPRQQDRNIPRGSDIIVDLEVTLEEVYAGNFVEVVRNKPVARQAPGKRKCNCRQEMRTTQLGPGRFQMTQEVVCDECPNVKLVNEERTLEVEIEPGVRDGMEYPFIGEGEPHVDGEPGDLRFRIKVVKHPIFERRGDDLYTNVTISLVESLVGFEMDITHLDGHKYIFPG

SEQ ID NO: 749762 - protein, 243 aa, Homo sapiens
MFGGTPRQQDRNIPRGSDIIVDLEVTLEEVYAGNFVEVVRNKPVARQAPGKRKCNCRQEMRTTQLGPGRFQMTQEVVCDECPNVKLVNEERTLEVEIEPGVRDGMEYPFIGEGEPHVDGEPGDLRFRIKVVKHPIFERRGDDLYTNVTISLVESLVGFEMDITHLDGHKVHISRDKITRPGAKLWKKGEGLPNFDNNNIKGSLIITFDVDFPKEQLTEEAREGIKQLLKQGSVQKVYNGLQGY

SEQ ID NO: 749763 - protein, 340 aa, Homo sapiens
MAPQNLSTFCLLLLYLIGAVIAGRDFYKILGVPRSASIKDIKKAYRKLALQLHPDRNPDDPQAQEKFQDLGAAYEVLSDSEKRKQYDTYGEEGLKDGHQSSHGDIFSHFFGDFGFMFGGTPRQQDRNIPRGSDIIVDLEVTLEEVYAGNFVEVVRNKPVARQAPGKRKCNCRQEMRTTQLGPGRFQMTQEVVCDECPNVKLVNEERTLEVEIEPGCNLLGLGEPHVDGEPGDLRFRIKVVKRGDDLYTNVTISLVESLVGFEMDITHLDGHKVHISRDKITRPGAKLWKKGEGLPNFDNNNIKGYVDFPKEQLTEEAREGIKQLLKQGSVQKVYNGLQGY

SEQ ID NO: 749764 - protein, 214 aa, Homo sapiens
GRVGRPTRPVRNKPVARQAPGKRKCNCRQEMRTTQLGPGRFQMTQEVVCDECPNVKLVNEERTLEVEIEPGVRDGMEYPFIGEGEPHVDGEPGDLRFRIKVVKHPIFERRGDDLYTNVTISLVESLVGFEMDITHLDGHKVHISRDKITRPGAKLWKKGEGLPNFDNNNIKGSLIITFDVDFPKEQLTEEAREGIKQLLKQGSVQKVYNGLQGY

SEQ ID NO: 749765 - protein, 144 aa, Homo sapiens; identical to SEQ ID NO: 749752

SEQ ID NO: 749766 - protein, 112 aa, Homo sapiens
YSFWLSIINYSWAGWFSCTTLLIYPSLQFYSVSRLPTRSLSDNICAVCGQKIIVELDEEGLIENTYQLSCNHVWERTHFLYGQILDWLRYLVAWQPVVIGIVQGINYSLGLE

SEQ ID NO: 749767 - protein, 328 aa, Homo sapiens
MAAGTAARKAAPVLEAPPQQEQLSHTKLSAEDTWNLQQERMYKMHRGHDSMHVEMILIFLCVLVIAQIVLVQWRQRHGRSYNLVTLLQMWVVPLYFTIKLYWWRFLSMWGMFSVITSYILFRATRKPLSGRTPRLVYKWFLLIYKLSYAFGVVGYLAIVFTMCGFNLFFKIKARDSMDFGIVSLFYGLYYGVMGRDFAEICSDYMASTIGFYSVSRLPTRSLSDNICAVCGQKIIVELDEEGLIENTYQLSCNHVFHEFCIRGWCIVGKKQTCPYCKEKVDLKRMISNPWERTHFLYGQILDWLRYLVAWQPVVIGIVQGINYSLGLE

SEQ ID NO: 749768 - protein, 256 aa, Homo sapiens
MAAGTAARKAAPVLEAPPQQEQLSHTKLSAEDTWNLQQERMYKMHRGHDSMHVEMILIFLCVLVIAQIVLVQWRQRHGRSYNLVTLLQMWVVPLYFTIKLYWWRFLSMWGMFSVITSYILFRATRKPLSGRTPRLVYKWFLLIYKLSYAFGVVGYLAIVFTMCGFNLFFKIKARDSMDFGIVSLFYGLYYGVMGRDFAEICSDYMASTIGFYSVSRLPTRSLSDNICAVCGQKIIVELDEEGLIENTYQLSCNHVC

SEQ ID NO: 749769 - protein, 256 aa, Homo sapiens; identical to SEQ ID NO: 749768

SEQ ID NO: 749770 - protein, 248 aa, Homo sapiens
MELVTLLQMWVVPLYFTIKLYWWRFLSMWGMFSVITSYILFRATRKPLSGRTPRLVYKWFLLIYKLSYAFGVVGYLAIVFTMCGFNLFFKIKARDSMDFGIVSLFYGLYYGVMGRDFAEICSDYMASTIGFYSVSRLPTRSLSDNICAVCGQKIIVELDEEGLIENTYQLSCNHVFHEFCIRGWCIVGKKQTCPYCKEKVDLKRMISNPWERTHFLYGQILDWLRYLVAWQPVVIGIVQGINYSLGLE

SEQ ID NO: 749771 - protein, 271 aa, Homo sapiens
MAAGTAARKAAPVLEAPPQQEQLSHTKLSAEDTWNLQQERMYKMHRGHDSMHVEMILIFLCVLVIAQIVLVQWRQRHGRSYNLVTLLQMWVVPLYFTIKLYWWRFLSMWGMFSVITSYILFRATRKPLSGRTPRLVYKWFLLIYKLSYAFGVVGYLAIVFTMCGFNLFFKIKARDSMDFGIVSLFYGLYYGVMGRDFAEICSDYMASTIGFYSVSRLPTRSLSDNICAVCGQKIIVELDEEGLIENTYQLSCNHVLNARKHSTLYVLYFPH

SEQ ID NO: 749772 - protein, 533 aa, Homo sapiens
SFIITVGIFLLLIFIINVVIITSRRKANLRLHLKELKKRRTNLTQTLTQQKKINNKDRAELNKIETDKHSNQKPSETSTDEHQHVPEDPREKSQDEVLRDDPPKKEHLRDTKSTFAGSPERESIHILSVDEKNKLGAKIIKAEMMGNMELAEQLKVQLEKANKFKETITQIPKKSGVENEDQQEVILVRTDQSGRVWPVNTPGKSLESQGGRRKRQMVSTHEERERVRYFHDDDNLSLNDLVKNEKMGTAENQNKLFMRMASKFMGKTDGDYYTLDDMFVSKAAERERLGEEEENQRKKAIAEHRSLAAQMEKCLYCFDSSQFPKHLIVAIGVKVYLCLPNVRSLTEGHCLIVPLQHHRAATLLDEDIWEEIQMFRKSLVKMFEDKGLDCIFLETNMSMKKQYHMVYECIPLPKEVGDMAPIYFKKAIMESDEEWSMNKKLIDLSSKDIRKSVPRGLPYFSVDFGLHGGFAHVIEDQHKFPHYFGKEIIGGMLDIEPRLWRKGIRESFEDQRKKALQFAQWWKPYDFTKSKNY

SEQ ID NO: 749773 - protein, 152 aa, Homo sapiens [sequence omitted]

SEQ ID NO: 749774 - protein, 633 aa, Homo sapiens
MEIFQSKLEDAEKAASTKEDYRRERWRKPTYSDKAQNCQESRESDLVKYGNSSRDRYATTDTAKNSNNEKFIGDEKDKRPGSLETCRRESNPRQNQEFSFGNLRAKFLRPSDDEELSFHSKGRKFEPLSSSSALVAQGSLCSGFRKPTKNSEERLTSWSRSDGRGDKKHSNQKPSETSTDEHQHVPEDPREKSQDEVLRDDPPKKEHLRDTKSTFAGSPERESIHILSVDEKNKLGAKIIKAEMMGNMELAEQLKVQLEKANKFKETITQIPKKSGVENEDQQEVILVRTDQSGRVWPVNTPGKSLESQGGRRKRQMVSTHEERERVRYFHDDDNLSLNDLVKNEKMGTAENQNKLFMRMASKFMGKTDGDYYTLDDMFVSKAAERERLGEEEENQRKKAIAEHRSLAAQMEKCLYCFDSSQFPKHLIVAIGVKVYLCLPNVRSLTEGHCLIVPLQHHRAATLLDEDIWEEIQMFRKSLVKMFEDKGLDCIFLETNMSMKKQYHMVYECIPLPKEVGDMAPIYFKKAIMESDEEWSMNKKLIDLSSKDIRKSVPRGLPYFSVDFGLHGGFAHVIEDQHKFPHYFGKEIIGGMLDIEPRLWRKGIRESFEDQRKKALQFAQWWKPYDFTKSKNY

SEQ ID NO: 749775 - protein, 490 aa, Homo sapiens
MEIFQSKLEDAEKAASTKEDYRRERWRKPTYSDKAQNCQESRESDLVKYGNSSRDRYATTDTAKNSNNEKFIGDEKDKRPGSLETCRRESNPRQNQEFSFGNLRAKFLRPSDDEELSFHSKGRKFEPLSSSSALVAQGSLCSGFRKPTKNSEERLTSWSRSDGRGDKKHSNQKPSETSTDEHQHVPEDPREKSQDEVLRDDPPKKEHLRDTKSTFAGSPERESIHILSVDEKNKLGAKIIKAEMMGNMELAEQLKVQLEKANKFKETITQIPKKSGVENEDQQEVILVRTDQSGRVWPVNTPGKSLESQGGRRKRQMVSTHEERERVRYFHDDDNLSLNDLVKNEKMGTAENQNKLFMRMASKFMGKTDGDYYTLDDMFVSKAAERERLGEEEENQRKKAIAEHRSLAAQMEKCLYCFDSSQFPKHLIVAIGVKVYLCLPNVRSLTEGHCLIVPLQHHRAATLLDEDIWEEIQVSIINVHYHFKTHEQFL

SEQ ID NO: 749776 - protein, 1597 aa, Homo sapiens
ESAEPPLTQSDKRETSHTTAAATGRSSHADARECAISTQAEQEAKTLQTSTDSVSKEGNTNCKGEGMQVNTLFETSQVPDWSDPPQVQVQETVRETISCSQMPAFSEPAGEESPFTGTTTISFSNLGGVHKENASLAQHSEVKPCTCGPQQEEKQDRDGNIPDNFREDLKYEQSISEANDETMSPGVFSRHLPKDARADFREPVAVSVASPEPTDTALTLENVCDEPRDREAVCAMECFEASDQGTCFDTIDSLVGTPVDNYSPQEICSVDTELAEGQNKVSDLCSSNDKTLEVFFQTQVSETSVSTCKSSKDGNSVMSPLFISTFTLNISHTASEGATGENLAKVEKSTYPLASTVHAGQEQPSPSNSGGLDETQLLSSENNPLVQFKEGGDKSPSPSAADTTATPASYSSIVSFPWEKPTTLTANNECFQATRETVTIATEVHPAKYLAVSIPEDKHAGGTEERFPRASHEKVSQFPSQVQVDHILSGATIKSTKELLCRAPSVPGVPHHVLQLPEGEGFCSNSPLQVDNLSGDKSQTVDRADFRSYEENFQERGSETKQGVQQQSLSQQGSLSAPDFQQSLPTTSAAQEERNLVPTAPSPASSREGAGQRSGWGTRVSVVAETAGEEDSQALSNVPSLSDILLEESKEYRPGNWEAGNKLKIITLEASASEIWPPRQLTNSESKASDGGLIIPDKVWAVPDSLKADAVVPELAPSEIAALAHSPEDAESALADSRESHKGEEPTISVHWRSLSSRGFSQPRLLESSVDPVDEKELSVTDSLSAASETGGKENVNNVSQDQEEKQLKMDHTAFFKKFLTCPKILESSVDPIDEISVIEYTRAGKPEPSETTPQGAREGGQSNDGNMGHEAEIQSAILQVPCLQGTILSENRISRSQEGSMKQEAEQIQPEEAKTAIWQVLQPSEGGERIPSGCSIGQIQESSDGSLGEAEQSKKDKAELISPTSPLSSCLPIMTHSSLGVDTHNSTGQIHDVPENDIVEPRKRQYVFPVSQKRGTIENERGKPLPSSPDLTRFPCTSSPEGNVTDFLISHKMEEPKIEVLQIGETKPPSSSSSSAKTLAFISGERELEKAPKLLQDPCQKGTLGCAKKSREREKSLEARAGKSPGTLTAVTGSEEVKRKPEAPGSGHLAEGVKKKILSRVAALRLKLEEKENIRKNSAFLKKMPKLETSLSHTEEKQDPKKPSCKREGRAPVLLKKIQAEMFPEHSGNVKLSCQFAEIHEDSTICWTKDSKSIAQVQRSAGDNSTVSFAIVQASPKDQGLYYCCIKNSYGKVTAEFNLTAEVLKQLSSRQDTKGCEEIEFSQLIFKEDFLHDSYFGGRLRGQIATEELHFGEGVHRKAFRSTVMHGLMPVFKPGHACVLKVHNAIAYGTRNNDELIQRNYKLAAQECYVQNTARYYAKIYAAEAQPLEGFGEVPEIIPIFLIHRPENNIPYATVEEELIGEFVKYSIRDGKEINFLRRESEAGQKCCTFQHWVYQKTSGCLLVTDMQGVGMKLTDVGIATLAKGYKGFKGNCSMTFIDQFKALHQCNKYCKMLGLKSLQNNNQKQKQPSIGKSKVQTNSMTVKKAGPETPGEKKT

SEQ ID NO: 749777 - protein, 1299 aa, Homo sapiens
ESAEPPLTQSDKRETSHTTAAATGRSSHADARECAISTQAEQEAKTLQTSTDSVSKEGNTNCKGEGMQVNTLFETSQVPDWSDPPQVQVQETVRETISCSQMPAFSEPAGEESPFTGTTTISFSNLGGVHKENASLAQHSEVKPCTCGPQQEEKQDRDGNIPDNFREDLKYEQSISEANDETMSPGVFSRHLPKDARADFREPVAVSVASPEPTDTALTLENVCDEPRDREAVCAMECFEASDQGTCFDTIDSLVGTPVDNYSPQEICSVDTELAEGQNKVSDLCSSNDKTLEVFFQTQVSETSVSTCKSSKDGNSVMSPLFISTFTLNISHTASEGATGENLAKVEKSTYPLASTVHAGQEQPSPSNSGGLDETQLLSSENNPLVQFKEGGDKSPSPSAADTTATPASYSSIVSFPWEKPTTLTANNECFQATRETVTIATEVHPAKYLAVSIPEDKHAGGTEERFPRASHEKVSQFPSQVQVDHILSGATIKSTKELLCRAPSVPGVPHHVLQLPEGEGFCSNSPLQVDNLSGDKSQTVDRADFRSYEENFQERGSETKQGVQQQSLSQQGSLSAPDFQQSLPTTSAAQEERNLVPTAPSPASSREGAGQRSGWGTRVSVVAETAGEEDSQALSNVPSLSDILLEESKEYRPGNWEAGNKLKIITLEASASEIWPPRQLTNSESKASDGGLIIPDKVWAVPDSLKADAVVPELAPSEIAALAHSPEDAESALADSRESHKGEEPTISVHWRSLSSRGFSQPRLLESSVDPVDEKELSVTDSLSAASETGGKENVNNVSQDQEEKQLKMDHTAFFKKFLTCPKILESSVDPIDEISVIEYTRAGKPEPSETTPQGAREGGQSNDGNMGHEAEIQSAILQVPCLQGTILSENRISRSQEGSMKQEAEQIQPEEAKTAIWQVLQPSEGGERIPSGCSIGQIQESSDGSLGEAEQSKKDKAELISPTSPLSSCLPIMTHSSLGVDTHNSTGQIHDVPENDIVEPRKRQYVFPVSQKRGTIENERGKPLPSSPDLTRFPCTSSPEGNVTDFLISHKMEEPKIEVLQIGETKPPSSSSSSAKTLAFISGERELEKAPKLLQDPCQKGTLGCAKKSREREKSLEARAGKSPGTLTAVTGSEEVKRKPEAPGSGHLAEGVKKKILSRVAALRLKLEEKENIRKNSAFLKKMPKLETSLSHTEEKQDPKKPSCKREGRGEALLLSIIVKVWACRPGIQFLCPRGSFAIKASVPQVGIDAMVVAKWLQHVASESPGGLVKTQIAPLPQCVKFALLTSSQVIYRENHD

SEQ ID NO: 749778 - protein, 839 aa, Homo sapiens [sequence omitted]

SEQ ID NO: 749779 - protein, 839 aa, Homo sapiens [sequence omitted]

SEQ ID NO: 749780 - protein, 708 aa, Homo sapiens
MSVVGIDLGFLNCYIAVARSGGIETIANEYSDRCTPACISLGSRTRAIGNAAKSQIVTNVRNTIHGFKKLHGRSFDDPIVQTERIRLPYELQKMPNGSAGVKVRYLEEERPFAIEQVTGMLLAKLKETSENALKKPVADCVISIPSFFTDAERRSVMAAAQVAGLNCLRLMNETTAVALAYGIYKQDLPPLDEKPRNVVFIDMGHSAYQVSVCAFNKGKLKVLATTFDPYLGGRNFDEALVDYFCDEFKTKYKINVKENSRALLRLYQECEKLKKLMSANASDLPLNIECFMNDLDVSSKMNRAQFEQLCASLLARVEPPLKAVMEQANLQREDISSIEIVGGATRIPAVKEQITKFFLKDISTTLNADEAVARGCALQCAILSPAFKVREFSITDLVPYSITLRWKTSFEDGSGECEVFCKNHPAPFSKVITFHKKEPFELEAFYTNLHEVPYPDARIGSFTIQNVFPQSDGDSSKVKVKVRVNIHGIFSVASASVIEKQNLEGDHSDAPMETETSFKNENKDNMDKMQVDQEEGHQKCHAEHTPEEEIDHTGAKTKSAVSDKQDRLNQTLKKGKVKSIDLPIQSSLCRQLGQDLLNSYIENEGKMIMQDKLEKERNDAKNAQNKLSLTQDPVVKVSEIVAKSKELDNFCNPIIYKPKPKAEVPEDKPKANSEHNGPMDGQSGTETKSDSTKDSSQHTKSSGEMEVD

SEQ ID NO: 749781 - protein, 613 aa, Homo sapiens
MSVVGIDLGFLNCYIAVARSGGIETIANEYSDRCTPACISLGSRTRAIGNAAKSQIVTNVRNTIHGFKKLHGRSFDDPIVQTERIRLPYELQKMPNGSAGVKVRYLEEERPFAIEQVTGMLLAKLKETSENALKKPVADCVISIPSFFTDAERRSVMAAAQVAGLNCLRLMNETTAVALAYGIYKQDLPPLDEKPRNVVFIDMGHSAYQVSVCAFNKGKLKVLATTFDPYLGGRNFDEALVDYFCDEFKTKYKINVKENSRALLRLYQECEKLKKLMSANASDLPLNIECFMNDLDVSSKMNRAQFEQLCASLLARVEPPLKAVMEQANLQREDISSIEIVGGATRIPAVKEQITKFFLKDISTTLNADEAVARGCALQCAILSPAFKVREFSITDLVPYSITLRWKTSFEDGSGECEVFCKNHPAPFSKVITFHKKEPFELEAFYTNLHEVPYPDARIGSFTIQNVFPQSDGDSSKVKVKVRVNIHGIFSVASASVIEKQNLEGDHSDAPMETETSFKNENKDNMDKMQVDQEEGHQKCHAEHTPEEEIDHTGAKTKSAVSDKQDRLNQTLKKGKVKSIDLPIQSSLCRQLGQDLLNSYIENEVCKSELMLK

SEQ ID NO: 749782 - protein, 140 aa, Homo sapiens
PSLHPPFLHPSMPLSLHPSVPPSLRPSIPPSLHPSILHSSTPPFSIPPSSIPPSLHLSIPSSSILHPPSLHLSIPPFSILPSLHPSISPSLHSPSLLHPPFSFHLSIPPFSIPPFSIPPSLHPSICPSLHPPSLYSSILH

SEQ ID NO: 749783 - protein, 90 aa, Homo sapiens
TVLYRESVFKLCPKLTYLDGYTERTRKHLYSDAEVDGVDEEEEDEEGEDEEDEDEGGRYTQCSHCAGSHSLVDQTRVDKDTRGFVGSLRA

SEQ ID NO: 749784 - protein, 292 aa, Homo sapiens
MPSELNKLRNCRVPQFPHVYNGNDYNKQDLFEELPGGLSDAKAPREALRFHAEAKGAQVRLDTRGCIAHRRTTFHDGIVFSQRPVRLGERVALRVLREESGWCGGLRVGFTRLDPACVSVPSLPPFLCPDLEEQSPTWAAVLPEGCALTGDLVRFWVDRRGCLFAKVNAGCRLLLREGVPVGAPLWAVMDVYGTTKAIELLDPTASRLPTPMPWDLSNKAVPEPKATPGEECAICFYHAANTRLVPCGHTYFCRYCAWRVFSDTAKCPVCRWQIEAVAPAQGPPALRVEEGS

SEQ ID NO: 749785 - protein, 290 aa, Homo sapiens
MLLGLCISGPTLPDAKAPREALRFHAEAKGAQVRLDTRGCIAHRRTTFHDGIVFSQRPVRLGERVALRVLREESGWCGGLRVGFTRLDPACVSVPSLPPFLCPDLEEQSPTWAAVLPEGCALTGDLVRFWVDRRGCLFAKVNAGCRLLLREGVPVGAPLWAVMDVYGTTKAIELLDPTASRLPTPMPWDLSNKAVPEPKGFGPKDLALPTGNLKATWHLCLREHLPTLHTRRGVCHLLLSRCQHPPCALRPHILLQILCLAGLQRYGQVPCVPLADRGGSPCAGPSCSEG

SEQ ID NO: 749786 - protein, 238 aa, Homo sapiens
GLSDFRHRSLSMAPYHIRKYQESDRKSVVGLLSGGMAEHAPATFRRLLKLPRTLILLLGGALALLLVSGSWILALVFSLSLLPALWFLAKKPWTRYVDIALRTDMSDITKSYLSECGSCFWVAESEEKVVGTVGALPVDDPTLREKRLQLFHLSVDNEHRGQGIAKALVRTVLQFARDQGYSEVVLDTSNIQLSAMGLYQSLGFKKTGQSFFHVWARLVDLHTVHFIYHLPSAQAGRL

SEQ ID NO: 749787 - protein, 66 aa, Homo sapiens
APQNTVWDCPPAGWPSAPLPVLAFCGLNGRTRMAARGGQATVGLPHSQLLAHILSSPWHEVIGQSL

SEQ ID NO: 749788 - protein, 1092 aa, Homo sapiens
IRGSGYHGAGVGTEALLTPLVGRLARLLEATPTDSCGYFRETIRRDIRQARERFSGPQLRQELARLQRRLDSVELLSPDIIMNLLLSYRDVQDYSAIIELVETLQALPTCDVAEQHNVCFHYTFALNRRNRPGDRAKALSVLLPLVQLEGSVAPDLYCMCGRIYKDMFFSSGFQDAGHREQAYHWYRKAFDVEPSLHSGINAAVLLIAAGQHFEDSKELRLIGMKLGCLLARKGCVEKMQYYWDVGFYLGAQILANDPTQVVLAAEQLYKLNAPIWYLVSVMETFLLYQHFRPTPEPPGGPPRRAHFWLHFLLQSCQPFKTACAQGDQCLVLVLEMNKVLLPAKLEVRGTDPVSTVTLSLLEPETQDIPSSWTFPVASICGVSASKRDERCCFLYALPPAQDVQLCFPSVGHCQWFCGLIQAWVTNPDSTAPAEEAEGAGEMLEFDYEYTETGERLVLGKGTYGVVYAGRDRHTRVRIAIKEIPERDSRFSQPLHEEIALHRRLRHKNIVRYLGSASQGGYLKIFMEEVPGGSLSSLLRSVWGPLKDNESTISFYTRQILQGLGYLHDNHIVHRDIKGDNVLINTFSGLLKISDFGTSKRLAGITPCTETFTGTLQYMAPEIIDQGPRGYGKAADIWSLGCTVIEMATGRPPFHELGSPQAAMFQVGMYKVHPPMPSSLSAEAQAFLLRTFEPDPRLRASAQTLLGDPFLQPGKRSRSPSSPRHAPRPSDAPSASPTPSANSTTQSQTFPCPQAPSQHPPSPPKRCLSYGGTSQLRVPEEPAAEEPASPEESSGLSLLHQESKRRAMLAAVLEQELPALAENLHQEQKQEQGARLGRNHVEELLRCLGAHIHTPNRRQLAQELRALQGRLRAQGLGPALLHRPLFAFPDAVKQILRKRQIRPHWMFVLDSLLSRAVRAALGVLGPEVEKEAVSPRSEELSNEGDSQQSPGQQSPLPVEPEQGPAPLMVQLSLLRAETDRLREILAGKEREYQALVQRALQRLNEEARTYVLAPEPPTALSTDQGLVQWLQELNVDSGTIQMLLNHSFTLHTLLTYATRDDLIYTRIRGGMVCRIWRAILAQRAGSTPVTSGP

SEQ ID NO: 749789 - protein, 1074 aa, Homo sapiens
MAGPCPRSGAERAGSCWQDPLAVALSRGRQLAAPPGRGCARSRPLSVVYVLTREPQPGLEPREGTEAEPLPLRCLREACAQVPRPRPPPQLRSLPFGTLELGDTAALDAFYNADVVVLEVSSSLVQPSLFYHLGVRESFSMTNNVLLCSQADLPDLQALREDVFQKNSDCVGSYTLIPYVVTATGRVLCGDAGLLRGLADGLVQAGVGTEALLTPLVGRLARLLEATPTDSCGYFRETIRRDIRQARERFSGPQLRQELARLQRRLDSVELLSPDIIMNLLLSYRDVQDYSAIIELVETLQALPTCDVAEQHNVCFHYTFALNRRNRPGDRAKALSVLLPLVQLEGSVAPDLYCMCGRIYKDMFFSSGFQDAGHREQAYHWYRKAFDVEPSLHSGINAAVLLIAAGQHFEDSKELRLIGMKLGCLLARKGCVEKMQYYWDVGFYLGAQILANDPTQVVLAAEQLYKLNAPIWYLVSVMETFLLYQHFRPTPEPPGGPPRRAHFWLHFLLQSCQPFKTACAQGDQCLVLVLEMNKVLLPAKLEVRGTDPVSTVTLSLLEPETQDIPSSWTFPVASICGVSASKRDERCCFLYALPPAQDVQLCFPSVGHCQWFCGLIQAWVTNPDSTAPAEEAEGAGEMLEFDYEYTETGERLVLGKGTYGVVYAGRDRHTRVRIAIKEIPERDSRFSQPLHEEIALHRRLRHKNIVRYLGSASQGGYLKIFMEEVPGGSLSSLLRSVWGPLKDNESTISFYTRQILQGLGYLHDNHIVHRDIKGDNVLINTFSGLLKISDFGTSKRLAGITPCTETFTGTLQYMAPEIIDQGPRGYGKAADIWSLGCTVIEMATGRPPFHELGSPQAAMFQVGMYKVHPPMPSSLSAEAQAFLLRTFEPDPRLRASAQTLLGDPFLQPGKRSRSPSSPRHAPRPSDAPSASPTPSANSTTQSQTFPCPQAPSQHPPSPPKRCLSYGGTSQLRVPEEPAAEEPASPEESSGLSLLHQESKRRAMLAAVLEQELPALAENLHQEQKQEQGARLGRNHVEELLRCLGAHIHTPNRRQLAQELRALQGWMNGEDKGSF

SEQ ID NO: 749790 - protein, 1321 aa, Homo sapiens
MAGPCPRSGAERAGSCWQDPLAVALSRGRQLAAPPGRGCARSRPLSVVYVLTREPQPGLEPREGTEAEPLPLRCLREACAQVPRPRPPPQLRSLPFGTLELGDTAALDAFYNADVVVLEVSSSLVQPSLFYHLGVRESFSMTNNVLLCSQADLPDLQALREDVFQKNSDCVGSYTLIPYVVTATGRVLCGDAGLLRGLADGLVQAGVGTEALLTPLVGRLARLLEATPTDSCGYFRETIRRDIRQARERFSGPQLRQELARLQRRLDSVELLSPDIIMNLLLSYRDVQDYSAIIELVETLQALPTCDVAEQHNVCFHYTFALNRRNRPGDRAKALSVLLPLVQLEGSVAPDLYCMCGRIYKDMFFSSGFQDAGHREQAYHWYRKAFDVEPSLHSGINAAVLLIAAGQHFEDSKELRLIGMKLGCLLARKGCVEKMQYYWDVGFYLGAQILANDPTQVVLAAEQLYKLNAPIWYLVSVMETFLLYQHFRPTPEPPGGPPRRAHFWLHFLLQSCQPFKTACAQGDQCLVLVLEMNKVLLPAKLEVRGTDPVSTVTLSLLEPETQDIPSSWTFPVASICGVSASKRDERCCFLYALPPAQDVQLCFPSVGHCQWFCGLIQAWVTNPDSTAPAEEAEGAGEMLEFDYEYTETGERLVLGKGTYGVVYAGRDRHTRVRIAIKEIPERDSRFSQPLHEEIALHRRLRHKNIVRYLGSASQGGYLKIFMEEVPGGSLSSLLRSVWGPLKDNESTISFYTRQILQGLGYLHDNHIVHRDIKGDNVLINTFSGLLKISDFGTSKRLAGITPCTETFTGTLQYMAPEIIDQGPRGYGKAADIWSLGCTVIEMATGRPPFHELGSPQAAMFQVGMYKVHPPMPSSLSAEAQAFLLRTFEPDPRLRASAQTLLGDPFLQPGKRSRSPSSPRHAPRPSGACGWRDGHSGGQRSCGAVRVEESPADGSVPPSDAPSASPTPSANSTTQSQTFPCPQAPSQHPPSPPKRCLSYGGTSQLRVPEEPAAEEPASPEESSGLSLLHQESKRRAMLAAVLEQELPALAENLHQEQKQEQGARLGRNHVEELLRCLGAHIHTPNRRQLAQELRALQGRLRAQGLGPALLHRPLFAFPDAVKQILRKRQIRPHWMFVLDSLLSRAVRAALGVLGPEVEKEAVSPRSEELSNEGDSQQSPGQQSPLPVEPEQGPAPLMVQLSLLRAETDRLREILAGKEREYQALVQRALQRLNEEARTYVLAPEPPTALSTDQGLVQWLQELNVDSGTIQMLLNHSFTLHTLLTYATRDDLIYTRIRGGMVCRIWRAILAQRAGSTPVTSGP

SEQ ID NO: 749791 - protein, 1266 aa, Homo sapiens
MAGPCPRSGAERAGSCWQDPLAVALSRGRQLAAPPGRGCARSRPLSVVYVLTREPQPGLEPREGTEAEPLPLRCLREACAQVPRPRPPPQLRSLPFGTLELGDTAALDAFYNADVVVLEVSSSLVQPSLFYHLGVRESFSMTNNVLLCSQADLPDLQALREDVFQKNSDCVGSYTLIPYVVTATGRVLCGDAGLLRGLADGLVQAGVGTEALLTPLVGRLARLLEATPTDSCGYFRETIRRDIRQARERFSGPQLRQELARLQRRLDSVELLSPDIIMNLLLSYRDVQDYSAIIELVETLQALPTCDVAEQHNVCFHYTFALNRRNRPGDRAKALSVLLPLVQLEGSVAPDLYCMCGRIYKDMFFSSGFQDAGHREQAYHWYRKAFDVEPSLHSGINAAVLLIAAGQHFEDSKELRLIGMKLGCLLARKGCVEKMQYYWDVGFYLGAQILANDPTQVVLAAEQLYKLNAPIWYLVSVMETFLLYQHFRPTPEPPGGPPRRAHFWLHFLLQSCQPFKTACAQGDQCLVLVLEMNKVLLPAKLEVRGTDPVSTVTLSLLEPETQDIPSSWTFPVASICGVSASKRDERCCFLYALPPAQDVQLCFPSVGHCQWFCGLIQAWVTNPDSTAPAEEAEGAGEMLEFDYEYTETGERLVLGKGTYGVVYAGRDRHTRVRIAIKEIPERDSRFSQPLHEEIALHRRLRHKNIVRYLGSASQGGYLKIFMEEVPGGSLSSLLRSVWGPLKDNESTISFYTRQILQGLGYLHDNHIVHRDIKGDNVLINTFSGLLKISDFGTSKRLAGITPCTETFTGTLQYMAPEIIDQGPRGYGKAADIWSLGCTVIEMATGRPPFHELGSPQAAMFQVGMYKVHPPMPSSLSAEAQAFLLRTFEPDPRLRASAQTLLGDPFLQPGKRSRSPSSPRHAPRPSDAPSASPTPSANSTTQSQTFPCPQAPSQHPPSPPKRCLSYGGTSQLRVPEEPAAEEPASPEESSGLSLLHQESKRRAMLAAVLEQELPALAENLHQEQKQEQGARLGRNHVEELLRCLGAHIHTPNRRQLAQELRALQGRLRAQGLGPALLHRPLFAFPDAVKQILRKRQIRPHWMFVLDSLLSRAVRAALGVLGPEVEKEAVSPRSEELSNEGDSQQSPGQQSPLPVEPEQGPAPLMVQLSLLRAETDRLREILAGKEREYQALVQRALQRLNEEARTYVLAPEPPTALSTDQGLVQWLQELNVDSGTIQMGRDGMPHLEGHLGTASRIHTSHLWTLRAE

SEQ ID NO: 749792 - protein, 528 aa, Homo sapiens
RVVDLRVSPSSGKGDNVLINTFSGLLKISDFGTSKRLAGITPCTETFTGTLQYMAPEIIDQGPRGYGKAADIWSLGCTVIEMATGRPPFHELGSPQAAMFQVGMYKVHPPMPSSLSAEAQAFLLRTFEPDPRLRASAQTLLGDPFLQPGKRSRSPSSPRHAPRPSDAPSASPTPSANSTTQSQTFPCPQAPSQHPPSPPKRCLSYGGTSQLRVPEEPAAEEPASPEESSGLSLLHQESKRRAMLAAVLEQELPALAENLHQEQKQEQGARLGRNHVEELLRCLGAHIHTPNRRQLAQELRALQGRLRAQGLGPALLHRPLFAFPDAVKQILRKRQIRPHWMFVLDSLLSRAVRAALGVLGPEVEKEAVSPRSEELSNEGDSQQSPGQQSPLPVEPEQGPAPLMVQLSLLRAETDRLREILAGKEREYQALVQRALQRLNEEARTYVLAPEPPTALSTDQGLVQWLQELNVDSGTIQMLLNHSFTLHTLLTYATRDDLIYTRIRGGMVCRIWRAILAQRAGSTPVTSGP

SEQ ID NO: 749793 - protein, 523 aa, Homo sapiens
MGIGAPVSVLGTLQYMAPEIIDQGPRGYGKAADIWSLGCTVIEMATGRPPFHELGSPQAAMFQVGMYKVHPPMPSSLSAEAQAFLLRTFEPDPRLRASAQTLLGDPFLQPGKRSRSPSSPRHAPRPSGACGWRDGHSGGQRSCGAVRVEESPADGSVPPSDAPSASPTPSANSTTQSQTFPCPQAPSQHPPSPPKRCLSYGGTSQLRVPEEPAAEEPASPEESSGLSLLHQESKRRAMLAAVLEQELPALAENLHQEQKQEQGARLGRNHVEELLRCLGAHIHTPNRRQLAQELRALQGRLRAQGLGPALLHRPLFAFPDAVKQILRKRQIRPHWMFVLDSLLSRAVRAALGVLGPEVEKEAVSPRSEELSNEGDSQQSPGQQSPLPVEPEQGPAPLMVQLSLLRAETDRLREILAGKEREYQALVQRALQRLNEEARTYVLAPEPPTALSTDQGLVQWLQELNVDSGTIQMLLNHSFTLHTLLTYATRDDLIYTRIRGGMVCRIWRAILAQRAGSTPVTSGP

SEQ ID NO: 749794 - protein, 588 aa, Homo sapiens
MAGPCPRSGAERAGSCWQDPLAVALSRGRQLAAPPGRGCARSRPLSVVYVLTREPQPGLEPREGTEAEPLPLRCLREACAQVPRPRPPPQLRSLPFGTLELGDTAALDAFYNADVVVLEVSSSLVQPSLFYHLGVRESFSMTNNVLLCSQADLPDLQALREDVFQKNSDCVGSYTLIPYVVTATGRVLCGDAGLLRGLADGLVQAGVGTEALLTPLVGRLARLLEATPTDSCGYFRETIRRDIRQARERFSGPQLRQELARLQRRLDSVELLSPDIIMNLLLSYRDVQDYSAIIELVETLQALPTCDVAEQHNVCFHYTFALNRRNRPGDRAKALSVLLPLVQLEGSVAPDLYCMCGRIYKDMFFSSGFQDAGHREQAYHWYRKAFDVEPSLHSGINAAVLLIAAGQHFEDSKELRLIGMKLGCLLARKGCVEKMQYYWDVGFYLGAQILANDPTQVVLAAEQLYKLNAPIWYLVSVMETFLLYQHFRPTPEPPGGPPRRAHFWLHFLLQSCQPFKTACAQGDQCLVLVLEMNKVLLPAKLEVRGTDPVSTVTLSLLEPETQDIPSSWTFPVASICGVSLKSDDLCPI

SEQ ID NO: 749795 - protein, 126 aa, Homo sapiens [sequence omitted]

SEQ ID NO: 749796 - protein, 359 aa, Homo sapiens
GALADNPSLPSQGARLGRNHVEELLRCLGAHIHTPNRRQLAQELRALQGRLRAQGLGPALLHRPLFAFPDAVKQILRKRQIRPHWMFVLDSLLSRAVRAALGVLGPGRRGMPRASCQRGCGACWARGTSNGAGGGQAGQGQAGAGGGVTKWTSPIPAPPGACPEPGTLPPHFGVWGSQTGVVALPEFTAWAAEVEKEAVSPRSEELSNEGDSQQSPGQQSPLPVEPEQGPAPLMVQLSLLRAETDRLREILAGKEREYQALVQRALQRLNEEARTYVLAPEPPTALSTDQGLVQWLQELNVDSGTIQMLLNHSFTLHTLLTYATRDDLIYTRIRGGMVCRIWRAILAQRAGSTPVTSGP

SEQ ID NO: 749797 - protein, 465 aa, Homo sapiens
DQKELASPVSPELRQKEVQMNFLNQLTSVFNPRTVASQPISTQTLVEGENDEQSSTDQASAIKTKNVFIAQNVASLQELGGSEKLLRVCLNLPYFLRYINRFQDAVLANSFFIMPATVADATAVRNGFHSLVIDVTMALDTLSLPVLEPLNPSRLQDVTVLSLSCLYAGVSVATCMAILHVGSAQQVRTGSTSSKEDDYESDAATIVQKCLEIYDMIGQAISSSRRAGGEHYQNFQLLGAWCLLNSLFLILNLSPTALADKGKEKDPLAALRVRDILSRTKEGVGSPKLGPGKGHQGFGVLSVILANHAIKLLTSLFQDLQVEALHKGWETDGPPAALSIMAQSTSIQRIQRLIDSVPLMNLLLTLLSTSYRKACVLQRQRKGSMSSDASASTDSNTYYEDDFSSTEEDSSQDDDSEPILGAMVLRETISSQLKRKAGTFRLLPHLLHWKALLGLKAPVSRPLVR

SEQ ID NO: 749798 - protein, 388 aa, Homo sapiens
DQKELASPVSPELRQKEVQMNFLNQLTSVFNPRTVASQPISTQTLVEGENDEQSSTDQASAIKTKNVFIAQNVASLQELGGSEKLLRVCLNLPYFLRYINRFQDAVLANSFFIMPATVADATAVRNGFHSLVIDVTMALDTLSLPVLEPLNPSRLQDVTVLSLSCLYAGVSVATCMAILHVGSAQQVRTGSTSSKEDDYESDAATIVQKCLEIYDMIGQAISSSRRAGGEHYQNFQLLGAWCLLNSLFLILNLSPTALADKGKEKDPLAALRVRDILSRTKEGVGSPKLGPGKGHQGFGVLSVILANHAIKLLTSLFQDLQVEALHKGWETDGPPAALSIMAQSTSIQRIQRLIDSVPLMNLLLTLLSTSYRKGPLVSPPIEETGGGV

SEQ ID NO: 749799 - protein, 65 aa, Homo sapiens
MFFILCLSQQHYQNFQLLGAWCLLNSLFLILNLSPTALADKGKEKDPLAALRVRDILSRTKEGVG

SEQ ID NO: 749800 - protein, 108 aa, Homo sapiens [sequence omitted]

SEQ ID NO: 749801 - protein, 582 aa, Homo sapiens
MAARSWQDELAQQAEEGSARLREMLSVGLGFLRTELGLDLGLEPKRYPGWVILVGTGALGLLLLFLLGYGWAAACAGARKKRRSPPRKREEAAAVPAAAPDDLALLKNLRSEEQKKKNRKKLSEKPKPNGRTVEVAEGEAVRTPQSVTAKQPPEIDKKNEKSKKNKKKSKSDAKAVQNSSRHDGKEVDEGAWETKISHREKRQQRKRDKVLTDSGSLDSTIPGIENTITVTTEQLTTASFPVGSKKNKGDSHLNVQVSNFKSGKGDSTLQVSSGLNENLTVNGGGWNEKSVKLSSQISAGEEKWNSVSPASAGKRKTEPSAWSQDTGDANTNGKDWGRSWSDRSIFSGIGSTAEPVSQSTTSDYQWDVSRNQPYIDDEWSGLNGLSSADPNSDWNAPAEEWGNWVDEERASLLKSQEPIPDDQKVSDDDKEKGEGALPTGKSKKKKKKKKKQGEDNSTAQDTEELEKEIREDLPVNTSKTRPKQEKAFSLKTISTSDPAEVLVKNSQPIKTLPPATSTEPSVILSKSDSDKSSSQVPPILQETDKSKSNTKQNSVPPSQTKSETSWESPKQIKKKKKARRET

SEQ ID NO: 749802 - protein, 582 aa, Homo sapiens; identical to SEQ ID NO: 749801

SEQ ID NO: 749803 - protein, 582 aa, Homo sapiens; identical to SEQ ID NO: 749801

SEQ ID NO: 749804 - protein, 493 aa, Homo sapiens
PASEEARLAGPDDLALLKNLRSEEQKKKNRKKLSEKPKPNGRTVEVAEGEAVRTPQSVTAKQPPEIDKKNEKSKKNKKKSKSDAKAVQNSSRHDGKEVDEGAWETKISHREKRQQRKRDKVLTDSGSLDSTIPGIENTITVTTEQLTTASFPVGSKKNKGDSHLNVQVSNFKSGKGDSTLQVSSGLNENLTVNGGGWNEKSVKLSSQISAGEEKWNSVSPASAGKRKTEPSAWSQDTGDANTNGKDWGRSWSDRSIFSGIGSTAEPVSQSTTSDYQWDVSRNQPYIDDEWSGLNGLSSADPNSDWNAPAEEWGNWVDEERASLLKSQEPIPDDQKVSDDDKEKGEGALPTGKSKKKKKKKKKQGEDNSTAQDTEELEKEIREDLPVNTSKTRPKQEKAFSLKTISTSDPAEVLVKNSQPIKTLPPATSTEPSVILSKSDSDKSSSQVPPILQETDKSKSNTKQNSVPPSQTKSETSWESPKQIKKKKKARRET

SEQ ID NO: 749805 - protein, 787 aa, Homo sapiens [sequence omitted]

SEQ ID NO: 749806 - protein, 787 aa, Homo sapiens [sequence omitted]

SEQ ID NO: 749807 - protein, 696 aa, Homo sapiens
MPVFSFGQIYSRGELHHFIDGFNEEKSNWMRYVNPAHSPREQNLAACQNGMNIYFYTIKPIPANQELLVWYCRDFAERLHYPYPGELTMMNLTQTQSSLKQPSTEKNELCPKNVPKREYSVKEILKLDSNPSKGKDLYRSNISPLTSEKDLDDFRRRGSPEMPFYPRVVYPIRAPLPEDFLKASLAYGIERPTYITRSPIPSSTTPSPSARSSPDQSLKSSSPHSSPGNTVSPVGPGSQEHRDSYAYLNASYGTEGLGSYPGYAPLPHLPPAFIPSYNAHYPKFLLPPYGMNCNGLSAVSSMNGINNFGLFPRLCPVYSNLLGGGSLPHPMLNPTSLPSSLPSDGARRLLQPEHPREVLVPAPHSAFSFTGAAASMKDKACSPTSGSPTAGTAATAEHVVQPKATSAAMAAPSSDEAMNLIKNKRNMTGYKTLPYPLKKQNGKIKYECNVCAKTFGQLSNLKVHLRVHSGERPFKCQTCNKGFTQLAHLQKHYLVHTGEKPHECQVCHKRFSSTSNLKTHLRLHSGEKPYQCKVCPAKFTQFVHLKLHKRLHTRERPHKCSQCHKNYIHLCSLKVHLKGNCAAAPAPGLPLEDLTRINEEIEKFDISDNADRLEDVEDDISVISVVEKEILAVVRKEKEETGLKVSLQRNMGNGLLSSGCSLYESSDLPLMKLPPSNPLPLVPVKVKQETVEPMDP

SEQ ID NO: 749808 - protein, 629 aa, Homo sapiens
MDMEDADMTLWTEAEFEEKCTYIVNDHPWDSGADGGTSVQAEASLPRNLLFKYATNSEEVIGVMSKEYIPKGTRFGPLIGEIYTNDTVPKNANRKYFWRIYSRGELHHFIDGFNEEKSNWMRYVNPAHSPREQNLAACQNGMNIYFYTIKPIPSSPHSSPGNTVSPVGPGSQEHRDSYAYLNASYGTEGLGSYPGYAPLPHLPPAFIPSYNAHYPKFLLPPYGMNCNGLSAVSSMNGINNFGLFPRLCPVYSNLLGGGSLPHPMLNPTSLPSSLPSDGARRLLQPEHPREVLVPAPHSAFSFTGAAASMKDKACSPTSGSPTAGTAATAEHVVQPKATSAAMAAPSSDEAMNLIKNKRNMTGYKTLPYPLKKQNGKIKYECNVCAKTFGQLSNLKVHLRVHSGERPFKCQTCNKGFTQLAHLQKHYLVHTGEKPHECQVCHKRFSSTSNLKTHLRLHSGEKPYQCKVCPAKFTQFVHLKLHKRLHTRERPHKCSQCHKNYIHLCSLKVHLKGNCAAAPAPGLPLEDLTRINEEIEKFDISDNADRLEDVEDDISVISVVEKEILAVVRKEKEETGLKVSLQRNMGNGLLSSGCSLYESSDLPLMKLPPSNPLPLVPVKVKQETVEPMDP

SEQ ID NO: 749809 - protein, 88 aa, Homo sapiens
RDLHYYFPAFTAGVLVVQTPGMKLQGGTQFQDTKNTQLLSNLLPPWTSAHEHSTGTQRFRQGLQECCAWSNPECQQACLSQHCYKVQG

SEQ ID NO: 749810 - protein, 500 aa, Homo sapiens
MAWAALLGLLAALLLLLLLSRRRTRRPGEPPLDLGSIPWLGYALDFGKDAASFLTRMKEKHGDIFTILVGGRYVTVLLDPHSYDAVVWEPRTRLDFHAYAIFLMERIFDVQLPHYSPSDEKARMKLTLLHRELQALTEAMYTNLHAVLLGDATEAGSGWHEMGLLDFSYSFLLRAGYLTLYGIEALPRTHESQAQDRVHSADVFHTFRQLDRLLPKLARGSLSVGDKDHMCSVKSRLWKLLSPARLARRAHRSKWLESYLLHLEEMGVSEEMQARALVLQLWATQGNMGPAAFWLLLFLLKNPEALAAVRGELESILWQAEQPVSQTTTLPQKVLDSTPVLDSVLSESLRLTAAPFITREVVVDLAMPMADGREFNLRRGDRLLLFPFLSPQRDPEIYTDPEVFKYNRFLNPDGSEKKDFYKDGKRLKNYNMPWGAGHNHCLGRSYAVNSIKQFVFLVLVHLDLELINADVEIPEFDLSRYGFGLMQPEHDVPVRYRIRP

SEQ ID NO: 749811 - protein, 500 aa, Homo sapiens; identical to SEQ ID NO: 749810

SEQ ID NO: 749812 - protein, 500 aa, Homo sapiens; identical to SEQ ID NO: 749810

SEQ ID NO: 749813 - protein, 191 aa, Homo sapiens
MQGGPGYLERPKLKLQDLGAGKGAGETIPTLPRAPDFLLRTLSSLESVITSFPLFYRPKGLRLGDSWHFLPPELYCKRVAREVGAVVGAREGGSAGPGRGAGTGHSLGALDLASLLPALQTNAWRLSEVLLRSSQPLTGPQKRRCYRDQELLRTALAGARPWARGFIMDTLSAQAAKQARVTGGGTETKAA

SEQ ID NO: 749814 - protein, 129 aa, Homo sapiens
MGDSWHFLPPELYCKRVAREVGAVVGAREGGSAGPGRGAGTGHSLGALDLASLLPALQTNAWRLSEVLLRSSQPLTGPQKRRCYRDQELLRTALAGARPWARGFIMDTLSAQAAKQARVTGGGTETKAA

SEQ ID NO: 749815 - protein, 134 aa, Homo sapiens
MHPACDFTGPTHPGPLEQDHGWIPGTGGVEVDPGKCRVKGGLRCTPCGLGSTSQKSNKDSRTHSTSSIPWPSVEPQSLRLWQGLFLRWTCSPEPAEAAWGKSVANSDRKGEDRSLSANCFSRAPILSTGSLDSS

SEQ ID NO: 749816 - protein, 102 aa, Homo sapiens
MERCRVKGGLRCTPCGLGSTSQKSNKDSRTHSTSSIPWPSVEPQSLRLWQGLFLRWTCSPEPAEAAWGKSVANSDRKGEDRSLSANCFSRAPILSTGSLDSS

SEQ ID NO: 749817 - protein, 309 aa, Homo sapiens
SVSGSEREKCRGCSGGGGGSSGSGDDGGGSAPTGSSLRAPPSSRERASASGQAPARRRQRPRPLGGTALTQGLHRHPEPNSKMGGKLSKKKKGYNVNDEKAKEKDKKAEGAATEEEGTPKESEPQAAAEPAEAKEGKEKPDQDAEGKAEEKEGEKDAAAAKEEAPKAEPEKTEGAAEAKAEPPKAPEQEQAAPGPAAGGEAPKAAEAAAAPAESAAPAAGEEPSKEEGEPKKTEAPAAPAAQETKSDGAPASDSKPGSSEAAPSSKETPAATEAPSSTPKAQGPAASAEEPKPVEAPAANSDQTVTVKE

SEQ ID NO: 749818 - protein, 309 aa, Homo sapiens; identical to SEQ ID NO: 749817

SEQ ID NO: 749819 - protein, 315 aa, Homo sapiens
VWHPTDPTSVSLLMLCCQNYPSCLPLGPGTIAEEMTSLYVTQAGLELWAQAILLPHLLKCWDYRKGSQSRPQGRILGSHAKKEFRNSKMGGKLSKKKKGYNVNDEKAKEKDKKAEGAATEEEGTPKESEPQAAAEPAEAKEGKEKPDQDAEGKAEEKEGEKDAAAAKEEAPKAEPEKTEGAAEAKAEPPKAPEQEQAAPGPAAGGEAPKAAEAAAAPAESAAPAAGEEPSKEEGEPKKTEAPAAPAAQETKSDGAPASDSKPGSSEAAPSSKETPAATEAPSSTPKAQGPAASAEEPKPVEAPAANSDQTVTVKE

SEQ ID NO: 749820 - protein, 291 aa, Homo sapiens
SVSGSEREKCRGCSGGGGGSSGSGDDGGGSAPTGSSLRAPPSSRERASASGQAPARRRQRPRPLGGTALTQGLHRHPEPNSKMGGKLSKKKKGYNVNDEKAKEKDKKAEGAATEEEGTPKESEPQAAAEPAEAKEGKEKPDQDAEGKAEEKEGEKDAAAAKEEAPKAEPEKTEGAAEAKAEPPKAPEQEQAAPGPAAGGEAPKAAEAAAAPAESAAPAAGEEPSKEEGEPKKTEAPAAPAAQETKSDGAPASDSEAPSSTPKAQGPAASAEEPKPVEAPAANSDQTVTVKE

SEQ ID NO: 749821 - protein, 297 aa, Homo sapiens
PTPPFRLASASLSFTSPRGGGGGGGSSGSGDDGGGSAPTGSSLRAPPSSRERASASGQAPARRRQRPRPLGGTALTQGLHRHPEPNSKMGGKLSKKKKGYNVNDEKAKEKDKKAEGAATEEEGTPKESEPQAAAEPAEAKEGKEKPDQDAEGKAEEKEGEKDAAAAKEEAPKAEPEKTEGAAEAKAEPPKAPEQEQAAPGPAAGGEAPKAAEAAAAPAESAAPAAGEEPSKEEGEPKKTEAPAAPAAQETKSDGAPASDSEAPSSTPKAQGPAASAEEPKPVEAPAANSDQTVTVKE

SEQ ID NO: 749822 - protein, 281 aa, Homo sapiens
SVSGSEREKCRGCSGGGGGSSGSGDDGGGSAPTGSSLRAPPSSRERASASGQAPARRRQRPRPLGGTALTQGLHRHPEPNSKMGGKLSKKKKGYNVNDEKAKEKDKKAEGAATEEEGTPKESEPQAAAEPAEAKEGKEKPDQDAEGKAEEKEGEKDAAAAKEEAPKAEPEKTAPKAAEAAAAPAESAAPAAGEEPSKEEGEPKKTEAPAAPAAQETKSDGAPASDSKPGSSEAAPSSKETPAATEAPSSTPKAQGPAASAEEPKPVEAPAANSDQTVTVKE

SEQ ID NO: 749823 - protein, 259 aa, Homo sapiens
SVSGSEREKCRGCSGGGGGSSGSGDDGGGSAPTGSSLRAPPSSRERASASGQAPARRRQRPRPLGGTALTQGLHRHPEPNSKMGGKLSKKKKGYNVNDEKAKEKDKKAEGAATEEEGTPKESEPQAAAEPAEAKEGKEKPDQDAEGKAEEKEGEKDAAAAKEEAPKAEPEKTPSKEEGEPKKTEAPAAPAAQETKSDGAPASDSKPGSSEAAPSSKETPAATEAPSSTPKAQGPAASAEEPKPVEAPAANSDQTVTVKE

SEQ ID NO: 749824 - protein, 309 aa, Homo sapiens; identical to SEQ ID NO: 749817

SEQ ID NO: 749825 - protein, 209 aa, Homo sapiens
KLAAAEPAEAKEGKEKPDQDAEGKAEEKEGEKDAAAAKGGGSSLRAPPSSRERASASGQAPARRRQRPRPLGGTALTQGLHRHPEPNSKMGGKLSKKKKGYNVNDEKAKEKDKKAEGAATEEPSKEEGEPKKTEAPAAPAAQETKSDGAPASDSKPGSSEAAPSSKETPAATEAPSSTPKAQGPAASAEEPKPVEAPAANSDQTVTVKE

SEQ ID NO: 749826 - protein, 99 aa, Homo sapiens
EFKLDCCRNSARPSKEEGEPKKTEAPAAPAAQETKSDGAPASDSKPGSSEAAPSSKETPAATEAPSSTPKAQGPAASAEEPKPVEAPAANSDQTVTVKE

SEQ ID NO: 749827 - protein, 95 aa, Homo sapiens
SSKDPVSEPSKEEGEPKKTEAPAAPAAQETKSDGAPASDSKPGSSEAAPSSKETPAATEAPSSTPKAQGPAASAEEPKPVEAPAANSDQTVTVKE

SEQ ID NO: 749828 - protein, 177 aa, Homo sapiens
SVSGSEREKCRGCSGGGGGSSGSGDDGGGSAPTGSSLRAPPSSRERASASGQAPARRRQRPRPLGGTALTQGLHRHPEPNSKMGGKLSKKKKGYNVNDEKAKEKDKKAEGAATEEEGTPKESEPQAAAEPAEAKEGKEKPDQDAEGKAEEKEGEKDAAAAKEEAPAANSDQTVTVKE

SEQ ID NO: 749829 - protein, 66 aa, Homo sapiens
HELVPLVPCPIKGGRGWENPNSIFVGKYLIYLQSTLPRSPGFPRSASESAVHRLYLKLPPHALLHR

SEQ ID NO: 749830 - protein, 309 aa, Homo sapiens; identical to SEQ ID NO: 749817

SEQ ID NO: 749831 - protein, 315 aa, Homo sapiens
SVSGSEREKCRGCSGGGGGSSGSGDDGGGSAPTGSSLRAPPSSRERASASGQAPARRRQRPRPLGGTALTQGLHRHPEPNSKMGGKLSKKKKGYNVNDEKAKEKDKKAEGAATEEEGTPKESEPQAAAEPAEAKEGKEKPDQDAEGKAEEKEGEKDAAAAKEEAPKAEPEKTEGAAEAKAEPPKAPEQEQAAPGPAAGGEAPKAAEAAAAPAESAAPAAGEEPSKEEGEPKKTEAPAAPAAQETKSDGAPASDSKPGSSEAAPSSKETPAATEAPSSTPKAQGPAASAEEPKPVEAPAANSDLPTAFPPDIPPVL

SEQ ID NO: 749832 - protein, 304 aa, Homo sapiens
SVSGSEREKCRGCSGGGGGSSGSGDDGGGSAPTGSSLRAPPSSRERASASGQAPARRRQRPRPLGGTALTQGLHRHPEPNSKMGGKLSKKKKGYNVNDEKAKEKDKKAEGAATEEEGTPKESEPHVLCLHDALPDVPMDVCNGMNALTMWLPDVCNGLSEELCGADECDCCAVLAQIGNGDVPPCIWAVMPPGEMTVMCAACAMNVPKLWPLERPPSGKWWLAPWNAMWMPMLLVAPPLVTPPWACLVWLVAGLWPLPKMACLRLWPGLAVAPLGPRKDAWLVLPLWPLLWGVECGRPPYGYMG

SEQ ID NO: 749833 - protein, 372 aa, Homo sapiens
MAKSKTKHRLCSQESSVSALLASCTLSGSNSSNSDGSFHYKDKLYRSASQALQAYIDDFDLGQIYPGASTGKINIDEDFTNMSQFCNYIYKPNNAFENLDHKKHSNFISCRRHTVNDIDSMSLTTDDLLRLPADGSFSYTYVGPSHPTSKKNKKCRGRLGSLDIEKNPHFQGPYTSMGKDNFVTPVIRSNINGKQCGDKIELLILKAKRNLEQCTEELPKSMKKDDSPCSLDKLEADRSWENIPVTFKSPVPVNSDDSPQQTSRAKSAKGVLEDFLNNDNQSCTLSGGKHHGPVEALKQMLFNLQAVQERFNQNKTTDPKEEIKQVSEDDFSKLQLKESMIPITRSLQKALHHLSRLRDLVDDTNGERSPKM

SEQ ID NO: 749834 - protein, 372 aa, Homo sapiens; identical to SEQ ID NO: 749833

SEQ ID NO: 749835 - protein, 492 aa, Homo sapiens
PSEPVVPAVMMATHEPSADLAPKKKPRKSSMPVKIEKEIIDTADEFDDEDDDPNDGGAVVNDMSHDNHCHSQEEMSPGMSVKDFSKHNRTRCISRTEIRRADSMTSEDQEPERDYENESESSEPKLGEESMEGDEHIHSEVSEKVLMNSERPDENHSEPSHQDVIKVKEEFTDPTYDMFYMSQYGLYNGGGASMAALHESFTSSLNYGSPQKFSPEGDLCSSPDPKICYVCKKSFKSSYSVKLHYRNVHLKEMHVCTVAGCNAAFPSRRSRDRHSANINLHRKLLTKELDDMGLDSSQPSLSKDLRDEFLVKIYGAQHPMGLDVREDASSPAGTEDSHLNGYGRGMAEDYMVLDLSTTSSLQSSSSIHSSRESDAGSDEGILLDDIDGASDSGESAHKAEAPALPGSLGAEVSGSLMFSSLSGSNGGIMCNICHKMYSNKGTLRVHYKTVHLREMHKCKVPGCNMMFSSVRSRNRHSQNPNLHKNIPFTSVD

SEQ ID NO: 749836 - protein, 492 aa, Homo sapiens; identical to SEQ ID NO: 749835

SEQ ID NO: 749837 - protein, 73 aa, Homo sapiens
QMKNLKNTLYEEHTESISSTESVFQILHWDIKILAKFLSVLYMSVYFSLWFLQICNCLCFRSISITSLWSIVK

SEQ ID NO: 749838 - protein, 266 aa, Homo sapiens
MDGPTRGHGLRKKRRSRSQRDRERRSRGGLGAGAAGGGGAGRTRALSLASSSGSDKEDNGKPPSSAPSRPRPPRRKRRESTSAEEDIIDGFAMTSFVTFEALEKDVALKPQERVEKRQTPLTKKKREALTNGLSFHSKKSRLSHPHHYSSDRENDRNLCQHLGKRKKMPKALRQLKPGQNSCRDSDSESASGESKGFHRSSSRERLSDSSAPSSLGTGYFRSGKMCLGEEACLKSGNDMKRDVSNTSSWASNRESFFSLVKLLKGF

SEQ ID NO: 749839 - protein, 266 aa, Homo sapiens; identical to SEQ ID NO: 749838

SEQ ID NO: 749840 - protein, 266 aa, Homo sapiens; identical to SEQ ID NO: 749838

SEQ ID NO: 749841 - protein, 83 aa, Homo sapiens
VYDYSAADEDEVSFQDGDTIVNVQQIDDGWMYGTVERTGDTGMLPANYVEATEPAAPPSVFSTFHGIASVLGVTRPFFSVSVF

SEQ ID NO: 749842 - protein, 85 aa, Homo sapiens
AARVARPRPGPYLATTRCAFSETFPEVGAPRLDHSLSSSSAARASASEGARAWVRNRQLPGAGSLKRFSKGPLPSFLSTRPEGVL

SEQ ID NO: 749843 - protein, 249 aa, Homo sapiens
MASEGRKVKVRAGAQEEASARTRNRDTPQPSCEGQPTGDFQPPWRSLHPRTFTYPRREAERHFATVSISAVELKYCHGWRPAGQRVPSKTATGQRTCAKPCQKPSTSKVILRAVADKGTCKYVSLATLKKAVSTTGYDMARNAYHFKRVLKGLVDKGSAGDRQGGLRLLHPGQEAGLQVQAQGQEATTAEVALWAAPLWTAQVTTGLQTGAQAAYQGGSKGGQVPLQLMRQARQAVRGAKTAIGSVQWE

SEQ ID NO: 749844 - protein, 365 aa, Homo sapiens
MENSRKGGGFIWIFNFCCNLRILGPFWDLSPISWQDFLSPEYSRFSLLFFFFPQHLNSQLPRLSPMTELGGWRRRGVARKLAGWGEETVCGAGVSVGRVGENARLPSSPASTRGGLRGRLREQGKGEGRSSRGSLSEDQEPGHTSAICEGQPTGDFQPPWRSLHPRTFTYPRREAERHFATVSISAVELKYCHGWRPAGQRVPSKTATGQRTCAKPCQKPSTSKVILRAVADKGTCKYVSLATLKKAVSTTGYDMARNAYHFKRVLKGLVDKGSAGDRQGGLRLLHPGQEAGLQVQAQGQEATTAEVALWAAPLWTAQVTTGLQTGAQAAYQGGSKGGQVPLQLMRQARQAVRGAKTAIGSVQWE

SEQ ID NO: 749845 - protein, 87 aa, Homo sapiens
METAVIGVVVVLFVVTVAITCVLCCFSCDSRAQDPQGGPGRSFTVATFRQEASLFTGLFAMPSQCQVPRTSGPSCDARVPRICCADG

SEQ ID NO: 749846 - protein, 114 aa, Homo sapiens
METAVIGVVVVLFVVTVAITCVLCCFSCDSRAQDPQGGPGRSFTVATFRQEASLFTGPVRHAQPVPSAQDFWTFIVTPESPGFAVLMGQTHPLLSKPSLAFPSSQGLLPVLPLQ

SEQ ID NO: 749847 - protein, 114 aa, Homo sapiens
YTQLRKTSFIRPQPHLCQELMSTWDNRLGTNCDPTRCLKHPPLTLLAGLCLPYGHCAWEGGKVAACVLPSTAPPFPFVRLMINPQKLSGWARWLTPIIPALWEAEARGSLEFRS

SEQ ID NO: 749848 - protein, 119 aa, Homo sapiens [sequence omitted]

SEQ ID NO: 749849 - protein, 189 aa, Homo sapiens
GSKDRTHPCHKRSTGRGVGVGAALRVSRPKPHSHSSLGRKGRVPGVSWWVSQELPLPGSHRTGMTDQGTAGSCHLWGQNMPSLRGLSIGVFESQTACLVLHTWLCSVQNPAHVILCDMPAAWLPGQEACPGGGAAGGGGAGTHESVQPCHRCIAQPAVLISAHLRVNQNKLHPDFHECMLTLSVHPFLC

SEQ ID NO: 749850 - protein, 66 aa, Homo sapiens
PCSPGMGLTTDSEGTASGAEAGREGHWAWGTHGEFSREIAAVNTWSPGLGVACGVQWPHALCPYDD

SEQ ID NO: 749851 - protein, 203 aa, Homo sapiens
MDRIYKNVMNKVSEMSSFQRNLFILAYNYKMEQISKGRNTPLCDSFVFRKVRSLLGGNIRLLLCGGAPLSATTQRFMNICFCCPVGQGYGLTESAGAGTISEVWDYNTGRVGAPLVCCEIKLKNWEEGGYFNTDKPHPRGEILIGGQSVTMGYYKNEAKTKADFFEDENGQRWLCTGDIGEFEPDGCLKIIEIWFEFAELPLS

SEQ ID NO: 749852 - protein, 720 aa, Homo sapiens
MNNHVSSKPSTMKLKHTINPILLYFIHFLISLYTILTYIPFYFFSESRQEKSNRIKAKPVNSKPDSAYRSVNSLDGLASVLYPGCDTLDKVFTYAKNKFKNKRLLGTREVLNEEDEVQPNGKIFKKVILGQYNWLSYEDVFVRAFNFGNGLQMLGQKPKTNIAIFCETRAEWMIAAQACFMYNFQLVTLYATLGGPAIVHALNETEVTNIITSKELLQTKLKDIVSLVPRLRHIITVDGKPPTWSEFPKGIIVHTMAAVEALGAKASMENQPHSKPLPSDIAVIMYTSGSTGLPKGVMISHSNIIAGITGMAERIPELGEEDVYIGYLPLAHVLELSAELVCLSHGCRIGYSSPQTLADQSSKIKKGSKGDTSMLKPTLMAAVPEIMDRIYKNVMNKVSEMSSFQRNLFILAYNYKMEQISKGRNTPLCDSFVFRKVRSLLGGNIRLLLCGGAPLSATTQRFMNICFCCPVGQGYGLTESAGAGTISEVWDYNTGRVGAPLVCCEIKLKNWEEGGYFNTDKPHPRGEILIGGQSVTMGYYKNEAKTKADFFEDENGQRWLCTGDIGEFEPDGCLKIIDRKKDLVKLQAGEYVSLGKVEAALKNLPLVDNICAYANSYHSYVIGFVVPNQKELTELARKKGLKGTWEELCNSCEMENEVLKVLSEAAISASLEKFEIPVKIRLSPEPWTPETGLVTDAFKLKRKELKTHYQADIERMYGRK

SEQ ID NO: 749853 - protein, 720 aa, Homo sapiens; identical to SEQ ID NO: 749852

SEQ ID NO: 749854 - protein, 720 aa, Homo sapiens; identical to SEQ ID NO: 749852

SEQ ID NO: 749855 - protein, 720 aa, Homo sapiens; identical to SEQ ID NO: 749852

SEQ ID NO: 749856 - protein, 465 aa, Homo sapiens
MAAVEALGAKASMENQPHSKPLPSDIAVIMYTSGSTGLPKGVMISHSNIIAGITGMAERIPELGEEDVYIGYLPLAHVLELSAELVCLSHGCRIGYSSPQTLADQSSKIKKGSKGDTSMLKPTLMAAVPEIMDRIYKNVMNKVSEMSSFQRNLFILAYNYKMEQISKGRNTPLCDSFVFRKVRSLLGGNIRLLLCGGAPLSATTQRFMNICFCCPVGQGYGLTESAGAGTISEVWDYNTGRVGAPLVCCEIKLKNWEEGGYFNTDKPHPRGEILIGGQSVTMGYYKNEAKTKADFFEDENGQRWLCTGDIGEFEPDGCLKIIDRKKDLVKLQAGEYVSLGKVEAALKNLPLVDNICAYANSYHSYVIGFVVPNQKELTELARKKGLKGTWEELCNSCEMENEVLKVLSEAAISASLEKFEIPVKIRLSPEPWTPETGLVTDAFKLKRKELKTHYQADIERMYGRK

SEQ ID NO: 749857 - protein, 491 aa, Homo sapiens
LTLFRPLLNETLQRRSPGFSIQIASIVIFSPCLASVFFIENQPHSKPLPSDIAVIMYTSGSTGLPKGVMISHSNIIAGITGMAERIPELGEEDVYIGYLPLAHVLELSAELVCLSHGCRIGYSSPQTLADQSSKIKKGSKGDTSMLKPTLMAAVPEIMDRIYKNVMNKVSEMSSFQRNLFILAYNYKMEQISKGRNTPLCDSFVFRKVRSLLGGNIRLLLCGGAPLSATTQRFMNICFCCPVGQGYGLTESAGAGTISEVWDYNTGRVGAPLVCCEIKLKNWEEGGYFNTDKPHPRGEILIGGQSVTMGYYKNEAKTKADFFEDENGQRWLCTGDIGEFEPDGCLKIIDRKKDLVKLQAGEYVSLGKVEAALKNLPLVDNICAYANSYHSYVIGFVVPNQKELTELARKKGLKGTWEELCNSCEMENEVLKVLSEAAISASLEKFEIPVKIRLSPEPWTPETGLVTDAFKLKRKELKTHYQADIERMYGRK

SEQ ID NO: 749858 - protein, 588 aa, Homo sapiens
MNNHVSSKPSTMKLKHTINPILLYFIHFLISLYTILTYIPFYFFSESRQEKSNRIKAKPVNSKPDSAYRSVNSLDGLASVLYPGCDTLDKVFTYAKNKFKNKRLLGTREVLNEEDEVQPNGKIFKKVILGQYNWLSYEDVFVRAFNFGNGLQMLGQKPKTNIAIFCETRAEWMIAAQACFMYNFQLVTLYATLGGPAIVHALNETEVTNIITSKELLQTKLKDIVSLVPRLRHIITVDGKPPTWSEFPKGIIVHTMAAVEALGAKASMENQPHSKPLPSDIAVIMYTSGSTGLPKGVMISHSNIIAGITGMAERIPELGEEDVYIGYLPLAHVLELSAELVCLSHGCRIGYSSPQTLADQSSKIKKGSKGDTSMLKPTLMAAVPEIMDRIYKNVMNKVSEMSSFQRNLFILAYNYKMEQISKGRNTPLCDSFVFRKVRSLLGGNIRLLLCGGAPLSATTQRFMNICFCCPVGQGYGLTESAGAGTISEVWDYNTGRVGAPLVCCEIKLKNWEEGGYFNTDKPHPRGEILIGGQSVTMGYYKNEAKTKADFFEDENGQRWLCTGDIGEFEPDGCLKIIDRKAAFEEIFT

SEQ ID NO: 749859 - protein, 258 aa, Homo sapiens [sequence omitted]

SEQ ID NO: 749860 - protein, 720 aa, Homo sapiens; identical to SEQ ID NO: 749852

SEQ ID NO: 749861 - protein, 720 aa, Homo sapiens; identical to SEQ ID NO: 749852

SEQ ID NO: 749862 - protein, 720 aa, Homo sapiens; identical to SEQ ID NO: 749852

SEQ ID NO: 749863 - protein, 692 aa, Homo sapiens
MNNHVSSKPSTMKLKHTINPILLYFIHFLISLYTILTYIPFYFFSESRQEKSNRIKAKPVNSKPDSAYRSVNSLDGLASVLYPGCDTLDKVFTYAKNKFKNKRLLGTREVLNEEDEVQPNGKIFKKVILGQYNWLSYEDVFVRAFNFGNGLQMLGQKPKTNIAIFCETRAEWMIAAQACFMYNFQLVTLYATLGGPAIVHALNETEVTNIITSKELLQTKLKDIVSLVPRLRHIITVDGKPPTWSEFPKGIIVHTMAAVEALGAKASMENQPHSKPLPSDIAVIMYTSGSTGLPKGVMISHSNIIAGITGMAERIPELGEEDVYIGYLPLAHVLELSAELVCLSHGCRIGYSSPQTLADQSSKIKKGSKGDTSMLKPTLMAAVPEIMDRIYKNVMNKVSEMSSFQRNLFILAYNYKMEQISKGRNTPLCDSFVFRKVRSLLGGNIRLLLCGGAPLSATTQRFMNICFCCPVGQGYGLTESAGAGTISEVWDYNTGRVGAPLVCCEIKLKNWEEGGYFNTDKPHPRGEILIGGQSVTMGYYKNEAKTKADFFEDENGQRWLCTGDIGEFEPDGCLKIIDRKKDLVKLQAGEYVSLGKVEAALKNLPLVDNICAYANSYHSYVIGFVVPNQKELTELARKKGLKGTWEELCNSCEMENEVLKVLSEAAISGEYSVKLILKTEMGREYLHAFNLF

SEQ ID NO: 749864 - protein, 187 aa, Homo sapiens [sequence omitted]

SEQ ID NO: 749865 - protein, 265 aa, Homo sapiens
PTVELRLQGINLGLEDDGVADESVKGLESQVLDKEEEQPLWAANENSVQMMRSEINTEVNEKAGLLPCPEPTIISAILKDDNHSLTFFPESTEQKQSDIKKPENTQPENKETISQATSEKLPMILTQRSVALGQDKVALQKLNDAATKLQACWRGFYARNYNPQAKDVRYEIRLRRMQEHIVCLTDEIRRLRKERDEERIKKFVQEEAFRFLWEPGKVSTGLATDSGPASKFLGILMFLLYQVLLCHRNIHYLPKARSPLVIKML

SEQ ID NO: 749866 - protein, 103 aa, Homo sapiens
RRLSQVAERPSATSSLLFPLLADSAKPDCLLTLVSMPQPLGGFPAVSPCPLPSPGVLRASSLAAGSWALFPCWHQGLESLFLPHLLTLVKAHHSTSAKELQAL

SEQ ID NO: 749867 - protein, 38 aa, Homo sapiens
METVPPSSPLPSSSSSSSSSVYLKFEFYLRNISWNADI

SEQ ID NO: 749868 - protein, 153 aa, Homo sapiens
MGQTKEAEKMTNHIVSEETGCLECYRLLSAIYSKQENHDKALDAIDKALQLKPKDPKVISELFFTKGNQLREQNLLDKAFESYRVAVQLNPDQAQAWMNMGGIQHIKGKYVSARAYYERALQLVPDSKLLKENLAKLDRLEKRLQEVREKDQT

SEQ ID NO: 749869 - protein, 153 aa, Homo sapiens; identical to SEQ ID NO: 749868

SEQ ID NO: 749870 - protein, 230 aa, Homo sapiens
MVNLGRLYRSLGENSMAEEWYKRALQVAHKAEILSPLGALYYNTGRYEEALQIYQEAAALQPSQRELRLALAQVLAVMGQTKEAEKMTNHIVSEETGCLECYRLLSAIYSKQENHDKALDAIDKALQLKPKDPKVISELFFTKGNQLREQNLLDKAFESYRVAVQLNPDQAQAWMNMGGIQHIKGKYVSARAYYERALQLVPDSKLLKENLAKLDRLEKRLQEVREKDQT

SEQ ID NO: 749871 - protein, 153 aa, Homo sapiens; identical to SEQ ID NO: 749868

SEQ ID NO: 749872 - protein, 109 aa, Homo sapiens
GWELVLEGPLPSPDTMARLGIEASVTSMQLCALGKPRTMLLGAQSTCIKFELSLVRHLSDGQEAPGWKPCRSKRTASKSSGRYCQVGLQKEIYKAAHAVAHACNPSTLG

SEQ ID NO: 749873 - protein, 137 aa, Homo sapiens
EPRSFKMTSLDKMDRSMPSEMESSRNDAKDDLGNLNVPDSSLPAENEATGPGLIPPPLAPISGPLFPVDTRGPFMRRGPPFPPPPPGTMFGASRGYFPPRDFPGPPHAPFAMRNIYPPRGLPPYLHPRPGFYPNPTF

SEQ ID NO: 749874 - protein, 102 aa, Homo sapiens
MCQCPQARLCRGGPWAPASRRCGGAGLGASCLAPLPVNPFSRLVWPTGLTLGCSPSDQESFVPGEDAPFVFTEDYKSGKFQNMMGLASSFLSEEAHVVDFAL

SEQ ID NO: 749875 - protein, 640 aa, Homo sapiens [sequence omitted]

SEQ ID NO: 749876 - protein, 143 aa, Homo sapiens
TVFIEPSKRVQMLLLHCSMWFIFWNFKHSFQRRMEETMKLATMEDTVEYCLFLIPDESRDSDKHKEILQKYIERIITRFAPMLVPYIWQNQPFNLKYKPGKGKALLLVWISVTFNVILTTVMCNSPRFIQCCQEEINTQKKSY

SEQ ID NO: 749877 - protein, 640 aa, Homo sapiens [sequence omitted]

SEQ ID NO: 749878 - protein, 640 aa, Homo sapiens [sequence omitted]

SEQ ID NO: 749879 - protein, 640 aa, Homo sapiens [sequence omitted]

SEQ ID NO: 749880 - protein, 386 aa, Homo sapiens
MTSVTFTKCLYAQLVQQRFVPDRRSGYRLPPPSDPQYRAHELGMKLAHGFEILCSKCSPHFSDCKKSLVTASPLWASFLESLKKNDYFKGLIEGSAQYRERLEMAENYFQLSVDWPESSLAMSPGEEILTLLQTIPFDIEDLKKEAANLPPEDDDQWLDLSPDQLDQLLQEAVGKKESESVSKEEKEQNYDLTEVSESMKAFISKVSTHKGAELPREPSEAPITFDADSFLNYFDKILGPRPNESDSDDLDDEDFECLDSDDDLDFETHEPGEEASLKGTLDNLKSYMAQMDQELAHTCISKSFTTRNQVEPVSQTTDNNSDEEDSGTGESVMAPVDVDLNLVSNILESYSSQAGLAGPASNLLQSMGVQLPDNTDHRPTSKPTKN

SEQ ID NO: 749881 - protein, 622 aa, Homo sapiens
MKLATMEDTVEYCLFLIPDESRDSDKHKEILQKYIERIITRFAPMLVPYIWQNQPFNLKYKPGKGGVPAHMFGVTKFGDNIEDEWFIVYVIKQITKEFPELVARIEDNDGEFLLIEAADFLPKWLDPENSTNRVFFCHGELCIIPAPRKSGAESWLPTTPPTIPQALNIITAHSEKILASESIRAAVNRRIRGYPEKIQASLHRAHCFLPAGIVAVLKQRPRLVAAAVQAFYLRDPIDLRACRVFKTFLPETRIMTSVTFTKCLYAQLVQQRFVPDRRSGYRLPPPSDPQYRAHELGMKLAHGFEILCSKCSPHFSDCKKSLVTASPLWASFLESLKKNDYFKGLIEGSAQYRERLEMAENYFQLSVDWPESSLAMSPGEEILTLLQTIPFDIEDLKKEAANLPPEDDDQWLDLSPDQLDQLLQEAVGKKESESVSKEEKEQNYDLTEVSESMKAFISKVSTHKGAELPREPSEAPITFDADSFLNYFDKILGPRPNESDSDDLDDEDFECLDSDDDLDFETHEPGEEASLKGTLDNLKSYMAQMDQELAHTCISNSDEEDSGTGESVMAPVDVDLNLVSNILESYSSQAGLAGPASNLLQSMGVQLPDNTDHRPTSKPTKN

SEQ ID NO: 749882 - protein, 527 aa, Homo sapiens
MVYCLCNKADHKGISRVSSKVFFCHGELCIIPAPRKSGAESWLPTTPPTIPQALNIITAHSEKILASESIRAAVNRRIRGYPEKIQASLHRAHCFLPAGIVAVLKQRPRLVAAAVQAFYLRDPIDLRACRVFKTFLPETRIMTSVTFTKCLYAQLVQQRFVPDRRSGYRLPPPSDPQYRAHELGMKLAHGFEILCSKCSPHFSDCKKSLVTASPLWASFLESLKKNDYFKGLIEGSAQYRERLEMAENYFQLSVDWPESSLAMSPGEEILTLLQTIPFDIEDLKKEAANLPPEDDDQWLDLSPDQLDQLLQEAVGKKESESVSKEEKEQNYDLTEVSESMKAFISKVSTHKGAELPREPSEAPITFDADSFLNYFDKILGPRPNESDSDDLDDEDFECLDSDDDLDFETHEPGEEASLKGTLDNLKSYMAQMDQELAHTCISKSFTTRNQVEPVSQTTDNNSDEEDSGTGESVMAPVDVDLNLVSNILESYSSQAGLAGPASNLLQSMGVQLPDNTDHRPTSKPTKN

SEQ ID NO: 749883 - protein, 670 aa, Homo sapiens
MKLATMEDTVEYCLFLIPDESRDSDKHKEILQKYIERIITRFAPMLVPYIWQNQPFNLKYKPGKGGVPAHMFGVTKFGDNIEDEWFIVYVIKQITKEFPELVARIEDNDGEFLLIEAADFLPKWLDPENSTNRVFFCHGELCIIPAPRKSGAESWLPTTPPTIPQALNIITAHSEKILASESIRAAVNRRIRGYPEKIQASLHRAHCFLPAGIVAVLKQRPRLVAAAVQAFYLRDPIDLRACRVFKTFLPETRIMTSVTFTKCLYAQLVQQRFVPDRRSGYRLPPPSDPQYRAHELGMKLAHGFEILCSKCSPHFSDCKKSLVTASPLWASFLESLKKNDYFKGLIEGSAQYRERLEMAENYFQLSVDWPESSLAMSPGEEILTLLQTIPFDIEDLKKEAANLPPEDDDQWLDLSPDQLDQLLQEAVGKKESESVSKEEKEQNYDLTEVSESMKAFISKVSTHKGAELPREPSEAPITFDADSFLNYFDKILGPRPNESDSDDLDDEDFECLDSDDDLDFETHEPGEEASLKGTLDNLKSYMAQMDQELAHTCISKSFTTRNQVEPVSQTTDNNSDEEDSGTGESVMAPVDVDLNLVSNILESYSSQAGLAGPASNLLQSMGVQLPDNTDHRPTNGVSLCCPGWSAVALSWLNASSTSRVHAILLPQPPE

SEQ ID NO: 749884 - protein, 570 aa, Homo sapiens
MFGVTKFGDNIEDEWFIVYVIKQITKEFPELVARIEDNDGEFLLIEAADFLPKWLDPENSTNRVFFCHGELCIIPAPRKSGAESWLPTTPPTIPQALNIITAHSEKILASESIRAAVNRRIRGYPEKIQASLHRAHCFLPAGIVAVLKQRPRLVAAAVQAFYLRDPIDLRACRVFKTFLPETRIMTSVTFTKCLYAQLVQQRFVPDRRSGYRLPPPSDPQYRAHELGMKLAHGFEILCSKCSPHFSDCKKSLVTASPLWASFLESLKKNDYFKGLIEGSAQYRERLEMAENYFQLSVDWPESSLAMSPGEEILTLLQTIPFDIEDLKKEAANLPPEDDDQWLDLSPDQLDQLLQEAVGKKESESVSKEEKEQNYDLTEVSESMKAFISKVSTHKGAELPREPSEAPITFDADSFLNYFDKILGPRPNESDSDDLDDEDFECLDSDDDLDFETHEPGEEASLKGTLDNLKSYMAQMDQELAHTCISKSFTTRNQVEPVSQTTDNNSDEEDSGTGESVMAPVDVDLNLVSNILESYSSQAGLAGPASNLLQSMGVQLPDNTDHRPTSKPTKN

SEQ ID NO: 749885 - protein, 360 aa, Homo sapiens
EVTMKKRSILLQVTNKPLTEAHGFEILCSKCSPHFSDCKKSLVTASPLWASFLESLKKNDYFKGLIEGSAQYRERLEMAENYFQLSVDWPESSLAMSPGEEILTLLQTIPFDIEDLKKEAANLPPEDDDQWLDLSPDQLDQLLQEAVGKKESESVSKEEKEQNYDLTEVSESMKAFISKVSTHKGAELPREPSEAPITFDADSFLNYFDKILGPRPNESDSDDLDDEDFECLDSDDDLDFETHEPGEEASLKGTLDNLKSYMAQMDQELAHTCISKSFTTRNQVEPVSQTTDNNSDEEDSGTGESVMAPVDVDLNLVSNILESYSSQAGLAGPASNLLQSMGVQLPDNTDHRPTSKPTKN

SEQ ID NO: 749886 - protein, 184 aa, Homo sapiens
AQLWSQLLGRLRWEEPSEAPITFDADSFLNYFDKILGPRPNESDSDDLDDEDFECLDSDDDLDFETHEPGEEASLKGTLDNLKSYMAQMDQELAHTCISKSFTTRNQVEPVSQTTDNNSDEEDSGTGESVMAPVDVDLNLVSNILESYSSQAGLAGPASNLLQSMGVQLPDNTDHRPTSKPTKN

SEQ ID NO: 749887 - protein, 153 aa, Homo sapiens
LGICVGPRPNESDSDDLDDEDFECLDSDDDLDFETHEPGEEASLKGTLDNLKSYMAQMDQELAHTCISKSFTTRNQVEPVSQTTDNNSDEEDSGTGESVMAPVDVDLNLVSNILESYSSQAGLAGPASNLLQSMGVQLPDNTDHRPTSKPTKN

SEQ ID NO: 749888 - protein, 83 aa, Homo sapiens
TASVARAMGRTLRGPHTQKVEPRPGYEDHPAVWRDEENEVQRDEVSCLKSVTESDQSWDVNPGLTLQSHMVDGTSEQHLNKGS

SEQ ID NO: 749889 - protein, 83 aa, Homo sapiens; identical to SEQ ID NO: 749888

SEQ ID NO: 749890 - protein, 107 aa, Homo sapiens
RPLATLGALKPEPSRARAAAAAAAAAHRSRAPSQRAGRGVGGGGPEGRGRARGRTRGLARKTGPSASREPLGDQAKWQFLPAGPQMGTSISLCSCKKLAAEPTCESL

SEQ ID NO: 749891 - protein, 107 aa, Homo sapiens; identical to SEQ ID NO: 749890

SEQ ID NO: 749892 - protein, 107 aa, Homo sapiens; identical to SEQ ID NO: 749890

SEQ ID NO: 749893 - protein, 261 aa, Homo sapiens
MSGEIAMCEPEFGNDKAREPSVGGRWRVSWYERFVQPCLVELLGSALFIFIGCLSVIENGTDTGLLQPALAHGLALGLVIATLGNISGGHFNPAVSLAAMLIGGLNLVMLLPYWVSQLLGGMLGAALAKAVSPEERFWNASGAAFVTVQEQGQVAGALVAEIILTTLLALAVCMGAINEKTKGPLAPFSIGFAVTVDILAGGPVSGGCMNPARAFGPAVVANHWNFHWIYWLGPLLAGLLVGLLIRCFIGDGKTRLILKAR

SEQ ID NO: 749894 - protein, 74 aa, Homo sapiens
LIFSDITQGKKPPLGPVSGGCMNPARAFGPAVVANHWNFHWIYWLGPLLAGLLVGLLIRCFIGDGKTRLILKAR

SEQ ID NO: 749895 - protein, 75 aa, Homo sapiens
HHPPPYRDAGQDRPEGPVSGGCMNPARAFGPAVVANHWNFHWIYWLGPLLAGLLVGLLIRCFIGDGKTRLILKAR

SEQ ID NO: 749896 - protein, 71 aa, Homo sapiens
PTSTPQRHPPSGPVSGGCMNPARAFGPAVVANHWNFHWIYWLGPLLAGLLVGLLIRCFIGDGKTRLILKAR

SEQ ID NO: 749897 - protein, 261 aa, Homo sapiens; identical to SEQ ID NO: 749893

SEQ ID NO: 749898 - protein, 192 aa, Homo sapiens [sequence omitted]

SEQ ID NO: 749899 - protein, 166 aa, Homo sapiens
MSKLGRAARGLRKPERGVSINQFCKEFNERTKDIKEGIPLPTKILVKPDRTFEIKIGQPTVSYFLKAAAGIEKGARQTGKEVAGLVTLKHVYEIARIKAQDEAFALQDVPLSSVVRSIIGSARSLGIRVVKDLSSEELAAFQKERAIFLAAQKEADLAAQEEAAKK

SEQ ID NO: 749900 - protein, 192 aa, Homo sapiens [sequence omitted]

SEQ ID NO: 749901 - protein, 192 aa, Homo sapiens [sequence omitted]

SEQ ID NO: 749902 - protein, 192 aa, Homo sapiens [sequence omitted]

SEQ ID NO: 749903 - protein, 166 aa, Homo sapiens; identical to SEQ ID NO: 749899

SEQ ID NO: 749904 - protein, 166 aa, Homo sapiens; identical to SEQ ID NO: 749899

SEQ ID NO: 749905 - protein, 181 aa, Homo sapiens
MSKLGRAARGLRKPEVGGVIRAIVRAGLAMPGPPLGPVLGQRGVSINQFCKEFNERTKDIKEGIPLPTKILVKPDRTFEIKIGQPTVSYFLKAAAGIEKGARQTGKEVAGLVTLKHVYEIARIKAQDEAFALQDVPLSSVVRSIIGSARSLGIRVVKERCSANVLRNGKISMKDPSGRSSV

SEQ ID NO: 749906 - protein, 181 aa, Homo sapiens; identical to SEQ ID NO: 749905

SEQ ID NO: 749907 - protein, 181 aa, Homo sapiens
MSKLGRAARGLRKPEVGGVIRAIVRAGLAMPGPPLGPVLGQRGVSINQFCKEFNERTKDIKEGIPLPTKILVKPDRTFEIKIGQPTVSYFLKAAAGIEKGARQTDVYEIARIKAQDEAFALQDVPLSSVVRSIIGSARSLGIRVVKDLSSEELAAFQKERAIFLAAQKEADLAAQEEAAKK

SEQ ID NO: 749908 - protein, 181 aa, Homo sapiens; identical to SEQ ID NO: 749907

SEQ ID NO: 749909 - protein, 156 aa, Homo sapiens
MSKLGRAARGLRKPEVGGVIRAIVRAGLAMPGPPLGPVLGQRGVSINQFCKEFNERTKDIKEGIPLPTKILVKPDRTFEIKIGQPTVSYFLKAAAGIEKGARQTEERGGRPGDLWALRVVKDLSSEELAAFQKERAIFLAAQKEADLAAQEEAAKK

SEQ ID NO: 749910 - protein, 121 aa, Homo sapiens
MLLTLSVLLCWVSADIRCHSCYKVPVLGCVDRQSCRLEPGQQCLTTHAYLGKMWVFSNLRCGTPEEPCQEAFNQTNRKLGLTYNTTCCNKDNCNSAGPRPTPALGLVFLTSLAGLGLWLLH

SEQ ID NO: 749911 - protein, 536 aa, Homo sapiens
MSPRVVSNSSVLASQSVGITNVRTVFSNVFNNTTAFPILRGSNCHKITAPGLGKGQLVNLLPPENLPWCGGSQGPRMLRTCYVLCSQAGPPSRGWQSLSFDGGAFHLKGTGELTRALLVLRLCAWPPLVTHGLLLQAWSRRLLGSRLSGAFLRASVYGQFVAGETAEEVKGCVQQLRTLSLRPLLAVPTEEEPDSAAKSGEAWYEGNLGAMLRCVDLSRGLLEPPSLAEASLMQLKVTALTSTRLCKELASWVRRPGASLELSPERLAEAMDSGQNLQVSCLNAEQNQHLRASLSRLHRVAQYARAQHVRLLVDAEYTSLNPALSLLVAALAVRWNSPGEGGPWVWNTYQACLKDTFERLGRDAEAAHRAGLAFGVKLVRGAYLDKERAVAQLHGMEDPTQPDYEATSQSYSRCLELMLTHVARHGPMCHLMVASHNEESVRQATKRMWELGIPLDGTVCFGQLLGMCDHVSLALGQAGYVVYKSIPYGSLEEVIPYLIRRAQENRSVLQGARREQELLSQELWRRLLPGCRRIPH

SEQ ID NO: 749912 - protein, 102 aa, Homo sapiens
MFSETEVSVPGGDWGVSPQPKPIPLSQKNTKNEKTKPTLPAGQAGYVVYKSIPYGSLEEVIPYLIRRAQENRSVLQGARREQELLSQELWRRLLPGCRRIPH

SEQ ID NO: 749913 - protein, 593 aa, Homo sapiens
MSPRVVSNSSVLASQSVGITNVRTVFSNVFNNTTAFPILRGSNCHKITAPGLGKGQLVNLLPPENLPWCGGSQGPRMLRTCYVLCSQAGPPSRGWQSLSFDGGAFHLKGTGELTRALLVLRLCAWPPLVTHGLLLQAWSRRLLGSRLSGAFLRASVYGQFVAGETAEEVKGCVQQLRTLSLRPLLAVPTEEEPDSAAKSGWVGSQGPGRLGGRRKGLCCSGPDTCWLGSEAWYEGNLGAMLRCVDLSRGLLEPPSLAEASLMQLKVTALTSTRLCVRSAKTGVRGGRGCPSGSPHHPPTTPFQKELASWVRRPGASLELSPERLAEAMDSGQNLQVSCLNAEQNQHLRASLSRLHRVAQYARAQHVRLLVDAEYTSLNPALSLLVAALAVRWNSPGEGGPWVWNTYQACLKDTFERLGRDAEAAHRAGLAFGVKLVRGAYLDKERAVAQLHGMEDPTQPDYEATSQSYSRCLELMLTHVARHGPMCHLMVASHNEESVRQATKRMWELGIPLDGTVCFGQLLGMCDHVSLALGQAGYVVYKSIPYGSLEEVIPYLIRRAQENRSVLQGARREQELLSQELWRRLLPGCRRIPH

SEQ ID NO: 749914 - protein, 565 aa, Homo sapiens
MSPRVVSNSSVLASQSVGITNVRTVFSNVFNNTTAFPILRGSNCHKITAPGLGKGQLVNLLPPENLPWCGGSQGPRMLRTCYVLCSQAGPPSRGWQSLSFDGGAFHLKGTGELTRALLVLRLCAWPPLVTHGLLLQAWSRRLLGSRLSGAFLRASVYGQFVAGETAEEVKGCVQQLRTLSLRPLLAVPTEEEPDSAAKSGWVGSQGPGRLGGRRKGLCCSGPDTCWLGSEAWYEGNLGAMLRCVDLSRGLLEPPSLAEASLMQLKVTALTSTRLCKELASWVRRPGASLELSPERLAEAMDSGQNLQVSCLNAEQNQHLRASLSRLHRVAQYARAQHVRLLVDAEYTSLNPALSLLVAALAVRWNSPGEGGPWVWNTYQACLKDTFERLGRDAEAAHRAGLAFGVKLVRGAYLDKERAVAQLHGMEDPTQPDYEATSQSYSRCLELMLTHVARHGPMCHLMVASHNEESVRQATKRMWELGIPLDGTVCFGQLLGMCDHVSLALGQAGYVVYKSIPYGSLEEVIPYLIRRAQENRSVLQGARREQELLSQELWRRLLPGCRRIPH

SEQ ID NO: 749915 - protein, 454 aa, Homo sapiens
MSPRVVSNSSVLASQSVGITNVRTVFSNVFNNTTAFPILRGSNCHKITAPGLGKGQLVNLLPPENLPWCGGSQGPRMLRTCYVLCSQAGPPSRGWQSLSFDGGAFHLKGTGELTRALLVLRLCAWPPLVTHGLLLQAWSRRLLGSRLSGAFLRASVYGQFVAGETAEEVKGCVQQLRTLSLRPLLAVPTEEEPDSAAKSGEAWYEGNLGAMLRCVDLSRGLLEPPSLAEASLMQLKVTALTSTRLCKELASWVRRPGASLELSPERLAEAMDSGQNLQVSCLNAEQNQHLRASLSRLHRVAQYARAQHVRLLVDAEYTSLNPALSLLVAALAVRWNSPGEGGPWVWNTYQACLKDTFERLGRDAEAAHRAGLAFGVKLVRGAYLDKERAVAQLHGMEDPTQPDYEATSQSYSRCLELMLTHVARHGPMCHLMVASHNEESVRQATKRAGRLCSV

SEQ ID NO: 749916 - protein, 477 aa, Homo sapiens
MSPRVVSNSSVLASQSVGITNVRTVFSNVFNNTTAFPILRGSNCHKITAPGLGKGQLVNLLPPENLPWCGGSQGPRMLRTCYVLCSQAGPPSRGWQSLSFDGGAFHLKGTGELTRALLVLRLCAWPPLVTHGLLLQAWSRRLLGSRLSGAFLRASVYGQFVAGETAEEVKGCVQQLRTLSLRPLLAVPTEEEPDSAAKSGEAWYEGNLGAMLRCVDLSRGLLEPPSLAEASLMQLKVTALTSTRLCKELASWVRRPGASLELSPERLAEAMDSGQNLQVSCLNAEQNQHLRASLSRLHRVAQYARAQHVRLLVDAEYTSLNPALSLLVAALAVRWNSPGEGGPWVWNTYQACLKDTFERLGRDAEAAHRAGLAFGVKLVRGAYLDKERAVAQLHGMEDPTQPDYEATSQSYSRCLELMLTHVARHGPMCHLMVASHNEESVRQATKRMWELGIPLDGTVCFGQLLGMCDHVSLALGM

SEQ ID NO: 749917 - protein, 496 aa, Homo sapiens
MGRGVRVLLLLSLLHCAGGSEGRKTWRRRGQQPPPPPRTEAAPAAGQPVESFPLDFTAVEGNMDSFMAQVKSLAQSLYPCSAQQLNEDLRLHLLLNTSVTCNDGSPAGYYLKESRGSRRWLLFLEGGWYCFNRENCDSRYDTMRRLMSSRDWPRTRTGTGILSSQPEENPYWWNANMVFIPYCSSDVWSGASSKSEKNEYAFMGALIIQEVVRELLGRGLSGAKVLLLAGSSAGGTGVLLNVDRVAEQLEKLGYPAIQVRGLADSGWFLDNKQYRHTDCVDTITCAPTEAIRRGIRYWNGVVPERCRRQFQEGEEWNCFFGYKVYPTLRCPVFVVQWLFDEAQLTVDNVHLTGQPVQEGLRLYIQNLGRELRHTLKDVPASFAPACLSHEIIIRSHWTDVQVKGTSLPRALHCWDRSLHDSHKASKTPLKGCPVHLVDSCPWPHCNPSCPTVRDQFTGQEMNVAQFLMHMGFDMQTVAQPQGLEPSELLGMLSNGS

SEQ ID NO: 749918 - protein, 496 aa, Homo sapiens; identical to SEQ ID NO: 749917

SEQ ID NO: 749919 - protein, 597 aa, Homo sapiens
PPSPGGGGGTSNARAPGPPRPPQISPASAPAAHWRGPQPAHPDPALPSDGRARTPAAEADGTRPRAPRAGRAFSARPGGRERGLREQERLKAARSPQVDAAMGRGVRVLLLLSLLHCAGGSEGRKTWRRRGQQPPPPPRTEAAPAAGQPVESFPLDFTAVEGNMDSFMAQVKSLAQSLYPCSAQQLNEDLRLHLLLNTSVTCNDGSPAGYYLKESRGSRRWLLFLEGGWYCFNRENCDSRYDTMRRLMSSRDWPRTRTGTGILSSQPEENPYWWNANMVFIPYCSSDVWSGASSKSEKNEYAFMGALIIQEVVRELLGRGLSGAKVLLLAGSSAGGTGVLLNVDRVAEQLEKLGYPAIQVRGLADSGWFLDNKQYRHTDCVDTITCAPTEAIRRGIRYWNGVVPERCRRQFQEGEEWNCFFGYKVYPTLRCPVFVVQWLFDEAQLTVDNVHLTGQPVQEGLRLYIQNLGRELRHTLKDVPASFAPACLSHEIIIRSHWTDVQVKGTSLPRALHCWDRSLHDSHKASKTPLKGCPVHLVDSCPWPHCNPSCPTVRDQFTGQEMNVAQFLMHMGFDMQTVAQPQGLEPSELLGMLSNGS

SEQ ID NO: 749920 - protein, 393 aa, Homo sapiens
KSRRMSRIELEGVRLATIPGRRWYWFKRENVRLQIRGPCGASGGSRVTGRRFTRHLDPVLELSRTPLVDHIDVSFYTPTAPSDVLERVSSKSEKNEYAFMGALIIQEVVRELLGRGLSGAKVLLLAGSSAGGTGVLLNVDRVAEQLEKLGYPAIQVRGLADSGWFLDNKQYRHTDCVDTITCAPTEAIRRGIRYWNGVVPERCRRQFQEGEEWNCFFGYKVYPTLRCPVFVVQWLFDEAQLTVDNVHLTGQPVQEGLRLYIQNLGRELRHTLKDVPASFAPACLSHEIIIRSHWTDVQVKGTSLPRALHCWDRSLHDSHKASKTPLKGCPVHLVDSCPWPHCNPSCPTVRDQFTGQEMNVAQFLMHMGFDMQTVAQPQGLEPSELLGMLSNGS

SEQ ID NO: 749921 - protein, 124 aa, Homo sapiens
ACNPATPEAEAGESLEPGRQRLCHWTDVQVKGTSLPRALHCWDRSLHDSHKASKTPLKGCPVHLVDSCPWPHCNPSCPTVRDQFTGQEMNVAQFLMHMGFDMQTVAQPQGLEPSELLGMLSNGS

SEQ ID NO: 749922 - protein, 496 aa, Homo sapiens; identical to SEQ ID NO: 749917

SEQ ID NO: 749923 - protein, 403 aa, Homo sapiens
MGRGVRVLLLLSLLHCAGGSEGRKTWRRRGQQPPPPPRTEAAPAAGQPVESFPLDFTAVEGNMDSFMAQVKSLAQSLYPCSAQQLNEDLRLHLLLNTSVTCNDGSPAGYYLKESRGSRRWLLFLEGGWYCFNRENCDSRYDTMRRLMSSRDWPRTRTGTGILSSQPEENPYWWNANMVFIPYCSSDVWSGASSKSEKNEYAFMGALIIQEVVRELLGRGLSGAKVLLLAGSSAGGTGVLLNVDRVAEQLEKLGYPAIQVRGLADSGWFLDNKQYRHTDCVDTITCAPTEAIRRGIRYWNGVVPERCRRQFQEGEEWNCFFGYKVYPTLRCPVFVVQWLFDEAQLTVDNVHLTGQPVQEGLRLYIQNLGRELRHTLKDVPASFAPACLSHEIIIRRSVSLLRAA

SEQ ID NO: 749924 - protein, 222 aa, Homo sapiens
MGRGVRVLLLLSLLHCAGGSEGRKTWRRRGQQPPPPPRTEAAPAAGQPVESFPLDFTAVEGNMDSFMAQVKSLAQSLYPCSAQQLNEDLRLHLLLNTSVTCNDGSPAGYYLKESRGSRRWLLFLEGGWYCFNRENCDSRYDTMRRLMSSRDWPRTRTGTGILSSQPEENPYWWNANMVFIPYCSSDVWSGASSKSEKTLDSSVHQLRQHPPAPPIKPFYIIL

SEQ ID NO: 749925 - protein, 87 aa, Homo sapiens
LITFAVECNPVLGVTSPHICHILLVRSKSQVPCVLIRRELHEGMTRRQETTGVQVGVCSPLMGWEESTYQLPHLPLPTAKHLLTEYL

SEQ ID NO: 749926 - protein, 117 aa, Homo sapiens
FPLHSLLWPDSLVGSTLLHAHVSIVSEDQNCSPMKCSSRAFLYLGPSRMKLESSWLGLSSALPGVPGKWRTHIHCNIISWERFVSLKLSPPTFKVGNAQRYLCCTLAIFFLCEREHY

SEQ ID NO: 749927 - protein, 1270 aa, Homo sapiens
ELPGGSGVGAGSPASVNRDMEPPGGSLGPGRGTRDKKKGRSPDELPSAGGDGGKSKKFLERFTSMRIKKEKEKPNSAHRNSSASYGDDPTAQSLQDVSDEQVLVLFEQMLLDMNLNEEKQQPLREKDIIIKREMVSQYLYTSKAGMSQKESSKSAMMYIQELRSGLRDMPLLSCLESLRVSLNNNPVSWVQTFGAEGLASLLDILKRLHDEKEETAGSYDSRNKHEIIRCLKAFMNNKFGIKTMLETEEGILLLVRAMDPAVPNMMIDAAKLLSALCILPQPEDMNERVLEAMTERAEMDEVERFQPLLDGLKSGTTIALKVGCLQLINALITPAEELDFRVHIRSELMRLGLHQVLQDLREIENEDMRVQLNVFDEQGEEDSYDLKGRLDDIRMEMDDFNEVFQILLNTVKDSKAEPHFLSILQHLLLVRNDYEARPQYYKLIEECISQIVLHKNGADPDFKCRHLQIEIEGLIDQMIDKTKVEKSEAKAAELEKKLDSELTARHELQVEMKKMESDFEQKLQDLQGEKDALHSEKQQIATEKQDLEAEVSQLTGEVAKLTKELEDAKKEMASLSAAAITVPPSVPSRAPVPPAPPLPGDSGTIIPPPPAPGDSTTPPPPPPPPPPPPPLPGGTAISPPPPLSGDATIPPPPPLPEGVGIPSPSSLPGGTAIPPPPPLPGSARIPPPPPPLPGSAGIPPPPPPLPGEAGMPPPPPPLPGGPGIPPPPPFPGGPGIPPPPPGMGMPPPPPFGFGVPAAPVLPFGLTPKKLYKPEVQLRRPNWSKLVAEDLSQDCFWTKVKEDRFENNELFAKLTLTFSAQTKTSKAKKDQEGGEEKKSVQKKKVKELKVLDSKTAQNLSIFLGSFRMPYQEIKNVILEVNEAVLTESMIQNLIKQMPEPEQLKMLSELKDEYDDLAESEQFGVVMGTVPRLRPRLNAILFKLQFSEQVENIKPEIVSVTAACEELRKSESFSNLLEITLLVGNYMNAGSRNAGAFGFNISFLCKLRDTKSTDQKMTLLHFLAELCENDYPDVLKFPDELAHVEKASRVSAENLQKNLDQMKKQISDVERDVQNFPAATDEKDKFVEKMTSFVKDAQEQYNKLRMMHSNMETLYKELGEYFLFDPKKLSVEEFFMDLHNFRNMFLQAVKENQKRRETEEKMRRAKLAKEKAEKERLEKQQKREQLIDMNAEGDETGVMDSLLEALQSGAAFRRKRGPRQANRKAGCAVTSLLASELTKDDAMAAVPAKVSKNSETFPTILEEAKELVGRAS

SEQ ID NO: 749928 - protein, 1270 aa, Homo sapiens; identical to SEQ ID NO: 749927

SEQ ID NO: 749929 - protein, 1282 aa, Homo sapiens
ELPGGSGVGAGSPASVNRDMEPPGGSLGPGRGTRDKKKGRSPDELPSAGGDGGKSKKFLERFTSMRIKKEKEKPNSAHRNSSASYGDDPTAQSLQDVSDEQVLVLFEQMLLDMNLNEEKQQPLREKDIIIKREMVSQYLYTSKAGMSQKESSKSAMMYIQELRSGLRDMPLLSCLESLRVSLNNNPVSWVQTFGAEGLASLLDILKRLHDEKEETAGSYDSRNKHEIIRCLKAFMNNKFGIKTMLETEEGILLLVRAMDPAVPNMMIDAAKLLSALCILPQPEDMNERVLEAMTERAEMDEVERFQPLLDGLKSGTTIALKVGCLQLINALITPAEELDFRVHIRSELMRLGLHQVLQDLREIENEDMRVQLNVFDEQGEEDSYDLKGRLDDIRMEMDDFNEVFQILLNTVKDSKAEPHFLSILQHLLLVRNDYEARPQYYKLIEECISQIVLHKNGADPDFKCRHLQIEIEGLIDQMIDKTKVEKSEAKAAELEKKLDSELTARHELQVEMKKMESDFEQKLQDLQGEKDALHSEKQQIATEKQDLEAEVSQLTGEVAKLTKELEDAKKEMASLSAAAITVPPSVPSRAPVPPAPPLPGDSGTIIPPPPAPGDSTTPPPPPPPPPPPPPLPGGVCISSPPSLPGGTAISPPPPLSGDATIPPPPPLPEGVGIPSPSSLPGGTAIPPPPPLPGSARIPPPPPPLPGSAGIPPPPPPLPGEAGMPPPPPPLPGGPGIPPPPPFPGGPGIPPPPPGMGMPPPPPFGFGVPAAPVLPFGLTPKKLYKPEVQLRRPNWSKLVAEDLSQDCFWTKVKEDRFENNELFAKLTLTFSAQTKTSKAKKDQEGGEEKKSVQKKKVKELKVLDSKTAQNLSIFLGSFRMPYQEIKNVILEVNEAVLTESMIQNLIKQMPEPEQLKMLSELKDEYDDLAESEQFGVVMGTVPRLRPRLNAILFKLQFSEQVENIKPEIVSVTAACEELRKSESFSNLLEITLLVGNYMNAGSRNAGAFGFNISFLCKLRDTKSTDQKMTLLHFLAELCENDYPDVLKFPDELAHVEKASRVSAENLQKNLDQMKKQISDVERDVQNFPAATDEKDKFVEKMTSFVKDAQEQYNKLRMMHSNMETLYKELGEYFLFDPKKLSVEEFFMDLHNFRNMFLQAVKENQKRRETEEKMRRAKLAKEKAEKERLEKQQKREQLIDMNAEGDETGVMDSLLEALQSGAAFRRKRGPRQANRKAGCAVTSLLASELTKDDAMAAVPAKVSKNSETFPTILEEAKELVGRAS

SEQ ID NO: 749930 - protein, 990 aa, Homo sapiens
MTERAEMDEVERFQPLLDGLKSGTTIALKVGCLQLINALITPAEELDFRVHIRSELMRLGLHQVLQDLREIENEDMRVQLNVFDEQGEEDSYDLKGRLDDIRMEMDDFNEVFQILLNTVKDSKAEPHFLSILQHLLLVRNDYEARPQYYKLIEECISQIVLHKNGADPDFKCRHLQIEIEGLIDQMIDKTKVEKSEAKAAELEKKLDSELTARHELQVEMKKMESDFEQKLQDLQGEKDALHSEKQQIATEKQDLEAEVSQLTGEVAKLTKELEDAKKEMASLSAAAITVPPSVPSRAPVPPAPPLPGDSGTIIPPPPAPGDSTTPPPPPPPPPPPPPLPGGVCISSPPSLPGGTAISPPPPLSGDATIPPPPPLPEGVGIPSPSSLPGGTAIPPPPPLPGSARIPPPPPPLPGSAGIPPPPPPLPGEAGMPPPPPPLPGGPGIPPPPPFPGGPGIPPPPPGMGMPPPPPFGFGVPAAPVLPFGLTPKKLYKPEVQLRRPNWSKLVAEDLSQDCFWTKVKEDRFENNELFAKLTLTFSAQTKTSKAKKDQEGGEEKKSVQKKKVKELKVLDSKTAQNLSIFLGSFRMPYQEIKNVILEVNEAVLTESMIQNLIKQMPEPEQLKMLSELKDEYDDLAESEQFGVVMGTVPRLRPRLNAILFKLQFSEQVENIKPEIVSVTAACEELRKSESFSNLLEITLLVGNYMNAGSRNAGAFGFNISFLCKLRDTKSTDQKMTLLHFLAELCENDYPDVLKFPDELAHVEKASRVSAENLQKNLDQMKKQISDVERDVQNFPAATDEKDKFVEKMTSFVKDAQEQYNKLRMMHSNMETLYKELGEYFLFDPKKLSVEEFFMDLHNFRNMFLQAVKENQKRRETEEKMRRAKLAKEKAEKERLEKQQKREQLIDMNAEGDETGVMDSLLEALQSGAAFRRKRGPRQANRKAGCAVTSLLASELTKDDAMAAVPAKVSKNSETFPTILEEAKELVGRAS

SEQ ID NO: 749931 - protein, 544 aa, Homo sapiens
GLPGNGGGGGIPGPSGMGMPPPPPFGFGVPAAPVLPFGLTPKKLYKPEVQLRRPNWSKLVAEDLSQDCFWTKVKEDRFENNELFAKLTLTFSAQTKTSKAKKDQEGGEEKKSVQKKKVKELKVLDSKTAQNLSIFLGSFRMPYQEIKNVILEVNEAVLTESMIQNLIKQMPEPEQLKMLSELKDEYDDLAESEQFGVVMGTVPRLRPRLNAILFKLQFSEQVENIKPEIVSVTAACEELRKSESFSNLLEITLLVGNYMNAGSRNAGAFGFNISFLCKLRDTKSTDQKMTLLHFLAELCENDYPDVLKFPDELAHVEKASRVSAENLQKNLDQMKKQISDVERDVQNFPAATDEKDKFVEKMTSFVKDAQEQYNKLRMMHSNMETLYKELGEYFLFDPKKLSVEEFFMDLHNFRNMFLQAVKENQKRRETEEKMRRAKLAKEKAEKERLEKQQKREQLIDMNAEGDETGVMDSLLEALQSGAAFRRKRGPRQANRKAGCAVTSLLASELTKDDAMAAVPAKVSKNSETFPTILEEAKELVGRAS

SEQ ID NO: 749932 - protein, 1270 aa, Homo sapiens; identical to SEQ ID NO: 749927

SEQ ID NO: 749933 - protein, 404 aa, Homo sapiens
MPYQEIKNVILEVNEAVLTESMIQNLIKQMPEPEQLKMLSELKDEYDDLAESEQFGVVMGTVPRLRPRLNAILFKLQFSEQVENIKPEIVSVTAACEELRKSESFSNLLEITLLVGNYMNAGSRNAGAFGFNISFLCKLRDTKSTDQKMTLLHFLAELCENDYPDVLKFPDELAHVEKASRVSAENLQKNLDQMKKQISDVERDVQNFPAATDEKDKFVEKMTSFVKDAQEQYNKLRMMHSNMETLYKELGEYFLFDPKKLSVEEFFMDLHNFRNMFLQAVKENQKRRETEEKMRRAKLAKEKAEKERLEKQQKREQLIDMNAEGDETGVMDSLLEALQSGAAFRRKRGPRQANRKAGCAVTSLLASELTKDDAMAAVPAKVSKNSETFPTILEEAKELVGRAS

SEQ ID NO: 749934 - protein, 463 aa, Homo sapiens
SDLPLSVILLLCLSKTSKAKKDQEGGEEKKSVQKKKVKELKVLDSKTAQNLSIFLGSFRMPYQEIKNVILEVNEAVLTESMIQNLIKQMPEPEQLKMLSELKDEYDDLAESEQFGVVMGTVPRLRPRLNAILFKLQFSEQVENIKPEIVSVTAACEELRKSESFSNLLEITLLVGNYMNAGSRNAGAFGFNISFLCKLRDTKSTDQKMTLLHFLAELCENDYPDVLKFPDELAHVEKASRVSAENLQKNLDQMKKQISDVERDVQNFPAATDEKDKFVEKMTSFVKDAQEQYNKLRMMHSNMETLYKELGEYFLFDPKKLSVEEFFMDLHNFRNMFLQAVKENQKRRETEEKMRRAKLAKEKAEKERLEKQQKREQLIDMNAEGDETGVMDSLLEALQSGAAFRRKRGPRQANRKAGCAVTSLLASELTKDDAMAAVPAKVSKNSETFPTILEEAKELVGRAS

SEQ ID NO: 749935 - protein, 192 aa, Homo sapiens
SWSWSFTPWLHSFVKDAQEQYNKLRMMHSNMETLYKELGEYFLFDPKKLSVEEFFMDLHNFRNMFLQAVKENQKRRETEEKMRRAKLAKEKAEKERLEKQQKREQLIDMNAEGDETGVMDSLLEALQSGAAFRRKRGPRQANRKAGCAVTSLLASELTKDDAMAAVPAKVSKNSETFPTILEEAKELVGRAS

SEQ ID NO: 749936 - protein, 111 aa, Homo sapiens
LGWKRKREWSDESEEEPEKELAPEPEETWVEGDETGVMDSLLEALQSGAAFRRKRGPRQANRKAGCAVTSLLASELTKDDAMAAVPAKVSKNSETFPTILEEAKELVGRAS

SEQ ID NO: 749937 - protein, 78 aa, Homo sapiens
ASTRWELSYCRPAGGANSLVIGGQEKANRKAGCAVTSLLASELTKDDAMAAVPAKVSKNSETFPTILEEAKELVGRAS

SEQ ID NO: 749938 - protein, 1034 aa, Homo sapiens
ELPGGSGVGAGSPASVNRDMEPPGGSLGPGRGTRDKKKGRSPDELPSAGGDGGKSKKFLERFTSMRIKKEKEKPNSAHRNSSASYGDDPTAQSLQDVSDEQVLVLFEQMLLDMNLNEEKQQPLREKDIIIKREMVSQYLYTSKAGMSQKESSKSAMMYIQELRSGLRDMPLLSCLESLRVSLNNNPVSWVQTFGAEGLASLLDILKRLHDEKEETAGSYDSRNKHEIIRCLKAFMNNKFGIKTMLETEEGILLLVRAMDPAVPNMMIDAAKLLSALCILPQPEDMNERVLEAMTERAEMDEVERFQPLLDGLKSGTTIALKVGCLQLINALITPAEELDFRVHIRSELMRLGLHQVLQDLREIENEDMRVQLNVFDEQGEEDSYDLKGRLDDIRMEMDDFNEVFQILLNTVKDSKAEPHFLSILQHLLLVRNDYEARPQYYKLIEECISQIVLHKNGADPDFKCRHLQIEIEGLIDQMIDKTKVEKSEAKAAELEKKLDSELTARHELQVEMKKMESDFEQKLQDLQGEKDALHSEKQQIATEKQDLEAEVSQLTGEVAKLTKELEDAKKEMASLSAAAITVPPSVPSRAPVPPAPPLPGDSGTIIPPPPAPGDSTTPPPPPPPPPPPPPLPGGVCISSPPSLPGGTAISPPPPLSGDATIPPPPPLPEGVGIPSPSSLPGGTAIPPPPPLPGSARIPPPPPPLPGSAGIPPPPPPLPGEAGMPPPPPPLPGGPGIPPPPPFPGGPGIPPPPPGMGMPPPPPFGFGVPAAPVLPFGLTPKKLYKPEVQLRRPNWSKLVAEDLSQDCFWTKVKEDRFENNELFAKLTLTFSAQTKTSKAKKDQEGGEEKKSVQKKKVKELKVLDSKTAQNLSIFLGSFRMPYQEIKNVILEVNEAVLTESMIQNLIKQMPEPEQLKMLSELKDEYDDLAESEQFGVVMGTVPRLRPRLNAILFKLQFSEQVENIKPEIVSVTAACEELRKSESFSNLLEITLLVGNYMNAGSRNAGAFGFNISFLCKLRDPSPQSRRSTQDPLER

SEQ ID NO: 749939 - protein, 759 aa, Homo sapiens
ELPGGSGVGAGSPASVNRDMEPPGGSLGPGRGTRDKKKGRSPDELPSAGGDGGKSKKFLERFTSMRIKKEKEKPNSAHRNSSASYGDDPTAQSLQDVSDEQVLVLFEQMLLDMNLNEEKQQPLREKDIIIKREMVSQYLYTSKAGMSQKESSKSAMMYIQELRSGLRDMPLLSCLESLRVSLNNNPVSWVQTFGAEGLASLLDILKRLHDEKEETAGSYDSRNKHEIIRCLKAFMNNKFGIKTMLETEEGILLLVRAMDPAVPNMMIDAAKLLSALCILPQPEDMNERVLEAMTERAEMDEVERFQPLLDGLKSGTTIALKVGCLQLINALITPAEELDFRVHIRSELMRLGLHQVLQDLREIENEDMRVQLNVFDEQGEEDSYDLKGRLDDIRMEMDDFNEVFQILLNTVKDSKAEPHFLSILQHLLLVRNDYEARPQYYKLIEECISQIVLHKNGADPDFKCRHLQIEIEGLIDQMIDKTKVEKSEAKAAELEKKLDSELTARHELQVEMKKMESDFEQKLQDLQGEKDALHSEKQQIATEKQDLEAEVSQLTGEVAKLTKELEDAKKEMASLSAAAITVPPSVPSRAPVPPAPPLPGDSGTIIPPPPAPGDSTTPPPPPPPPPPPPPLPGGVCISSPPSLPGGTAISPPPPLSGDATIPPPPPLPEGVGIPSPSSLPGGTAIPPPPPLPGSARIPPPPPPLPGSAGIPPPPPPLPGEAGMPPPPPPLPGGPGIPPPPPPCSLTSGALTLSFLIYFC

SEQ ID NO: 749940 - protein, 403 aa, Homo sapiens
ELPGGSGVGAGSPASVNRDMEPPGGSLGPGRETRDKKKGRSPDELPSAGGDGGKSKKFLERFTSMRIKKEKEKPNSAHRNSSASYGDDPTAQSLQDVSDEQVLVLFEQMLLDMNLNEEKQQPLREKDIIIKREMVSQYLYTSKAGMSQKESSKSAMMYIQELRSGLRDMPLLSCLESLRVSLNNNPVSWVQTFGAEGLASLLDILKRLHDEKEETAGSYDSRNKHEIIRCLKAFMNNKFGIKTMLETEEGILLLVRAMDPAVPNMMIDAAKLLSALCILPQPEDMNERVLEAMTERAEMDEVERFQPLLDGLKSGTTIALKVGCLQLINALITPAEELDFRVHIRSELMRLGLHQVLQDLREIENEDMRVQLNVFDEQGEEDSYDLKGRLDDIRMEMEYPFAD

SEQ ID NO: 749941 - protein, 319 aa, Homo sapiens
ELPGGSGVGAGSPASVNRDMEPPGGSLGPGRETRDKKKGRSPDELPSAGGDGGKSKKFLERFTSMRIKKEKEKPNSAHRNSSASYGDDPTAQSLQDVSDEQVLVLFEQMLLDMNLNEEKQQPLREKDIIIKREMVSQYLYTSKAGMSQKESSKSAMMYIQELRSGLRDMPLLSCLESLRVSLNNNPVSWVQTFGAEGLASLLDILKRLHDEKEETAGSYDSRNKHEIIRCLKAFMNNKFGIKTMLETEEGILLLVRAMDPAVPNMMIDAAKLLSALCILPQPEDMYVTGIIFLLHFQFYHFLLVQRTIELVGCPLGHKY

SEQ ID NO: 749942 - protein, 3266 aa, Homo sapiens
HSGPPPATALRHWFAGAFLLEVATAAGLSAGLTRLGSQVGGAMRRSKADVERYIASVQGSTPSPRQKSMKGFYFAKLYYEAKEYDLAKKYICTYINVQERDPKAHRFLGLLYELEENTDKAVECYRRSVELNPTQKDLVLKIAELLCKNDVTDGRAKYWLERAAKLFPGSPAIYKLKEQLLDCEGEDGWNKLFDLIQSELYVRPDDVHVNIRLVEVYRSTKRLKDAVAHCHEAERNIALRSSLEWNSCVVQTLKEYLESLQCLESDKSDWRATNTDLLLAYANLMLLTLSTRDVQESRELLQSFDSALQSVKSLGGNDELSATFLEMKGHFYMHAGSLLLKMGQHSSNVQWRALSELAALCYLIAFQVPRPKIKLIKGEAGQNLLEMMACDRLSQSGHMLLNLSRGKQDFLKEIVETFANKSGQSALYDALFSSQSPKDTSFLGSDDIGNIDVREPELEDLTRYDVGAIRAHNGSLQHLTWLGLQWNSLPALPGIRKWLKQLFHHLPHETSRLETNAPESICILDLEVFLLGVVYTSHLQLKEKCNSHHSSYQPLCLPLPVCKQLCTERQKSWWDAVCTLIHRKAVPGNVAKLRLLVQHEINTLRAQEKHGLQPALLVHWAECLQKTGSGLNSFYDQREYIGRSVHYWKKVLPLLKIIKKKNSIPEPIDPLFKHFHSVDIQASEIVEYEEDAHITFAILDAVNGNIEDAVTAFESIKSVVSYWNLALIFHRKAEDIENDALSPEEQEECKNYLRKTRDYLIKIIDDSDSNLSVVKKLPVPLESVKEMLNSVMQELEDYSEGGPLYKNGSLRNADSEIKHSTPSPTRYSLSPSKSYKYSPKTPPRWAEDQNSLLKMICQQVEAIKKEMQELKLNSSNSASPHRWPTENYGPDSVPDGYQGSQTFHGAPLTVATTGPSVYYSQSPAYNSQYLLRPAANVTPTKGPVYGMNRLPPQQHIYAYPQQMHTPPVQSSSACMFSQEMYGPPALRFESPATGILSPRGDDYFNYNVQQTSTNPPLPEPGYFTKPPIAAHASRSAESKTIEFGKTNFVQPMPGEGLRPSLPTQAHTTQPTPFKFNSNFKSNDGDFTFSSPQVVTQPPPAAYSNSESLLGLLTSDKPLQGDGYSGAKPIPGGQTIGPRNTFNFGSKNVSGISFTENMGSSQQKNSGFRRSDDMFTFHGPGKSVFGTPTLETANKNHETDGGSAHGDDDDDGPHFEPVVPLPDKIEVKTGEEDEEEFFCNRAKLFRFDVESKEWKERGIGNVKILRHKTSGKIRLLMRREQVLKICANHYISPDMKLTPNAGSDRSFVWHALDYADELPKPEQLAIRFKTPEEAALFKCKFEEAQSILKAPGTNVAMASNQAVRIVKEPTSHDNKDICKSDAGNLNFEFQVAKKEGSWWHCNSCSLKNASTAKKCVSCQNLNPSNKELVGPPLAETVFTPKTSPENVQDRFALVTPKKEGHWDCSICLVRNEPTVSRCIACQNTKSANKSGSSFVHQASFKFGQGDLPKPINSDFRSVFSTKEGQWDCSACLVQNEGSSTKCAACQNPRKQSLPATSIPTPASFKFGTSETSKTLKSGFEDMFAKKEGQWDCSSCLVRNEANATRCVACQNPDKPSPSTSVPAPASFKFGTSETSKAPKSGFEGMFTKKEGQWDCSVCLVRNEASATKCIACQNPGKQNQTTSAVSTPASSETSKAPKSGFEGMFTKKEGQWDCSVCLVRNEASATKCIACQNPGKQNQTTSAVSTPASSETSKAPKSGFEGMFTKKEGQWDCSVCLVRNEASATKCIACQCPSKQNQTTAISTPASSEISKAPKSGFEGMFIRKGQWDCSVCCVQNESSSLKCVACDASKPTHKPIAEAPSAFTLGSEMKLHDSSGSQVGTGFKSNFSEKASKFGNTEQGFKFGHVDQENSPSFMFQGSSNTEFKSTKEGFSIPVSADGFKFGISEPGNQEKKSEKPLENGTGFQAQDISGQKNGRGVIFGQTSSTFTFADLAKSTSGEGFQFGKKDPNFKGFSGAGEKLFSSQYGKMANKANTSGDFEKDDDAYKTEDSDDIHFEPVVQMPEKVELVTGEEDEKVLYSQRVKLFRFDAEVSQWKERGLGNLKILKNEVNGKLRMLMRREQVLKVCANHWITTTMNLKPLSGSDRAWMWLASDFSDGDAKLEQLAAKFKTPELAEEFKQKFEECQRLLLDIPLQTPHKLVDTGRAAKLIQRAEEMKSGLKDFKTFLTNDQTKVTEEENKGSGTGAAGASDTTIKPNPENTGPTLEWDNYDLREDALDDSVSSSSVHASPLASSPVRKNLFRFGESTTGFNFSFKSALSPSKSPAKLNQSGTSVGTDEESDVTQEEERDGQYFEPVVPLPDLVEVSSGEENEQVVFSHRAKLYRYDKDVGQWKERGIGDIKILQNYDNKQVRIVMRRDQVLKLCANHRITPDMTLQNMKGTERVWLWTACDFADGERKVEHLAVRFKLQDVADSFKKIFDEAKTAQEKDSLITPHVSRSSTPRESPCGKIAVAVLEETTRERTDVIQGDDVADATSEVEVSSTSETTPKAVVSPPKFVFGSESVKSIFSSEKSKPFAFGNSSATGSLFGFSFNAPLKSNNSETSSVAQSGSESKVEPKKCELSKNSDIEQSSDSKVKNLFASFPTEESSINYTFKTPEKAKEKKKPEDSPSDDDVLIVYELTPTAEQKALATKLKLPPTFFCYKNRPDYVSEEEEDDEDFETAVKKLNGKLYLDGSEKCRPLEENTADNEKECIIVWEKKPTVEEKAKADTLKLPPTFFCGVCSDTDEDNGNGEDFQSELQKVQEAQKSQTEEITSTTDSVYTGGTEVMVPSFCKSEEPDSITKSISSPSVSSETMDKPVDLSTRKEIDTDSTSQGESKIVSFGFGSSTGLSFADLASSNSGDFAFGSKDKNFQWANTGAAVFGTQSVGTQSAGKVGEDEDGSDEEVVHNEDIHFEPIVSLPEVEVKSGEEDEEILFKERAKLYRWDRDVSQWKERGVGDIKILWHTMKNYYRILMRRDQVFKVCANHVITKTMELKPLNVSNNALVWTASDYADGEAKVEQLAVRFKTKEVADCFKKTFEECQQNLMKLQKGHVSLAAELSKETNPVVFFDVCADGEPLGRITMELFSNIVPRTAENFRALCTGEKGFGFKNSIFHRVIPDFVCQGGDITKHDGTGGQSIYGDKFEDENFDVKHTGPGLLSMANQGQNTNNSQFVITLKKAEHLDFKHVVFGFVKDGMDTVKKIESFGSPKGSVCRRITITECGQI

SEQ ID NO: 749943 - protein, 3266 aa, Homo sapiens; identical to SEQ ID NO: 749942

SEQ ID NO: 749944 - protein, 234 aa, Homo sapiens [sequence omitted]

SEQ ID NO: 749945 - protein, 159 aa, Homo sapiens
RCSSSQQQQSGVDAYAETTFFLYANGDVGQLTAIQQIAFSNRKERKGVSSSWSGKQTMKPTETVVGLVPNSARDGDKFEDENFDVKHTGPGLLSMANQGQNTNNSQFVITLKKAEHLDFKHVVFGFVKDGMDTVKKIESFGSPKGSVCRRITITECGQI

SEQ ID NO: 749946 - protein, 139 aa, Homo sapiens
QSNSRNQSLSLQCICTGEKGFGFKNSIFHRVIPDFVCQGGDITKHDGTGGQSIYGDKFEDENFDVKHTGPGLLSMANQGQNTNNSQFVITLKKAEHLDFKHVVFGFVKDGMDTVKKIESFGSPKGSVCRRITITECGQI

SEQ ID NO: 749947 - protein, 2982 aa, Homo sapiens
MLLTLSTRDVQESRELLQSFDSALQSVKSLGGNDELSATFLEMKGHFYMHAGSLLLKMGQHSSNVQWRALSELAALCYLIAFQVPRPKIKLIKGEAGQNLLEMMACDRLSQSGHMLLNLSRGKQDFLKEIVETFANKSGQSALYDALFSSQSPKDTSFLGSDDIGNIDVREPELEDLTRYDVGAIRAHNGSLQHLTWLGLQWNSLPALPGIRKWLKQLFHHLPHETSRLETNAPESICILDLEVFLLGVVYTSHLQLKEKCNSHHSSYQPLCLPLPVCKQLCTERQKSWWDAVCTLIHRKAVPGNVAKLRLLVQHEINTLRAQEKHGLQPALLVHWAECLQKTGSGLNSFYDQREYIGRSVHYWKKVLPLLKIIKKKNSIPEPIDPLFKHFHSVDIQASEIVEYEEDAHITFAILDAVNGNIEDAVTAFESIKSVVSYWNLALIFHRKAEDIENDALSPEEQEECKNYLRKTRDYLIKIIDDSDSNLSVVKKLPVPLESVKEMLNSVMQELEDYSEGGPLYKNGSLRNADSEIKHSTPSPTRYSLSPSKSYKYSPKTPPRWAEDQNSLLKMICQQVEAIKKEMQELKLNSSNSASPHRWPTENYGPDSVPDGYQGSQTFHGAPLTVATTGPSVYYSQSPAYNSQYLLRPAANVTPTKGPVYGMNRLPPQQHIYAYPQQMHTPPVQSSSACMFSQEMYGPPALRFESPATGILSPRGDDYFNYNVQQTSTNPPLPEPGYFTKPPIAAHASRSAESKTIEFGKTNFVQPMPGEGLRPSLPTQAHTTQPTPFKFNSNFKSNDGDFTFSSPQVVTQPPPAAYSNSESLLGLLTSDKPLQGDGYSGAKPIPGGQTIGPRNTFNFGSKNVSGISFTENMGSSQQKNSGFRRSDDMFTFHGPGKSVFGTPTLETANKNHETDGGSAHGDDDDDGPHFEPVVPLPDKIEVKTGEEDEEEFFCNRAKLFRFDVESKEWKERGIGNVKILRHKTSGKIRLLMRREQVLKICANHYISPDMKLTPNAGSDRSFVWHALDYADELPKPEQLAIRFKTPEEAALFKCKFEEAQSILKAPGTNVAMASNQAVRIVKEPTSHDNKDICKSDAGNLNFEFQVAKKEGSWWHCNSCSLKNASTAKKCVSCQNLNPSNKELVGPPLAETVFTPKTSPENVQDRFALVTPKKEGHWDCSICLVRNEPTVSRCIACQNTKSANKSGSSFVHQASFKFGQGDLPKPINSDFRSVFSTKEGQWDCSACLVQNEGSSTKCAACQNPRKQSLPATSIPTPASFKFGTSETSKTLKSGFEDMFAKKEGQWDCSSCLVRNEANATRCVACQNPDKPSPSTSVPAPASFKFGTSETSKAPKSGFEGMFTKKEGQWDCSVCLVRNEASATKCIACQNPGKQNQTTSAVSTPASSETSKAPKSGFEGMFTKKEGQWDCSVCLVRNEASATKCIACQNPGKQNQTTSAVSTPASSETSKAPKSGFEGMFTKKEGQWDCSVCLVRNEASATKCIACQCPSKQNQTTAISTPASSEISKAPKSGFEGMFIRKGQWDCSVCCVQNESSSLKCVACDASKPTHKPIAEAPSAFTLGSEMKLHDSSGSQVGTGFKSNFSEKASKFGNTEQGFKFGHVDQENSPSFMFQGSSNTEFKSTKEGFSIPVSADGFKFGISEPGNQEKKSEKPLENGTGFQAQDISGQKNGRGVIFGQTSSTFTFADLAKSTSGEGFQFGKKDPNFKGFSGAGEKLFSSQYGKMANKANTSGDFEKDDDAYKTEDSDDIHFEPVVQMPEKVELVTGEEDEKVLYSQRVKLFRFDAEVSQWKERGLGNLKILKNEVNGKLRMLMRREQVLKVCANHWITTTMNLKPLSGSDRAWMWLASDFSDGDAKLEQLAAKFKTPELAEEFKQKFEECQRLLLDIPLQTPHKLVDTGRAAKLIQRAEEMKSGLKDFKTFLTNDQTKVTEEENKGSGTGAAGASDTTIKPNPENTGPTLEWDNYDLREDALDDSVSSSSVHASPLASSPVRKNLFRFGESTTGFNFSFKSALSPSKSPAKLNQSGTSVGTDEESDVTQEEERDGQYFEPVVPLPDLVEVSSGEENEQVVFSHRAKLYRYDKDVGQWKERGIGDIKILQNYDNKQVRIVMRRDQVLKLCANHRITPDMTLQNMKGTERVWLWTACDFADGERKVEHLAVRFKLQDVADSFKKIFDEAKTAQEKDSLITPHVSRSSTPRESPCGKIAVAVLEETTRERTDVIQGDDVADATSEVEVSSTSETTPKAVVSPPKFVFGSESVKSIFSSEKSKPFAFGNSSATGSLFGFSFNAPLKSNNSETSSVAQSGSESKVEPKKCELSKNSDIEQSSDSKVKNLFASFPTEESSINYTFKTPEKAKEKKKPEDSPSDDDVLIVYELTPTAEQKALATKLKLPPTFFCYKNRPDYVSEEEEDDEDFETAVKKLNGKLYLDGSEKCRPLEENTADNEKECIIVWEKKPTVEEKAKADTLKLPPTFFCGVCSDTDEDNGNGEDFQSELQKVQEAQKSQTEEITSTTDSVYTGGTEVMVPSFCKSEEPDSITKSISSPSVSSETMDKPVDLSTRKEIDTDSTSQGESKIVSFGFGSSTGLSFADLASSNSGDFAFGSKDKNFQWANTGAAVFGTQSVGTQSAGKVGEDEDGSDEEVVHNEDIHFEPIVSLPEVEVKSGEEDEEILFKERAKLYRWDRDVSQWKERGVGDIKILWHTMKNYYRILMRRDQVFKVCANHVITKTMELKPLNVSNNALVWTASDYADGEAKVEQLAVRFKTKEVADCFKKTFEECQQNLMKLQKGHVSLAAELSKETNPVVFFDVCADGEPLGRITMELFSNIVPRTAENFRALCTGEKGFGFKNSIFHRVIPDFVCQGGDITKHDGTGGQSIYGDKFEDENFDVKHTGPGLLSMANQGQNTNNSQFVITLKKAEHLDFKHVVFGFVKDGMDTVKKIESFGSPKGSVCRRITITECGQI

SEQ ID NO: 749948 - protein, 3266 aa, Homo sapiens; identical to SEQ ID NO: 749942

SEQ ID NO: 749949 - protein, 3248 aa, Homo sapiens
HSGPPPATALRHWFAGAFLLEVATAAGLSAGLTRLGSQVGGAMRRSKADVERYIASVQGSTPSPRQKSMKGFYFAKLYYEAKEYDLAKKYICTYINVQERDPKAHRFLGLLYELEENTDKAVECYRRSVELNPTQKDLVLKIAELLCKNDVTDGRAKYWLERAAKLFPGSPAIYKLKEQLLDCEGEDGWNKLFDLIQSELYVRPDDVHVNIRLVEVYRSTKRLKDAVAHCHEAERNIALRSSLEWNSCVVQTLKEYLESLQCLESDKSDWRATNTDLLLAYANLMLLTLSTRDVQESRELLQSFDSALQSVKSLGGNDELSATFLEMKGHFYMHAGSLLLKMGQHSSNVQWRALSELAALCYLIAFQVPRPKIKLIKGEAGQNLLEMMACDRLSQSGHMLLNLSRGKQDFLKEIVETFANKSGQSALYDALFSSQSPKDTSFLGSDDIGNIDVREPELEDLTRYDVGAIRAHNGSLQHLTWLGLQWNSLPALPGIRKWLKQLFHHLPHETSRLETNAPESICILDLEVFLLGVVYTSHLQLKEKCNSHHSSYQPLCLPLPVCKQLCTERQKSWWDAVCTLIHRKAVPGNVAKLRLLVQHEINTLRAQEKHGLQPALLVHWAECLQKTGSGLNSFYDQREYIGRSVHYWKKVLPLLKIIKKKNSIPEPIDPLFKHFHSVDIQASEIVEYEEDAHITFAILDAVNGNIEDAVTAFESIKSVVSYWNLALIFHRKAEDIENDALSPEEQEECKNYLRKTRDYLIKIIDDSDSNLSVVKKLPVPLESVKEMLNSVMQELEDYSEGGPLYKNGSLRNADSEIKHSTPSPTRYSLSPSKSYKYSPKTPPRWAEDQNSLLKMICQQVEAIKKEMQELKLNSSNSASPHRWPTENYGPDSVPDGYQGSQTFHGAPLTVATTGPSVYYSQSPAYNSQYLLRPAANVTPTKGPVYGMNRLPPQQHIYAYPQQMHTPPVQSSSACMFSQEMYGPPALRFESPATGILSPRGDDYFNYNVQQTSTNPPLPEPGYFTKPPIAAHASRSAESKTIEFGKTNFVQPMPGEGLRPSLPTQAHTTQPTPFKFNSNFKSNDGDFTFSSPQVVTQPPPAAYSNSESLLGLLTSDKPLQGDGYSGAKPIPGGQTIGPRNTFNFGSKNVSGISFTENMGSSQQKNSGFRRSDDMFTFHGPGKSVFGTPTLETANKNHETDGGSAHGDDDDDGPHFEPVVPLPDKIEVKTGEEDEEEFFCNRAKLFRFDVESKEWKERGIGNVKILRHKTSGKIRLLMRREQVLKICANHYISPDMKLTPNAGSDRSFVWHALDYADELPKPEQLAIRFKTPEEAALFKCKFEEAQSILKAPGTNVAMASNQAVRIVKEPTSHDNKDICKSDAGNLNFEFQVAKKEGSWWHCNSCSLKNASTAKKCVSCQNLNPSNKELVGPPLAETVFTPKTSPENVQDRFALVTPKKEGHWDCSICLVRNEPTVSRCIACQNTKSANKSGSSFVHQASFKFGQGDLPKPINSDFRSVFSTKEGQWDCSACLVQNEGSSTKCAACQNPRKQSLPATSIPTPASFKFGTSETSKTLKSGFEDMFAKKEGQWDCSSCLVRNEANATRCVACQNPDKPSPSTSVPAPASFKFGTSETSKAPKSGFEGMFTKKEGQWDCSVCLVRNEASATKCIACQNPGKQNQTTSAVSTPASSETSKAPKSGFEGMFTKKEGQWDCSVCLVRNEASATKCIACQNPGKQNQTTSAVSTPASSETSKAPKSGFEGMFTKKEGQWDCSVCLVRNEASATKCIACQCPSKQNQTTAISTPASSEISKAPKSGFEGMFIRKGQWDCSVCCVQNESSSLKCVACDASKPTHKPIAEAPSAFTLGSEMKLHDSSGSQVGTGFKSNFSEKASKFGNTEQGFKFGHVDQENSPSFMFQGSSNTEFKSTKEGFSIPVSADGFKFGISEPGNQEKKSEKPLENGTGFQAQDISGQKNGRGVIFGQTSSTFTFADLAKSTSGEGFQFGKKDPNFKGFSGAGEKLFSSQYGKMANKANTSGDFEKDDDAYKTEDSDDIHFEPVVQMPEKVELVTGEEDEKVLYSQRVKLFRFDAEVSQWKERGLGNLKILKNEVNGKLRMLMRREQVLKVCANHWITTTMNLKPLSGSDRAWMWLASDFSDGDAKLEQLAAKFLLLDIPLQTPHKLVDTGRAAKLIQRAEEMKSGLKDFKTFLTNDQTKVTEEENKGSGTGAAGASDTTIKPNPENTGPTLEWDNYDLREDALDDSVSSSSVHASPLASSPVRKNLFRFGESTTGFNFSFKSALSPSKSPAKLNQSGTSVGTDEESDVTQEEERDGQYFEPVVPLPDLVEVSSGEENEQVVFSHRAKLYRYDKDVGQWKERGIGDIKILQNYDNKQVRIVMRRDQVLKLCANHRITPDMTLQNMKGTERVWLWTACDFADGERKVEHLAVRFKLQDVADSFKKIFDEAKTAQEKDSLITPHVSRSSTPRESPCGKIAVAVLEETTRERTDVIQGDDVADATSEVEVSSTSETTPKAVVSPPKFVFGSESVKSIFSSEKSKPFAFGNSSATGSLFGFSFNAPLKSNNSETSSVAQSGSESKVEPKKCELSKNSDIEQSSDSKVKNLFASFPTEESSINYTFKTPEKAKEKKKPEDSPSDDDVLIVYELTPTAEQKALATKLKLPPTFFCYKNRPDYVSEEEEDDEDFETAVKKLNGKLYLDGSEKCRPLEENTADNEKECIIVWEKKPTVEEKAKADTLKLPPTFFCGVCSDTDEDNGNGEDFQSELQKVQEAQKSQTEEITSTTDSVYTGGTEVMVPSFCKSEEPDSITKSISSPSVSSETMDKPVDLSTRKEIDTDSTSQGESKIVSFGFGSSTGLSFADLASSNSGDFAFGSKDKNFQWANTGAAVFGTQSVGTQSAGKVGEDEDGSDEEVVHNEDIHFEPIVSLPEVEVKSGEEDEEILFKERAKLYRWDRDVSQWKERGVGDIKILWHTMKNYYRILMRRDQVFKVCANHVITKTMELKPLNVSNNALVWTASDYADGEAKVEQLAVRFKTKEVADCFKKTFEECQQNLMKLQKGHVSLAAELSKETNPVVFFDVCADGEPLGRITMELFSNIVPRTAENFRALCTGEKGFGFKNSIFHRVIPDFVCQGGDITKHDGTGGQSIYGDKFEDENFDVKHTGPGLLSMANQGQNTNNSQFVITLKKAEHLDFKHVVFGFVKDGMDTVKKIESFGSPKGSVCRRITITECGQI

SEQ ID NO: 749950 - protein, 2205 aa, Homo sapiens
ETESYSVARAGVQWRDLGSLQAPPPGFMPFSSLSLPSSWDYSNSESLLGLLTSDKPLQGDGYSGAKPIPGGQTIGPRNTFNFGSKNVSGISFTENMGSSQQKNSGFRRSDDMFTFHGPGKSVFGTPTLETANKNHETDGGSAHGDDDDDGPHFEPVVPLPDKIEVKTGEEDEEEFFCNRAKLFRFDVESKEWKERGIGNVKILRHKTSGKIRLLMRREQVLKICANHYISPDMKLTPNAGSDRSFVWHALDYADELPKPEQLAIRFKTPEEAALFKCKFEEAQSILKAPGTNVAMASNQAVRIVKEPTSHDNKDICKSDAGNLNFEFQVAKKEGSWWHCNSCSLKNASTAKKCVSCQNLNPSNKELVGPPLAETVFTPKTSPENVQDRFALVTPKKEGHWDCSICLVRNEPTVSRCIACQNTKSANKSGSSFVHQASFKFGQGDLPKPINSDFRSVFSTKEGQWDCSACLVQNEGSSTKCAACQNPRKQSLPATSIPTPASFKFGTSETSKTLKSGFEDMFAKKEGQWDCSSCLVRNEANATRCVACQNPDKPSPSTSVPAPASFKFGTSETSKAPKSGFEGMFTKKEGQWDCSVCLVRNEASATKCIACQNPGKQNQTTSAVSTPASSETSKAPKSGFEGMFTKKEGQWDCSVCLVRNEASATKCIACQNPGKQNQTTSAVSTPASSETSKAPKSGFEGMFTKKEGQWDCSVCLVRNEASATKCIACQCPSKQNQTTAISTPASSEISKAPKSGFEGMFIRKGQWDCSVCCVQNESSSLKCVACDASKPTHKPIAEAPSAFTLGSEMKLHDSSGSQVGTGFKSNFSEKASKFGNTEQGFKFGHVDQENSPSFMFQGSSNTEFKSTKEGFSIPVSADGFKFGISEPGNQEKKSEKPLENGTGFQAQDISGQKNGRGVIFGQTSSTFTFADLAKSTSGEGFQFGKKDPNFKGFSGAGEKLFSSQYGKMANKANTSGDFEKDDDAYKTEDSDDIHFEPVVQMPEKVELVTGEEDEKVLYSQRVKLFRFDAEVSQWKERGLGNLKILKNEVNGKLRMLMRREQVLKVCANHWITTTMNLKPLSGSDRAWMWLASDFSDGDAKLEQLAAKFKTPELAEEFKQKFEECQRLLLDIPLQTPHKLVDTGRAAKLIQRAEEMKSGLKDFKTFLTNDQTKVTEEENKGSGTGAAGASDTTIKPNPENTGPTLEWDNYDLREDALDDSVSSSSVHASPLASSPVRKNLFRFGESTTGFNFSFKSALSPSKSPAKLNQSGTSVGTDEESDVTQEEERDGQYFEPVVPLPDLVEVSSGEENEQVVFSHRAKLYRYDKDVGQWKERGIGDIKILQNYDNKQVRIVMRRDQVLKLCANHRITPDMTLQNMKGTERVWLWTACDFADGERKVEHLAVRFKLQDVADSFKKIFDEAKTAQEKDSLITPHVSRSSTPRESPCGKIAVAVLEETTRERTDVIQGDDVADATSEVEVSSTSETTPKAVVSPPKFVFGSESVKSIFSSEKSKPFAFGNSSATGSLFGFSFNAPLKSNNSETSSVAQSGSESKVEPKKCELSKNSDIEQSSDSKVKNLFASFPTEESSINYTFKTPEKAKEKKKPEDSPSDDDVLIVYELTPTAEQKALATKLKLPPTFFCYKNRPDYVSEEEEDDEDFETAVKKLNGKLYLDGSEKCRPLEENTADNEKECIIVWEKKPTVEEKAKADTLKLPPTFFCGVCSDTDEDNGNGEDFQSELQKVQEAQKSQTEEITSTTDSVYTGGTEVMVPSFCKSEEPDSITKSISSPSVSSETMDKPVDLSTRKEIDTDSTSQGESKIVSFGFGSSTGLSFADLASSNSGDFAFGSKDKNFQWANTGAAVFGTQSVGTQSAGKVGEDEDGSDEEVVHNEDIHFEPIVSLPEVEVKSGEEDEEILFKERAKLYRWDRDVSQWKERGVGDIKILWHTMKNYYRILMRRDQVFKVCANHVITKTMELKPLNVSNNALVWTASDYADGEAKVEQLAVRFKTKEVADCFKKTFEECQQNLMKLQKGHVSLAAELSKETNPVVFFDVCADGEPLGRITMELFSNIVPRTAENFRALCTGEKGFGFKNSIFHRVIPDFVCQGGDITKHDGTGGQSIYGDKFEDENFDVKHTGPGLLSMANQGQNTNNSQFVITLKKAEHLDFKHVVFGFVKDGMDTVKKIESFGSPKGSVCRRITITECGQI

SEQ ID NO: 749951 - protein, 3248 aa, Homo sapiens
HSGPPPATALRHWFAGAFLLEVATAAGLSAGLTRLGSQVGGAMRRSKADVERYIASVQGSTPSPRQKSMKGFYFAKLYYEAKEYDLAKKYICTYINVQERDPKAHRFLGLLYELEENTDKAVECYRRSVELNPTQKDLVLKIAELLCKNDVTDGRAKYWLERAAKLFPGSPAIYKLKEQLLDCEGEDGWNKLFDLIQSELYVRPDDVHVNIRLVEVYRSTKRLKDAVAHCHEAERNIALRSSLEWNSCVVQTLKEYLESLQCLESDKSDWRATNTDLLLAYANLMLLTLSTRDVQESRELLQSFDSALQSVKSLGGNDELSATFLEMKGHFYMHAGSLLLKMGQHSSNVQWRALSELAALCYLIAFQVPRPKIKLIKGEAGQNLLEMMACDRLSQSGHMLLNLSRGKQDFLKEIVETFANKSGQSALYDALFSSQSPKDTSFLGSDDIGNIDVREPELEDLTRYDVGAIRAHNGSLQHLTWLGLQWNSLPALPGIRKWLKQLFHHLPHETSRLETNAPESICILDLEVFLLGVVYTSHLQLKEKCNSHHSSYQPLCLPLPVCKQLCTERQKSWWDAVCTLIHRKAVPGNVAKLRLLVQHEINTLRAQEKHGLQPALLVHWAECLQKTGSGLNSFYDQREYIGRSVHYWKKVLPLLKIIKKKNSIPEPIDPLFKHFHSVDIQASEIVEYEEDAHITFAILDAVNGNIEDAVTAFESIKSVVSYWNLALIFHRKAEDIENDALSPEEQEECKNYLRKTRDYLIKIIDDSDSNLSVVKKLPVPLESVKEMLNSVMQELEDYSEGGPLYKNGSLRNADSEIKHSTPSPTRYSLSPSKSYKYSPKTPPRWAEDQNSLLKMICQQVEAIKKEMQELKLNSSNSASPHRWPTENYGPDSVPDGYQGSQTFHGAPLTVATTGPSVYYSQSPAYNSQYLLRPAANVTPTKGPVYGMNRLPPQQHIYAYPQQMHTPPVQSSSACMFSQEMYGPPALRFESPATGILSPRGDDYFNYNVQQTSTNPPLPEPGYFTKPPIAAHASRSAESKTIEFGKTNFVQPMPGEGLRPSLPTQAHTTQPTPFKFNSNFKSNDGDFTFSSPQVVTQPPPAAYSNSESLLGLLTSDKPLQGDGYSGAKPIPGGQTIGPRNTFNFGSKNVSGISFTENMGSSQQKNSGFRRSDDMFTFHGPGKSVFGTPTLETANKNHETDGGSAHGDDDDDGPHFEPVVPLPDKIEVKTGEEDEEEFFCNRAKLFRFDVESKEWKERGIGNVKILRHKTSGKIRLLMRREQVLKICANHYISPDMKLTPNAGSDRSFVWHALDYADELPKPEQLAIRFKTPEEAALFKCKFEEAQSILKAPGTNVAMASNQAVRIVKEPTSHDNKDICKSDAGNLNFEFQVAKKEGSWWHCNSCSLKNASTAKKCVSCQNLNPSNKELVGPPLAETVFTPKTSPENVQDRFALVTPKKEGHWDCSICLVRNEPTVSRCIACQNTKSANKSGSSFVHQASFKFGQGDLPKPINSDFRSVFSTKEGQWDCSACLVQNEGSSTKCAACQNPRKQSLPATSIPTPASFKFGTSETSKTLKSGFEDMFAKKEGQWDCSSCLVRNEANATRCVACQNPDKPSPSTSVPAPASFKFGTSETSKAPKSGFEGMFTKKEGQWDCSVCLVRNEASATKCIACQNPGKQNQTTSAVSTPASSETSKAPKSGFEGMFTKKEGQWDCSVCLVRNEASATKCIACQNPGKQNQTTSAVSTPASSETSKAPKSGFEGMFTKKEGQWDCSVCLVRNEASATKCIACQCPSKQNQTTAISTPASSEISKAPKSGFEGMFIRKGQWDCSVCCVQNESSSLKCVACDASKPTHKPIAEAPSAFTLGSEMKLHDSSGSQVGTGFKSNFSEKASKFGNTEQGFKFGHVDQENSPSFMFQGSSNTEFKSTKEGFSIPVSADGFKFGISEPGNQEKKSEKPLENGTGFQAQDISGQKNGRGVIFGQTSSTFTFADLAKSTSGEGFQFGKKDPNFKGFSGAGEKLFSSQYGKMANKANTSGDFEKDDDAYKTEDSDDIHFEPVVQMPEKVELVTGEEDEKVLYSQRVKLFRFDAEVSQWKERGLGNLKILKNEVNGKLRMLMRREQVLKVCANHWITTTMNLKPLSGSDRAWMWLASDFSDGDAKLEQLAAKFKTPELAEEFKQKFEECQRLLLDIPLQTPHKLVDTGRAAKLIQRAEEMKSGLKDFKTFLTNDQTKVTEEENKGSGTGAAGASDTTIKPNPENTGPTLEWDNYDLREDALDDSVSSSSVHASPLASSPVRKNLFRFGESTTGFNFSFKSALSPSKSPAKLNQSGTSVGTDEESDVTQEEERDGQYFEPVVPLPDLVEVSSGEENEQVVFSHRAKLYRYDKDVGQWKERGIGDIKILQNYDNKQVRIVMRRDQVLKLCANHRITPDMTLQNMKGTERVWLWTACDFADGERKVEHLAVRFKLQDVADSFKKIFDEAKTAQEKDSLITPHVSRSSTPRESPCGKIAVAVLEETTRERTDVIQGDDVADATSEVEVSSTSETTPKAVVSPPKFVFGSESVKSIFSSEKSKPFAFGNSSATGSLFGFSFNAPLKSNNSETSSVAQSGSESKVEPKKCELSKNSDIEQSSDSKVKNLFASFPTEESSINYTFKTPEKAKEKKKPEDSPSDDDVLIVYELTPTAEQKALATKLKLPPTFFCYKNRPDYVSEEEEDDEDFETAVKKLNGKLYLDGSEKCRPLEENTADNEKECIIVWEKKPTVEEKAKADTLKLPPTFFCGVCSDTDEDNGNGEDFQSELQKVQEAQKSQTEEITSTTDSVYTGGTEVMVPSFCKSEEPDSITKSISSPSVSSETMDKPVDLSTRKEIDTDSTSQGESKIVSFGFGSSTGLSFADLASSNSGDFAFGSKVGTQSAGKVGEDEDGSDEEVVHNEDIHFEPIVSLPEVEVKSGEEDEEILFKERAKLYRWDRDVSQWKERGVGDIKILWHTMKNYYRILMRRDQVFKVCANHVITKTMELKPLNVSNNALVWTASDYADGEAKVEQLAVRFKTKEVADCFKKTFEECQQNLMKLQKGHVSLAAELSKETNPVVFFDVCADGEPLGRITMELFSNIVPRTAENFRALCTGEKGFGFKNSIFHRVIPDFVCQGGDITKHDGTGGQSIYGDKFEDENFDVKHTGPGLLSMANQGQNTNNSQFVITLKKAEHLDFKHVVFGFVKDGMDTVKKIESFGSPKGSVCRRITITECGQI

SEQ ID NO: 749952 - protein, 3248 aa, Homo sapiens
HSGPPPATALRHWFAGAFLLEVATAAGLSAGLTRLGSQVGGAMRRSKADVERYIASVQGSTPSPRQKSMKGFYFAKLYYEAKEYDLAKKYICTYINVQERDPKAHRFLGLLYELEENTDKAVECYRRSVELNPTQKDLVLKIAELLCKNDVTDGRAKYWLERAAKLFPGSPAIYKLKEQLLDCEGEDGWNKLFDLIQSELYVRPDDVHVNIRLVEVYRSTKRLKDAVAHCHEAERNIALRSSLEWNSCVVQTLKEYLESLQCLESDKSDWRATNTDLLLAYANLMLLTLSTRDVQESRELLQSFDSALQSVKSLGGNDELSATFLEMKGHFYMHAGSLLLKMGQHSSNVQWRALSELAALCYLIAFQVPRPKIKLIKGEAGQNLLEMMACDRLSQSGHMLLNLSRGKQDFLKEIVETFANKSGQSALYDALFSSQSPKDTSFLGSDDIGNIDVREPELEDLTRYDVGAIRAHNGSLQHLTWLGLQWNSLPALPGIRKWLKQLFHHLPHETSRLETNAPESICILDLEVFLLGVVYTSHLQLKEKCNSHHSSYQPLCLPLPVCKQLCTERQKSWWDAVCTLIHRKAVPGNVAKLRLLVQHEINTLRAQEKHGLQPALLVHWAECLQKTGSGLNSFYDQREYIGRSVHYWKKVLPLLKIIKKKNSIPEPIDPLFKHFHSVDIQASEIVEYEEDAHITFAILDAVNGNIEDAVTAFESIKSVVSYWNLALIFHRKAEDIENDALSPEEQEECKNYLRKTRDYLIKIIDDSDSNLSVVKKLPVPLESVKEMLNSVMQELEDYSEGGPLYKNGSLRNADSEIKHSTPSPTRYSLSPSKSYKYSPKTPPRWAEDQNSLLKMICQQVEAIKKEMQELKLNSSNSASPHRWPTENYGPDSVPDGYQGSQTFHGAPLTVATTGPSVYYSQSPAYNSQYLLRPAANVTPTKGPVYGMNRLPPQQHIYAYPQQMHTPPVQSSSACMFSQEMYGPPALRFESPATGILSPRGDDYFNYNVQQTSTNPPLPEPGYFTKPPIAAHASRSAESKTIEFGKTNFVQPMPGEGLRPSLPTQAHTTQPTPFKFNSNFKSNDGDFTFSSPQVVTQPPPAAYSNSESLLGLLTSDKPLQGDGYSGAKPIPGGQTIGPRNTFNFGSKNVSGISFTENMGSSQQKNSGFRRSDDMFTFHGPGKSVFGTPTLETANKNHETDGGSAHGDDDDDGPHFEPVVPLPDKIEVKTGEEDEEEFFCNRAKLFRFDVESKEWKERGIGNVKILRHKTSGKIRLLMRREQVLKICANHYISPDMKLTPNAGSDRSFVWHALDYADELPKPEQLAIRFKTPEEAALFKCKFEEAQSILKAPGTNVAMASNQAVRIVKEPTSHDNKDICKSDAGNLNFEFQVAKKEGSWWHCNSCSLKNASTAKKCVSCQNLNPSNKELVGPPLAETVFTPKTSPENVQDRFALVTPKKEGHWDCSICLVRNEPTVSRCIACQNTKSANKSGSSFVHQASFKFGQGDLPKPINSDFRSVFSTKEGQWDCSACLVQNEGSSTKCAACQNPRKQSLPATSIPTPASFKFGTSETSKTLKSGFEDMFAKKEGQWDCSSCLVRNEANATRCVACQNPDKPSPSTSVPAPASFKFGTSETSKAPKSGFEGMFTKKEGQWDCSVCLVRNEASATKCIACQNPGKQNQTTSAVSTPASSETSKAPKSGFEGMFTKKEGQWDCSVCLVRNEASATKCIACQNPGKQNQTTSAVSTPASSETSKAPKSGFEGMFTKKEGQWDCSVCLVRNEASATKCIACQCPSKQNQTTAISTPASSEISKAPKSGFEGMFIRKGQWDCSVCCVQNESSSLKCVACDASKPTHKPIAEAPSAFTLGSEMKLHDSSGSQVGTGFKSNFSEKASKFGNTEQGFKFGHVDQENSPSFMFQGSSNTEFKSTKEGFSIPVSADGFKFGISEPGNQEKKSEKPLENGTGFQAQDISGQKNGRGVIFGQTSSTFTFADLAKSTSGEGFQFGKKDPNFKGFSGAGEKLFSSQYGKMANKANTSGDFEKDDDAYKTEDSDDIHFEPVVQMPEKVELVTGEEDEKVLYSQRVKLFRFDAEVSQWKERGLGNLKILKNEVNGKLRMLMRREQVLKVCANHWITTTMNLKPLSGSDRAWMWLASDFSDGDAKLEQLAAKFKTPELAEEFKQKFEECQRLLLDIPLQTPHKLVDTGRAAKLIQRAEEMKSGLKDFKTFLTNDQTKVTEEENKGSGTGAAGASDTTIKPNPENTGPTLEWDNYDLREDALDDSVSSSSVHASPLASSPVRKNLFRFGESTTGFNFSFKSALSPSKSPAKLNQSGTSVGTDEESDVTQEEERDGQYFEPVVPLPDLVEVSSGEENEQVVFSHRAKLYRYDKDVGQWKERGIGDIKILQNYDNKQVRIVMRRDQVLKLCANHRITPDMTLQNMKGTERVWLWTACDFADGERKVEHLAVRFKLQDVADSFKKIFDEAKTAQEKDSLITPHVSRSSTPRESPCGKIAVAVLEETTRERTDVIQGDDVADATSEVEVSSTSETTPKAVVSPPKFVFGSESVKSIFSSEKSKPFAFGNSSATGSLFGFSFNAPLKSNNSETSSVAQSGSESKVEPKKCELSKNSDIEQSSDSKVKNLFASFPTEESSINYTFKTPEKAKEKKKPEDSPSDDDVLIVYELTPTAEQKALATKLKLPPTFFCYKNRPDYVSEEEEDDEDFETAVKKLNGKLYLDGSEKCRPLEENTADNEKECIIVWEKKPTVEEKAKADTLKLPPTFFCGVCSDTDEDNGNGEDFQSELQKVQEAQKSQTEEITSTTDSVYTGGTEVMVPSFCKSEEPDSITKSISSPSVSSETMDKPVDLSTRKEIDTDSTSQGESKIVSFGFGSSTGLSFADLASSNSGDFAFGSKDKNFQWANTGAAVFGTQSVGTQSAGKVGEDEDGSDEEVVHNEDIHFEPIVSLPEVEVKSGEEDEEILFKERAKLYRWDRDVSQWKERGVGDIKILWHTMKNYYRILMRRDQVFKVCANHVITKTMELKPLNVSNNALVWTASDYADGEAKVEQLAVRFKTKEVADCFKSLAAELSKETNPVVFFDVCADGEPLGRITMELFSNIVPRTAENFRALCTGEKGFGFKNSIFHRVIPDFVCQGGDITKHDGTGGQSIYGDKFEDENFDVKHTGPGLLSMANQGQNTNNSQFVITLKKAEHLDFKHVVFGFVKDGMDTVKKIESFGSPKGSVCRRITITECGQI

SEQ ID NO: 749953 - protein, 3068 aa, Homo sapiens
HSGPPPATALRHWFAGAFLLEVATAAGLSAGLTRLGSQVGGAMRRSKADVERYIASVQGSTPSPRQKSMKGFYFAKLYYEAKEYDLAKKYICTYINVQERDPKAHRFLGLLYELEENTDKAVECYRRSVELNPTQKDLVLKIAELLCKNDVTDGRAKYWLERAAKLFPGSPAIYKLKEQLLDCEGEDGWNKLFDLIQSELYVRPDDVHVNIRLVEVYRSTKRLKDAVAHCHEAERNIALRSSLEWNSCVVQTLKEYLESLQCLESDKSDWRATNTDLLLAYANLMLLTLSTRDVQESRELLQSFDSALQSVKSLGGNDELSATFLEMKGHFYMHAGSLLLKMGQHSSNVQWRALSELAALCYLIAFQVPRPKIKLIKGEAGQNLLEMMACDRLSQSGHMLLNLSRGKQDFLKEIVETFANKSGQSALYDALFSSQSPKDTSFLGSDDIGNIDVREPELEDLTRYDVGAIRAHNGSLQHLTWLGLQWNSLPALPGIRKWLKQLFHHLPHETSRLETNAPESICILDLEVFLLGVVYTSHLQLKEKCNSHHSSYQPLCLPLPVCKQLCTERQKSWWDAVCTLIHRKAVPGNVAKLRLLVQHEINTLRAQEKHGLQPALLVHWAECLQKTGSGLNSFYDQREYIGRSVHYWKKVLPLLKIIKKKNSIPEPIDPLFKHFHSVDIQASEIVEYEEDAHITFAILDAVNGNIEDAVTAFESIKSVVSYWNLALIFHRKAEDIENDALSPEEQEECKNYLRKTRDYLIKIIDDSDSNLSVVKKLPVPLESVKEMLNSVMQELEDYSEGGPLYKNGSLRNADSEIKHSTPSPTRYSLSPSKSYKYSPKTPPRWAEDQNSLLKMICQQVEAIKKEMQELKLNSSNSASPHRWPTENYGPDSVPDGYQGSQTFHGAPLTVATTGPSVYYSQSPAYNSQYLLRPAANVTPTKGPVYGMNRLPPQQHIYAYPQQMHTPPVQSSSACMFSQEMYGPPALRFESPATGILSPRGDDYFNYNVQQTSTNPPLPEPGYFTKPPIAAHASRSAESKTIEFGKTNFVQPMPGEGLRPSLPTQAHTTQPTPFKFNSNFKSNDGDFTFSSPQVVTQPPPAAYSNSESLLGLLTSDKPLQGDGYSGAKPIPGGQTIGPRNTFNFGSKNVSGISFTENMGSSQQKNSGFRRSDDMFTFHGPGKSVFGTPTLETANKNHETDGGSAHGDDDDDGPHFEPVVPLPDKIEVKTGEEDEEEFFCNRAKLFRFDVESKEWKERGIGNVKILRHKTSGKIRLLMRREQVLKICANHYISPDMKLTPNAGSDRSFVWHALDYADELPKPEQLAIRFKTPEEAALFKCKFEEAQSILKAPGTNVAMASNQAVRIVKEPTSHDNKDICKSDAGNLNFEFQVAKKEGSWWHCNSCSLKNASTAKKCVSCQNLNPSNKELVGPPLAETVFTPKTSPENVQDRFALVTPKKEGHWDCSICLVRNEPTVSRCIACQNTKSANKSGSSFVHQASFKFGQGDLPKPINSDFRSVFSTKEGQWDCSACLVQNEGSSTKCAACQNPRKQSLPATSIPTPASFKFGTSETSKTLKSGFEDMFAKKEGQWDCSSCLVRNEANATRCVACQNPDKPSPSTSVPAPASFKFGTSETSKAPKSGFEGMFTKKEGQWDCSVCLVRNEASATKCIACQNPGKQNQTTSAVSTPASSETSKAPKSGFEGMFTKKEGQWDCSVCLVRNEASATKCIACQNPGKQNQTTSAVSTPASSETSKAPKSGFEGMFTKKEGQWDCSVCLVRNEASATKCIACQCPSKQNQTTAISTPASSEISKAPKSGFEGMFIRKGQWDCSVCCVQNESSSLKCVACDASKPTHKPIAEAPSAFTLGSEMKLHDSSGSQVGTGFKSNFSEKASKFGNTEQGFKFGHVDQENSPSFMFQGSSNTEFKSTKEGFSIPVSADGFKFGISEPGNQEKKSEKPLENGTGFQAQDISGQKNGRGVIFGQTSSTFTFADLAKSTSGEGFQFGKKDPNFKGFSGAGEKLFSSQYGKMANKANTSGDFEKDDDAYKTEDSDDIHFEPVVQMPEKVELVTGEEDEKVLYSQRVKLFRFDAEVSQWKERGLGNLKILKNEVNGKLRMLMRREQVLKVCANHWITTTMNLKPLSGSDRAWMWLASDFSDGDAKLEQLAAKFKTPELAEEFKQKFEECQRLLLDIPLQTPHKLVDTGRAAKLIQRAEEMKSGLKDFKTFLTNDQTKVTEEENKGSGTGAAGASDTTIKPNPENTGPTLEWDNYDLREDALDDSVSSSSVHASPLASSPVRKNLFRFGESTTGFNFSFKSALSPSKSPAKLNQSGTSVGTDEESDVTQEEERDGQYFEPVVPLPDLVEVSSGEENEQVVFSHRAKLYRYDKDVGQWKERGIGDIKILQNYDNKQVRIVMRRDQVLKLCANHRITPDMTLQNMKGTERVWLWTACDFADGERKVEHLAVRFKLQDVADSFKKIFDEAKTAQEKDSLITPHVSRSSTPRESPCGKIAVAVLEETTRERTDVIQGDDVADATSEVEVSSTSETTPKAVVSPPKFVFGSESVKSIFSSEKSKPFAFGNSSATGSLFGFSFNAPLKSNNSETSSVAQSGSESKVEPKKCELSKNSDIEQSSDSKVKNLFASFPTEESSINYTFKTPEKAKEKKKPEDSPSDDDVLIVYELTPTAEQKALATKLKLPPTFFCYKNRPDYVSEEEEDDEDFETAVKKLNGKLYLDGSEKCRPLEENTADNEKECIIVWEKKPTVEEKAKADTLKLPPTFFCGVCSDTDEDNGNGEDFQSELQKVQEAQKSQTEEITSTTDSVYTGGTEVMVPSFCKSEEPDSITKSISSPSVSSETMDKPVDLSTRKEIDTDSTSQGESKIVSFGFGSSTGLSFADLASSNSGDFAFGSKDKNFQWANTGAAVFGTQSVGTQSAGKVGEDEDGSDEEVVHNEDIHFEPIVSLPEVEVKSGEEDEEILFKERAKLYRWDRDVSQWKERGVGDIKILWHTMKNYYRILMRRDQVFKVCANHVITKTMELKPLNVSNNALVWTASDYADGEAKVEQLAVRFRI

SEQ ID NO: 749954 - protein, 3266 aa, Homo sapiens; identical to SEQ ID NO: 749942

SEQ ID NO: 749955 - protein, 3051 aa, Homo sapiens
HSGPPPATALRHWFAGAFLLEVATAAGLSAGLTRLGSQVGGAMRRSKADVERYIASVQGSTPSPRQKSMKGFYFAKLYYEAKEYDLAKKYICTYINVQERDPKAHRFLGLLYELEENTDKAVECYRRSVELNPTQKDLVLKIAELLCKNDVTDGRAKYWLERAAKLFPGSPAIYKLKEQLLDCEGEDGWNKLFDLIQSELYVRPDDVHVNIRLVEVYRSTKRLKDAVAHCHEAERNIALRSSLEWNSCVVQTLKEYLESLQCLESDKSDWRATNTDLLLAYANLMLLTLSTRDVQESRELLQSFDSALQSVKSLGGNDELSATFLEMKGHFYMHAGSLLLKMGQHSSNVQWRALSELAALCYLIAFQVPRPKIKLIKGEAGQNLLEMMACDRLSQSGHMLLNLSRGKQDFLKEIVETFANKSGQSALYDALFSSQSPKDTSFLGSDDIGNIDVREPELEDLTRYDVGAIRAHNGSLQHLTWLGLQWNSLPALPGIRKWLKQLFHHLPHETSRLETNAPESICILDLEVFLLGVVYTSHLQLKEKCNSHHSSYQPLCLPLPVCKQLCTERQKSWWDAVCTLIHRKAVPGNVAKLRLLVQHEINTLRAQEKHGLQPALLVHWAECLQKTGSGLNSFYDQREYIGRSVHYWKKVLPLLKIIKKKNSIPEPIDPLFKHFHSVDIQASEIVEYEEDAHITFAILDAVNGNIEDAVTAFESIKSVVSYWNLALIFHRKAEDIENDALSPEEQEECKNYLRKTRDYLIKIIDDSDSNLSVVKKLPVPLESVKEMLNSVMQELEDYSEGGPLYKNGSLRNADSEIKHSTPSPTRYSLSPSKSYKYSPKTPPRWAEDQNSLLKMICQQVEAIKKEMQELKLNSSNSASPHRWPTENYGPDSVPDGYQGSQTFHGAPLTVATTGPSVYYSQSPAYNSQYLLRPAANVTPTKGPVYGMNRLPPQQHIYAYPQQMHTPPVQSSSACMFSQEMYGPPALRFESPATGILSPRGDDYFNYNVQQTSTNPPLPEPGYFTKPPIAAHASRSAESKTIEFGKTNFVQPMPGEGLRPSLPTQAHTTQPTPFKFNSNFKSNDGDFTFSSPQVVTQPPPAAYSNSESLLGLLTSDKPLQGDGYSGAKPIPGGQTIGPRNTFNFGSKNVSGISFTENMGSSQQKNSGFRRSDDMFTFHGPGKSVFGTPTLETANKNHETDGGSAHGDDDDDGPHFEPVVPLPDKIEVKTGEEDEEEFFCNRAKLFRFDVESKEWKERGIGNVKILRHKTSGKIRLLMRREQVLKICANHYISPDMKLTPNAGSDRSFVWHALDYADELPKPEQLAIRFKTPEEAALFKCKFEEAQSILKAPGTNVAMASNQAVRIVKEPTSHDNKDICKSDAGNLNFEFQVAKKEGSWWHCNSCSLKNASTAKKCVSCQNLNPSNKELVGPPLAETVFTPKTSPENVQDRFALVTPKKEGHWDCSICLVRNEPTVSRCIACQNTKSANKSGSSFVHQASFKFGQGDLPKPINSDFRSVFSTKEGQWDCSACLVQNEGSSTKCAACQNPRKQSLPATSIPTPASFKFGTSETSKTLKSGFEDMFAKKEGQWDCSSCLVRNEANATRCVACQNPDKPSPSTSVPAPASFKFGTSETSKAPKSGFEGMFTKKEGQWDCSVCLVRNEASATKCIACQNPGKQNQTTSAVSTPASSETSKAPKSGFEGMFTKKEGQWDCSVCLVRNEASATKCIACQNPGKQNQTTSAVSTPASSETSKAPKSGFEGMFTKKEGQWDCSVCLVRNEASATKCIACQCPSKQNQTTAISTPASSEISKAPKSGFEGMFIRKGQWDCSVCCVQNESSSLKCVACDASKPTHKPIAEAPSAFTLGSEMKLHDSSGSQVGTGFKSNFSEKASKFGNTEQGFKFGHVDQENSPSFMFQGSSNTEFKSTKEGFSIPVSADGFKFGISEPGNQEKKSEKPLENGTGFQAQDISGQKNGRGVIFGQTSSTFTFADLAKSTSGEGFQFGKKDPNFKGFSGAGEKLFSSQYGKMANKANTSGDFEKDDDAYKTEDSDDIHFEPVVQMPEKVELVTGEEDEKVLYSQRVKLFRFDAEVSQWKERGLGNLKILKNEVNGKLRMLMRREQVLKVCANHWITTTMNLKPLSGSDRAWMWLASDFSDGDAKLEQLAAKFKTPELAEEFKQKFEECQRLLLDIPLQTPHKLVDTGRAAKLIQRAEEMKSGLKDFKTFLTNDQTKVTEEENKGSGTGAAGASDTTIKPNPENTGPTLEWDNYDLREDALDDSVSSSSVHASPLASSPVRKNLFRFGESTTGFNFSFKSALSPSKSPAKLNQSGTSVGTDEESDVTQEEERDGQYFEPVVPLPDLVEVSSGEENEQVVFSHRAKLYRYDKDVGQWKERGIGDIKILQNYDNKQVRIVMRRDQVLKLCANHRITPDMTLQNMKGTERVWLWTACDFADGERKVEHLAVRFKLQDVADSFKKIFDEAKTAQEKDSLITPHVSRSSTPRESPCGKIAVAVLEETTRERTDVIQGDDVADATSEVEVSSTSETTPKAVVSPPKFVFGSESVKSIFSSEKSKPFAFGNSSATGSLFGFSFNAPLKSNNSETSSVAQSGSESKVEPKKCELSKNSDIEQSSDSKVKNLFASFPTEESSINYTFKTPEKAKEKKKPEDSPSDDDVLIVYELTPTAEQKALATKLKLPPTFFCYKNRPDYVSEEEEDDEDFETAVKKLNGKLYLDGSEKCRPLEENTADNEKECIIVWEKKPTVEEKAKADTLKLPPTFFCGVCSDTDEDNGNGEDFQSELQKVQEAQKSQTEEITSTTDSVYTGGTEVMVPSFCKSEEPDSITKSISSPSVSSETMDKPVDLSTRKEIDKNLMKLQKGHVSLAAELSKETNPVVFFDVCADGEPLGRITMELFSNIVPRTAENFRALCTGEKGFGFKNSIFHRVIPDFVCQGGDITKHDGTGGQSIYGDKFEDENFDVKHTGPGLLSMANQGQNTNNSQFVITLKKAEHLDFKHVVFGFVKDGMDTVKKIESFGSPKGSVCRRITITECGQI

SEQ ID NO: 749956 - protein, 3266 aa, Homo sapiens; identical to SEQ ID NO: 749942

SEQ ID NO: 749957 - protein, 599 aa, Homo sapiens
NDGPQLRKYSYVLLDSNDGPQRFRNLKLPPTFFCYKNRPDYVSEEEEDDEDFETAVKKLNGKLYLDGSEKCRPLEENTADNEKECIIVWEKKPTVEEKAKADTLKLPPTFFCGVCSDTDEDNGNGEDFQSELQKVQEAQKSQTEEITSTTDSVYTGGTEVMVPSFCKSEEPDSITKSISSPSVSSETMDKPVDLSTRKEIDTDSTSQGESKIVSFGFGSSTGLSFADLASSNSGDFAFGSKDKNFQWANTGAAVFGTQSVGTQSAGKVGEDEDGSDEEVVHNEDIHFEPIVSLPEVEVKSGEEDEEILFKERAKLYRWDRDVSQWKERGVGDIKILWHTMKNYYRILMRRDQVFKVCANHVITKTMELKPLNVSNNALVWTASDYADGEAKVEQLAVRFKTKEVADCFKKTFEECQQNLMKLQKGHVSLAAELSKETNPVVFFDVCADGEPLGRITMELFSNIVPRTAENFRALCTGEKGFGFKNSIFHRVIPDFVCQGGDITKHDGTGGQSIYGDKFEDENFDVKHTGPGLLSMANQGQNTNNSQFVITLKKAEHLDFKHVVFGFVKDGMDTVKKIESFGSPKGSVCRRITITECGQI

SEQ ID NO: 749958 - protein, 3013 aa, Homo sapiens
HSGPPPATALRHWFAGAFLLEVATAAGLSAGLTRLGSQVGGAMRRSKADVERYIASVQGSTPSPRQKSMKGFYFAKLYYEAKEYDLAKKYICTYINVQERDPKAHRFLGLLYELEENTDKAVECYRRSVELNPTQKDLVLKIAELLCKNDVTDGRAKYWLERAAKLFPGSPAIYKLKEQLLDCEGEDGWNKLFDLIQSELYVRPDDVHVNIRLVEVYRSTKRLKDAVAHCHEAERNIALRSSLEWNSCVVQTLKEYLESLQCLESDKSDWRATNTDLLLAYANLMLLTLSTRDVQESRELLQSFDSALQSVKSLGGNDELSATFLEMKGHFYMHAGSLLLKMGQHSSNVQWRALSELAALCYLIAFQVPRPKIKLIKGEAGQNLLEMMACDRLSQSGHMLLNLSRGKQDFLKEIVETFANKSGQSALYDALFSSQSPKDTSFLGSDDIGNIDVREPELEDLTRYDVGAIRAHNGSLQHLTWLGLQWNSLPALPGIRKWLKQLFHHLPHETSRLETNAPESICILDLEVFLLGVVYTSHLQLKEKCNSHHSSYQPLCLPLPVCKQLCTERQKSWWDAVCTLIHRKAVPGNVAKLRLLVQHEINTLRAQEKHGLQPALLVHWAECLQKTGSGLNSFYDQREYIGRSVHYWKKVLPLLKIIKKKNSIPEPIDPLFKHFHSVDIQASEIVEYEEDAHITFAILDAVNGNIEDAVTAFESIKSVVSYWNLALIFHRKAEDIENDALSPEEQEECKNYLRKTRDYLIKIIDDSDSNLSVVKKLPVPLESVKEMLNSVMQELEDYSEGGPLYKNGSLRNADSEIKHSTPSPTRYSLSPSKSYKYSPKTPPRWAEDQNSLLKMICQQVEAIKKEMQELKLNSSNSASPHRWPTENYGPDSVPDGYQGSQTFHGAPLTVATTGPSVYYSQSPAYNSQYLLRPAANVTPTKGPVYGMNRLPPQQHIYAYPQQMHTPPVQSSSACMFSQEMYGPPALRFESPATGILSPRGDDYFNYNVQQTSTNPPLPEPGYFTKPPIAAHASRSAESKTIEFGKTNFVQPMPGEGLRPSLPTQAHTTQPTPFKFNSNFKSNDGDFTFSSPQVVTQPPPAAYSNSESLLGLLTSDKPLQGDGYSGAKPIPGGQTIGPRNTFNFGSKNVSGISFTENMGSSQQKNSGFRRSDDMFTFHGPGKSVFGTPTLETANKNHETDGGSAHGDDDDDGPHFEPVVPLPDKIEVKTGEEDEEEFFCNRAKLFRFDVESKEWKERGIGNVKILRHKTSGKIRLLMRREQVLKICANHYISPDMKLTPNAGSDRSFVWHALDYADELPKPEQLAIRFKTPEEAALFKCKFEEAQSILKAPGTNVAMASNQAVRIVKEPTSHDNKDICKSDAGNLNFEFQVAKKEGSWWHCNSCSLKNASTAKKCVSCQNLNPSNKELVGPPLAETVFTPKTSPENVQDRFALVTPKKEGHWDCSICLVRNEPTVSRCIACQNTKSANKSGSSFVHQASFKFGQGDLPKPINSDFRSVFSTKEGQWDCSACLVQNEGSSTKCAACQNPRKQSLPATSIPTPASFKFGTSETSKTLKSGFEDMFAKKEGQWDCSSCLVRNEANATRCVACQNPDKPSPSTSVPAPASFKFGTSETSKAPKSGFEGMFTKKEGQWDCSVCLVRNEASATKCIACQNPGKQNQTTSAVSTPASSETSKAPKSGFEGMFTKKEGQWDCSVCLVRNEASATKCIACQNPGKQNQTTSAVSTPASSETSKAPKSGFEGMFTKKEGQWDCSVCLVRNEASATKCIACQCPSKQNQTTAISTPASSEISKAPKSGFEGMFIRKGQWDCSVCCVQNESSSLKCVACDASKPTHKPIAEAPSAFTLGSEMKLHDSSGSQVGTGFKSNFSEKASKFGNTEQGFKFGHVDQENSPSFMFQGSSNTEFKSTKEGFSIPVSADGFKFGISEPGNQEKKSEKPLENGTGFQAQDISGQKNGRGVIFGQTSSTFTFADLAKSTSGEGFQFGKKDPNFKGFSGAGEKLFSSQYGKMANKANTSGDFEKDDDAYKTEDSDDIHFEPVVQMPEKVELVTGEEDEKVLYSQRVKLFRFDAEVSQWKERGLGNLKILKNEVNGKLRMLMRREQVLKVCANHWITTTMNLKPLSGSDRAWMWLASDFSDGDAKLEQLAAKFKTPELAEEFKQKFEECQRLLLDIPLQTPHKLVDTGRAAKLIQRAEEMKSGLKDFKTFLTNDQTKVTEEENKGSGTGAAGASDTTIKPNPENTGPTLEWDNYDLREDALDDSVSSSSVHASPLASSPVRKNLFRFGESTTGFNFSFKSALSPSKSPAKLNQSGTSVGTDEESDVTQEEERDGQYFEPVVPLPDLVEVSSGEENEQVVFSHRAKLYRYDKDVGQWKERGIGDIKILQNYDNKQVRIVMRRDQVLKLCANHRITPDMTLQNMKGTERVWLWTACDFADGERKVEHLAVRFKLQDVADSFKKIFDEAKTAQEKDSLITPHVSRSSTPRESPCGKIAVAVLEETTRERTDVIQGDDVADATSEVEVSSTSETTPKAVVSPPKFVFGSESVKSIFSSEKSKPFAFGNSSATGSLFGFSFNAPLKSNNSETSSVAQSGSESKVEPKKCELSKNSDIEQSSDSKVKNLFASFPTEESSINYTFKTPEKAKEKKKPEDSPSDDDVLIVYELTPTAEQKALATKLKLPPTFFCYKNRPDYVSEEEEDDEDFETAVKKLNGKLYLDGSEKCRPLEENTADNEKECIIVWEKKPTVEEKAKADTLKLPPTFFCGVCSDTDEDNGNGEDFQSELQKVQEAQKSQTEEITSTTDSVYTGGTEVMVPSFCKSEEPDSITKSISSPSVSSETMDKPVDLSTRKEIDTDSTSQGESKIVSFGFGSSTGLSFADLASSNSGDFAFGSKDKNFQWANTGAAVFGTQSVGTQSAGKVGEDEDGSDEEVVHNEDIHFEPIVSLPEVEVKSGEEDEEILFKERAKLYRWDRGGKIWGGFSPQKRGFFPPQNEELLPD

SEQ ID NO: 749959 - protein, 2928 aa, Homo sapiens
HSGPPPATALRHWFAGAFLLEVATAAGLSAGLTRLGSQVGGAMRRSKADVERYIASVQGSTPSPRQKSMKGFYFAKLYYEAKEYDLAKKYICTYINVQERDPKAHRFLGLLYELEENTDKAVECYRRSVELNPTQKDLVLKIAELLCKNDVTDGRAKYWLERAAKLFPGSPAIYKLKEQLLDCEGEDGWNKLFDLIQSELYVRPDDVHVNIRLVEVYRSTKRLKDAVAHCHEAERNIALRSSLEWNSCVVQTLKEYLESLQCLESDKSDWRATNTDLLLAYANLMLLTLSTRDVQESRELLQSFDSALQSVKSLGGNDELSATFLEMKGHFYMHAGSLLLKMGQHSSNVQWRALSELAALCYLIAFQVPRPKIKLIKGEAGQNLLEMMACDRLSQSGHMLLNLSRGKQDFLKEIVETFANKSGQSALYDALFSSQSPKDTSFLGSDDIGNIDVREPELEDLTRYDVGAIRAHNGSLQHLTWLGLQWNSLPALPGIRKWLKQLFHHLPHETSRLETNAPESICILDLEVFLLGVVYTSHLQLKEKCNSHHSSYQPLCLPLPVCKQLCTERQKSWWDAVCTLIHRKAVPGNVAKLRLLVQHEINTLRAQEKHGLQPALLVHWAECLQKTGSGLNSFYDQREYIGRSVHYWKKVLPLLKIIKKKNSIPEPIDPLFKHFHSVDIQASEIVEYEEDAHITFAILDAVNGNIEDAVTAFESIKSVVSYWNLALIFHRKAEDIENDALSPEEQEECKNYLRKTRDYLIKIIDDSDSNLSVVKKLPVPLESVKEMLNSVMQELEDYSEGGPLYKNGSLRNADSEIKHSTPSPTRYSLSPSKSYKYSPKTPPRWAEDQNSLLKMICQQVEAIKKEMQELKLNSSNSASPHRWPTENYGPDSVPDGYQGSQTFHGAPLTVATTGPSVYYSQSPAYNSQYLLRPAANVTPTKGPVYGMNRLPPQQHIYAYPQQMHTPPVQSSSACMFSQEMYGPPALRFESPATGILSPRGDDYFNYNVQQTSTNPPLPEPGYFTKPPIAAHASRSAESKTIEFGKTNFVQPMPGEGLRPSLPTQAHTTQPTPFKFNSNFKSNDGDFTFSSPQVVTQPPPAAYSNSESLLGLLTSDKPLQGDGYSGAKPIPGGQTIGPRNTFNFGSKNVSGISFTENMGSSQQKNSGFRRSDDMFTFHGPGKSVFGTPTLETANKNHETDGGSAHGDDDDDGPHFEPVVPLPDKIEVKTGEEDEEEFFCNRAKLFRFDVESKEWKERGIGNVKILRHKTSGKIRLLMRREQVLKICANHYISPDMKLTPNAGSDRSFVWHALDYADELPKPEQLAIRFKTPEEAALFKCKFEEAQSILKAPGTNVAMASNQAVRIVKEPTSHDNKDICKSDAGNLNFEFQVAKKEGSWWHCNSCSLKNASTAKKCVSCQNLNPSNKELVGPPLAETVFTPKTSPENVQDRFALVTPKKEGHWDCSICLVRNEPTVSRCIACQNTKSANKSGSSFVHQASFKFGQGDLPKPINSDFRSVFSTKEGQWDCSACLVQNEGSSTKCAACQNPRKQSLPATSIPTPASFKFGTSETSKTLKSGFEDMFAKKEGQWDCSSCLVRNEANATRCVACQNPDKPSPSTSVPAPASFKFGTSETSKAPKSGFEGMFTKKEGQWDCSVCLVRNEASATKCIACQNPGKQNQTTSAVSTPASSETSKAPKSGFEGMFTKKEGQWDCSVCLVRNEASATKCIACQNPGKQNQTTSAVSTPASSETSKAPKSGFEGMFTKKEGQWDCSVCLVRNEASATKCIACQCPSKQNQTTAISTPASSEISKAPKSGFEGMFIRKGQWDCSVCCVQNESSSLKCVACDASKPTHKPIAEAPSAFTLGSEMKLHDSSGSQVGTGFKSNFSEKASKFGNTEQGFKFGHVDQENSPSFMFQGSSNTEFKSTKEGFSIPVSADGFKFGISEPGNQEKKSEKPLENGTGFQAQDISGQKNGRGVIFGQTSSTFTFADLAKSTSGEGFQFGKKDPNFKGFSGAGEKLFSSQYGKMANKANTSGDFEKDDDAYKTEDSDDIHFEPVVQMPEKVELVTGEEDEKVLYSQRVKLFRFDAEVSQWKERGLGNLKILKNEVNGKLRMLMRREQVLKVCANHWITTTMNLKPLSGSDRAWMWLASDFSDGDAKLEQLAAKFKTPELAEEFKQKFEECQRLLLDIPLQTPHKLVDTGRAAKLIQRAEEMKSGLKDFKTFLTNDQTKVTEEENKGSGTGAAGASDTTIKPNPENTGPTLEWDNYDLREDALDDSVSSSSVHASPLASSPVRKNLFRFGESTTGFNFSFKSALSPSKSPAKLNQSGTSVGTDEESDVTQEEERDGQYFEPVVPLPDLVEVSSGEENEQVVFSHRAKLYRYDKDVGQWKERGIGDIKILQNYDNKQVRIVMRRDQVLKLCANHRITPDMTLQNMKGTERVWLWTACDFADGERKVEHLAVRFKLQDVADSFKKIFDEAKTAQEKDSLITPHVSRSSTPRESPCGKIAVAVLEETTRERTDVIQGDDVADATSEVEVSSTSETTPKAVVSPPKFVFGSESVKSIFSSEKSKPFAFGNSSATGSLFGFSFNAPLKSNNSETSSVAQSGSESKVEPKKCELSKNSDIEQSSDSKVKNLFASFPTEESSINYTFKTPEKAKEKKKPEDSPSDDDVLIVYELTPTAEQKALATKLKLPPTFFCYKNRPDYVSEEEEDDEDFETAVKKLNGKLYLDGSEKCRPLEENTADNEKECIIVWEKKPTVEEKAKADTLKLPPTFFCGVCSDTDEDNGNGEDFQSELQKVQEAQKSQTEEITSTTDSVYTGGTEVMVPSFCKSEEPDSITKSISSPSVSSETMDKPVDLSTRKEIDTDSTSQGESKIVSFGFGSSTGLSFADLASSNSGDFAFGSKGCHSVAQAGVQWHEHSSLLP

SEQ ID NO: 749960 - protein, 2820 aa, Homo sapiens
HSGPPPATALRHWFAGAFLLEVATAAGLSAGLTRLGSQVGGAMRRSKADVERYIASVQGSTPSPRQKSMKGFYFAKLYYEAKEYDLAKKYICTYINVQERDPKAHRFLGLLYELEENTDKAVECYRRSVELNPTQKDLVLKIAELLCKNDVTDGRAKYWLERAAKLFPGSPAIYKLKEQLLDCEGEDGWNKLFDLIQSELYVRPDDVHVNIRLVEVYRSTKRLKDAVAHCHEAERNIALRSSLEWNSCVVQTLKEYLESLQCLESDKSDWRATNTDLLLAYANLMLLTLSTRDVQESRELLQSFDSALQSVKSLGGNDELSATFLEMKGHFYMHAGSLLLKMGQHSSNVQWRALSELAALCYLIAFQVPRPKIKLIKGEAGQNLLEMMACDRLSQSGHMLLNLSRGKQDFLKEIVETFANKSGQSALYDALFSSQSPKDTSFLGSDDIGNIDVREPELEDLTRYDVGAIRAHNGSLQHLTWLGLQWNSLPALPGIRKWLKQLFHHLPHETSRLETNAPESICILDLEVFLLGVVYTSHLQLKEKCNSHHSSYQPLCLPLPVCKQLCTERQKSWWDAVCTLIHRKAVPGNVAKLRLLVQHEINTLRAQEKHGLQPALLVHWAECLQKTGSGLNSFYDQREYIGRSVHYWKKVLPLLKIIKKKNSIPEPIDPLFKHFHSVDIQASEIVEYEEDAHITFAILDAVNGNIEDAVTAFESIKSVVSYWNLALIFHRKAEDIENDALSPEEQEECKNYLRKTRDYLIKIIDDSDSNLSVVKKLPVPLESVKEMLNSVMQELEDYSEGGPLYKNGSLRNADSEIKHSTPSPTRYSLSPSKSYKYSPKTPPRWAEDQNSLLKMICQQVEAIKKEMQELKLNSSNSASPHRWPTENYGPDSVPDGYQGSQTFHGAPLTVATTGPSVYYSQSPAYNSQYLLRPAANVTPTKGPVYGMNRLPPQQHIYAYPQQMHTPPVQSSSACMFSQEMYGPPALRFESPATGILSPRGDDYFNYNVQQTSTNPPLPEPGYFTKPPIAAHASRSAESKTIEFGKTNFVQPMPGEGLRPSLPTQAHTTQPTPFKFNSNFKSNDGDFTFSSPQVVTQPPPAAYSNSESLLGLLTSDKPLQGDGYSGAKPIPGGQTIGPRNTFNFGSKNVSGISFTENMGSSQQKNSGFRRSDDMFTFHGPGKSVFGTPTLETANKNHETDGGSAHGDDDDDGPHFEPVVPLPDKIEVKTGEEDEEEFFCNRAKLFRFDVESKEWKERGIGNVKILRHKTSGKIRLLMRREQVLKICANHYISPDMKLTPNAGSDRSFVWHALDYADELPKPEQLAIRFKTPEEAALFKCKFEEAQSILKAPGTNVAMASNQAVRIVKEPTSHDNKDICKSDAGNLNFEFQVAKKEGSWWHCNSCSLKNASTAKKCVSCQNLNPSNKELVGPPLAETVFTPKTSPENVQDRFALVTPKKEGHWDCSICLVRNEPTVSRCIACQNTKSANKSGSSFVHQASFKFGQGDLPKPINSDFRSVFSTKEGQWDCSACLVQNEGSSTKCAACQNPRKQSLPATSIPTPASFKFGTSETSKTLKSGFEDMFAKKEGQWDCSSCLVRNEANATRCVACQNPDKPSPSTSVPAPASFKFGTSETSKAPKSGFEGMFTKKEGQWDCSVCLVRNEASATKCIACQNPGKQNQTTSAVSTPASSETSKAPKSGFEGMFTKKEGQWDCSVCLVRNEASATKCIACQNPGKQNQTTSAVSTPASSETSKAPKSGFEGMFTKKEGQWDCSVCLVRNEASATKCIACQCPSKQNQTTAISTPASSEISKAPKSGFEGMFIRKGQWDCSVCCVQNESSSLKCVACDASKPTHKPIAEAPSAFTLGSEMKLHDSSGSQVGTGFKSNFSEKASKFGNTEQGFKFGHVDQENSPSFMFQGSSNTEFKSTKEGFSIPVSADGFKFGISEPGNQEKKSEKPLENGTGFQAQDISGQKNGRGVIFGQTSSTFTFADLAKSTSGEGFQFGKKDPNFKGFSGAGEKLFSSQYGKMANKANTSGDFEKDDDAYKTEDSDDIHFEPVVQMPEKVELVTGEEDEKVLYSQRVKLFRFDAEVSQWKERGLGNLKILKNEVNGKLRMLMRREQVLKVCANHWITTTMNLKPLSGSDRAWMWLASDFSDGDAKLEQLAAKFKTPELAEEFKQKFEECQRLLLDIPLQTPHKLVDTGRAAKLIQRAEEMKSGLKDFKTFLTNDQTKVTEEENKGSGTGAAGASDTTIKPNPENTGPTLEWDNYDLREDALDDSVSSSSVHASPLASSPVRKNLFRFGESTTGFNFSFKSALSPSKSPAKLNQSGTSVGTDEESDVTQEEERDGQYFEPVVPLPDLVEVSSGEENEQVVFSHRAKLYRYDKDVGQWKERGIGDIKILQNYDNKQVRIVMRRDQVLKLCANHRITPDMTLQNMKGTERVWLWTACDFADGERKVEHLAVRFKLQDVADSFKKIFDEAKTAQEKDSLITPHVSRSSTPRESPCGKIAVAVLEETTRERTDVIQGDDVADATSEVEVSSTSETTPKAVVSPPKFVFGSESVKSIFSSEKSKPFAFGNSSATGSLFGFSFNAPLKSNNSETSSVAQSGSESKVEPKKCELSKNSDIEQSSDSKVKNLFASFPTEESSINYTFKTPEKAKEKKKPEDSPSDDDVLIVYELTPTAEQKALATKLKLPPTFFCYKNRPDYVSEEEEDDEDFETAVKKLNGKLYLDGSEKCRPLEENTADNEKECIIVWEKKPTVEEKAKADTLKLPPTFFCGVCSDTDEDNGNGEDFQSELQKVQEAQKSQTEGKQLFMYSF

SEQ ID NO: 749961 - protein, 2431 aa, Homo sapiens
HSGPPPATALRHWFAGAFLLEVATAAGLSAGLTRLGSQVGGAMRRSKADVERYIASVQGSTPSPRQKSMKGFYFAKLYYEAKEYDLAKKYICTYINVQERDPKAHRFLGLLYELEENTDKAVECYRRSVELNPTQKDLVLKIAELLCKNDVTDGRAKYWLERAAKLFPGSPAIYKLKEQLLDCEGEDGWNKLFDLIQSELYVRPDDVHVNIRLVEVYRSTKRLKDAVAHCHEAERNIALRSSLEWNSCVVQTLKEYLESLQCLESDKSDWRATNTDLLLAYANLMLLTLSTRDVQESRELLQSFDSALQSVKSLGGNDELSATFLEMKGHFYMHAGSLLLKMGQHSSNVQWRALSELAALCYLIAFQVPRPKIKLIKGEAGQNLLEMMACDRLSQSGHMLLNLSRGKQDFLKEIVETFANKSGQSALYDALFSSQSPKDTSFLGSDDIGNIDVREPELEDLTRYDVGAIRAHNGSLQHLTWLGLQWNSLPALPGIRKWLKQLFHHLPHETSRLETNAPESICILDLEVFLLGVVYTSHLQLKEKCNSHHSSYQPLCLPLPVCKQLCTERQKSWWDAVCTLIHRKAVPGNVAKLRLLVQHEINTLRAQEKHGLQPALLVHWAECLQKTGSGLNSFYDQREYIGRSVHYWKKVLPLLKIIKKKNSIPEPIDPLFKHFHSVDIQASEIVEYEEDAHITFAILDAVNGNIEDAVTAFESIKSVVSYWNLALIFHRKAEDIENDALSPEEQEECKNYLRKTRDYLIKIIDDSDSNLSVVKKLPVPLESVKEMLNSVMQELEDYSEGGPLYKNGSLRNADSEIKHSTPSPTRYSLSPSKSYKYSPKTPPRWAEDQNSLLKMICQQVEAIKKEMQELKLNSSNSASPHRWPTENYGPDSVPDGYQGSQTFHGAPLTVATTGPSVYYSQSPAYNSQYLLRPAANVTPTKGPVYGMNRLPPQQHIYAYPQQMHTPPVQSSSACMFSQEMYGPPALRFESPATGILSPRGDDYFNYNVQQTSTNPPLPEPGYFTKPPIAAHASRSAESKTIEFGKTNFVQPMPGEGLRPSLPTQAHTTQPTPFKFNSNFKSNDGDFTFSSPQVVTQPPPAAYSNSESLLGLLTSDKPLQGDGYSGAKPIPGGQTIGPRNTFNFGSKNVSGISFTENMGSSQQKNSGFRRSDDMFTFHGPGKSVFGTPTLETANKNHETDGGSAHGDDDDDGPHFEPVVPLPDKIEVKTGEEDEEEFFCNRAKLFRFDVESKEWKERGIGNVKILRHKTSGKIRLLMRREQVLKICANHYISPDMKLTPNAGSDRSFVWHALDYADELPKPEQLAIRFKTPEEAALFKCKFEEAQSILKAPGTNVAMASNQAVRIVKEPTSHDNKDICKSDAGNLNFEFQVAKKEGSWWHCNSCSLKNASTAKKCVSCQNLNPSNKELVGPPLAETVFTPKTSPENVQDRFALVTPKKEGHWDCSICLVRNEPTVSRCIACQNTKSANKSGSSFVHQASFKFGQGDLPKPINSDFRSVFSTKEGQWDCSACLVQNEGSSTKCAACQNPRKQSLPATSIPTPASFKFGTSETSKTLKSGFEDMFAKKEGQWDCSSCLVRNEANATRCVACQNPDKPSPSTSVPAPASFKFGTSETSKAPKSGFEGMFTKKEGQWDCSVCLVRNEASATKCIACQNPGKQNQTTSAVSTPASSETSKAPKSGFEGMFTKKEGQWDCSVCLVRNEASATKCIACQNPGKQNQTTSAVSTPASSETSKAPKSGFEGMFTKKEGQWDCSVCLVRNEASATKCIACQCPSKQNQTTAISTPASSEISKAPKSGFEGMFIRKGQWDCSVCCVQNESSSLKCVACDASKPTHKPIAEAPSAFTLGSEMKLHDSSGSQVGTGFKSNFSEKASKFGNTEQGFKFGHVDQENSPSFMFQGSSNTEFKSTKEGFSIPVSADGFKFGISEPGNQEKKSEKPLENGTGFQAQDISGQKNGRGVIFGQTSSTFTFADLAKSTSGEGFQFGKKDPNFKGFSGAGEKLFSSQYGKMANKANTSGDFEKDDDAYKTEDSDDIHFEPVVQMPEKVELVTGEEDEKVLYSQRVKLFRFDAEVSQWKERGLGNLKILKNEVNGKLRMLMRREQVLKVCANHWITTTMNLKPLSGSDRAWMWLASDFSDGDAKLEQLAAKFKTPELAEEFKQKFEECQRLLLDIPLQTPHKLVDTGRAAKLIQRAEEMKSGLKDFKTFLTNDQTKVTEEENKGSGTGAAGASDTTIKPNPENTGPTLEWDNYDLREDALDDSVSSSSVHASPLASSPVRKNLFRFGESTTGFNFSFKSALSPSKSPAKLNQSGTSVGTDEESDVTQEEERDGQYFEPVVPLPDLVEVSSGEENEQVVFSHRAKLYRYDKDVGQWKERGIGDIKILQNYDNKQVRIVMRKGTVDAAANLVVVGGR

SEQ ID NO: 749962 - protein, 586 aa, Homo sapiens
HSGPPPATALRHWFAGAFLLEVATAAGLSAGLTRLGSQVGGAMRRSKADVERYIASVQGSTPSPRQKSMKGFYFAKLYYEAKEYDLAKKYICTYINVQERDPKAHRFLGLLYELEENTDKAVECYRRSVELNPTQKDLVLKIAELLCKNDVTDGRAKYWLERAAKLFPGSPAIYKLKEQLLDCEGEDGWNKLFDLIQSELYVRPDDVHVNIRLVEVYRSTKRLKDAVAHCHEAERNIALRSSLEWNSCVVQTLKEYLESLQCLESDKSDWRATNTDLLLAYANLMLLTLSTRDVQESRELLQSFDSALQSVKSLGGNDELSATFLEMKGHFYMHAGSLLLKMGQHSSNVQWRALSELAALCYLIAFQVPRPKIKLIKGEAGQNLLEMMACDRLSQSGHMLLNLSRGKQDFLKEIVETFANKSGQSALYDALFSSQSPKDTSFLGSDDIGNIDVREPELEDLTRYDVGAIRAHNGSLQHLTWLGLQWNSLPALPGIRKWLKQLFHHLPHETSRLETNAPESICILDLEVFLLGVVYTSHLQLKEKCNSHHSSYQPLCLPLPVCKQLCTERQKSWWDAVCTLIHRKAV

SEQ ID NO: 749963 - protein, 393 aa, Homo sapiens
HSGPPPATALRHWFAGAFLLEVATAAGLSAGLTRLGSQVGGAMRRSKADVERYIASVQGSTPSPRQKSMKGFYFAKLYYEAKEYDLAKKYICTYINVQERDPKAHRFLGLLYELEENTDKAVECYRRSVELNPTQKDLVLKIAELLCKNDVTDGRAKYWLERAAKLFPGSPAIYKLKEQLLDCEGEDGWNKLFDLIQSELYVRPDDVHVNIRLVEVYRSTKRLKDAVAHCHEAERNIALRSSLEWNSCVVQTLKEYLESLQCLESDKSDWRATNTDLLLAYANLMLLTLSTRDVQESRELLQSFDSALQSVKSLGGNDELSATFLEMKGHFYMHAGSLLLKMGQHSSNVQWRALSELAALCYLIAFQVSLPLVGAIDISLSLDVFEMKVCSGM

SEQ ID NO: 749964 - protein, 151 aa, Homo sapiens
IQIHQTPSLPGASARGRQIFPSWCPDPNQFSPFWGLETSLGNIAASRLQLSSYECQSLKTWNLEVHAECLDKTMSQRHRSRPGHTVQSWSTNTTPGLHDLAMPPLLPLLLLPPHYVLHSSQAKPQAIPGSCIALTLPMKFPLMGRLFHLTQ

SEQ ID NO: 749965 - protein, 88 aa, Homo sapiens
NITDHSIVVRSSGRIHMLWQGVKNANWLAKAIHSKAARKWMRPFDGTHSTFTFISTDANLPLLQAVGLFQLIANKAGICINFNENFKY

SEQ ID NO: 749966 - protein, 157 aa, Homo sapiens
RHFRLQPPGRSFGLWCGEVVVSSARVREGPGAPLGTGLEAETGPEDQADVRIRPLDATAEPEQTRRARLGGYSQEVLVASAAAVRPQREARGCRECSVFSRSLQGVTGPVPFYLSEHHAELLTVDSTAFSMWYFFFSVNVHLFFASNMRFCYFSNVP

SEQ ID NO: 749967 - protein, 157 aa, Homo sapiens; identical to SEQ ID NO: 749966

SEQ ID NO: 749968 - protein, 157 aa, Homo sapiens; identical to SEQ ID NO: 749966

SEQ ID NO: 749969 - protein, 104 aa, Homo sapiens
GTRRPAANVSFSQTPVDIWALGCMIIEMATGNPYLPSSSDLDLLHKIVLKVGFMPELKAKLLQEAKVNSLIKPKESSKENELRKDERKTVYTNTLLSSSVLGKK

SEQ ID NO: 749970 - protein, 455 aa, Homo sapiens
MEMYETLGKVGEGSYGTVMKCKHKNTGQIVAIKIFYERPEQSVNKIAMREIKFLKQFHHENLVNLIEVFRQKKKIHLVFEFIDHTVLDELQHYCHGLESKRLRKYLFQILRAIDYLHSNNIIHRDIKPENILVSQSGITKLCDFGFARTLAAPGDIYTDYVATRWYRAPELVLKDTSYGKPVDIWALGCMIIEMATGNPYLPSSSDLDLLHKIVLKVGNLSPHLQNIFSKSPIFAGVVLPQVQHPKNARKKYPKLNGLLADIVHACLQIDPADRISSSDLLHHEYFTRDGFIEKFMPELKAKLLQEAKVNSLIKPKESSKENELRKDERKTVYTNTLLSSSVLGKEIEKEKKPKEIKVRVIKVKGGRGDISEPKKKEYEGGLGQQDANENVHPMSPDTKLVTIEPPNPINPSTNCNGLKENPHCGGSVTMPPINLTNSNLMAANLSSNLFHPSVR

SEQ ID NO: 749971 - protein, 592 aa, Homo sapiens
MEMYETLGKVGEGSYGTVMKCKHKNTGQIVAIKIFYERPEQSVNKIAMREIKFLKQFHHENLVNLIEVFRQKKKIHLVFEFIDHTVLDELQHYCHGLESKRLRKYLFQILRAIDYLHSNNIIHRDIKPENILVSQSGITKLCDFGFARTLAAPGDIYTDYVATRWYRAPELVLKDTSYGKPVDIWALGCMIIEMATGNPYLPSSSDLDLLHKIVLKVGNLSPHLQNIFSKSPIFAGVVLPQVQHPKNARKKYPKLNGLLADIVHACLQIDPADRISSSDLLHHEYFTRDGFIEKFMPELKAKLLQEAKVNSLIKPKESSKENELRKDERKTVYTNTLLSSSVLGKEIEKEKKPKEIKVRVIKVKGGRGDISEPKKKEYEGGLGQQDANENVHPMSPDTKLVTIEPPNPINPSTNCNGLKENPHCGGSVTMPPINLTNSNLMAANLSSNLFHPSVRLTERAKKRRTSSQSIGQVMPNSRQEDPGPIQSQMEKGIFNERTGHSDQMANENKRKLNFSRSDRKEFHFPELPVTIQSKDTKGMEVKQIKMLKRESKKTESSKIPTLLNVDQNQEKQEGGDGHCEGKNLKRNRFFFW

SEQ ID NO: 749972 - protein, 219 aa, Homo sapiens
MEMYETLGKVGEGSYGTVMKCKHKNTGQIVAIKIFYERPEQSVNKIAMREIKFLKQFHHENLVNLIEVFRQKKKIHLVFEFIDHTVLDELQHYCHGLESKRLRKYLFQILRAIDYLHSNNIIHRDIKPENILVSQSGITKLCDFGFARTLAAPGDIYTDYVATRWYRAPELVLKDTSYGKPVDIWALGCMIIEMATGNPYLPSSSDLDLLHKIVLKVGK

SEQ ID NO: 749973 - protein, 455 aa, Homo sapiens; identical to SEQ ID NO: 749970

SEQ ID NO: 749974 - protein, 532 aa, Homo sapiens
MEMYETLGKVGEGSYGTVMKCKHKNTGQIVAIKIFYERPEQSVNKIAMREIKFLKQFHHENLVNLIEVFRQKKKIHLVFEFIDHTVLDELQHYCHGLESKRLRKYLFQILRAIDYLHSNKPVDIWALGCMIIEMATGNPYLPSSSDLDLLHKIVLKVGNLSPHLQNIFSKSPIFAGVVLPQVQHPKNARKKYPKLNGLLADIVHACLQIDPADRISSSDLLHHEYFTRDGFIEKFMPELKAKLLQEAKVNSLIKPKESSKENELRKDERKTVYTNTLLSSSVLGKEIEKEKKPKEIKVRVIKVKGGRGDISEPKKKEYEGGLGQQDANENVHPMSPDTKLVTIEPPNPINPSTNCNGLKENPHCGGSVTMPPINLTNSNLMAANLSSNLFHPSVRLTERAKKRRTSSQSIGQVMPNSRQEDPGPIQSQMEKGIFNERTGHSDQMANENKRKLNFSRSDRKEFHFPELPVTIQSKDTKGMEVKQIKMLKRESKKTESSKIPTLLNVDQNQEKQEGGDGHCEGKNLKRNRFFFW

SEQ ID NO: 749975 - protein, 374 aa, Homo sapiens
MEMYETLGKVGEGSYGTVMKCKHKNTGQIVAIKIFYERPEQSVNKIAMREIKFLKQFHHENLVNLIEVFRQKKKIHLVFEFIDHTVLDELQHYCHGLESKRLRKYLFQILRAIDYLHSNNIIHRDIKPENILVSQSGITKLCDFGFARTLAAPGDIYTDYVATRWYRAPELVLKDTSYGKPVDIWALGCMIIEMATGNPYLPSSSDLDLLHKIVLKVGNLSPHLQNIFSKSPIFAGVVLPQVQHPKNARKKYPKLNGLLADIVHEIEKEKKPKEIKVRVIKVKGGRGDISEPKKKEYEGGLGQQDANENVHPMSPDTKLVTIEPPNPINPSTNCNGLKENPHCGGSVTMPPINLTNSNLMAANLSSNLFHPSVR

SEQ ID NO: 749976 - protein, 181 aa, Homo sapiens
MIIEMATGNPYLPSSSDLDLLHKIVLKVGNLSPHLQNIFSKSPIFAGVVLPQVQHPKNARKKYPKLNGLLADIVHSQMEKGIFNERTGHSDQMANENKRKLNFSRSDRKEFHFPELPVTIQSKDTKGMEVKQIKMLKRESKKTESSKIPTLLNVDQNQEKQEGGDGHCEGKNLKRNRFFFW

SEQ ID NO: 749977 - protein, 333 aa, Homo sapiens
MEMYETLGKVGEGSYGTVMKCKHKNTGQIVAIKIFYERPEQSVNKIAMREIKFLKQFHHENLVNLIEVFRQKKKIHLVFEFIDHTVLDELQHYCHGLESKRLRKYLFQILRAIDYLHSNNIIHRDIKPENILVSQSGITKLCDFGFARTLAAPGDIYTDYVATRWYRAPELVLKDTSYGKPVDIWALGCMIIEMATGNPYLPSSSDLDLLHKIVLKVGNLSPHLQNIFSKSPIFAGVVLPQVQHPKNARKKYPKLNGLLADIVHACLQIDPADRISSSDLLHHEYFTRDGFIEKLTERAKKRRTSSQSIGQVMPNSRQEDPGPIQEPNGEGYI

SEQ ID NO: 749978 - protein, 511 aa, Homo sapiens
MVDSTEYEVASQPEVETSPLGDGASPGPEQVKLKKEISLLNGVCLIVGNMIGSGIFVSPKGVLIYSASFGLSLVIWAVGGLFSVFGALCYAELGTTIKKSGASYAYILEAFGGFLAFIRLWTSLLIIEPTSQAIIAITFANYMVQPLFPSCFAPYAASRLLAAACICLLTFINCAYVKWGTLVQDIFTYAKVLALIAVIVAGIVRLGQGASTHFENSFEGSSFAVGDIALALYSALFSYSGWDTLNYVTEEIKNPERNLPLSIGISMPIVTIIYILTNVAYYTVLDMRDILASDAVAVTFADQIFGIFNWIIPLSVALSCFGGLNASIVAASRLFFVGSREGHLPDAICMIHVERFTPVPSLLFNGIMALIYLCVEDIFQLINYYSFSYWFFVGLSIVGQLYLRWKEPDRPRPLKLSVFFPIVFCLCTIFLVAVPLYSDTINSLIGIAIALSGLPFYFLIIRVPEHKRPLYLRRIVGSATRYLQVLCMSVAAEMDLEDGGEMPKQRDPKSN

SEQ ID NO: 749979 - protein, 511 aa, Homo sapiens; identical to SEQ ID NO: 749978

SEQ ID NO: 749980 - protein, 511 aa, Homo sapiens; identical to SEQ ID NO: 749978

SEQ ID NO: 749981 - protein, 511 aa, Homo sapiens; identical to SEQ ID NO: 749978

SEQ ID NO: 749982 - protein, 511 aa, Homo sapiens; identical to SEQ ID NO: 749978

SEQ ID NO: 749983 - protein, 511 aa, Homo sapiens; identical to SEQ ID NO: 749978

SEQ ID NO: 749984 - protein, 461 aa, Homo sapiens
MVDSTEYEVASQPEVETSPLGDGASPGPEQVKLKKEISLLNGVCLIVGNMIGSGIFVSPKGVLIYSASFGLSLVIWAVGGLFSVFGALCYAELGTTIKKSGASYAYILEAFGGFLAFIRLWTSLLIIEPTSQAIIAITFANYMVQPLFPSCFAPYAASRLLAAACICLLTFINCAYVKWGTLVQDIFTYAKVLALIAVIVAGIVRLGQGASTHFENSFEGSSFAVGDIALALYSALFSYSGWDTLNYVTEEIKNPERNLPLSIGISMPIVTIIYILTNVAYYTVLDMRDILASDAVAVTFADQIFGIFNWIIPLSVALSCFGGLNASIVAASRLFFVGSREGHLPDAICMIHVERFTPVPSLLFNLSVFFPIVFCLCTIFLVAVPLYSDTINSLIGIAIALSGLPFYFLIIRVPEHKRPLYLRRIVGSATRYLQVLCMSVAAEMDLEDGGEMPKQRDPKSN

SEQ ID NO: 749985 - protein, 511 aa, Homo sapiens; identical to SEQ ID NO: 749978

SEQ ID NO: 749986 - protein, 511 aa, Homo sapiens
MVDSTEYEVASQPEVETSPLGDGASPGPEQVKLKKEISLLNGVCLIVGNMIGSGIFVSPKGVLIYSASFGLSLVIWAVGGLFSVFGALCYAELGTTIKKSGASYAYILEAFGGFLAFIRLWTSLLIIEPTSQAIIAITFANYMVQPLFPSCFAPYAASRLLAAACICLLTFINCAYVKWGTLVQDIFTYAKVLALIAVIVAGIVRLGQGASTHFENSFEGSSFAVGDIALALYSALFSYSGWDTLNYVTEEIKNPERNLPLSIGISMPIVTIIYILTNVAYYTVLDMRDILASDAVAVTFADQIFGIFNWIIPLSVALSCFGGLNASIVAASRLFFVGSREGHLPDAICMIHVERFTPVPSLLFNGIMALIYLCVEDIFQLINYYSFSYWFFVGLSIVGQLYLRWKEPDRPRPLKLSVFFPIVFCLCTIFLVAVPLYSDTINSLIGIAIALSGLPFYFLIIRVPEHKRPLYLRRIVGKPCILKSAQLLQSLVFAFFCKSSLQRHLCLSPFL

SEQ ID NO: 749987 - protein, 242 aa, Homo sapiens
MVDSTEYEVASQPEVETSPLGDGASPGPEQVKLKKEISLLNGVCLIVGNMIGSGIFVSPKGVLIYSASFGLSLVIWAVGGLFSVFGALCYAELGTTIKKSGASYAYILEAFGGFLAFIRLWTSLLIIEPTSQAIIAITFANYMVQPLFPSCFAPYAASRLLAAACICLLTFINCAYVKWGTLVQDIFTYAKVLALIAVIVAGIVRLGQGASTHSGYSSMCSSFAVGVTVMTRWSAPVRGSRR

SEQ ID NO: 749988 - protein, 104 aa, Homo sapiens
SSGRKGEQVFEKWPKARLKFRLFITPVASINLWWLEQVREVNCPLKRTKCTMRFRDTHEDKPQRAKLCQHVATFEPYIINRVAIEQIYLRQLSFIACFSGRHNY

SEQ ID NO: 749989 - protein, 93 aa, Homo sapiens
IPRATRMAVLVLRLTVVLGLLVLFLTCYADDKPDKPDDKPDDSGKDPKPDFPKFLSLLGTEIIENAVEFILRSMSRSTGFMEFDDNEGKHSSK

SEQ ID NO: 749990 - protein, 78 aa, Homo sapiens
IPRATRMAVLVLRLTVVLGLLVLFLTCYADDKPDKPDDKPDDSGKDPKPDFPKFLSLLGTEIIENAVEFILRSMSRST

SEQ ID NO: 749991 - protein, 377 aa, Homo sapiens
FHIHQRVHTGEKPYKCDVCGKGFSHNSPLICHRRVHTGEKPYKCEACGKGFTRNTDLHIHFRVHTGEKPYKCKECGKGFSQASNLQVHQNVHTGEKRFKCETCGKGFSQSSKLQTHQRVHTGEKPYRCDVCGKDFSYSSNLKLHQVIHTGEKPYKCEECGKGFSWRSNLHAHQRVHSGEKPYKCEQCDKSFSQAIDFRVHQRVHTGEKPYKCGVCGKGFSQSSGLQSHQRVHTGEKPYKCDVCGKGFRYSSQFIYHQRGHTGEKPYKCEECGKGFGRSLNLRHHQRVHTGEKPHICEECGKAFSLPSNLRVHLGVHTREKLFKCEECGKGFSQSARLEAHQRVHTGEKPYKCDICDKDFRHRSRLTYHQKVHTGKKL

SEQ ID NO: 749992 - protein, 334 aa, Homo sapiens
CPECGKGFSQASNLQVHQNVHTGEKPYQCPECGKGFSQASNLQVHQNVHTGEKRFKCETCGKGFSQSSKLQTHQRVHTGEKPYRCDVCGKDFSYSSNLKLHQVIHTGEKPYKCEECGKGFSWRSNLHAHQRVHSGEKPYKCEQCDKSFSQAIDFRVHQRVHTGEKPYKCGVCGKGFSQSSGLQSHQRVHTGEKPYKCDVCGKGFRYSSQFIYHQRGHTGEKPYKCEECGKGFGRSLNLRHHQRVHTGEKPHICEECGKAFSLPSNLRVHLGVHTREKLFKCEECGKGFSQSARLEAHQRVHTGEKPYKCDICDKDFRHRSRLTYHQKVHTGKKL

SEQ ID NO: 749993 - protein, 249 aa, Homo sapiens
CPECGKTFNQQLTLNICRLHTGEKPYKCEECGKGFSWRSNLHAHQRVHSGEKPYKCEQCDKSFSQAIDFRVHQRVHTGEKPYKCGVCGKGFSQSSGLQSHQRVHTGEKPYKCDVCGKGFRYSSQFIYHQRGHTGEKPYKCEECGKGFGRSLNLRHHQRVHTGEKPHICEECGKAFSLPSNLRVHLGVHTREKLFKCEECGKGFSQSARLEAHQRVHTGEKPYKCDICDKDFRHRSRLTYHQKVHTGKKL

SEQ ID NO: 749994 - protein, 114 aa, Homo sapiens
MEVDLSPSPIRKSEIAAGPARISMISPPQDGRMGSVSSRGPEHPGLTTSQRSVGKPLRIPPLQIPYKGPPLTPTPQLPGRAGRGDSPSFGGSQARLPPRPPISISSLLQRQCLV

SEQ ID NO: 749995 - protein, 101 aa, Homo sapiens
PNPRNSRMLKNKTKKLERQRLLPGPRASRPDNESEERGKASQDSTSANSLQGTPTNANTTVTRESRKRGLSKLRGLPGQAAPPAAHQHLQPAAEAVFSVKF

SEQ ID NO: 749996 - protein, 271 aa, Homo sapiens
RRAARLRALRGEAGPNLAWASRGPGLAAAVARLAWPTGCSVIAASSRPTGRRASASPTAGTCTATPASAKTDADIQAFFMSIDSLCKKYSRETSQILEFQEKHRKRLLAFYREKISRLEESLRKSVLQIEQLQSMRSSQQTAFSTIKSSVSTKPHGCLLPPHSSAPDRLESMEVDLSPSPIRKSEIAAGPARISMISPPQDGRMGSVSSRGPEHPGLTTSQRSVGKPLRIPPLQIPYKGPPLTPTPQLPGRAGRGDSPSFGGSQARLPPAP

SEQ ID NO: 749997 - protein, 258 aa, Homo sapiens
QSCPPSGPARGGWSQPCVGFAWARPRRCGRPPGMANWVFCNRCFQPPHRTSCFSLTNCGHVYCDACLGKGKKNECLICKAPCRTVLLSKHTDADIQAFFMSIDSLCKKYSRETSQILEFQEKHRKRLLAFYREKISRLEESLRKSVLQIEQLQSMRSSQQTAFSTIKSSVSTKPHGCLLPPHSSAPDRLESMEVDLSPSPIRKSEIAAGPARISMISPPQDGRMGLTLSKPPVPGECVISRGSPCFCIDVCPHWLLLL

SEQ ID NO: 749998 - protein, 249 aa, Homo sapiens
QSCPPSGPARGGWSQPCVGFAWARPRRCGRPPGMANWVFCNRCFQPPHRTSCFSLTNCGHVYCDACLGKGKKNECLICKAPCRTVLLSKHTDADIQAFFMSIDSLCKKYSRETSQYLRLSRGCCRLKLCPATSSKEVPRGSTHGSQAAARDPQEHWVSTTRAPRPGCRRSQSQPEAHGNTIQDAPHPLTLLHPSRTLIHTKSPWGRKLLEFIKHVCYHRHQSHRPCAPGWFCQVLQRPGAVSGEKTQQT

SEQ ID NO: 749999 - protein, 34 aa, Homo sapiens
MKDDCRCRGKSSFIYQKLSSEQKCCGKTEGKKGD

SEQ ID NO: 750000 - protein, 232 aa, Homo sapiens
RRAARLRALRGEAGPNLAWASRGPGLAAAVARLAWPTGCSVIAASSRPTGRRASASPTAGTCTATPASAKTDADIQAFFMSIDSLCKKYSRETSQILEFQEKHRKRLLAFYREKISRLEESLRKSVLQIEQLQSMRSSQQTAFSTIKSSVSTKPHGCLLPPHSSAPDRLESMEVDLSPSPIRKSEIAAGPARISMISPPQDGRMGSVSSRGPEHPGLTTSQRSVGKPLSVKF

SEQ ID NO: 750001 - protein, 118 aa, Homo sapiens
QIYRMQSLSPVCSGLENEQFKSPGNRVSRLSHLRHHYSKKWHRFRFNPKFYSFLSAQEPSHKIGTSLSSLTGSGKRNRIRSSLPWRQNSWKGYSENMRKLRKTHDIPCPDLPWSYKIE

SEQ ID NO: 750002 - protein, 126 aa, Homo sapiens
TSGGFGEDSACPSETEQDIRLSTSLLSSADWPTVAEESEHAPGPAFPGGNEQLPPKPAPEAGVAIAACVEMEQLYDPLDSDMPAMDTAGLFKESHEDMKKSDEEEEKQKMEDSLWAGVEACQKVDT

SEQ ID NO: 750003 - protein, 210 aa, Homo sapiens
AGTARDFGPEPASWGAASGRGGRDRPSRPGSPAVRVCAGPGAWSAAAGPVDGPGGGGGMRLLFLAVLRPHTGNAVTAQRVRAHLEAAGHVCVLKDAFDFESRSEIANLILAENCEAALALHLYRGGRLLQGHRIPFGVIFGGTDVNEDANQAEKNTVMGRVLEEASRMLRVRSMSRVKELQQHQTPLLTGIPFFNALRLTKVLIICTYFF

SEQ ID NO: 750004 - protein, 272 aa, Homo sapiens
AGTARDFGPEPASWGAASGRGGRDRPSRPGSPAVRVCAGPGAWSAAAGPVDGPGGGGGMRLLFLAVLRPHTGNAVTAQRVRAHLEAAGHVCVLKDAFDFESRSEIANLILAENCEAALALHLYRGGRLLQGHRIPFGVIFGGTDVNEDANQAEKNTVMGRVLEEARFAVAFTESMKEMAQAQWPHAKGKVYVQSQGIATTPNAAFNWNTFLQRSEINQSADNLHIFLLICGLRQVKDPLYLVDAFSAWHQEEPNVHLVIVGPEVDPVFTREV

SEQ ID NO: 750005 - protein, 386 aa, Homo sapiens
MCERAARLCRAGAHRLLREPPQQGRALGGLLRWVGARMGEPRESLAPAAPADPGPASPRGGTAVILDIFRRADKNDDGKLSLEEFQLFFADGVLNEKELEDLFHTIDSDNTNHVDTKELCDYFVDHMGDYEDVLASLETLNHSVLKAMGYTKKVYEGGSNVDQFVTRFLLKETANQIQSLLSSVESAVEAIEEQTSQLRQNHIKPSHSAAQTWCGSPTPASAPNHKLMAMEQGKTLPSATEDAKEEGLEAQISRLAELIGRLESKALWFDLQQRLSDEDGTNMHLQLVRQEMAVCPEQLSEFLDSLRQYLRGTTGVRNCFHITAVRLSDGFTFVIYEFWETEEAWKRHLQSPLCKAFRHVKVDTLSQPEALSRILVPAAWCTVGRD

SEQ ID NO: 750006 - protein, 404 aa, Homo sapiens
MAVGLRVCVSVAGSRLVVLAAASTWVRGGPLSATSLISSPWIPARGGGEGRGAQLPRTLSCSWEKRRIPVSGQRLQEALASPWPRADSASLFCRFSAVRTKMMMGSCPWRNSSSSLQMASLMRKNWRISFTRLTLTTPNYFVDHMGDYEDVLASLETLNHSVLKAMGYTKKVYEGGSNVDQFVTRFLLKETANQIQSLLSSVESAVEAIEEQTSQLRQNHIKPSHSAAQTWCGSPTPASAPNHKLMAMEQGKTLPSATEDAKEEGLEAQISRLAELIGRLESKALWFDLQQRLSDEDGTNMHLQLVRQEMAVCPEQLSEFLDSLRQYLRGTTGVRNCFHITAVRLSDGFTFVIYEFWETEEAWKRHLQSPLCKAFRHVKVDTLSQPEALSRILVPAAWCTVGRD

SEQ ID NO: 750007 - protein, 144 aa, Homo sapiens
LIAELESYWYWSRKSCRKETGSSGGGTAVCELSVFSFSECREVLLPLLTDQLSGQLDDNSNKPDHEASSQLLSNILEVLDRKDVGATAVHIQLIMERLLRRINRTVIGMNRQSPHIVSISLLDPTAAAVSLSPLPIGRPSGPVA

SEQ ID NO: 750008 - protein, 134 aa, Homo sapiens [sequence omitted]

SEQ ID NO: 750009 - protein, 80 aa, Homo sapiens
RGPLMQENPMGRGYICPLQYLASLGIQSLVQQRAFAGKTANKLMDALKDSDLLHWKHSLSELIDISIAQKTAIWRLYGRR

SEQ ID NO: 750010 - protein, 562 aa, Homo sapiens
MRVKEKWQKEELDVSVREEEVSCSGPLSQKQAEFFLSQQASLLKNDETKALTPASLQKELNNLLKFNPDFAEAHYLSYLNNLRVQDVFSSTHSLLHYFDRLILTGAESKSNGEEGYGRSLRYAALNLAALHCRFGHYQQAELALQEAIRIAQESNDHVCLQHCLSWLYVLGQKRSDSYVLLEHSVKKAVHFGLPRAFAGKTANKLMDALKDSDLLHWKHSLSELIDISIAQKTAIWRLYGRSTMALQQAQMLLSMNSLEAVNAGVQQNNTESFAVALCHLAELHAEQGCFAAASEVLKHLKERFPPNSQHAQLWMLCDQKIQFDRAMNDGKYHLADSLVTGITALNSIEGVYRKAVVLQAQNQMSEAHKLLQKLLVHCQKLKNTEMVISVLLSVAELYWRSSSPTIALPMLLQALALSKEYRLQYLASETVLNLAFAQLILGIPEQALSLLHMAIEPILADGAILDKGRAMFLVAKCQVASAASYDQPKKAEALEAAIENLNEAKNYFAKVDCKERIRDVVYFQARLYHTLGKTQERNRCAMLFRQLHQELPSHGVPLINHL

SEQ ID NO: 750011 - protein, 575 aa, Homo sapiens
MRVKEKWQKEELDVSVREEEVSCSGPLSQKQAEFFLSQQASLLKNDETKALTPASLQKELNNLLKFNPDFAEAHYLSYLNNLRVQDVFSSTHSLLHYFDRLILTGAESKSNGEEGYGRSLRYAALNLAALHCRFGHYQQAELALQEAIRIAQESNDHVCLQHCLSWLYVLGQKRSDSYVLLEHSVKKAVHFGLPYLASLGIQSLVQQRAFAGKTANKLMDALKDSDLLHWKHSLSELIDISIAQKTAIWRLYGRSTMALQQAQMLLSMNSLEAVNAGVQQNNTESFAVALCHLAELHAEQGCFAAASEVLKHLKERFPPNSQHAQLWMLCDQKIQFDRAMNDGKYHLADSLVTGITALNSIEGVYRKAVVLQAQNQMSEAHKLLQKLLVHCQKLKNTEMVISVLLSVAELYWRSSSPTIALPMLLQALALSKEYRLQYLASETVLNLAFAQLILGIPEQALSLLHMAIEPILADGAILDKGRAMFLVAKCQVASAASYDQPKKAEALEAAIENLNEAKNYFAKVDCKERIRDVVYFQARLYHTLGKTQERNRCAMLFRQLHQELPSHGVPLINHL

SEQ ID NO: 750012 - protein, 575 aa, Homo sapiens; identical to SEQ ID NO: 750011

SEQ ID NO: 750013 - protein, 562 aa, Homo sapiens; identical to SEQ ID NO: 750010

SEQ ID NO: 750014 - protein, 621 aa, Homo sapiens
MRVKEKWQKEELDVSVREEEVSCSGPLSQKQAEFFLSQQASLLKNDETKALTPASLQKELNNLLKFNPDFAEAHYLSYLNNLRVQDVFSSTHSLLHYFDRLILTGAESKSNGEEGYGRSLRYAALNLAALHCRFGHYQQAELALQEAIRIAQESNDHVCLQHCLSWLYVLGQKRSDSYVLLEHSVKKAVHFGLPYLASLGIQSLVQQRAFAGKTANKLMDALKDSDLLHWKHSLSELIDISIAQKTAIWRLYGRSTMALQQAQMLLSMNSLEAVNAGVQQNNTESFAVALCHLAELHAEQNKRLRSWELNPVSNTCKCQRQVSNRNLVDSKEEQWEWDIILMTYSSGCFAAASEVLKHLKERFPPNSQHAQLWMLCDQKIQFDRAMNDGKYHLADSLVTGITALNSIEGVYRKAVVLQAQNQMSEAHKLLQKLLVHCQKLKNTEMVISVLLSVAELYWRSSSPTIALPMLLQALALSKEYRLQYLASETVLNLAFAQLILGIPEQALSLLHMAIEPILADGAILDKGRAMFLVAKCQVASAASYDQPKKAEALEAAIENLNEAKNYFAKVDCKERIRDVVYFQARLYHTLGKTQERNRCAMLFRQLHQELPSHGVPLINHL

SEQ ID NO: 750015 - protein, 549 aa, Homo sapiens
MRVKEKWQKEELDVSVREEEVSCSGPLSQKQAEFFLSQQASLLKNDETKALTPASLQKELNNLLKFNPDFAEAHYLSYLNNLRVQDVFSSTHSLLHYFDRLILTGAESKSNGEEGYGRSLRYAALNLAALHCRFGHYQQAELALQEAIRIAQESNDHVCLQHCLSWLYVLGQKRSDSYVLLEHSVKKAVHFGLPRAFAGKTANKLMDALKDSDLLHWKHSLSELIDISITMALQQAQMLLSMNSLEAVNAGVQQNNTESFAVALCHLAELHAEQGCFAAASEVLKHLKERFPPNSQHAQLWMLCDQKIQFDRAMNDGKYHLADSLVTGITALNSIEGVYRKAVVLQAQNQMSEAHKLLQKLLVHCQKLKNTEMVISVLLSVAELYWRSSSPTIALPMLLQALALSKEYRLQYLASETVLNLAFAQLILGIPEQALSLLHMAIEPILADGAILDKGRAMFLVAKCQVASAASYDQPKKAEALEAAIENLNEAKNYFAKVDCKERIRDVVYFQARLYHTLGKTQERNRCAMLFRQLHQELPSHGVPLINHL

SEQ ID NO: 750016 - protein, 600 aa, Homo sapiens
MRVKEKWQKEELDVSVREEEVSCSGPLSQKQAEFFLSQQASLLKNDETKALTPASLQKELNNLLKFNPDFAEAHYLSYLNNLRVQDVFSSTHSLLHYFDRLILTGAESKSNGEEGYGRSLRYAALNLAALHCRFGHYQQAELALQEAIRIAQESNDHVCLQHCLSWLYVLGQKRSDSYVLLEHSVKKAVHFGLPYLASLGIQSLVQQRAFAGKTANKLMDALKDSDLLHWKHSLSELIDISIAQKTAIWRLYGRSTMALQQAQMLLSMNSLEAVNAGVQQNNTESFAVALCHLAELHAEQGCFAAASEVLKHLKERFPPNSQHAQLWMLCDQKIQFDRAMNDGKYHLADSLVTGITALNSIEGVYRKAVVLQAQNQMSEAHKLLQKLLVHCQKLKNTEMVIRKGSLVHLTEMWWWIFSSCVFLFTVIVLLSVAELYWRSSSPTIALPMLLQALALSKEYRLQYLASETVLNLAFAQLILGIPEQALSLLHMAIEPILADGAILDKGRAMFLVAKCQVASAASYDQPKKAEALEAAIENLNEAKNYFAKVDCKERIRDVVYFQARLYHTLGKTQERNRCAMLFRQLHQELPSHGVPLINHL

SEQ ID NO: 750017 - protein, 584 aa, Homo sapiens
MRVKEKWQKEELDVSVREEEVSCSGPLSQKQAEFFLSQQASLLKNDETKALTPASLQKELNNLLKFNPDFAEAHYLSYLNNLRVQDVFSSTHSLLHYFDRLILTGAESKSNGEEGYGRSLRYAALNLAALHCRFGHYQQAELALQEAIRIAQESNDHVCLQHCLSWLYVLGQKRSDSYVLLEHSVKKAVHFGLPYLASLGIQSLVQQRAFAGKTANKLMDALKDSDLLHWKHSLSELIDISIAQKTAIWRLYGRSTMALQQAQMLLSMNSLEAVNAGVQQNNTESFAVALCHLAELHAEQGCFAAASEVLKHLKERFPPNSQHAQLWMLCDQKIQFDRAMNDGKYHLADSLVTGITALNSIEGVYRKAVVLQAQNQMSEAHKLLQVRGLLYISRRCGGGSSHPVFSSLRSVVLLSVAELYWRSSSPTIALPMLLQALALSKEYRLQYLASETVLNLAFAQLILGIPEQALSLLHMAIEPILADGAILDKGRAMFLVAKCQVASAASYDQPKKAEALEAAIENLNEAKNYFAKVDCKERIRDVVYFQARLYHTLGKTQERNRCAMLFRQLHQELPSHGVPLINHL

SEQ ID NO: 750018 - protein, 759 aa, Homo sapiens
MASVHESLYFNPMMTNGVVHANVFGIKDWVTPYKIAVLVLLNEMSRTGEGAVSLMERRRLNQLLLPLLQGPDITLSKLYKLIEESCPQLANSVQIRIKLMAEGELKDMEQFFDDLSDSFSGTEPEVHKTSVVGLFLRHMILAYSKLSFSQVFKLYTALQQYFQNGEKKTVEDADMELTSRDEGDPTPCAPQQATSACYLQPEEEVSCSGPLSQKQAEFFLSQQASLLKNDETKALTPASLQKELNNLLKFNPDFAEAHYLSYLNNLRVQDVFSSTHSLLHYFDRLILTGAESKSNGEEGYGRSLRYAALNLAALHCRFGHYQQAELALQEAIRIAQESNDHVCLQHCLSWLYVLGQKRSDSYVLLEHSVKKAVHFGLPYLASLGIQSLVQQRAFAGKTANKLMDALKDSDLLHWKHSLSELIDISIAQKTAIWRLYGRSTMALQQAQMLLSMNSLEAVNAGVQQNNTESFAVALCHLAELHAEQGCFAAASEVLKHLKERFPPNSQHAQLWMLCDQKIQFDRAMNDGKYHLADSLVTGITALNSIEGVYRKAVVLQAQNQMSEAHKLLQKLLVHCQKLKNTEMVISVLLSVAELYWRSSSPTIALPMLLQALALSKEYRLQYLASETVLNLAFAQLILGIPEQALSLLHMAIEPILADGAILDKGRAMFLVAKCQVASAASYDQPKKAEALEAAIENLNEAKNYFAKVDCKERIRDVVYFQARLYHTLGKTQERNRCAMLFRQLHQELPSHGVPLINHL

SEQ ID NO: 750019 - protein, 556 aa, Homo sapiens
MRVKEKWQKEELDVSVREEEVSCSGPLSQKQAEFFLSQQASLLKNDETKALTPASLQKELNNLLKFNPDFAEAHYLSYLNNLRVQDVFSSTHSLLHYFDRLILTGAESKSNGEEGYGRSLRYAALNLAALHCRFGHYQQAELALQEAIRIAQESNDHVCLQHCLSWLYVLGQKRSDSYVLLEHSVKKAVHFGLPYLASLGIQSLVQQRAFAGKTANKLMDALKDSDLLHWKHSLSELIDISIAQKTAIWRLYGRSTMALQQAQMLLSMNSLEAVNAGVQQNNTESFAVALCHLAELHAEQGCFAAASEVLKHLKERFPPNSQHAQLWMLCDQKIQFDRAMNDGKYHLADSLVTGITALNSIEGVYRKAVVLQAQNQMSEAHKLLQKLLVHCQKLKNTEMVISVLLSVAELYWRSSSPTIALPMLLQALALSKEYRLQYLASETVLNLAFAQLILGIPEQALSLLHMAIEPILADGAILDKGRAMFLVAKCQVASAASYDQPKKAEALEAAIENLNEAKNYFAKVDCKERIRDVVYFQARLYHTLGKTQERNRTLVT

SEQ ID NO: 750020 - protein, 575 aa, Homo sapiens; identical to SEQ ID NO: 750011

SEQ ID NO: 750021 - protein, 575 aa, Homo sapiens; identical to SEQ ID NO: 750011

SEQ ID NO: 750022 - protein, 575 aa, Homo sapiens; identical to SEQ ID NO: 750011

SEQ ID NO: 750023 - protein, 420 aa, Homo sapiens
MRVKEKWQKEELDVSVREEEVSCSGPLSQKQAEFFLSQQASLLKNDETKALTPASLQKELNNLLKFNPDFAEAHYLSYLNNLRVQDVFSSTHSLLHYFDRLILTGAESKSNGEEGYGRSLRYAALNLAALHCRFGHYQQAELALQEAIRIAQESNDHVCLQHCLSWLYVLGQKRSDSYVLLEHSVKKAVHFGLPYLASLGIQSLVQQRAFAGKTANKLMDALKDSDLLHWKHSLSELIDISIAQKTAIWRLYGRSTMALQQAQMLLSMNSLEAVNAGVQQNNTESFAVALCHLAELHAEQGCFAAASEVLKHLKERFPPNSQHAQLWMLCDQKIQFDRAMNDGKYHLADSLVTGITALNSIEGVYRKAVVLQAQNQMSEAHKLLQKLLVHCQKLKNTEMVIRLWPSPRSTGYSTWPLKQC

SEQ ID NO: 750024 - protein, 301 aa, Homo sapiens
MRVKEKWQKEELDVSVREEEVSCSGPLSQKQAEFFLSQQASLLKNDETKALTPASLQKELNNLLKFNPDFAEAHYLSYLNNLRVQDVFSSTHSLLHYFDRLILTGAESKSNGEEGYGRSLRYAALNLAALHCRFGHYQQAELALQEAIRIAQESNDHVCLQHCLSWLYVLGQKRSDSYVLLEHSVKKAVHFGLPYLASLGIQSLVQQRAFAGKTANKLMDALKDSDLLHWKHSLSELIDISIAQKTAIWRLYGRSTMALQQAQMLLSMNSLEAVNAGVQQNNTESFAVALCHLAELHAEQN

SEQ ID NO: 750025 - protein, 255 aa, Homo sapiens
MRVKEKWQKEELDVSVREEEVSCSGPLSQKQAEFFLSQQASLLKNDETKALTPASLQKELNNLLKFNPDFAEAHYLSYLNNLRVQDVFSSTHSLLHYFDRLILTGAESKSNGEEGYGRSLRYAALNLAALHCRFGHYQQAELALQEAIRIAQESNDHVCLQHCLSWLYVLGQKRSDSYVLLEHSVKKAVHFGLPYLASLGIQSLVQQRAFAGKTANKLMDALKDSDLLHWKHSLSELIDISIAQKTAIWRLYGRR

SEQ ID NO: 750026 - protein, 346 aa, Homo sapiens
MRVKEKWQKEELDVSVREEEVSCSGPLSQKQAEFFLSQQASLLKNDETKALTPASLQKELNNLLKFNPDFAEAHYLSYLNNLRVQDVFSSTHSLLHYFDRLILTGAESKSNGEEGYGRSLRYAALNLAALHCRFGHYQQAELALQEAIRIAQESNDHVCLQHCLSWLYVLGQKRSDSYVLLEHSVKKAVHFGLPRAFAGKTANKLMDALKDSDLLHWKHSLSELIDISIAQKTAIWRLYGRSTMALQQAQMLLSMNSLEAVNAGVQQNNTESFAVALCHLAELHAEQGCFAAASEVLKHLKERFPPNSQHAHFGPLWSQKTFCPTFFDRQIYLVVSTVFRNNHFFI

SEQ ID NO: 750027 - protein, 327 aa, Homo sapiens
MRVKEKWQKEELDVSVREEEVSCSGPLSQKQAEFFLSQQASLLKNDETKALTPASLQKELNNLLKFNPDFAEAHYLSYLNNLRVQDVFSSTHSLLHYFDRLILTGAESKSNGEEGYGRSLRYAALNLAALHCRFGHYQQAELALQEAIRIAQESNDHVCLQHCLSWLYVLGQKRSDSYVLLEHSVKKAVHFGLPRAFAGKTANKLMDALKDSDLLHWKHSLSELIDISIAQKTAIWRLYGRSTMALQQAQMLLSMNSLEAVNAGVQQNNTESFAVALCHLAELHAEQGCFAAASEVLKHLKERFPPNSQHAPLLGAIGAQNTSCQNQ

SEQ ID NO: 750028 - protein, 192 aa, Homo sapiens
MASVHESLYFNPMMTNGVVHANVFGIKDWVTPYKIAVLVLLNEMSRTGEGAVSLMERRRLNQLLLPLLQGPDITLSKLYKLIEESCPQLANSVQIRIKLMAEGELKDMEQFFDDLSDSFSGTEPEVHKTSVVGLFLRHMILAYSKLSFSQVFKLYTALQQYFQNGEKKTVEDADMELTSRDEGERKMAKRRT

SEQ ID NO: 750029 - protein, 192 aa, Homo sapiens; identical to SEQ ID NO: 750028

SEQ ID NO: 750030 - protein, 192 aa, Homo sapiens; identical to SEQ ID NO: 750028

SEQ ID NO: 750031 - protein, 192 aa, Homo sapiens; identical to SEQ ID NO: 750028

SEQ ID NO: 750032 - protein, 132 aa, Homo sapiens [sequence omitted]

SEQ ID NO: 750033 - protein, 137 aa, Homo sapiens
MASVHESLYFNPMMTNGVVHANVFGIKDWVTPYKIAVLVLLNEMSRTGEGAVSLMERRRLNQLLLPLLQGPDITLSKLYKLIEESCPQLANSVQIRIKLMAEGELKDMEQFFDDLSDSFSGTEPEVHKTSVVGMKLF

SEQ ID NO: 750034 - protein, 575 aa, Homo sapiens; identical to SEQ ID NO: 750011

SEQ ID NO: 750035 - protein, 575 aa, Homo sapiens; identical to SEQ ID NO: 750011

SEQ ID NO: 750036 - protein, 312 aa, Homo sapiens
MLLSMNSLEAVNAGVQQNNTESFAVALCHLAELHAEQGCFAAASEVLKHLKERFPPNSQHAQLWMLCDQKIQFDRAMNDGKYHLADSLVTGITALNSIEGVYRKAVVLQAQNQMSEAHKLLQKLLVHCQKLKNTEMVISVLLSVAELYWRSSSPTIALPMLLQALALSKEYRLQYLASETVLNLAFAQLILGIPEQALSLLHMAIEPILADGAILDKGRAMFLVAKCQVASAASYDQPKKAEALEAAIENLNEAKNYFAKVDCKERIRDVVYFQARLYHTLGKTQERNRCAMLFRQLHQELPSHGVPLINHL

SEQ ID NO: 750037 - protein, 357 aa, Homo sapiens
MDALKDSDLLHWKHSLSELIDISIAQKTAIWRLYGRSTMALQQAQMLLSMNSLEAVNAGVQQNNTESFAVALCHLAELHAEQGCFAAASEVLKHLKERFPPNSQHAQLWMLCDQKIQFDRAMNDGKYHLADSLVTGITALNSIEGVYRKAVVLQAQNQMSEAHKLLQKLLVHCQKLKNTEMVISVLLSVAELYWRSSSPTIALPMLLQALALSKEYRLQYLASETVLNLAFAQLILGIPEQALSLLHMAIEPILADGAILDKGRAMFLVAKCQVASAASYDQPKKAEALEAAIENLNEAKNYFAKVDCKERIRDVVYFQARLYHTLGKTQERNRCAMLFRQLHQELPSHGVPLINHL

SEQ ID NO: 750038 - protein, 424 aa, Homo sapiens
MRVKEKWQKEELDVSVREEEVSCSGPLSQKQAEFFLSQQASLLKNDETKALTPASLQKELNNLLKFNPDFAEAHYLSYLNNLRVQDVFSSTHSLLHYFDRLILTGAESKSNGEEGYGRSLRYAALNLAALHCRFGHYQQAELALQEAIRIAQESNDHVCLQHCLSWLYVLGQKRSDSYVLLEHSVKKAVHFGLPYLASLGIQSLVQQRAFAGKTANKLMDALKDSDLLHWKHSLSELIDISIAQKTAIWRLYGRSTMALQQAQMLLSMNSLEAVNAGVQQNNTESFAVALCHLAELHAEQGCFAAASEVLKHLKERFPPNSQHAQLWMLCDQKIQFDRAMNDGKYHLADSLVTGITALNSIEGVYRKAVVLQAQNQMSEAHKLLQCPTVRGRAVLAIFLPYHRAAHAPAGSGPLQGVPVTVLGL

SEQ ID NO: 750039 - protein, 1309 aa, Homo sapiens
RRPALSSCWQSPATETTVLMSQTEADLALRPPPPLGTAGQPRLGPPPRRARRFSGKAEPRPRSSRLSRRSSVDLGLLSSWSLPASPAPDPPDPPDSAGPGPARSPPPSSKEPPEGTWTEGAPVKAAEDSARPELPDSAVGPGSREPLRVPEAVALERRREQEEKEDMETQAVATSPDGRYLKFDIEIGRGSFKTVYRGLDTDTTVEVAWCELQTRKLSRAERQRFSEEVEMLKGLQHPNIVRFYDSWKSVLRGQVCIVLVTELMTSGTLKTYLRRFREMKPRVLQRWSRQILRGLHFLHSRVPPILHRDLKCDNVFITGPTGSVKIGDLGLATLKRASFAKSVIGTPEFMAPEMYEEKYDEAVDVYAFGMCMLEMATSEYPYSECQNAAQIYRKVTSGRKPNSFHKVKIPEVKEIIEGCIRTDKNERFTIQDLLAHAFFREERGVHVELAEEDDGEKPGLKLWLRMEDARRGGRPRDNQAIEFLFQLGRDAAEEVAQEMVALGLVCEADYQPVARAVRERVAAIQRKREKLRKARELEALPPEPGPPPATVPMAPGPPSVFPPEPEEPEADQHQPFLFRHASYSSTTSDCETDGYLSSSGFLDASDPALQPPGGVPSSLAESHLCLPSAFALSIPRSGPGSDFSPGDSYASDAASGLSDVGEGMGQMRRPPGRNLRRRPRSRLRVTSVSDQNDRVVECQLQTHNSKMVTFRFDLDGDSPEEIAAAMVYNEFILPSERDGFLRRIREIIQRVETLLKRDTGPMEAAEDTLSPQEEPAPLPALPVPLPDPSNEELQSSTSLEHRSWTAFSTSSSSPGTPLSPGNPFSPGTPISPGPIFPITSPPCHPSPSPFSPISSQVSSNPSPHPTSSPLPFSSSTPEFPVPLSQCPWSSLPTTSPPTFSPTCSQVTLSSPFFPPCPSTSSFPSTTAAPLLSLASAFSLAVMTVAQSLLSPSPGLLSQSPPAPPSPLPSLPLPPPVAPGGQESPSPHTAEVESEASPPPARPLPGEARLAPISEEGKPQLVGRFQVTSSKEPAEPLPLQPTSPTLSGSPKPSTPQLTSESSDTEDSAGGGPETREALAESDRAAEGLGAGVEEEGDDGKEPQVGGSPQPLSHPSPVWMNYSYSSLCLSSEESESSGEDEEFWAELQSLRQKHLSEVETLQTLQKKEIEDLYSRLGKQPPPGIVAPAAMLSSRQRRLSKGSFPTSRRNSLQRSEPPGPGIMRRNSLSGSSTGSQEQRASKGVTFAGDVGRMVRAGPREGEPREWYLAAASPSSHLGGFFITFSFPSSEFRTEAMYLPHTRAHHGACVLRI

SEQ ID NO: 750040 - protein, 1250 aa, Homo sapiens
RRPALSSCWQSPATETTVLMSQTEADLALRPPPPLGTAGQPRLGPPPRRARRFSGKAEPRPRSSRLSRRSSVDLGLLSSWSLPASPAPDPPDPPDSAGPGPARSPPPSSKEPPEGTWTEGAPVKAAEDSARPELPDSAVGPGSREPLRVPEAVALERRREQEEKEDMETQAVATSPDGRYLKFDIEIGRGSFKTVYRGLDTDTTVEVAWCELQTRKLSRAERQRFSEEVEMLKGLQHPNIVRFYDSWKSVLRGQVCIVLVTELMTSGTLKTYLRRFREMKPRVLQRWSRQILRGLHFLHSRVPPILHRDLKCDNVFITGPTGSVKIGDLGLATLKRASFAKSVIGTPEFMAPEMYEEKYDEAVDVYAFGMCMLEMATSEYPYSECQNAAQIYRKVTSGRKPNSFHKVKIPEVKEIIEGCIRTDKNERFTIQDLLAHAFFREERGVHVELAEEDDGEKPGLKLWLRMEDARRGGRPRDNQAIEFLFQLGRDAAEEVAQEMVALGLVCEADYQPVARAVRERVAAIQRKREKLRKARELEALPPEPGPPPATVPMAPGPPSVFPPEPEEPEADQHQPFLFRHASYSSTTSDCETDGYLSSSGFLDASDPALQPPGGVPSSLAESHLCLPSAFALSIPRSGPGSDFSPGDSYASDAASGLSDVGEGMGQMRRPPGRNLRRRPRSRLRVTSVSDQNDRVVECQLQTHNSKMVTFRFDLDGDSPEEIAAAMVYNEFILPSERDGFLRRIREIIQRVETLLKRDTGPMEAAEDTLSPQEEPAPLPALPVPLPDPSNEELQSSTSLEHRSWTAFSTSSSSPGTPLSPGNPFSPGTPISPGPIFPITSPPCHPSPSPFSPISSQVSSNPSPHPTSSPLPFSSSTPEFPVPLSQCPWSSLPTTSPPTFSPTCSQVTLSSPFFPPCPSTSSFPSTTAAPLLSLASAFSLAVMTVAQSLLSPSPGLLSQSPPAPPSPLPSLPLPPPVAPGGQESPSPHTAEVESEASPPPARPLPGEARLAPISEEGKPQLVGRFQVTSSKEPAEPLPLQPTSPTLSGSPKPSTPQLTSESSDTEDSAGGGPETREALAESDRAAEGLGAGVEEEGDDGKEPQVGGSPQPLSHPSPVWMNYSYSSLCLSSEESESSGEDEEFWAELQSLRQKHLSEVETLQTLQKKEIEDLYSRLGKQPPPGIVAPAAMLSSRQRRLSKGSFPTSRRNSLQRSEPPGPGIMRRNSLSGSSTGSQEQRASKGVTFAGDVGRM

SEQ ID NO: 750041 - protein, 745 aa, Homo sapiens
RRPALSSCWQSPATETTVLMSQTEADLALRPPPPLGTAGQPRLGPPPRRARRFSGKAEPRPRSSRLSRRSSVDLGLLSSWSLPASPAPDPPDPPDSAGPGPARSPPPSSKEPPEGTWTEGAPVKAAEDSARPELPDSAVGPGSREPLRVPEAVALERRREQEEKEDMETQAVATSPDGRYLKFDIEIGRGSFKTVYRGLDTDTTVEVAWCELQTRKLSRAERQRFSEEVEMLKGLQHPNIVRFYDSWKSVLRGQVCIVLVTELMTSGTLKTYLRRFREMKPRVLQRWSRQILRGLHFLHSRVPPILHRDLKCDNVFITGPTGSVKIGDLGLATLKRASFAKSVIGTPEFMAPEMYEEKYDEAVDVYAFGMCMLEMATSEYPYSECQNAAQIYRKVTSGRKPNSFHKVKIPEVKEIIEGCIRTDKNERFTIQDLLAHAFFREERGVHVELAEEDDGEKPGLKLWLRMEDARRGGRPRDNQAIEFLFQLGRDAAEEVAQEMVALGLVCEADYQPVARAVRERVAAIQRKREKLRKARELEALPPEPGPPPATVPMAPGPPSVFPPEPEEPEADQHQPFLFRHASYSSTTSDCETDGYLSSSGFLDASDPALQPPGGVPSSLAESHLCLPSAFALSIPRSGPGSDFSPGDSYASDAASGLSDVGEGMGQMRRPPGRNLRRRPRSRLRVTSVSDQNDRVVECQLQTHNSKMVTFRFDLDGDSPEEIAAAMVRGREMRTECLDLEQESPS

SEQ ID NO: 750042 - protein, 1250 aa, Homo sapiens; identical to SEQ ID NO: 750040

SEQ ID NO: 750043 - protein, 1244 aa, Homo sapiens
RRPALSSCWQSPATETTVLMSQTEADLALRPPPPLGTAGQPRLGPPPRRARRFSGKAEPRPRSSRLSRRSSVDLGLLSSWSLPASPAPDPPDPPDSAGPGPARSPPPSSKEPPEGTWTEGAPVKAAEDSARPELPDSAVGPGSREPLRVPEAVALERRREQEEKEDMETQAVATSPDGRYLKFDIEIGRGSFKTVYRGLDTDTTVEVAWCELQTRKLSRAERQRFSEEVEMLKGLQHPNIVRFYDSWKSVLRGQVCIVLVTELMTSGTLKTYLRRFREMKPRVLQRWSRQILRGLHFLHSRVPPILHRDLKCDNVFITGPTGSVKIGDLGLATLKRASFAKSVIGTPEFMAPEMYEEKYDEAVDVYAFGMCMLEMATSEYPYSECQNAAQIYRKVTSGRKPNSFHKVKIPEVKEIIEGCIRTDKNERFTIQDLLAHAFFREERGVHVELAEEDDGEKPGLKLWLRMEDARRGGRPRDNQAIEFLFQLGRDAAEEVAQEMVALGLVCEADYQPVARAVRERVAAIQRKREKLRKARELEALPPEPGPPPATVPMAPGPPSVFPPEPEEPEADQHQPFLFRHASYSSTTSDCETDGYLSSSGFLDASDPALQPPGGVPSSLAESHLCLPSAFALSIPRSGPGSDFSPGDSYASDAASGLSDVGEGMGQMRRPPGRNLRRRPRSRLRVTSVSDQNDRVVECQLQTHNSKMVTFRFDLDGDSPEEIAAAMVYNEFILPSERDGFLRRIREIIQRVETLLKRDTGPMEAAEDTLSPQEEPAPLPALPVPLPDPSNEELQSSTSLEHRSWTAFSTSSSSPGTPLSPGNPFSPGTPISPGPIFPITSPPCHPSPSPFSPISSQVSSNPSPHPTSSPLPFSSSTPEFPVPLSQCPWSSLPTTSPPTFSPTCSQVTLSSPFFPPCPSTSSFPSTTAAPLLSLASAFSLAVMTVAQSLLSPSPGLLSQSPPAPPSPLPSLPLPPPVAPGGQESPSPHTAEVESEASPPPARPLPGEARLAPISEEGKPQLVGRFQVTSSKEPAEPLPLQPTSPTLSGSPKPSTPQLTSESSDTEDSAGGGPETREALAESDRAAEGLGAGVEEEGDDGKEPQVGGSPQPLSHPSPVWMNYSYSSLCLSSEESESSGEDEEFWAELQSLRQKHLSEVETLQTLQKKEIEDLYSRLGKQPPPGIVAPAAMLSSRQRRLSKGSFPTSRRNSLQRSEPPGPVNSEQKPCISPTPGPTMELVFSESDAF

SEQ ID NO: 750044 - protein, 99 aa, Homo sapiens
TPQLTSESSDTEDSAGGGPETREALAESDRAAEGLGAGVEEEGDDGKEPQVGGSPQPLSHPSPVWMNYSYSSLCLSSEESESSGEDEEFWAELQSLRQK

SEQ ID NO: 750045 - protein, 232 aa, Homo sapiens
GPGGRPTRLLSPSSSSPPFTAENRKKTMDKIIRGKLALPPYLTPDARDLVKKFLKRNPSQRIGGGPGDAADVQRHPFFRHMNWDDLLAWRVDPPFRPCLQSEEDVSQFDTRFTRQTPVDSPDDTALSESANQAFLGFTYVAPSVLDSIKEGFSFQPKLRSPRRLNSSPRVPVSPLKFSPFEGFRPSPSLPEPTELPLPPLLPPPPPSTTAPLPIRPPSGTKKSKRGRGRPGR

SEQ ID NO: 750046 - protein, 482 aa, Homo sapiens
MAAVFDLDLETEEGSEGEGEPELSPADACPLAELRAAGLEPVGHYEEVELTETSVNVGPERIGPHCFELLRVLGKGGYGKVFQVRKVQGTNLGKIYAMKVLRKAKIVRNAKDTAHTRAERNILESVKHPFIVELAYAFQTGGKLYLILECLSGGELFTHLEREGIFLEDTACFYLAEITLALGHLHSQGIIYRDLKPENIMLSSQGHIKLTDFGLCKESIHEGAVTHTFCGTIEYMAPEILVRSGHNRAVDWWSLGALMYDMLTGSPPFTAENRKKTMDKIIRGKLALPPYLTPDARDLVKKFLKRNPSQRIGGGPGDAADVQRHPFFRHMNWDDLLAWRVDPPFRPCLQSEEDVSQFDTRFTRQTPVDSPDDTALSESANQAFLGFTYVAPSVLDSIKEGFSFQPKLRSPRRLNSSPRVPVSPLKFSPFEGFRPSPSLPEPTELPLPPLLPPPPPSTTAPLPIRPPSGTKKSKRGRGRPGR

SEQ ID NO: 750047 - protein, 390 aa, Homo sapiens
MAAVFDLDLETEEGSEGEGEPELSPADACPLAELRAAGLEPVGHYEEVELTETSVNVGPERIGPHCFELLRVLGKGGYGKVFQVRKVQGTNLGKIYAMKVLRKAKIVRNAKDTAHTRAERNILESVKHPFIVELAYAFQTGGKLYLILECLSGGELFTHLEREGIFLEDTACFYLAEITLALGHLHSQGIIYRDLKPENIMLSSQGHIKLTDFGLCKESIHEGAVTHTFCGTIEYMAPEILVRSGHNRAVDWWSLGALMYDMLTGSPPFTAENRKKTMDKIIRGKLALPPYLTPDARDLVKKFLKRNPSQRIGGGPGDAADVQRHPFFRHMNWDDLLAWRVDPPFRPCLQSEEDVSQFDTRFTRQTPVDSPDDTALSESANQAFLVSAGA

SEQ ID NO: 750048 - protein, 497 aa, Homo sapiens
LVGLGVNLAECQSVRGQVRADGPAGPAPPWRPCLIWIWRRRKAARARASQSSAPRPVGHYEEVELTETSVNVGPERIGPHCFELLRVLGKGGYGKVFQVRKVQGTNLGKIYAMKVLRKAKIVRNAKDTAHTRAERNILESVKHPFIVELAYAFQTGGKLYLILECLSGGELFTHLEREGIFLEDTACFYLAEITLALGHLHSQGIIYRDLKPENIMLSSQGHIKLTDFGLCKESIHEGAVTHTFCGTIEYMAPEILVRSGHNRAVDWWSLGALMYDMLTGSPPFTAENRKKTMDKIIRGKLALPPYLTPDARDLVKKFLKRNPSQRIGGGPGDAADVQRHPFFRHMNWDDLLAWRVDPPFRPCLQSEEDVSQFDTRFTRQTPVDSPDDTALSESANQAFLGFTYVAPSVLDSIKEGFSFQPKLRSPRRLNSSPRVPVSPLKFSPFEGFRPSPSLPEPTELPLPPLLPPPPPSTTAPLPIRPPSGTKKSKRGRGRPGR

SEQ ID NO: 750049 - protein, 282 aa, Homo sapiens
MLSSQGHIKLTDFGLCKESIHEGAVTHTFCGTIEYMAPEILVRSGHNRAVDWWSLGALMYDMLTGSPPFTAENRKKTMDKIIRGKLALPPYLTPDARDLVKKFLKRNPSQRIGGGPGDAADVQRHPFFRHMNWDDLLAWRVDPPFRPCLQSEEDVSQFDTRFTRQTPVDSPDDTALSESANQAFLGFTYVAPSVLDSIKEGFSFQPKLRSPRRLNSSPRVPVSPLKFSPFEGFRPSPSLPEPTELPLPPLLPPPPPSTTAPLPIRPPSGTKKSKRGRGRPGR

SEQ ID NO: 750050 - protein, 282 aa, Homo sapiens; identical to SEQ ID NO: 750049

SEQ ID NO: 750051 - protein, 205 aa, Homo sapiens [sequence omitted]

SEQ ID NO: 750052 - protein, 184 aa, Homo sapiens
MDKIIRGKLALPPYLTPDARDLVKKRHPFFRHMNWDDLLAWRVDPPFRPCLQSEEDVSQFDTRFTRQTPVDSPDDTALSESANQAFLGFTYVAPSVLDSIKEGFSFQPKLRSPRRLNSSPRVPVSPLKFSPFEGFRPSPSLPEPTELPLPPLLPPPPPSTTAPLPIRPPSGTKKSKRGRGRPGR

SEQ ID NO: 750053 - protein, 168 aa, Homo sapiens
LVGLGVNLAECQSVRGQVRADGPAGPAPPWRPCLIWIWRRRKAARARASQSSAPRPVGHYEEVELTETSVNVGPERIGPHCFELLRVLGKGGYGKVFQVRKVQGTNLGKIYAMKVLRKAKIVRNAKDTAHTRAERNILESVKHPFIVELAYAFQTGGKLYLILECLSD

SEQ ID NO: 750054 - protein, 47 aa, Homo sapiens
MAAVFDLDLETEEGSEGEGEPELSPAVSALPWRDWILEPILSPSRGR

SEQ ID NO: 750055 - protein, 482 aa, Homo sapiens; identical to SEQ ID NO: 750046

SEQ ID NO: 750056 - protein, 482 aa, Homo sapiens; identical to SEQ ID NO: 750046

SEQ ID NO: 750057 - protein, 282 aa, Homo sapiens; identical to SEQ ID NO: 750049

SEQ ID NO: 750058 - protein, 282 aa, Homo sapiens; identical to SEQ ID NO: 750049

SEQ ID NO: 750059 - protein, 277 aa, Homo sapiens
RLWKTGRLWKTGRLWKTARLWKTGRLWKTGRLWKTGEAVEDGRAVDWWSLGALMYDMLTGSPPFTAENRKKTMDKIIRGKLALPPYLTPDARDLVKKFLKRNPSQRIGGGPGDAADVQRHPFFRHMNWDDLLAWRVDPPFRPCLQSEEDVSQFDTRFTRQTPVDSPDDTALSESANQAFLGFTYVAPSVLDSIKEGFSFQPKLRSPRRLNSSPRVPVSPLKFSPFEGFRPSPSLPEPTELPLPPLLPPPPPSTTAPLPIRPPSGTKKSKRGRGRPGR

SEQ ID NO: 750060 - protein, 153 aa, Homo sapiens
MAAVFDLDLETEEGSEGEGEPELSPADACPLAELRAAGLEPVGHYEEVELTETSVNVGPERIGPHCFELLRVLGKGGYGKVFQVRKVQGTNLGKIYAMKVLRKAKIVRNAKDTAHTRAERNILESVKHPFIVELAYAFQTGGKLYLILECLSD

SEQ ID NO: 750061 - protein, 182 aa, Homo sapiens
MAAVFDLDLETEEGSEGEGEPELSPADACPLAELRAAGLEPVGHYEEVELTETSVNVGPERIGPHCFELLRVLGKGGYGKVFQVRKVQGTNLGKIYAMKVLRKAKIVRNAKDTAHTRAERNILESVKHPFIVELAYAFQTGGKLYLILECLSGMSAGPGRGAGGRGGAASQQRKLWGEALER

SEQ ID NO: 750062 - protein, 122 aa, Homo sapiens
ALGALATSVGQCWLRLLCLSWGPQFLHPLWPGCLDGSLWSPRPVCLGRWERLPSLTECWEPLAGPRRLLFCLGFPCSPLKFSPFEGFRPSPSLPEPTELPLPPLLPPPPPSTTAPLPIRPPS

SEQ ID NO: 750063 - protein, 242 aa, Homo sapiens
GGVCAHSIEGGELFERIVDEDYHLTEVDTMVFVRQICDGILFMHKMRVLHLDLKPENILCVNTTGHLVKIIDFGLARRYNPNEKLKVNFGTPEFLSPEVVNYDQISDKTDMWSMGVITYMLLSGLSPFLGDDDTETLNNVLSGNWYFDEETFEAVSDEAKDFVSNLIVKDQRARMNAAQCLAHPWLNNLAEKAKRCNRRLKSQILLKKYLMKRRWKKNFIAVSAANRFKKISSSGALMALGV

SEQ ID NO: 750064 - protein, 596 aa, Homo sapiens
MATENGAVELGIQNPSTDKAPKGPTGERPLAAGKDPGPPDPKKAPDPPTLKKDAKAPASEKGDGTLAQPSTSSQGPKGEGDRGGGPAEGSAGPPAALPQQTATPETSVKKPKAEQGASGSQDPGKPRVGKKAAEGQAAARRGSPAFLHSPSCPAIISSSEKLLAKKPPSEASELTFEGVPMTHSPTDPRPAKAEEGKNILAESQKEVGEKTPGQAGQAKMQGDTSRGIEFQAVPSEKSEVGQALCLTAREEDCFQILDDCPPPPAPFPHRMVELRTGNVSSEFSMNSKEALGGGKFGAVCTCMEKATGLKLAAKVIKKQTPKDKEMVLLEIEVMNQLNHRNLIQLYAAIETPHEIVLFMEYIEGGELFERIVDEDYHLTEVDTMVFVRQICDGILFMHKMRVLHLDLKPENILCVNTTGHLVKIIDFGLARRYNPNEKLKVNFGTPEFLSPEVVNYDQISDKTDMWSMGVITYMLLSGLSPFLGDDDTETLNNVLSGNWYFDEETFEAVSDEAKDFVSNLIVKDQRARMNAAQCLAHPWLNNLAEKAKRCNRRLKSQILLKKYLMKRRWKKNFIAVSAANRFKKISSSGALMALGV

SEQ ID NO: 750065 - protein, 596 aa, Homo sapiens; identical to SEQ ID NO: 750064

SEQ ID NO: 750066 - protein, 202 aa, Homo sapiens
MEAALLGLCNWSTLGVCAALKLPQISAVLAARSARGLSLPSLLLELAGFLVFLRYQCYYGYPPLTYLEYPILIAQDVILLLCIFHFNGNVKQATPYIAVLVSSWFILALQKWIIDLAMNLCTFISAASKFAQLQCLWKTRDSGTVSALTWSLSSYTCATRIITTLMTTNDFTILLRFVIMLALNIWVTVTVLRYRKTAIKAE

SEQ ID NO: 750067 - protein, 180 aa, Homo sapiens [sequence omitted]

SEQ ID NO: 750068 - protein, 180 aa, Homo sapiens
MEAALLGLCNWSTLGVCAALKLPQISAVLAARSARGLSLPSLLLELAGFLVFLRYQCYYGYPPLTYLEYPILIAQDVILLLCIFHFNGNVKQATPYIAVLVSSWFILALQKWIIDLAMNLCTFISAASKFAQLQCLWKTRDSGTVSALTWSLSSYTCASKNRTHMVGRPLVAPSVYVVGC

SEQ ID NO: 750069 - protein, 102 aa, Homo sapiens
MEAALLGLCNWSTLGVCAALKLPQISAVLAARSARGLSLPSLLLELAGFLVFLRYQCYYGYPPLTYLEYPILIAQDVILLLCIFHFNGNVKQATPYIAVYPF

SEQ ID NO: 750070 - protein, 115 aa, Homo sapiens
MEAALLGLCNWSTLGVCAALKLPQISAVLAARSARGLSLPSLLLELAGFLVFLRYQCYYGYPPLTYLEYPILIAQEGFSCLSFLSSWDYRHTPPCLANFCIFSRDEFSPCWPGWF

SEQ ID NO: 750071 - protein, 169 aa, Homo sapiens
MEAALLGLCNWSTLGVCAALKLPQISAVLAARSARGLSLPSLLLELAGFLVFLRYQCYYGYPPLTYLEYPILIAQDVILLLCIFHFNGNVKQATPYIAVLVSSWFILALQKWIIDLAMNLCTFISAASKFAQLQCLWKTRDSGTVSALTWSLSSYTCARSRSLSQAGVQ

SEQ ID NO: 750072 - protein, 188 aa, Homo sapiens
MEAALLGLCNWSTLGVCAALKLPQISAVLAARSARGLSLPSLLLELAGFLVFLRYQCYYGYPPLTYLEYPILIAQDVILLLCIFHFNGNVKQATPYIAVLVSSWFILALQKWIIDLAMNLCTFISAASKFAQLQCLWKTRDSGTVSALTWSLSSYTCAILLRFVIMLALNIWVTVTVLRYRKTAIKAE

SEQ ID NO: 750073 - protein, 120 aa, Homo sapiens
MEAALLGLCNWSTLGVCAALKLPQISAVLAARSARGLSLPSLLLELAGFLVFLRYQCYYGYPPLTYLEYPILIAQDVILLLCIFHFNGNVKQATPYIAVLVSSWFILALQKWIIDLAMQE

SEQ ID NO: 750074 - protein, 125 aa, Homo sapiens
MEAALLGLCNWSTLGVCAALKLPQISAVLAARSARGLSLPSLLLELAGFLVFLRYQCYYGYPPLTYLEYPILIAQDVILLLCIFHFNGNVKQATPYIAVIYVLSSARPVSLHSSSVCGRRETQEL

SEQ ID NO: 750075 - protein, 102 aa, Homo sapiens; identical to SEQ ID NO: 750069

SEQ ID NO: 750076 - protein, 107 aa, Homo sapiens
MPVIPRCWNYRCEPPHLASFAFLTNRLVTFSHFICKQNLCTFISAASKFAQLQCLWKTRDSGTVSALTWSLSSYTCAILLRFVIMLALNIWVTVTVLRYRKTAIKAE

SEQ ID NO: 750077 - protein, 180 aa, Homo sapiens [sequence omitted]

SEQ ID NO: 750078 - protein, 202 aa, Homo sapiens; identical to SEQ ID NO: 750066

SEQ ID NO: 750079 - protein, 202 aa, Homo sapiens; identical to SEQ ID NO: 750066

SEQ ID NO: 750080 - protein, 169 aa, Homo sapiens; identical to SEQ ID NO: 750071

SEQ ID NO: 750081 - protein, 74 aa, Homo sapiens
RPRRRSFLKYLGQLSTLCSSIVLGLRDSVKRRVTAGHGGSLTPVIPALWEAEAGGSLGQEIETILANVVKPRLY

SEQ ID NO: 750082 - protein, 211 aa, Homo sapiens
SFARLPGGRGSRRGQELLSSSPLPAALSWPRQRPRALRVCQALGLRGHWVGGGPRRPEGPGRLSGLLSTLERRPRVSVSWICGSVSAGGLLLAHNLEAPGSTAPSGPATQGLVRFLLTHRFWERGASRQEDAEFLMTGPVSVHSLVPGERGGTPTPSWRSLQRCSSGPIRDLGCLCVLWSREFATWSHFVTQAGMHWHEHVSLQPQPPRLK

SEQ ID NO: 750083 - protein, 211 aa, Homo sapiens; identical to SEQ ID NO: 750082

SEQ ID NO: 750084 - protein, 119 aa, Homo sapiens
PKMLPISDFVTLNLILLNAVLPRLGQSTLLNSIPLSVYLLLTSHPRSVDSGLQGSTKTSVFECLHSPAKSLIRFYRSAMPLALMPFFLHHTLTPWTSGPLPNWVTLATLDLEDSQPVTW

SEQ ID NO: 750085 - protein, 44 aa, Homo sapiens
GPPWAREPSGGWWGSVLLSSCHGKKYPSEFLFGPIQLLALPWTD

SEQ ID NO: 750086 - protein, 102 aa, Homo sapiens
LPPGPALPNSLGRPGAHTLLRPRRSEERGWRGDPGPRGRDLAVAREAPLARASVLSPRAEGLRAADRYGMLEDIWGPQMLLLLETQLKFSWSFHCLVQCHRP

SEQ ID NO: 750087 - protein, 102 aa, Homo sapiens; identical to SEQ ID NO: 750086

SEQ ID NO: 750088 - protein, 658 aa, Homo sapiens
MKLYCLSGHPTLPCNVLKFKSTTIMLDCGLDMTSTLNFLPLPLVQSPRLSNLPGWSLKDGNAFLDKELKECSGHVFVDSVPEFCLPETELIDLSTVDVILISNYHCMMALPYITEHTGFTGTVYATEPTVQIGRLLMEELVNFIERVPKAQSASLWKNKDIQRLLPSPLKDAVEVSTWRRCYTMQEVNSALSKIQLVGYSQKIELFGAVQVTPLSSGYALGSSNWIIQSHYEKVSYVSGSSLLTTHPQPMDQASLKNSDVLVLTGLTQIPTANPDGMVGEFCSNLALTVRNGGNVLVPCYPSGVIYDLLECLYQYIDSAGLSSVPLYFISPVANSSLEFSQIFAEWLCHNKQSKVYLPEPPFPHAELIQTNKLKHYPSIHGDFSNDFRQPCVVFTGHPSLRFGDVVHFMELWGKSSLNTVIFTEPDFSYLEALAPYQPLAMKCIYCPIDTRLNFIQVSKLLKEVQPLHVVCPEQYTQPPPAQSHRMDLMIDCQPPAMSYRRAEVLALPFKRRYEKIEIMPELADSLVPMEIKPGISLATVSAVLHTKDNKHLLQPPPRPAQPTSGKKRKRVSDDVPDCKVLKPLLSGSIPVEQFVQTLEKHGFSDIKVEDTAKGHIVLLQEAETLIQIEEDSTHIICDNDEMLRVRLRDLVLKFLQKF

SEQ ID NO: 750089 - protein, 260 aa, Homo sapiens
GWYEPGVKNELFGAVQVTPLSSGYALGSSNWIIQSHYEKVSYVSGSSLLTTHPQPMDQASLKNSDVLVLTGLTQIPTANPDGMVGEFCSNLALTVRNGGNVLVPCYPSGVIYDLLECLYQYIDSAGLSSVPLYFISPVANSSLEFSQIFAEWLCHNKQSKVYLPEPPFPHAELIQTNKLKHYPSIHGDFSNDFRQPCVVFTGHPSLRFGDVVHFMELWGKSSLNTVIFTEPTSPTWEPGSYRRWPEMVYALEPVNLQGRR

SEQ ID NO: 750090 - protein, 658 aa, Homo sapiens; identical to SEQ ID NO: 750088

SEQ ID NO: 750091 - protein, 409 aa, Homo sapiens
MDQASLKNSDVLVLTGLTQIPTANPDGMVGEFCSNLALTVRNGGNVLVPCYPSGVIYDLLECLYQYIDSAGLSSVPLYFISPVANSSLEFSQIFAEWLCHNKQSKVYLPEPPFPHAELIQTNKLKHYPSIHGDFSNDFRQPCVVFTGHPSLRFGDVVHFMELWGKSSLNTVIFTEPDFSYLEALAPYQPLAMKCIYCPIDTRLNFIQVSKLLKEVQPLHVVCPEQYTQPPPAQSHRMDLMIDCQPPAMSYRRAEVLALPFKRRYEKIEIMPELADSLVPMEIKPGISLATVSAVLHTKDNKHLLQPPPRPAQPTSGKKRKRVSDDVPDCKVLKPLLSGSIPVEQFVQTLEKHGFSDIKVEDTAKGHIVLLQEAETLIQIEEDSTHIICDNDEMLRVRLRDLVLKFLQKF

SEQ ID NO: 750092 - protein, 573 aa, Homo sapiens
YLPPHLANFCIFSRDRVFPCWSGWSRTPDLKLPGRLGASQSAGIIGVSHRAWPRFLFYVLSQHCVLFLLKTFGNVVTLFVSFNSCIRAPRKQVMTFLPTLISYTLSMLLCEIVVAQNIELFGAVQVTPLSSGYALGSSNWIIQSHYEKVSYVSGSSLLTTHPQPMDQASLKNSDVLVLTGLTQIPTANPDGMVGEFCSNLALTVRNGGNVLVPCYPSGVIYDLLECLYQYIDSAGLSSVPLYFISPVANSSLEFSQIFAEWLCHNKQSKVYLPEPPFPHAELIQTNKLKHYPSIHGDFSNDFRQPCVVFTGHPSLRFGDVVHFMELWGKSSLNTVIFTEPDFSYLEALAPYQPLAMKCIYCPIDTRLNFIQVSKLLKEVQPLHVVCPEQYTQPPPAQSHRMDLMIDCQPPAMSYRRAEVLALPFKRRYEKIEIMPELADSLVPMEIKPGISLATVSAVLHTKDNKHLLQPPPRPAQPTSGKKRKRVSDDVPDCKVLKPLLSGSIPVEQFVQTLEKHGFSDIKVEDTAKGHIVLLQEAETLIQIEEDSTHIICDNDEMLRVRLRDLVLKFLQKF

SEQ ID NO: 750093 - protein, 475 aa, Homo sapiens [sequence omitted]

SEQ ID NO: 750094 - protein, 218 aa, Homo sapiens [sequence omitted]

SEQ ID NO: 750095 - protein, 693 aa, Homo sapiens
MKLYCLSGHPTLPCNVLKFKSTTIMLDCGLDMTSTLNFLPLPLVQSPRLSNLPGWSLKDGNAFLDKELKECSGHVFVDSVPEFCLPETELIDLSTVDVILISNYHCMMALPYITEHTGFTGTVYATEPTVQIGRLLMEELVNFIERVPKAQSASLWKNKDIQRLLPSPLKDAVEVSTWRRCYTMQEVNSALSKIQLVGYSQKIELFGAVQVTPLSSGYALGSSNWIIQSHYEKVSYVSGSSLLTTHPQPMDQASLKNSDVLVLTGLTQIPTANPDGMVGEFCSNLALTVRNGGNVLVPCYPSGVIYDLLECLYQYIDSAGLSSVPLYFISPVANSSLEFSQIFAEWLCHNKQSKVYLPEPPFPHAELIQTNKLKHYPSIHGDFSNDFRQPCVVFTGHPSLRFGDVVHFMELWGKSSLNTVIFTEPDFSYLEALAPYQPLAMKCIYCPIDTRLNFIQVSKLLKEVQPLHVVCPEQYTQPPPAQSHRMDLMIDCQPPAMSYRRAEVLALPFKRRYEKIEIMPELADSLVPMEIKPGISLATVSAVLHTKDNKHLLQPPPRPAQPTSGKKRKRVSDDVPDCKVLKPLLSGSIPVEQFVQTLEKVSWFRWCRENSTRGSLSLAHYGPLAAGSGCCCLSLSPHCPVASVWSKVLLGDPGERKQSEECPILPPSTRSPEGLSRLKKKLLPHTHVTSGAG

SEQ ID NO: 750096 - protein, 355 aa, Homo sapiens
MKLYCLSGHPTLPCNVLKFKSTTIMLDCGLDMTSTLNFLPLPLVQSPRLSNLPGWSLKDGNAFLDKELKECSGHVFVDSVPEFCLPETELIDLSTVDVILISNYHCMMALPYITEHTGFTGTVYATEPTVQIGRLLMEELVNFIERVPKAQSASLWKNKDIQRLLPSPLKDAVEVSTWRRCYTMQEVNSALSKIQLVGYSQKIELFGAVQVTPLSSGYALGSSNWIIQSHYEKVSYVSGSSLLTTHPQPMDQASLKNSDVLVLTGLTQIPTANPDGMVGEFCSNLALTVRNGGNVLVPCYPSGVIYDLLECLYQYIDSAGLSSVPLYFISPVANSSLEFSQIFAEWYVRGFFFCV

SEQ ID NO: 750097 - protein, 102 aa, Homo sapiens [sequence omitted]

SEQ ID NO: 750098 - protein, 243 aa, Homo sapiens
MKLYCLSGHPTLPCNVLKFKSTTIMLDCGLDMTSTLNFLPLPLVQSPRLSNLPGWSLKDGNAFLDKELKECSGHVFVDSVPEFCLPETELIDLSTVDVILISNYHCMMALPYITEHTGFTGTVYATEPTVQIGRLLMEELVNFIERVPKAQSASLWKNKDIQRLLPSPLKDAVEVSTWRRCYTMQEVNSALSKIQLVGYSQKILGSSTWSSRLILGKGLWSWTSLVTHTPRPCPAFLNKVVLL

SEQ ID NO: 750099 - protein, 637 aa, Homo sapiens
MKLYCLSGHPTLPCNVLKFKSTTIMLDCGLDMTSTLNFLPLPLVQSPRLSNLPGWSLKDGNAFLDKTELIDLSTVDVILISNYHCMMALPYITEHTGFTGTVYATEPTVQIGRLLMEELVNFIERVPKAQSASLWKNKDIQRLLPSPLKDAVEVSTWRRCYTMQEVNSALSKIQLVGYSQKIELFGAVQVTPLSSGYALGSSNWIIQSHYEKVSYVSGSSLLTTHPQPMDQASLKNSDVLVLTGLTQIPTANPDGMVGEFCSNLALTVRNGGNVLVPCYPSGVIYDLLECLYQYIDSAGLSSVPLYFISPVANSSLEFSQIFAEWLCHNKQSKVYLPEPPFPHAELIQTNKLKHYPSIHGDFSNDFRQPCVVFTGHPSLRFGDVVHFMELWGKSSLNTVIFTEPDFSYLEALAPYQPLAMKCIYCPIDTRLNFIQVSKLLKEVQPLHVVCPEQYTQPPPAQSHRMDLMIDCQPPAMSYRRAEVLALPFKRRYEKIEIMPELADSLVPMEIKPGISLATVSAVLHTKDNKHLLQPPPRPAQPTSGKKRKRVSDDVPDCKVLKPLLSGSIPVEQFVQTLEKHGFSDIKVEDTAKGHIVLLQEAETLIQIEEDSTHIICDNDEMLRVRLRDLVLKFLQKF

SEQ ID NO: 750100 - protein, 464 aa, Homo sapiens
GWYEPGVKNELFGAVQVTPLSSGYALGSSNWIIQSHYEKVSYVSGSSLLTTHPQPMDQASLKNSDVLVLTGLTQIPTANPDGMVGEFCSNLALTVRNGGNVLVPCYPSGVIYDLLECLYQYIDSAGLSSVPLYFISPVANSSLEFSQIFAEWLCHNKQSKVYLPEPPFPHAELIQTNKLKHYPSIHGDFSNDFRQPCVVFTGHPSLRFGDVVHFMELWGKSSLNTVIFTEPDFSYLEALAPYQPLAMKCIYCPIDTRLNFIQVSKLLKEVQPLHVVCPEQYTQPPPAQSHRMDLMIDCQPPAMSYRRAEVLALPFKRRYEKIEIMPELADSLVPMEIKPGISLATVSAVLHTKDNKHLLQPPPRPAQPTSGKKRKRVSDDVPDCKVLKPLLSGSIPVEQFVQTLEKHGFSDIKVEDTAKGHIVLLQEAETLIQIEEDSTHIICDNDEMLRVRLRDLVLKFLQKF

SEQ ID NO: 750101 - protein, 658 aa, Homo sapiens; identical to SEQ ID NO: 750088

SEQ ID NO: 750102 - protein, 202 aa, Homo sapiens
MKVHLGLEVPLHVVCPEQYTQPPPAQSHRMDLMIDCQPPAMSYRRAEVLALPFKRRYEKIEIMPELADSLVPMEIKPGISLATVSAVLHTKDNKHLLQPPPRPAQPTSGKKRKRVSDDVPDCKVLKPLLSGSIPVEQFVQTLEKHGFSDIKVEDTAKGHIVLLQEAETLIQIEEDSTHIICDNDEMLRVRLRDLVLKFLQKF

SEQ ID NO: 750103 - protein, 425 aa, Homo sapiens
MKLYCLSGHPTLPCNVLKFKSTTIMLDCGLDMTSTLNFLPLPLVQSPRLSNLPGWSLKDGNAFLDKELKECSGHVFVDSVPEFCLPETELIDLSTVDVILISNYHCMMALPYITEHTGFTGTVYATEPTVQIGRLLMEELVNFIERVPKAQSASLWKNKDIQRLLPSPLKDAVEVSTWRRCYTMQEVNSALSKIQLVGYSQKIELFGAVQVTPLSSGYALGSSNWIIQSHYEKVSYVSGSSLLTTHPQPMDQASLKNSDVLVLTGLTQIPTANPDGMVGEFCSNLALTVRNGGNVLVPCYPSGVIYDLLECLYQYIDSAGLSSVPLYFISPVANSSLEFSQIFAEWLCHNKQSKVYLPEPPFPHAELIQTNKLKHYPSIHGDFSNDFRQPCVVFTGHPSLRFGDVVHFMELWGKSSLNTVIFTGK

SEQ ID NO: 750104 - protein, 110 aa, Homo sapiens [sequence omitted]

SEQ ID NO: 750105 - protein, 95 aa, Homo sapiens
CVFRVQGPAGTEHSSLPGLVWFQGFQRLKAAHAALEEEYLKACREQHPAQPLAGSKGTPGRFDPRRYLLGWKAWKDRWDGPLGSLSLQEGGTLSL

SEQ ID NO: 750106 - protein, 164 aa, Homo sapiens
EAGLSLEGHGNTSPMALGHGQARGWVASGEQASGDKLSEHSEVNPSVELSPARSWSSGTVSLDHPSDSLDSTWEGETDGPQPTALAETLPEGPSHHLLSPDGRTGGSVARATPMEFQDSSAPPAQSPQHATDRWRRETTRFFCPQPKEHIMVPFSTSRMVPSFS

SEQ ID NO: 750107 - protein, 1293 aa, Homo sapiens
EAGLSLEGHGNTSPMALGHGQARGWVASGEQASGDKLSEHSEVNPSVELSPARSWSSGTVSLDHPSDSLDSTWEGETDGPQPTALAETLPEGPSHHLLSPDGRTGGSVARATPMEFQDSSAPPAQSPQHATDRWRRETTRFFCPQPKEHIWKQTKTSPKPLPSRFIGSISPLNPQPRPTRQGRPLPRQGATLAGRSSSNAPKYGRGQLNYPLPDFSKVGPRVRFPKDESYRPPKSRSHNRKPQAPARPLIFKSPAEIVQEVLLSSGEAALAKDTPPAHPITRVPQEFQTPEQATELVHQLQEDYHRLLTKYAEAENTIDQLRLGAKVNLFSDPPQPNHSIHTGMVPQGTKVLSFTIPQPRSAEWWPGPAEDPQASAASGWPSARGDLSPSSLTSMPTLGWLPENRDISEDQSSAEQTQALASQASQFLAKVESFERLIQAGRLMPQDQVKGFQRLKAAHAALEEEYLKACREQHPAQPLAGSKGTPGRFDPRRELEAEIYRLGSCLEELKEHIDQTQQEPEPPGSDSALDSTPALPCLHQPTHLPAPSGQAPMPAIKTSCPEPATTTAAASTGPCPLHVNVEVSSGNSEVEDRPQDPLARLRHKELQMEQVYHGLMERYLSVKSLPEAMRMEEEEEGEEEEEEEGGGDSLEVDGVAATPGKAEATRVLPRQCPVQAEKSHGAPLEEATEKMVSMKPPGFQASLARDGHMSGLGKAEAAPPGPGVPPHPPGTKSAASHQSSMTSLEGSGISERLPQKPLHRGGGPHLEETWMASPETDSGFVGSETSRVSPLTQTPEHRLSHISTAGTLAQPFAASVPRDGASYPKARGSLIPRRATEPSTPRSQAQRYLSSPSGPLRQRAPNFSLERTLAAEMAVPGSEFEGHKRISEQPLPNKTISPPPAPAPAAAPLPCGPTETIPSFLLTRAGRDQAICELQEEVSRLRLRLEDSLHQPLQGSPTRPASAFDRPARTRGRPADSPATWGSHYGSKSTERLPGEPRGEEQIVPPGRQRARSSSVPREVLRLSLSSESELPSLPLFSEKSKTTKDSPQAARDGKRGVGSAGWPDRVTFRGQYTGHEYHVLSPKAVPKGNGTVSCPHCRPIRTQDAGGAVTGDPLGPPPADTLQCPLCGQVGSPPEADGPGSATSGAEKATTRRKAPSTPSPKQRSKQAGSSPRPPPGLWYLATAPPAPAPPAFAYISSVPIMPYPPAAVYYAPAGPTSAQPAAKWPPTASPPPARRHRHSIQLDLGDLEELNKALSRAVQAAESVRSTTRQMRSSLSADLRQAHSLRGSCLF

SEQ ID NO: 750108 - protein, 1293 aa, Homo sapiens; identical to SEQ ID NO: 750107

SEQ ID NO: 750109 - protein, 384 aa, Homo sapiens [sequence omitted]

SEQ ID NO: 750110 - protein, 121 aa, Homo sapiens
MCNEPTHFSPQVLCACRTYLSPTSCQVAAHSLSPTSPETPALHPARPGRPRGAQQGPEPGRAGCRERPLYHQADEKLAVSRPAPGSQPAGLLPLLTSLGAQRQMGGWVGRWPARPGVGWSC

SEQ ID NO: 750111 - protein, 343 aa, Homo sapiens
EAGLSLEGHGNTSPMALGHGQARGWVASGEQASGDKLSEHSEVNPSVELSPARSWSSGTVSLDHPSDSLDSTWEGETDGPQPTALAETLPEGPSHHLLSPDGRTGGSVARATPMEFQDSSAPPAQSPQHATDRWRRETTRFFCPQPKEHIWKQTKTSPKPLPSRFIGSISPLNPQPRPTRQGRPLPRQGATLAGRSSSNAPKYGRGQLNYPLPDFSKVGPRVRFPKDESYRPPKSRSHNRKPQAPARPLIFKSPAEIVQEVLLSSGEAALAKDTPPAHPITRVPQEFQTPEQATELVHQLQEDYHRLLTKYAEAENTIDQLRLGAKVNLFSEPPPHWVPKTRI

SEQ ID NO: 750112 - protein, 98 aa, Homo sapiens
GLACGGAQMLPPECLTLCDPCVSLPPRSPSTAGTLAQPFAASVPRDGASYPKARGSLIPRRATEPSTPRSQAQRYLSSPSGPLRQRAPNFSLERTLAA

SEQ ID NO: 750113 - protein, 121 aa, Homo sapiens; identical to SEQ ID NO: 750110

SEQ ID NO: 750114 - protein, 200 aa, Homo sapiens
EAGLSLEGHGNTSPMALGHGQARGWVASGEQASGDKLSEHSEVNPSVELSPARSWSSGTVSLDHPSDSLDSTWEGETDGPQPTALAETLPEGPSHHLLSPDGRTGGSVARATPMEFQDSSAPPAQSPQHATDRWRRETTRFFCPQPKEHIWGTVCGHEARPPPAPLPRGSSIPLHFWNVCASMMFVYLRHLKIYFRYEGK

SEQ ID NO: 750115 - protein, 616 aa, Homo sapiens
MVFSSHAREATEKMVSMKPPGFQASLARDGHMSGLGKAEAAPPGPGVPPHPPGTKSAASHQSSMTSLEGSGISERLPQKPLHRGGGPHLEETWMASPETDSGFVGSETSRVSPLTQTPEHRLSHISTAGTLAQPFAASVPRDGASYPKARGSLIPRRATEPSTPRSQAQRYLSSPSGPLRQRAPNFSLERTLAAEMAVPGSEFEGHKRISEQPLPNKTISPPPAPAPAAAPLPCGPTETIPSFLLTRAGRDQAICELQEEVSRLRLRLEDSLHQPLQGSPTRPASAFDRPARTRGRPADSPATWGSHYGSKSTERLPGEPRGEEQIVPPGRQRARSSSVPREVLRLSLSSESELPSLPLFSEKSKTTKDSPQAARDGKRGVGSAGWPDRVTFRGQYTGHEYHVLSPKAVPKGNGTVSCPHCRPIRTQDAGGAVTGDPLGPPPADTLQCPLCGQVGSPPEADGPGSATSGAEKATTRRKAPSTPSPKQRSKQAGSSPRPPPGLWYLATAPPAPAPPAFAYISSVPIMPYPPAAVYYAPAGPTSAQPAAKWPPTASPPPARRHRHSIQLDLGDLEELNKALSRAVQAAESVRSTTRQMRSSLSADLRQAHSLRGSCLF

SEQ ID NO: 750116 - protein, 135 aa, Homo sapiens
GRPRGARRAPARPPPRPPPGLWYLATAPPAPAPPAFAYISSVPIMPYPPAAVYYAPAGPTSAQPAAKWPPTASPPPARRHRHSIQLDLGDLEELNKALSRAVQAAESVRSTTRQMRSSLSADLRQAHSLRGSCLF

SEQ ID NO: 750117 - protein, 1084 aa, Homo sapiens
EAGLSLEGHGNTSPMALGHGQARGWVASGEQASGDKLSEHSEVNPSVELSPARSWSSGTVSLDHPSDSLDSTWEGETDGPQPTALAETLPEGPSHHLLSPDGRTGGSVARATPMEFQDSSAPPAQSPQHATDRWRRETTRFFCPQPKEHIWKQTKTSPKPLPSRFIGSISPLNPQPRPTRQGRPLPRQGATLAGRSSSNAPKYGRGQLNYPLPDFSKVGPRVRFPKDESYRPPKSRSHNRKPQAPARPLIFKSPAEIVQEVLLSSGEAALAKDTPPAHPITRVPQEFQTPEQATELVHQLQEDYHRLLTKYAEAENTIDQLRLGAKVNLFSDPPQPNHSIHTGMVPQGTKVLSFTIPQPRSAEWWPGPAEDPQASAASGWPSARGDLSPSSLTSMPTLGWLPENRDISEDQSSAEQTQALASQASQFLAKVESFERLIQAGRLMPQDQVKGFQRLKAAHAALEEEYLKACREQHPAQPLAGSKGTPGRFDPRRELEAEIYRLGSCLEELKEHIDQTQQEPEPPGSDSALDSTPALPCLHQPTHLPAPSGQAPMPAIKTSCPEPATTTAAASTGPCPLHVNVEVSSGNSEVEDRPQDPLARLRHKELQMEQVYHGLMERYLSVKSLPEAMRMEEEEEGEEEEEEEGGGDSLEVDGVAATPGKAEATRVLPRQCPVQAEKSHGAPLEEATEKMVSMKPPGFQASLARDGHMSGLGKAEAAPPGPGVPPHPPGTKSAASHQSSMTSLEGSGISERLPQKPLHRGGGPHLEETWMASPETDSGFVGSETSRVSPLTQTPEHRLSHISTAGTLAQPFAASVPRDGASYPKARGSLIPRRATEPSTPRSQAQRYLSSPSGPLRQRAPNFSLERTLAAEMAVPGSEFEGHKRISEQPLPNKTISPPPAPAPAAAPLPCGPTETIPSFLLTRAGRDQAICELQEEVSRLRLRLEDSLHQPLQGSPTRPASAFDRPARTRGRPADSPATWGSHYGSKSTERLPGEPRGEEQIVPPGRQRARSSSVPREVLRLSLSSESELPSLPLFSEKSKTTKDSPQAARDGKRGVGSAGWPDRVTFRGQYTGRSGGRAGMG

SEQ ID NO: 750118 - protein, 124 aa, Homo sapiens
EDYGTDCDNMRVTAFLDIPGQDNLPPLTRLEKYAFSENTFNRQIIARGLLDIFRDFGNNEEDFLTVMEIVVRLSEDAEPTVRTELMEQIPPIAIFLQENRSNFPVVLSEYLIPIVVRYLTDPNN

SEQ ID NO: 750119 - protein, 193 aa, Homo sapiens
GGQPPAAGSRGVGADLETGMGGLRLLAVALTCCWWPQGSQGKTLRGSFSSTAAQDAQGQRIGHFEFHGDHALLCVRINNIAVAVGKEAKLYLFQAQEWLKLQQSSHGYSCSEKLSKAQLTMTMNQTEHNLTVSQIPSPQTWHVFYADKYTCQDDKENSQVEDIPFEMVLLNPDAEGNPFDHFSAGESVTPKME

SEQ ID NO: 750120 - protein, 459 aa, Homo sapiens
GGQPPAAGSRGVGADLETGMGGLRLLAVALTCCWWPQGSQGKTLRGSFSSTAAQDAQGQRIGHFEFHGDHALLCVRINNIAVAVGKEAKLYLFQAQEWLKLQQSSHGYSCSEKLSKAQLTMTMNQTEHNLTVSQIPSPQTWHVFYADKYTCQDDKENSQVEDIPFEMVLLNPDAEGNPFDHFSAGESGLHEFFFLLVLVYFVIACIYAQSLWQAIKKGGPMHMILKVLTTALLLQAGSALANYIHFSSYSKDGIGVPFMGSLAEFFDIASQIQMLYLLLSLCMGWTIVRMKKSQSRPLQWDSTPASTGIAVFIVMTQSVLLLWEQFEDISHHSYHSHHNLAGILLIVLRICLALSLGCGLYQIITVERSTLKREFYITFAKGCILWFLCHPVLACISVIFSDYQRDKVITIGVILCQSVSMVILYRLFLSHSLYWEVSSLSSVTLPLTISSGHKSRPHF

SEQ ID NO: 750121 - protein, 288 aa, Homo sapiens
GGQPPAAGSRGVGADLETGMGGLRLLAVALTCCWWPQGSQGKTLRGSFSSTAAQDAQGQRIGHFEFHGDHALLCVRINNIAVAVGKEAKLYLFQAQEWLKLQQSSHGYSCSEKLSKAQLTMTMNQTEHNLTVSQIPSPQTWHVFYADKYTCQDDKENSQVEDIPFEMVLLNPDAEGNPFDHFSAGESGLHEFFFLLVLVYFVIACIYAQSLWQAIKKGGPMHMILKVLTTALLLQAGSALANYIHFSSYSKDGIGVPFMGSLAECEYLSEHFLKSFYTRYLLFFYFLS

SEQ ID NO: 750122 - protein, 699 aa, Homo sapiens
MNLLPKSSREFGSVDYWEKFFQQRGKKAFEWYGTYLELCGVLHKYIKPREKVLVIGCGNSELSEQLYDVGYRDIVNIDISEVVIKQMKECNATRRPQMSFLKMDMTQMEFPDASFQVVLDKGTLDAVLTDEEEKTLQQVDRMLAEVGRVLQVGGRYLCISLAQAHILKKAVGHFSREGWMVRVHQVANSQDQVLEAEPQFSLPVFAFIMTKFRPVPGSALQIFELCAQEQRKPVRLESAERLAEAVQERQQYAWLCSQLRRKARLGSVSLDLCDGDTGEPRYTLHVVDSPTVKPSRDNHFAIFIIPQGRETEWLFGMDEGRKQLAASAGFRRLITVALHRGQQYESMDHIQAELSARVMELAPAGMPTQQQVPFLSVGGDIGVRTVQHQDCSPLSGDYVIEDVQGDDKRYFRRLIFLSNRNVVQSEARLLKDVSHKAQKKRKKDRKKQRPADAEDLPAAPGQSIDKSYLCCEHHKAMIAGLALLRNPELLLEIPLALLVVGLGGGSLPLFVHDHFPKSCIDAVEIDPSMLEVATQWFGFSQSDRMKVHIADGLDYIASLAGGGEARPCYDVIMFDVDSKDPTLGMSCPPPAFVEQSFLQKVKSILTPEGVFILNLVCRDLGLKDSVLAGLKAVFPLLYVRRIEGEVNEILFCQLHPEQKLATPELLETAQALERTLRKPGRGWDDTYVLSDMLKTVKIV

SEQ ID NO: 750123 - protein, 613 aa, Homo sapiens
MKECNATRRPQMSFLKMDMTQMEFPDASFQVVLDKGTLDAVLTDEEEKTLQQVDRMLAEVGRVLQVGGRYLCISLAQAHILKKAVGHFSREGWMVRVHQVANSQDQVLEAEPQFSLPVFAFIMTKFRPVPGSALQIFELCAQEQRKPVRLESAERLAEAVQERQQYAWLCSQLRRKARLGSVSLDLCDGDTGEPRYTLHVVDSPTVKPSRDNHFAIFIIPQGRETEWLFGMDEGRKQLAASAGFRRLITVALHRGQQYESMDHIQAELSARVMELAPAGMPTQQQVPFLSVGGDIGVRTVQHQDCSPLSGDYVIEDVQGDDKRYFRRLIFLSNRNVVQSEARLLKDVSHKAQKKRKKDRKKQRPADAEDLPAAPGQSIDKSYLCCEHHKAMIAGLALLRNPELLLEIPLALLVVGLGGGSLPLFVHDHFPKSCIDAVEIDPSMLEVATQWFGFSQSDRMKVHIADGLDYIASLAGGGEARPCYDVIMFDVDSKDPTLGMSCPPPAFVEQSFLQKVKSILTPEGVFILNLVCRDLGLKDSVLAGLKAVFPLLYVRRIEGEVNEILFCQLHPEQKLATPELLETAQALERTLRKPGRGWDDTYVLSDMLKTVKIV

SEQ ID NO: 750124 - protein, 698 aa, Homo sapiens
MRAFVVSREFGSVDYWEKFFQQRGKKAFEWYGTYLELCGVLHKYIKPREKVLVIGCGNSELSEQLYDVGYRDIVNIDISEVVIKQMKECNATRRPQMSFLKMDMTQMEFPDASFQVVLDKGTLDAVLTDEEEKTLQQVDRMLAEVGRVLQVGGRYLCISLAQAHILKKAVGHFSREGWMVRVHQVANSQDQVLEAEPQFSLPVFAFIMTKFRPVPGSALQIFELCAQEQRKPVRLESAERLAEAVQERQQYAWLCSQLRRKARLGSVSLDLCDGDTGEPRYTLHVVDSPTVKPSRDNHFAIFIIPQGRETEWLFGMDEGRKQLAASAGFRRLITVALHRGQQYESMDHIQAELSARVMELAPAGMPTQQQVPFLSVGGDIGVRTVQHQDCSPLSGDYVIEDVQGDDKRYFRRLIFLSNRNVVQSEARLLKDVSHKAQKKRKKDRKKQRPADAEDLPAAPGQSIDKSYLCCEHHKAMIAGLALLRNPELLLEIPLALLVVGLGGGSLPLFVHDHFPKSCIDAVEIDPSMLEVATQWFGFSQSDRMKVHIADGLDYIASLAGGGEARPCYDVIMFDVDSKDPTLGMSCPPPAFVEQSFLQKVKSILTPEGVFILNLVCRDLGLKDSVLAGLKAVFPLLYVRRIEGEVNEILFCQLHPEQKLATPELLETAQALERTLRKPGRGWDDTYVLSDMLKTVKIV

SEQ ID NO: 750125 - protein, 699 aa, Homo sapiens; identical to SEQ ID NO: 750122

SEQ ID NO: 750126 - protein, 223 aa, Homo sapiens [sequence omitted]

SEQ ID NO: 750127 - protein, 655 aa, Homo sapiens
MNLLPKSSREFGSVDYWEKFFQQRGKKAFEWYGTYLELCGVLHKYIKPREKVLVIGCGNSELSEQLYDVGYRDIVNIDISEVVIKQMKECNATRRPQMSFLKMDMTQMEFPDASFQVVLDKGTLDAVLTDEEEKTLQQVDRMLAEVGRVLQVGGRYLCISLAQAHILKKAVGHFSREGWMVRVHQVANSQDQVLEAEPQFSLPVFAFIMTKFRPVPGSALQIFELCAQEQRKPVRLESAERLAEAVQERQQYAWLCSQLRRKARLGSVSLDLCDGDTGEPRYTLHVVDSPTVKPSRDNHFAIFIIPQGRETEWLFGMDEGRKQLAASAGFRRLITVALHRGQQYESMDHIQAELSARVMELAPAGMPTQQQVPFLSVGGDIGVRTVQHQDCSPLSGDYVIEDVQGDDKRYFRRLIFLSNRNVVQSEARLLKDVSHKAQKKRKKDRKKQRPADAEDLPAAPGQSIDKSYLCCEHHKAMIAGLALLRNPELLLEIPLALLVVGLGGGSLPLFVHDHFPKSCIDAVEIDPSMLEVATQWFGFSQSDRMKVHIADGLDYIASLAGGGEARPCYDVIMFDVDSKDPTLGMSCPPPAFVEQSFLQKVKSILTPEGVFILNLVCRDLGLKDSVLAGLKAVFPLLYVRRIEGEVNEIPFKTLL

SEQ ID NO: 750128 - protein, 658 aa, Homo sapiens
MNLLPKSSREFGSVDYWEKFFQQRGKKAFEWYGTYLELCGVLHKYIKPREKVLVIGCGNSELSEQLYDVGYRDIVNIDISEVVIKQMKECNATRRPQMSFLKMDMTQMEFPDASFQVVLDKGTLDAVLTDEEEKTLQQVDRMLAEVGRVLQVGGRYLCISLAQAHILKKAVGHFSREGWMVRVHQVANSQDQVLEAEPQFSLPVFAFIMTKFRPVPGSALQIFELCAQEQRKPVRLESAERLAEAVQERQQYAWLCSQLRRKARLGSVSLDLCDGDTGEPRYTLHVVDSPTVKPSRDNHFAIFIIPQGRETEWLFGMDEGRKQLAASAGFRRLITVALHRGQQYESMDHIQAELSARVMELAPAGMPTQQQVPFLSVGGDIGVRTVQHQDCSPLSGDYVIEDVQGDDKRYFRRLIFLSNRNVVQSEARLLKDVSHKAQKKRKKDRKKQRPADAEDLPAAPGQSIDKSYLCCEHHKAMIAGLALLRNPELLLEIPLALLVVGLGGGSLPLFVHDHFPKSCIDAVEIDPSMLEVATQWFGFSQSDRMKVHIADGLDYIASLAGGGEARPCYDVIMFDVDSKDPTLGMSCPPPAFVEQSFLQKVKSILTPEGSPDPPPPAGSPWLQKNSVFCKTLQSYYCSLLRLDHVPIIQEISFKSVYQ

SEQ ID NO: 750129 - protein, 517 aa, Homo sapiens
MNLLPKSSREFGSVDYWEKFFQQRGKKAFEWYGTYLELCGVLHKYIKPREKVLVIGCGNSELSEQLYDVGYRDIVNIDISEVVIKQMKECNATRRPQMSFLKMDMTQMEFPDASFQVVLDKGTLDAVLTDEEEKTLQQVDRMLAEVGRVLQVGGRYLCISLAQAHILKKAVGHFSREGWMVRVHQVANSQDQVLEAEPQFSLPVFAFIMTKFRPVPGSALQIFELCAQEQRKPVRLESAERLAEAVQERQQYAWLCSQLRRKARLGSVSLDLCDGDTGEPRYTLHVVDSPTVKPSRDNHFAIFIIPQGRETEWLFGMDEGRKQLAASAGFRRLITVALHRGQQYESMDHIQAELSARVMELAPAGMPTQQQVPFLSVGGDIGVRTVQHQDCSPLSGDYVIEDVQGDDKRYFRRLIFLSNRNVVQSEARLLKDVSHKAQKKRKKDRKKQRPADAEDLPAAPGQSIDKSYLCCEHHKAMIAGLALLRNPELLLGERDATAFHRREHKDYRPKQLVSLAL

SEQ ID NO: 750130 - protein, 45 aa, Homo sapiens
MLFSICLSMLCILCKLITTVCFSPPVSLGQELVFSSKPILVFHMS

SEQ ID NO: 750131 - protein, 545 aa, Homo sapiens
MNLLPKSSREFGSVDYWEKFFQQRGKKAFEWYGTYLELCGVLHKYIKPREKVLVIGCGNSELSEQLYDVGYRDIVNIDISEVVIKQMKECNATRRPQMSFLKMDMTQMEFPDASFQVVLDKGTLDAVLTDEEEKTLQQVDRMLAEVGRVLQPQGRETEWLFGMDEGRKQLAASAGFRRLITVALHRGQQYESMDHIQAELSARVMELAPAGMPTQQQVPFLSVGGDIGVRTVQHQDCSPLSGDYVIEDVQGDDKRYFRRLIFLSNRNVVQSEARLLKDVSHKAQKKRKKDRKKQRPADAEDLPAAPGQSIDKSYLCCEHHKAMIAGLALLRNPELLLEIPLALLVVGLGGGSLPLFVHDHFPKSCIDAVEIDPSMLEVATQWFGFSQSDRMKVHIADGLDYIASLAGGGEARPCYDVIMFDVDSKDPTLGMSCPPPAFVEQSFLQKVKSILTPEGVFILNLVCRDLGLKDSVLAGLKAVFPLLYVRRIEGEVNEILFCQLHPEQKLATPELLETAQALERTLRKPGRGWDDTYVLSDMLKTVKIV

SEQ ID NO: 750132 - protein, 699 aa, Homo sapiens; identical to SEQ ID NO: 750122

SEQ ID NO: 750133 - protein, 644 aa, Homo sapiens
MNLLPKSSREFGSVDYWEKFFQQRGKKAFEWYGTYLELCGVLHKYIKPREKVLVIGCGNSELSEQLYDVGYRDIVNIDISEVVIKQMKECNATRRPQMSFLKMDMTQMEFPDASFQVVLDKGTLDAVLTDEEEKTLQQVDRMLAEVGRVLQVGGRYLCISLAQAHILKKAVGHFSREGWMVRVHQVANSQDQVLEAEPQFSLPVFAFIMTKFRPVPGSALQIFELCAQEQRKPVRLESAERLAEAVQERQQYAWLCSQLRRKARLGSVSLDLCDGDTGEPRYTLHVVDSPTVKPSRDNHFAIFIIPQGRETEWLFGMDEGRKQLAASAGFRRLITVALHRGQQYESMDHIQAELSARVMELAPAGMPTQQQVPFLSVGGDIGVRTVQHQDCSPLSGDYVIEDVQGDDKRYFRRLIFLSNRNVVQSEARLLKDVSHKEIPLALLVVGLGGGSLPLFVHDHFPKSCIDAVEIDPSMLEVATQWFGFSQSDRMKVHIADGLDYIASLAGGGEARPCYDVIMFDVDSKDPTLGMSCPPPAFVEQSFLQKVKSILTPEGVFILNLVCRDLGLKDSVLAGLKAVFPLLYVRRIEGEVNEILFCQLHPEQKLATPELLETAQALERTLRKPGRGWDDTYVLSDMLKTVKIV

SEQ ID NO: 750134 - protein, 682 aa, Homo sapiens
MNLLPKSSREFGSVDYWEKFFQQRGKKAFEWYGTYLELCGVLHKYIKPREKVLVIGCGNSELSEQLYDVGYRDIVNIDISEVVIKQMKECNATRRPQMSFLKMDMTQMEFPDASFQVVLDKGTLDAVLTDEEEKTLQQVDRMLAEVGRVLQVGGRYLCISLAQAHILKKAVGHFSREGWMVRVHQVANSQDQVLEAEPQFSLPVFAFIMTKFRPVPGSALQIFELCAQEQRKPVRLESAERLAEAVQERQQYAWLCSQLRRKARLGSVSLDLCDGDTGEPRYTLHVVDSPTVKPSRDNHFAIFIIPQGRETEWLFGMDEGRKQLAASAGFRRLITVALHRGQQYESMDHIQAELSARVMELAPAGMPTQQQVPFLSVGGDIGVRTVQHQDCSPLSGDYVIEDVQGDDKRYFRRLIFLSNRNVVQSEARLLKDVSHKAQKKRKKDRKKQRPADAEDLPAAPGQSIDKSYLCCEHHKAMIAGLALLRNPELLLEIPLALLVVGLGGGSLPLFVHDHFPKSCIDAVEIDPSMLEVATQWFGFSQSDRMKVHIADGLDYIASLAGGGEARPCYDVIMFDVDSKDPTLGMSCPPPAFVEQSFLQKVKSILTPEGVFILNLVCRDLGLKDSVLAGLKAVFPLLYVRRIEGEVNEILFCQLHPEQKLPALGEKNLKQALERTLRQPGTR

SEQ ID NO: 750135 - protein, 623 aa, Homo sapiens [sequence omitted]

SEQ ID NO: 750136 - protein, 103 aa, Homo sapiens
SYRTLYPSRLLNVCLFSTLFEIVLLIKDSVLAGLKAVFPLLYVRRIEGEVNEILFCQLHPEQKLATPELLETAQALERTLRKPGRGWDDTYVLSDMLKTVKIV

SEQ ID NO: 750137 - protein, 113 aa, Homo sapiens
MAYPDLQPHTRTRWQLWPTYSFAFAWFLPSLPHTTNTFIDLPGAQHLAAASAWGLFDSSLYERFEASFLGLCICSPDPVTCSSSCRCPSPFWFVQGAAALHSCSSVWYHRIWF

SEQ ID NO: 750138 - protein, 211 aa, Homo sapiens
MISRMEKMTMMMKILIMFALGMNYWSCSGFPVYDYDPSSLRDALSASVVKVNSQSLSPYLFRAFRSSLKRVEVLDENNLVMNLEFSIRETTCRKDSGEDPATCAFQRDYYVSTAVCRSTVKVSAQQVQGVHARCSWSSSTSESYSSEEMIFGDMLGSHKWRNNYLFGLISDESISEQFYDRSLGIMRRVLPPGNRRYPNHRHRARINTDFE

SEQ ID NO: 750139 - protein, 85 aa, Homo sapiens
DFQNGEDDDDDEDIDYVCSWNELLVLLRFPSVRLRSILLKGCPQCLCGKSEFPVTESVSVSGIQKLIKKIDKWDLIKLKSFCTAK

SEQ ID NO: 750140 - protein, 211 aa, Homo sapiens; identical to SEQ ID NO: 750138

SEQ ID NO: 750141 - protein, 586 aa, Homo sapiens
MTCFGGSPGHRRRKLEPSDFLLFTFQRLELGRKPEHTGTLACGVTSLPAVFPGQVRRTLFITGLPRDARKETVESHFRDAYPTCEVVDVQLCYNVAKLIYLCKEKKKTEKSLTYYTNLQVKTGQRTLINPKPCGQFCCCEVLGCEWEDAISYYTRMKDRLLERITEEERHVQDQPLGMAFVTFQEKSMATYILKDFNACKCQSLQCKGEPQPSSHSRELYTSKWTVTFAADPEDICWKNLSIQGLRWWLQWLGINFTLFLGLFFLTTPSIILSTMDKFNVTKPIHALNNPIISQFFPTLLLWSFSALLPSIVYYSTLLESHWTKSGENQIMMTKVYIFLIFMVLILPSLGLTSLDFFFRWLFDKTSSEASIRLECVFLPDQGAFFVNYVIASAFIGNGMELLRLPGLILYTFRMIMAKTAADRRNVKQNQAFQYEFGAMYAWMLCVFTVIVAYSITCPIIAPFGLIYILLKHMVDRHNLYFVYLPAKLEKGIHFAAVNQALAAPILCLFWLYFFSFLRLGMKAPATLFTFLVLLLTILVCLAHTCFGCFKHLSPLNYKTEEPASDKGSEAEAHMPPPFTITWQASL

SEQ ID NO: 750142 - protein, 607 aa, Homo sapiens
MTCFGGSPGHRRRKLEPSDFLLFTFQRLELGRKPEHTGTLACGVTSLPAVFPGQVRRTLFITGLPRDARKETVESHFRDAYPTCEVVDVQLCYNVAKLIYLCKEKKKTEKSLTYYTNLQVKTGQRTLINPKPCGQFCCCEVLGCEWEDAISYYTRMKDRLLERITEEERHVQDQPLGMAFVTFQEKSMATYILKDFNACKCQSLQCKGEPQPSSHSRELYTSKWTVTFAADPEDICWKNLSIQGLRWWLQWLGINFTLFLGLFFLTTPSIILSTMDKFNVTKPIHALNNPIISQFFPTLLLWSFSALLPSIVYYSTLLESHWTKSGENQIMMTKVYIFLIFMVLILPSLGLTSLDFFFRWLFDKTSSEASIRLECVFLPDQGAFFVNYVIASAFIGNGMELLRLPGLILYTFRMIMAKTAADRRNVKQNQAFQYEFGAMYAWMLCVFTVIVAYSITCPIIAPFGLIYILLKHMVDRHNLYFVYLPAKLEKGIHFAAVNQALAAPILCLFWLYFFSFLRLGMKAPATLFTFLVLLLTILVCLAHTCFGCFKHLSPLNYKTEEPASDKGSEAEAHMPPPFTPYVPRILNGLASERTALSPQQQQQQTYG

SEQ ID NO: 750143 - protein, 445 aa, Homo sapiens
MTCFGGSPGHRRRKLEPSDFLLFTFQRLELGRKPEHTGTLACGVTSLPAVFPGQVRRTLFITGLPRDARKETVESHFRDAYPTCEVVDVQLCYNVAKLIYLCKEKKKTEKSLTYYTNLQVKTGQRTLINPKPCGQFCCCEVLGCEWEDAISYYTRMKDRLLERITEEERHVQDQPLGMAFVTFQEKSMATYILKDFNACKCQSLQCKGEPQPSSHSRELYTSKWTVTFAADPEDICWKNLSIQGLRWWLQWLGINFTLFLGLFFLTTPSIILSTMDKFNVTKPIHALNNPIISQFFPTLLLWSFSALLPSIVYYSTLLESHWTKSGENQIMMTKVYIFLIFMVLILPSLGLTSLDFFFRWLFDKTSSEASIRLECVFLPDQGAFFVNYVIASAFIGNGMELLRLPGLILYTFRMIMAKTAADRRNVKQNQPSSTSLDHSLAAISR

SEQ ID NO: 750144 - protein, 324 aa, Homo sapiens
MTCFGGSPGHRRRKLEPSDFLLFTFQRLELGRKPEHTGTLACGVTSLPAVFPGQVRRTLFITGLPRDARKETVESHFRDAYPTCEVVDVQLCYNVAKLIYLCKEKKKTEKSLTYYTNLQVKTGQRTLINPKPCGQFCCCEVLGCEWEDAISYYTRMKDRLLERITEEERHVQDQPLGMAFVTFQEKSMATYILKDFNACKCQSLQCKGEPQPSSHSRELYTSKWTVTFAADPEDICWKNLSIQGLRWWLQWLGINFTLFLGLFFLTTPSIILSTMDKFNVTKPIHALNNPIISQFFPTLLLWSFSALLPSIVYYSTLLESHWTK

SEQ ID NO: 750145 - protein, 312 aa, Homo sapiens
MDKFNVTKPIHALNNPIISQFFPTLLLWSFSALLPSIVYYSTLLESHWTKSGENQIMMTKVYIFLIFMVLILPSLGLTSLDFFFRWLFDKTSSEASIRLECVFLPDQGAFFVNYVIASAFIGNGMELLRLPGLILYTFRMIMAKTAADRRNVKQNQAFQYEFGAMYAWMLCVFTVIVAYSITCPIIAPFGLIYILLKHMVDRHNLYFVYLPAKLEKGIHFAAVNQALAAPILCLFWLYFFSFLRLGMKAPATLFTFLVLLLTILVCLAHTCFGCFKHLSPLNYKTEEPASDKGSEAEAHMPPPFTITWQASL

SEQ ID NO: 750146 - protein, 237 aa, Homo sapiens
MTCFGGSPGHRRRKLEPSDFLLFTFQRLELGRKPEHTGTLACGVTSLPAVFPGQVRRTLFITGLPRDARKETVESHFRDAYPTCEVVDVQLCYNVAKLIYLCKEKKKTEKSLTYYTNLQVKTGQRTLINPKPCGQFCCCEVLGCEWEDAISYYTRMKDRLLERITEEERHVQDQPLGMAFVTFQEKSMATYILKDFNACKCQSLQCKGEPQPSSHSRELYTSKWTVTFAADPEDICW

SEQ ID NO: 750147 - protein, 58 aa, Homo sapiens
AWGHVIPMGCVLWQEDAISYYTRMKDRLLERITEEERHVQDQPLGMAFVTFQEKSMAT

SEQ ID NO: 750148 - protein, 613 aa, Homo sapiens
MAEGTAEAPLENGGGGDSGAGALERGVAPIKRQYLTTKEQFHQFLEAKGQEKTCRETEVGDPAGNELAEPEAKRIRLEDGQTADGQTEEAAEPGEQLQTQKRARGQNKGRPHVKPTNYDKNRLCPSLIQESAAKCFFGDRCRFLHDVGRYLETKPADLGPRCVLFETFGRCPYGVTCRFAGAHLGPEGQNLVQEELAARGTQPPSIRNGLDKALQQQLRKREVRFERAEQALRRFSQGPTPAAAVPEGTAAEGAPRQENCGAQQVPAGPGTSNPPSSPVRTCGPLTDEDVVRLRPCEKKRLDIRGKLYLAPLTTCGNLPFRRICKRFGADVTCGEMAVCTNLLQGQMSEWALLKRHQCEDIFGVQLEGAFPDTMTKCAELLSRTVEVDFVDINVGCPIDLVYKKGGGCALMNRSTKFQQIVRGMNQVLDVPLTVKIRTGVQERVNLAHRLLPELRDWGVALVTLHGRSREQRYTKLADWQYIEECVQAASPMPLFGNGDILSFEDANRAMQTGVTGIMIARGALLKPWLFTEIKEQRHWDISSSERLDICGTSPTTAWSTGARTRRAWRRPGAFCSSGCPSCAGTCPWGCWSGSHRGSTSGRPTTWAATTWRR

SEQ ID NO: 750149 - protein, 604 aa, Homo sapiens
MRGRESLRCGGDRSDLDESAPLASYLTTKEQFHQFLEAKGQEKTCRETEVGDPAGNELAEPEAKRIRLEDGQTADGQTEEAAEPGEQLQTQKRARGQNKGRPHVKPTNYDKNRLCPSLIQESAAKCFFGDRCRFLHDVGRYLETKPADLGPRCVLFETFGRCPYGVTCRFAGAHLGPEGQNLVQEELAARGTQPPSIRNGLDKALQQQLRKREVRFERAEQALRRFSQGPTPAAAVPEGTAAEGAPRQENCGAQQVPAGPGTSNPPSSPVRTCGPLTDEDVVRLRPCEKKRLDIRGKLYLAPLTTCGNLPFRRICKRFGADVTCGEMAVCTNLLQGQMSEWALLKRHQCEDIFGVQLEGAFPDTMTKCAELLSRTVEVDFVDINVGCPIDLVYKKGGGCALMNRSTKFQQIVRGMNQVLDVPLTVKIRTGVQERVNLAHRLLPELRDWGVALVTLHGRSREQRYTKLADWQYIEECVQAASPMPLFGNGDILSFEDANRAMQTGVTGIMIARGALLKPWLFTEIKEQRHWDISSSERLDICGTSPTTAWSTGARTRRAWRRPGAFCSSGCPSCAGTCPWGCWSGSHRGSTSGRPTTWAATTWRR

SEQ ID NO: 750150 - protein, 559 aa, Homo sapiens
RLVRGRWLIGRGLAEPEAKRIRLEDGQTADGQTEEAAEPGEQLQTQKRARGQNKGRPHVKPTNYDKNRLCPSLIQESAAKCFFGDRCRFLHDVGRYLETKPADLGPRCVLFETFGRCPYGVTCRFAGAHLGPEGQNLVQEELAARGTQPPSIRNGLDKALQQQLRKREVRFERAEQALRRFSQGPTPAAAVPEGTAAEGAPRQENCGAQQVPAGPGTSNPPSSPVRTCGPLTDEDVVRLRPCEKKRLDIRGKLYLAPLTTCGNLPFRRICKRFGADVTCGEMAVCTNLLQGQMSEWALLKRHQCEDIFGVQLEGAFPDTMTKCAELLSRTVEVDFVDINVGCPIDLVYKKGGGCALMNRSTKFQQIVRGMNQVLDVPLTVKIRTGVQERVNLAHRLLPELRDWGVALVTLHGRSREQRYTKLADWQYIEECVQAASPMPLFGNGDILSFEDANRAMQTGVTGIMIARGALLKPWLFTEIKEQRHWDISSSERLDICGTSPTTAWSTGARTRRAWRRPGAFCSSGCPSCAGTCPWGCWSGSHRGSTSGRPTTWAATTWRR

SEQ ID NO: 750151 - protein, 184 aa, Homo sapiens
RLCLSLSLSAWLSWSLPLCISLSASYPAWRLLPQLHGRSREQRYTKLADWQYIEECVQAASPMPLFGNGDILSFEDANRAMQTGVTGIMIARGALLKPWLFTEIKEQRHWDISSSERLDICGTSPTTAWSTGARTRRAWRRPGAFCSSGCPSCAGTCPWGCWSGSHRGSTSGRPTTWAATTWRR

SEQ ID NO: 750152 - protein, 160 aa, Homo sapiens
FRIPIATTRAAALGHLVVRAPGHLRDFTNYGLEHWGSDTQGVEKTRRFLLEWLSFLCRYVPVGLLERLPQRINERPPYYLGRDYLETLMASQKAADWIRIRCLGGLELGSCSRGPGVTEGTLQVLGLTSLFHLLSHSEMLLGPVPPSFAFLPKHKANAYK

SEQ ID NO: 750153 - protein, 222 aa, Homo sapiens
MAEGTAEAPLENGGGGDSGAGALERGVAPIKRQYLTTKEQFHQFLEAKGQEKTCRETEVGDPAGNELAEPEAKRIRLEDGQTADGQTEEAAEPGEQLQIGHAGRGEDPALSARVAVLPVPVRARGAAGAAPTEDQRAAALLPGPRLPGDADGQPEGSRLDPHQVPGWAGVGELQSGARGHGGYFAGPGPDLAFHLLSHSEMLLGPVPPSFAFLPKHKANAYK

SEQ ID NO: 750154 - protein, 685 aa, Homo sapiens
MAEGTAEAPLENGGGGDSGAGALERGVAPIKRQYLTTKEQFHQFLEAKGQEKTCRETEVGDPAGNELAEPEAKRIRLEDGQTADGQTEEAAEPGEQLQTQKRARGQNKGRPHVKPTNYDKNRLCPSLIQESAAKCFFGDRCRFLHDVGRYLETKPADLGPRCVLFETFGRCPYGVTCRFAGAHLGPEGQNLVQEELAARGTQPPSIRNGLDKALQQQLRKREVRFERAEQALRRFSQGPTPAAAVPEGTAAEGAPRQENCGAQQVPAGPGTSNPPSSPVRTCGPLTDEDVVRLRPCEKKRLDIRGKLYLAPLTTCGNLPFRRICKRFGADVTCGEMAVCTNLLQGQMSEWALLKRHQCEDIFGVQLEGAFPDTMTKCAELLSRTVEVDFVDINVGCPIDLVYKKGGGCALMNRSTKFQQIVRGMNQVLDVPLTVKIRTGVQERVNLAHRLLPELRDWGVALVTLHGRSREQRYTKLADWQYIEECVQAASPMPLFGNGDILSFEDANRAMQTGVTGIMIARGALLKPWLFTEIKEQRHWDISSSERLDICGTSPTTAWSTGARTRRAWRRPGAFCSSGCPSCAGTSRGAAGAAPTEDQRAAALLPGPRLPGDADGQPEGSRLDPHQVPGWAGVGELQSGARGHGGYFAGPGPDLAFHLLSHSEMLLGPVPPSFAFLPKHKANAYK

SEQ ID NO: 750155 - protein, 310 aa, Homo sapiens
MRGRESLRCGGDRSDLDESAPLASYLTTKEQFHQFLEAKGQEKTCRETEVGDPAGNELAEPEAKRIRLEDGQTADGQTEEAAEPGEQLQTQKRARGQNKGRPHVKPTNYDKNRLCPSLIQESAAKCFFGDRCRFLHDVGRYLETKWRPAQAVALHGDQGAAALGHLVVRAPGHLRDFTNYGLEHWGSDTQGVEKTRRFLLEWLSFLCRYVPVGLLERLPQRINERPPYYLGRDYLETLMASQKAADWIRIRCLGGLELGSCSRGPGVTEGTLQVLGLTSLFHLLSHSEMLLGPVPPSFAFLPKHKANAYK

SEQ ID NO: 750156 - protein, 313 aa, Homo sapiens
MRGRESLRCGGDRSDLDESAPLASYLTTKEQFHQFLEAKGQEKTCRETEVGDPAGNELAEPEAKRIRLEDGQTADGQTEEAAEPGEQLQTQKRARGQNKGRPHVKPTNYDKNRLCPSLIQESAAKCFFGDRCRFLHDVGRYLETKPADLGPRCVLFETFGRCPYGVTCRFAGAHLGPEGLHQLRPGALGLGHAGRGEDPALSARVAVLPVPVRARGAAGAAPTEDQRAAALLPGPRLPGDADGQPEGSRLDPHQVPGWAGVGELQSGARGHGGYFAGPGPDLAFHLLSHSEMLLGPVPPSFAFLPKHKANAYK

SEQ ID NO: 750157 - protein, 90 aa, Homo sapiens
MGAEEKAGARRRGGGVTSHLPKGLSPTPPTPPSRCHLHTGEPWGQVGGGRLDSPVLSFSRGHVYLAQSQETGFSRLGTVAHAYNLRTLGG

SEQ ID NO: 750158 - protein, 605 aa, Homo sapiens
MAGLYSLGVSVFSDQGGRKYMEDVTQIVVEPEPTAEEKPSPRRSLSQPLPPRPSPAALPGGEVSGKGPAVAAREARDPLPDAGASPAPSRCCRRRSSVAFFAVCDGHGGREAAQFAREHLWGFIKKQKGFTSSEPAKVCAAIRKGFLACHLAMWKKLAEWPKTMTGLPSTSGTTASVVIIRGMKMYVAHVGDSGVVLGIQDDPKDDFVRAVEVTQDHKPELPKERERIEGLGGSVMNKSGVNRVVWKRPRLTHNGPVRRSTVIDQIPFLAVARALGDLWSYDFFSGEFVVSPEPDTSVHTLDPQKHKYIILGSDGLWNMIPPQDAISMCQDQEEKKYLMGEHGQSCAKMLVNRALGRWRQRMLRADNTSAIVICISPEVDNQGNFTNEDELYLNLTDSPSYNSQETCVMTPSPCSTPPVKSLEEDPWPRVNSKDHIPALVRSNAFSENFLEVSAEIARENVQGVVIPSKDPEPLEENCAKALTLRIHDSLNNSLPIGLVPTNSTNTVMDQKNLKMSTPGQMKAQEIERTPPTNFKRTLEESNSGPLMKKHRRNGLSRSSGAQPASLPTTSQRKNSVKLTMRRRLRGQKKIGNPLLHQHRKTVCVC

SEQ ID NO: 750159 - protein, 385 aa, Homo sapiens
SPYCILRIEGLGGSVMNKSGVNRVVWKRPRLTHNGPVRRSTVIDQIPFLAVARALGDLWSYDFFSGEFVVSPEPDTSVHTLDPQKHKYIILGSDGLWNMIPPQDAISMCQDQEEKKYLMGEHGQSCAKMLVNRALGRWRQRMLRADNTSAIVICISPEVDNQGNFTNEDELYLNLTDSPSYNSQETCVMTPSPCSTPPVKSLEEDPWPRVNSKDHIPALVRSNAFSENFLEVSAEIARENVQGVVIPSKDPEPLEENCAKALTLRIHDSLNNSLPIGLVPTNSTNTVMDQKNLKMSTPGQMKAQEIERTPPTNFKRTLEESNSGPLMKKHRRNGLSRSSGAQPASLPTTSQRKNSVKLTMRRRLRGQKKIGNPLLHQHRKTVCVC

SEQ ID NO: 750160 - protein, 113 aa, Homo sapiens
SYLFYLLIFQSLEEDPWPRVNSKDHIPALVRSNAFSENFLEVSAEIARENVQGVVIPSKDPEPLEENCAKALTLRIHDSLNNSLPIGLVPTNSTNTVMDQKNLKMSTPGQMKA

SEQ ID NO: 750161 - protein, 605 aa, Homo sapiens; identical to SEQ ID NO: 750158

SEQ ID NO: 750162 - protein, 504 aa, Homo sapiens
MAGLYSLGVSVFSDQGGRKYMEDVTQIVVEPEPTAEEKPSPRRSLSQPLPPRPSPAALPGGEVSGKGPAVAAREARDPLPDAGASPAPSRCCRRRSSVAFFAVCDGHGGREAAQFAREHLWGFIKKQKGFTSSEPAKVCAAIRKGFLACHLAMWKKLAEWPKTMTGLPSTSGTTASVVIIRGMKMYVAHVGDSGVVLGIQDDPKDDFVRAVEVTQDHKPELPKERERIEGLGGSVMNKSGVNRVVWKRPRLTHNGPVRRSTVIDQIPFLAVARALGDLWSYDFFSGEFVVSPEPDTSVHTLDPQKHKYIILGSDGLWNMIPPQDAISMCQDQEEKKYLMGEHGQSCAKMLVNRALGRWRQRMLRADNTSAIVICISPEVDNQGNFTNEDELYLNLTDSPSYNSQETCVMTPSPCSTPPVKSLEEDPWPRVNSKDHIPALVRSNAFSENFLEVSAEIARENVQGVVIPSKDPEPLEENWKSFTSSTQENCLCLLKCIWEMRFFQT

SEQ ID NO: 750163 - protein, 198 aa, Homo sapiens
MSPYPYVLDQQLMSLEEDPWPRVNSKDHIPALVRSNAFSENFLEVSAEIARENVQGVVIPSKDPEPLEENCAKALTLRIHDSLNNSLPIGLVPTNSTNTVMDQKNLKMSTPGQMKAQEIERTPPTNFKRTLEESNSGPLMKKHRRNGLSRSSGAQPASLPTTSQRKNSVKLTMRRRLRGQKKIGNPLLHQHRKTVCVC

SEQ ID NO: 750164 - protein, 482 aa, Homo sapiens
MAGLYSLGVSVFSDQGGRKYMEDVTQIVVEPEPTAEEKPSPRRSLSQPLPPRPSPAALPGGEVSGKGPAVAAREARDPLPDAGASPAPSRCCRRRSSVAFFAVCDGHGGREAAQFAREHLWGFIKKQKGFTSSEPAKVCAAIRKGFLACHLAMWKKLAEWPKTMTGLPSTSGTTASVVIIRGMKMYVAHVGDSGVVLGIQDDPKDDFVRAVEVTQDHKPELPKERERIEGLGGSVMNKSGVNRVVWKRPRLTHNGPVRRSTVIDQIPFLAVARALGDLWSYDFFSGEFVVSPEPDTSVHTLDPQKHKYIILGSDGLWNMIPPQDAISMCQDQEEKKYLMGEHGQSCAKMLVNRALGRWRQRMLRADNTSAIVICISPEVDNQGNFTNEDELYLNLTDSPSYNSQETCVMTPSPCSTPPVKSLEEDPWPRVNSKDHIPALVRSNAFSENFLEVSAEIARENVQGVVIPSKDPEPLNIALDRTG

SEQ ID NO: 750165 - protein, 197 aa, Homo sapiens
MVEELNSGKVMYAFCRVKDPNSGLPKFVLINWTGEGVNDVRKGACASHVSTMASFLKGAHVTINARAEEDVEPECIMEKVAKASGANYSFHKESGRFQDVGPQAPVGSVYQKTNAVSEIKRVGKDSFWAKAEKEEENRRLEEKRRAEEAQRQLEQERRERELREAARREQRYQEQGGEASPQRDVGAAARSGFKEPK

SEQ ID NO: 750166 - protein, 258 aa, Homo sapiens
KGAGGARGRGGRVLSRNGPALQEAYVRVVTEKSPTDWALFTYEGNSNDIRVAGTGEGGLEEMVEELNSGKVMYAFCRVKDPNSGLPKFVLINWTGEGVNDVRKGACASHVSTMASFLKGAHVTINARAEEDVEPECIMEKVAKASGANYSFHKESGRFQDVGPQAPVGSVYQKTNAVSEIKRVGKDSFWAKAEKEEENRRLEEKRRAEEAQRQLEQERRERELREAARREQRYQEQGGEASPQRDVGAAARSGFKEPK

SEQ ID NO: 750167 - protein, 310 aa, Homo sapiens
MLDQLAGQLARTRGCGWPLPFPLPAVGRGFRMSEARLVGCQRGGPAGPGSYSSGAETAGRAMAANLSRNGPALQEAYVRVVTEKSPTDWALFTYEGNSNDIRVAGTGEGGLEEMVEELNSGKVMYAFCRVKDPNSGLPKFVLINWTGEGVNDVRKGACASHVSTMASFLKGAHVTINARAEEDVEPECIMEKVAKASGANYSFHKESGRFQDVGPQAPVGSVYQKTNAVSEIKRVGKDSFWAKAEKEEENRRLEEKRRAEEAQRQLEQERRERELREAARREQRYQEQGGEASPQRDVGAAARSGFKEPK

SEQ ID NO: 750168 - protein, 197 aa, Homo sapiens; identical to SEQ ID NO: 750165

SEQ ID NO: 750169 - protein, 310 aa, Homo sapiens; identical to SEQ ID NO: 750167

SEQ ID NO: 750170 - protein, 310 aa, Homo sapiens; identical to SEQ ID NO: 750167

SEQ ID NO: 750171 - protein, 309 aa, Homo sapiens
MWSLSASWRRWPRLQVPTTAFTRRVAASRTWDPRPQWALCTRRPMPCLRLKGLVKTASGPKQRRRRRTVGWRKSGGPRRHSGSWSRSAGSVSCVRLHAGSSAIRSRVARPAPRGTWEQQQEVVSRNRNEQESAVHPREIFKQKERAMSTTSISSPQPGKLRSPFLQKQLTQPETHFGREPAAAISRPRADLPAEEPAPSTPPCLVQAEEEAVYEEPPEQETFYEQPPLVQQQGAGSEHIDHHIQGQGLSGQGLCARALYDYQAADDTEISFDPENLITGIEVIDEGWWRGYGPDGHFGMFPANYVELIE

SEQ ID NO: 750172 - protein, 310 aa, Homo sapiens; identical to SEQ ID NO: 750167

SEQ ID NO: 750173 - protein, 310 aa, Homo sapiens; identical to SEQ ID NO: 750167

SEQ ID NO: 750174 - protein, 163 aa, Homo sapiens [sequence omitted]

SEQ ID NO: 750175 - protein, 251 aa, Homo sapiens
GSHLVASVDTALLWKSGGPRRHSGSWSRSAGSVSCVRLHAGSSAIRSRVARPAPRGTWEQQQEVVSRNRNEQESAVHPREIFKQKERAMSTTSISSPQPGKLRSPFLQKQLTQPETHFGREPAAAISRPRADLPAEEPAPSTPPCLVQAEEEAVYEEPPEQETFYEQPPLVQQQGAGSEHIDHHIQGQGLSGQGLCARALYDYQAADDTEISFDPENLITGIEVIDEGWWRGYGPDGHFGMFPANYVELIE

SEQ ID NO: 750176 - protein, 278 aa, Homo sapiens
DRVGFLSDLRLKGLVKTASGPKQRRRRRTVGWRKSGGPRRHSGSWSRSAGSVSCVRLHAGSSAIRSRVARPAPRGTWEQQQEVVSRNRNEQGSTCASLQESAVHPREIFKQKERAMSTTSISSPQPGKLRSPFLQKQLTQPETHFGREPAAAISRPRADLPAEEPAPSTPPCLVQAEEEAVYEEPPEQETFYEQPPLVQQQGAGSEHIDHHIQGQGLSGQGLCARALYDYQAADDTEISFDPENLITGIEVIDEGWWRGYGPDGHFGMFPANYVELIE

SEQ ID NO: 750177 - protein, 310 aa, Homo sapiens; identical to SEQ ID NO: 750167

SEQ ID NO: 750178 - protein, 374 aa, Homo sapiens
MTLGNSERRELFLAEFVTKVRVDHGGLAAGNLSCWSLLCAPHSISLSLCLGYGKWGCRWPSSHPGYSKTADTTCSSTRLTRCLQAPVCASTDSDFRKSNTEWPWPVVFPYFLSQLIRVSEEQICFWTTKKKNKTKNLLQATHIMQYEDTNRHREERQHGPQKRNPGTKHEQRKPEGQNKQQHTQIERNRNNKTRNTQPLDIHPVATNMDFPGESIHAVLSSLEHRHTEECNKDKTRQDEDHESNQEAQNKPSTDSDNTREHKNTTQRHKHKQCNETTTSYHLCSRGKGRGETEKEERQSRREKRCGGGRRERESWQWIYERRSDEDRERKRESYRQHGEERKRSEKEEGESREEGVRGEEREDRAGGGGGERVR

SEQ ID NO: 750179 - protein, 374 aa, Homo sapiens; identical to SEQ ID NO: 750178

SEQ ID NO: 750180 - protein, 374 aa, Homo sapiens
MTLGNSERRELFLAEFVTKVRVDHGGLAAGNLSCWSLLCAPHSISLSLCLGYGKWGCRWPSSHPGYSKTADTTCSSTRLTRCLQAPVCASTDSDFRKSNTEWPWPVVFPYFLSQLIRVSEEQICFWTTKKKNKTKNLLQATHIMQYEDTNRHREERQHGPQKRNPGTKHEQRKPEGQNKQQHTQIERNRNNKTRNTQPLDIHPVATNMDFPGESIHAVLSSLEHRHTEECNKDKTRQDEDHESNQEAQNKARTDSDNTREHKNTTQRHKHKQCNETTTSYHLCSRGKGRGETEKEERQSRREKRCGGGRRERESWQWIYERRSDEDRERKRESYRQHGEERKRSEKEEGESREEGVRGEEREDRAGGGGGERVR

SEQ ID NO: 750181 - protein, 139 aa, Homo sapiens
MVEELNSGKVMYAFCRVKDPNSGLPKFVLINWTGEGVNDVRKGACASHVSTMASFLKGAHVTINARAEEDVEPECIMEKVAKASGANYSFHKESGRFQDVGPQAPVGSVYQKTNAVSEIKRVGKDSFWAKAEMVTLRLG

SEQ ID NO: 750182 - protein, 109 aa, Homo sapiens
MVEELNSGKVMYAFCRVKDPNSGLPKFVLINWTGEGVNDVRKGACASHVSTMASFLKGAHVTINARAEEDVEPECIMEKVAKASGANYSFHKESGRFQDVGPQAPVCLN

SEQ ID NO: 750183 - protein, 167 aa, Homo sapiens
MLDQLAGQLARTRGCGWPLPFPLPAVGRGFRMSEARLVGCQRGGPAGPGSYSSGAETAGRAMAANLSRNGPALQEAYVRVVTEKSPTDWWAARRARVGPGLPQGALFTYEGNSNDIRVAGTGEGGLEEMVEELNSGKVMYAFCRVKDPNSGLPKFVLINWVCGACFI

SEQ ID NO: 750184 - protein, 72 aa, Homo sapiens
CLQAPVCASTDSDFRKSNTEWPWPVVFPYFLSQLIRVSEEQICFWTTKFPVWSTQARSSHLSCCSLNAPMWE

SEQ ID NO: 750185 - protein, 310 aa, Homo sapiens; identical to SEQ ID NO: 750167

SEQ ID NO: 750186 - protein, 310 aa, Homo sapiens; identical to SEQ ID NO: 750167

SEQ ID NO: 750187 - protein, 325 aa, Homo sapiens
MLDQLAGQLARTRGCGWPLPFPLPAVGRGFRMSEARLVGCQRGGPAGPGSYSSGAETAGRAMAANLSRNGPALQEAYVRVVTEKSPTDWWAARRARVGPGLPQGALFTYEGNSNDIRVAGTGEGGLEEMVEELNSGKVMYAFCRVKDPNSGLPKFVLINWTGEGVNDVRKGACASHVSTMASFLKGAHVTINARAEEDVEPECIMEKVAKASGANYSFHKESGRFQDVGPQAPVGSVYQKTNAVSEIKRVGKDSFWAKAEKEEENRRLEEKRRAEEAQRQLEQERRERELREAARREQRYQEQGGEASPQRDVGAAARSGFKEPK

SEQ ID NO: 750188 - protein, 197 aa, Homo sapiens; identical to SEQ ID NO: 750165

SEQ ID NO: 750189 - protein, 309 aa, Homo sapiens; identical to SEQ ID NO: 750171

SEQ ID NO: 750190 - protein, 309 aa, Homo sapiens; identical to SEQ ID NO: 750171

SEQ ID NO: 750191 - protein, 310 aa, Homo sapiens; identical to SEQ ID NO: 750167

SEQ ID NO: 750192 - protein, 265 aa, Homo sapiens
MPCLRLKGLVKTASGPKQRRRRRTVGWRKSGGPRRHSGSWSRSAGSVSCVRLHAGSSAIRSRVARPAPRGTWEQQQEVVSRNRNEQESAVHPREIFKQKERAMSTTSISSPQPGKLRSPFLQKQLTQPETHFGREPAAAISRPRADLPAEEPAPSTPPCLVQAEEEAVYEEPPEQETFYEQPPLVQQQGAGSEHIDHHIQGQGLSGQGLCARALYDYQAADDTEISFDPENLITGIEVIDEGWWRGYGPDGHFGMFPANYVELIE

SEQ ID NO: 750193 - protein, 284 aa, Homo sapiens
TKDPEDAAQDVDQASGSVTKTMPVEIKGWKDSFWAKQRRRRRTVGWRKSGGPRRHSGSWSRSAGSVSCVRLHAGSSAIRSRVARPAPRGTWEQQQEVVSRNRNEQESAVHPREIFKQKERAMSTTSISSPQPGKLRSPFLQKQLTQPETHFGREPAAAISRPRADLPAEEPAPSTPPCLVQAEEEAVYEEPPEQETFYEQPPLVQQQGAGSEHIDHHIQGQGLSGQGLCARALYDYQAADDTEISFDPENLITGIEVIDEGWWRGYGPDGHFGMFPANYVELIE

SEQ ID NO: 750194 - protein, 305 aa, Homo sapiens
MLDQLAGQLARTRGCGWPLPFPLPAVGRGFRMSEARLVGCQRGGPAGPGSYSSGAETAGRAMAANLSRNGPALQEAYVRVVTEKSPTDWALFTYEGNSNDIRVAGTGEGGLEEMVEELNSGKVMYAFCRVKDPNSGLPKFVLINWTGEGVNDVRKGACASHVSTMASFLKGAHVTINARAEEDVEPECIMEKVAKASGANYSFHKESGRFQDVGPQAPVGSVYQKTNAVSEIKRVGKDSFWAKAEKEEENRRLEEKRRAEEAQRQLEQERRERELREAARREQRYQEQGGEASPQRGTVNVENCF

SEQ ID NO: 750195 - protein, 269 aa, Homo sapiens
MLDQLAGQLARTRGCGWPLPFPLPAVGRGFRMSEARLVGCQRGGPAGPGSYSSGAETAGRAMAANLSRNGPALQEAYVRVVTEKSPTDWALFTYEGNSNDIRVAGTGEGGLEEMVEELNSGKVMYAFCRVKDPNSGLPKFVLINWTGEGVNDVRKGACASHVSTMASFLKGAHVTINARAEEDVEPECIMEKVAKASGANYSFHKESGRFQDVGPQAPVGSVYQKTNAVSEIKRVGKDSFWAKAEVSAAPGHAGHVGVFCLLWLIFPHK

SEQ ID NO: 750196 - protein, 222 aa, Homo sapiens
MLDQLAGQLARTRGCGWPLPFPLPAVGRGFRMSEARLVGCQRGGPAGPGSYSSGAETAGRAMAANLSRNGPALQEAYVRVVTEKSPTDWALFTYEGNSNDIRVAGTGEGGLEEMVEELNSGKVMYAFCRVKDPNSGLPKFVLINWTGEGVNDVRKGACASHVSTMASFLKGAHVTINARAEEDVEPECIMEKVAKASGANYSFHKESGRFQDVGPQAPVCLN

SEQ ID NO: 750197 - protein, 147 aa, Homo sapiens
MLDQLAGQLARTRGCGWPLPFPLPAVGRGFRMSEARLVGCQRGGPAGPGSYSSGAETAGRAMAANLSRNGPALQEAYVRVVTEKSPTDWWAARRARVGPGLPQGWVCLGRAGDSGGAGREAERCPGRWPGAYLSAPPHRSRSAVSPS

SEQ ID NO: 750198 - protein, 72 aa, Homo sapiens
PLVPVGWPSTWVQVSNECCPLQGSVYQKTNAVSEIKRVGKDSFWAKAEVSAAPGHAGHVGVFCLLWLIFPHK

SEQ ID NO: 750199 - protein, 131 aa, Homo sapiens
MKIFLPVLLAALLGVERASSLMCFSCLNQKSNLYCLKPTICSDQDNYCVTVSASAGIGNLVTFGHSLSKTCSPACPIPEGVNVGVASMGISCCQSFLCNFSAADGGLRASVTLLGAGLLLSLLPALLRFGP

SEQ ID NO: 750200 - protein, 131 aa, Homo sapiens; identical to SEQ ID NO: 750199

SEQ ID NO: 750201 - protein, 131 aa, Homo sapiens; identical to SEQ ID NO: 750199

SEQ ID NO: 750202 - protein, 131 aa, Homo sapiens; identical to SEQ ID NO: 750199

SEQ ID NO: 750203 - protein, 131 aa, Homo sapiens; identical to SEQ ID NO: 750199

SEQ ID NO: 750204 - protein, 131 aa, Homo sapiens; identical to SEQ ID NO: 750199

SEQ ID NO: 750205 - protein, 131 aa, Homo sapiens; identical to SEQ ID NO: 750199

SEQ ID NO: 750206 - protein, 131 aa, Homo sapiens; identical to SEQ ID NO: 750199

SEQ ID NO: 750207 - protein, 140 aa, Homo sapiens
MVRGWVVIGRGIFLPVLLAALLGVERASSLMCFSCLNQKSNLYCLKPTICSDQDNYCVTVSASAGIGNLVTFGHSLSKTCSPACPIPEGVNVGVASMGISCCQSFLCNFSAADGGLRASVTLLGAGLLLSLLPALLRFGP

SEQ ID NO: 750208 - protein, 77 aa, Homo sapiens
RGRAAAWEAPGQPRSRAREVRGARPGCWYLRPPGEQDRLLWFVTSRQDGHPLQNEDLLASAAGCPSGCGARRAICTA

SEQ ID NO: 750209 - protein, 131 aa, Homo sapiens; identical to SEQ ID NO: 750199

SEQ ID NO: 750210 - protein, 131 aa, Homo sapiens; identical to SEQ ID NO: 750199

SEQ ID NO: 750211 - protein, 131 aa, Homo sapiens; identical to SEQ ID NO: 750199

SEQ ID NO: 750212 - protein, 131 aa, Homo sapiens; identical to SEQ ID NO: 750199

SEQ ID NO: 750213 - protein, 131 aa, Homo sapiens; identical to SEQ ID NO: 750199

SEQ ID NO: 750214 - protein, 146 aa, Homo sapiens
RGRAAAWEAPGQPRSRAREVRGARPGCWYLRPPGEQDRLLWFVTSRQDGHPLQNEDLLASAAGCPSGCGASQLLPELSVQFQCGRWRAAGKRHPAGCRAAAEPAAGPAAVWPLTAQTLSPDPPAQEGKPSPFWIPQCMGAPDSSRA

SEQ ID NO: 750215 - protein, 106 aa, Homo sapiens
RGRAAAWEAPGQPRSRAREVRGARPGCWYLRPPGEQDRLLWFVTSRQDGHPLQNEDLLASAAGCPSGCGASQLADVLLLLEPEEQSVLPEADHLLRPGQLLRDCVC

SEQ ID NO: 750216 - protein, 132 aa, Homo sapiens
MRVGGHFVGSCPRSGVDDVTFLGGLRKGRGFPGVLRSNIRTKSHGHADRVPRETVSVGMCAWLCTWVCSARESTWRLLGAMFGEGGVPAAWRASVPVAPCPGTAACTSRAWQRCPRSGRIFLQDIKKPDCDD

SEQ ID NO: 750217 - protein, 131 aa, Homo sapiens; identical to SEQ ID NO: 750199

SEQ ID NO: 750218 - protein, 131 aa, Homo sapiens; identical to SEQ ID NO: 750199

SEQ ID NO: 750219 - protein, 131 aa, Homo sapiens; identical to SEQ ID NO: 750199

SEQ ID NO: 750220 - protein, 124 aa, Homo sapiens
LSRDDWSEHWPGSLKIVSSYIDHHFLYGDFGQSCSVYGPYVPNVGVIEGNWNLVTFGHSLSKTCSPACPIPEGVNVGVASMGISCCQSFLCNFSAADGGLRASVTLLGAGLLLSLLPALLRFGP

SEQ ID NO: 750221 - protein, 178 aa, Homo sapiens
MKIFLPVLLAALLGVERASSLMCFSCLNQKSNLYCLKPTICSDQDNYCVTVSASAGIGNLVTFGHSLSKTCSPACPIPEGVNVGVASMGISCCQSFLCNFSAADGGLRASVTLLAIPQLRKESPALSGSHSVWEPLTPHVPDLCPWSQVRAHPACTSDLPQPLPLPRSGASCPHFWGG

SEQ ID NO: 750222 - protein, 131 aa, Homo sapiens; identical to SEQ ID NO: 750199

SEQ ID NO: 750223 - protein, 131 aa, Homo sapiens; identical to SEQ ID NO: 750199

SEQ ID NO: 750224 - protein, 156 aa, Homo sapiens
MRVGGHFVGSCPRSGVDDVTFLGGLRKGRGFPGVLRSNIRTKSHGHADRVPRETVSVGMCAWLCTWVCSARESTWRLLGAMFGEGGVPAAWRASVPVAPCPGTAACTSRAWQRCPRSGIWTPPVLPASLPVQKSQQETNLNGLLVDKTASTCTFAH

SEQ ID NO: 750225 - protein, 69 aa, Homo sapiens
VALLEGQTVDHSGAGERKLHPKAMAGNLDLTAGKQKRGGRWAMMEFLTNALFLLKLTCASISGISSTSQ

SEQ ID NO: 750226 - protein, 276 aa, Homo sapiens
GSSAWRAPASASAPAPASPAAPRPRATKPPAKPAQLRVPGRGAMPCRREEEEEAGEEAEGEEEEDDSFLLLQQSVTLGSSGEVDRLVAQIGETLQLDAAQDSPASPCAPPGVPLRAPGPLAAAVPADKARPPAVPLLLPPASAETVGPAPSGALRCALGDRGRVRGRAAPYCVAEVAAGPSALPGPCRRGWLRDAVTSRRLQQRRWTQAGARAGDDDPHRLLQQLVLSGNLIKEAVRRLQRAVAAVAATGPASAPGPGGGRSGPDRIALQPSGSLL

SEQ ID NO: 750227 - protein, 276 aa, Homo sapiens; identical to SEQ ID NO: 750226

SEQ ID NO: 750228 - protein, 276 aa, Homo sapiens; identical to SEQ ID NO: 750226

SEQ ID NO: 750229 - protein, 276 aa, Homo sapiens; identical to SEQ ID NO: 750226

SEQ ID NO: 750230 - protein, 276 aa, Homo sapiens; identical to SEQ ID NO: 750226

SEQ ID NO: 750231 - protein, 149 aa, Homo sapiens
MCWTTVSHSMSHCLRGGSASFSHHFNQLHLNVVLIGMWPPLKSSTLVFLSDHSLTNALCALTSRRPLVLRHLHFLHLMNCLFRVLSELHALNHFATLPVCHPSCQEGSPVSAIPSSLIETPLLIPISSPFYSMGGVFQTGLLSPGPLLM

SEQ ID NO: 750232 - protein, 470 aa, Homo sapiens
SLRAPAEIAAQPMAGSPSRAAGRRLQLPLLCLFLQGATAVLFAVFVRYNHKTDAALWHRSNHSNADNEFYFRYPSFQDVHAMVFVGFGFLMVFLQRYGFSSVGFTFLLAAFALQWSTLVQGFLHSFHGGHIHVGVESMINADFCAGAVLISFGAVLGKTGPTQLLLMALLEVVLFGINEFVLLHLLGVRDAGGSMTIHTFGAYFGLVLSRVLYRPQLEKSKHRQGSVYHSDLFAMIGTIFLWIFWPSFNAALTALGAGQHRTALNTYYSLAASTLGTFALSALVGEDGRLDMVHIQNAALAGGVVVGTSSEMMLTPFGALAAGFLAGTVSTLGYKFFTPILESKFKVQDTCGVHNLHGMPGVLGALLGVLVAGLATHEAYGDGLESVFPLIAEGQRSATSQAMHQLFGLFVTLMFASVGGGLGGLLLKLPFLDSPPDSQHYEDQVHWQVPGEHEDKAQRPLRVEEADTQA

SEQ ID NO: 750233 - protein, 457 aa, Homo sapiens
SLRAPAEIAAQPMAGSPSRAAGRRLQLPLLCLFLQGATAVLFAVFVRYNHKTDAALWHRSNHSNADNEFYFRYPSFQDVHAMVFVGFGFLMVFLQRYGFSSVGFTFLLAAFALQWSTLVQGFLHSFHGGHIHVGVESMINADFCAGAVLISFGAVLGKTGPTQLLLMALLEVVLFGINEFVLLHLLGVRDAGGSMTIHTFGAYFGLVLSRVLYRPQLEKSKHRQGSVYHSDLFAMIGTIFLWIFWPSFNAALTALGAGQHRTALNTYYSLAASTLGTFALSALVGEDGRLDMVHIQNAALAGGVVVGTSSEMMLTPFGALAAGFLAGTVSTLGYKFFTPILESKFKVQDTCGVHNLHGMPGVLGALLGVLVAGLATHEAYGDGLESVFPLIAEGQRSATSQAMHQLFGLFVTLMFASVGGGLGDSQHYEDQVHWQVPGEHEDKAQRPLRVEEADTQA

SEQ ID NO: 750234 - protein, 140 aa, Homo sapiens
SLRAPAEIAAQPMAGSPSRAAGRRLQLPLLCLFLQGATAVLFAVFVRYNHKTDAALWHRSNHSNADNEFYFRYPKESHSVAQAGVQRRNLGSLQPSPPRFKRFTPLSLPRSWDYRHPPKHLDKFCIFSRDEVSPCWPGWS

SEQ ID NO: 750235 - protein, 291 aa, Homo sapiens
RVPRPQFRRKMAGSPELVVLDPPWDKELAAGTESQALVSATPREDFRVRCTSKRAVTEMLQLCGRFVQKLGDALPEEIREPALRDAQWTFESAVQENISINGQAWQEASDNCFMDSDIKVLEDQFDEIIVDIATKRKQYPRKILECVIKTIKAKQEILKQYHPVVHPLDLKYDPDPAPHMENLKCRGETVAKEISEAMKSLPALIEQGEGFSQVLRMQPVIHLQRIHQEVFSSCHRKPDAKPENFITQIETTPTETASRKTSDVVLKRKQTKDCPQRKWYPLRPKKINLDT

SEQ ID NO: 750236 - protein, 188 aa, Homo sapiens
RVPRPQFRRKMAGSPELVVLDPPWDKELAAGTESQALVSATPREDFRVRCTSKRAVTEMLQLCGRFVQKLGDALPEEIREPALRDAQWTFESAVQENISINGQAWQEASDNCFMDSDIKVLEDQFDEIIVDIATKRKQYPRKILECVIKTIKAKQEILKQYHPVVHPLDLKYDPDPGAKPGGLALGAV

SEQ ID NO: 750237 - protein, 232 aa, Homo sapiens
RVPRPQFRRKMAGSPELVVLDPPWDKELAAGTESQALVSATPREDFRVRCTSKRAVTEMLQLCGRFVQKLGDALPEEIREPALRDAQWTFESAVQENISINGQAWQEASDNCFMDSDIKVLEDQFDEIIVDIATKRKQYPRKILECVIKTIKAKQEILKQYHPVVHPLDLKYDPDPVLNGNAFNFSPFNMMLAVDLSYMVFITSSPAPDMEFLVIPRGNSLFGYSPCPVSLA

SEQ ID NO: 750238 - protein, 291 aa, Homo sapiens; identical to SEQ ID NO: 750235

SEQ ID NO: 750239 - protein, 291 aa, Homo sapiens; identical to SEQ ID NO: 750235

SEQ ID NO: 750240 - protein, 223 aa, Homo sapiens
RVPRPQFRRKMAGSPELVVLDPPWDKELAAGTESQALVSATPREDFRVRCTSKRAVTEMLQLCGRFVQKLGDALPEEIREPALRDAQWTFESAVQENISINGQAWQEASDNCFMDSDIKVLEDQFDEIIVDIATKRKQYPRKILECVIKTIKAKQEILKQYHPVVHPLDLKYDPDPVLNGNAFNFSPFNMMLAVDLSYMVFITSSPSYGKFEMQRGNSSKGDQ

SEQ ID NO: 750241 - protein, 211 aa, Homo sapiens
LTTVNLLQTFESAVQENISINGQAWQEASDNCFMDSDIKVLEDQFDEIIVDIATKRKQYPRKILECVIKTIKAKQEILKQYHPVVHPLDLKYDPDPAPHMENLKCRGETVAKEISEAMKSLPALIEQGEGFSQVLRMQPVIHLQRIHQEVFSSCHRKPDAKPENFITQIETTPTETASRKTSDVVLKRKQTKDCPQRKWYPLRPKKINLDT

SEQ ID NO: 750242 - protein, 242 aa, Homo sapiens
MGQGARGWHREPGLGLRHSPRRLSGALHLEAGCDRNATTVRPLRAKARGRSAGGDSGARSARCAVDSDIKVLEDQFDEIIVDIATKRKQYPRKILECVIKTIKAKQEILKQYHPVVHPLDLKYDPDPAPHMENLKCRGETVAKEISEAMKSLPALIEQGEGFSQVLRMQPVIHLQRIHQEVFSSCHRKPDAKPENFITQIETTPTETASRKTSDVVLKRKQTKDCPQRKWYPLRPKKINLDT

SEQ ID NO: 750243 - protein, 142 aa, Homo sapiens
RVPRPQFRRKMAGSPELVVLDPPWDKELAAGTESQALVSATPREDFRVRCTSKRAVTEMLQLCGRFVQKLGDALPEEIREPALRDAQWVRDQLASSLLIILLPNTQDLRIQKDPTPGLGRINGAPGYCRTSSRNARGERNRC

SEQ ID NO: 750244 - protein, 291 aa, Homo sapiens; identical to SEQ ID NO: 750235

SEQ ID NO: 750245 - protein, 160 aa, Homo sapiens
RVPRPQFRRKMAGSPELVVLDPPWDKELAAGTESQALVSATPREDFRVRCTSKRAVTEMLQLCGRFVQKLGDALPEEIREPALRDAQWTFESAVQENISINGQAWQEASDNCFMDSDIKVLEDQFDEIIVDIATKRKQYPRKILECVIKTIKAKQEILVR

SEQ ID NO: 750246 - protein, 291 aa, Homo sapiens; identical to SEQ ID NO: 750235

SEQ ID NO: 750247 - protein, 142 aa, Homo sapiens; identical to SEQ ID NO: 750243

SEQ ID NO: 750248 - protein, 182 aa, Homo sapiens
RVPRPQFRRKMAGSPELVVLDPPWDKELAAGTESQALVSATPREDFRVRCTSKRAVTEMLQLCGRFVQKLGDALPEEIREPALRDAQWTFESAVQENISINGQAWQEASDNCFMDSDIKVLEDQFDEIIVDIATKRKQYPRKILECVIKTIKAKQEILKQYHPVVHPLDLKYDPDPVLACIN

SEQ ID NO: 750249 - protein, 250 aa, Homo sapiens
RVPRPQFRRKMAGSPELVVLDPPWDKELAAGTESQALVSATPREDFRVRCTSKRAVTEMLQLCGRFVQKLGDALPEEIREPALRDAQWTFESAVQENISINGQAWQEASDNCFMDSDIKVLEDQFDEIIVDIATKRKQYPRKILECVIKTIKAKQEILSLPALIEQGEGFSQVLRMQPVIHLQRIHQEVFSSCHRKPDAKPENFITQIETTPTETASRKTSDVVLKRKQTKDCPQRKWYPLRPKKINLDT

SEQ ID NO: 750250 - protein, 723 aa, Homo sapiens
ARDDTKQSLLSLDLQKLAGGKKSNMKIAVLFCFFLLIIFQTDFGKNEEIPRKQRRKIYHRRLRKSSTSHKHRSNRQLGIQQTTVFTPVARLPIVNFDYSMEEKFESFSSFPGVESSYNVLPGKKGHCLVKGITMYNKAVWSPEPCTTCLCSDGRVLCDETMCHPQRCPQTVIPEGECCPVCSATVSYSLLSGIALNDRNEFSGDSSEQREPTNLLHKQLPPPQVGMDRIVRKEALQSEEDEEVKEEDTEQKRETPESRNQGQLYSEGDSRGGDRKQRPGEERRLAHQQQRQGREEEEDEEEEGEEGEEDEEDEEDPVRGDMFRMPSRSPLPAPPRGTLRLPSGCSLSYRTISCINAMLTQIPPLTAPQITSLELTGNSIASIPDEAFNGLPNLERLDLSKNNITSSGIGPKAFKLLKKLMRLNMDGNNLIQIPSQLPSTLEELKVNENNLQAIDEESLSDLNQLVTLELEGNNLSEANVNPLAFKPLKSLAYLRLGKNKFRIIPQGLPGSIEELYLENNQIEEITEICFNHTRKINVIVLRYNKIEENRIAPLAWINQENLESIDLSYNKLYHVPSYLPKSLLHLVLLGNQIERIPGYVFGHMEPGLEYLYLSFNKLADDGMDRVSFYGAYHSLRELFLDHNDLKSIPPGIQEMKALHFLRLNNNKIRNILPEEICNAEEDDDSNLEHLHLENNYIKIREIPSYTFSCIRSYSSIVLKPQNIK

SEQ ID NO: 750251 - protein, 569 aa, Homo sapiens
MEEKFESFSSFPGVESSYNVLPGKKGHCLVKGITMYNKAVWSPEPCTTCLCSDGRVLCDETMCHPQRCPQTVIPEGECCPVCSATVSYSLLSGIALNDRNEFSGDSSEQREPTNLLHKQLPPPQVGMDRIVRKEALQSEEDEEVKEEDTEQKRETPESRNQGQLYSEGDSRGGDRKQRPGEERRLAHQQQRQGREEEEDEEEEGEEGEEDEEDEEDPVRGDMFRMPSRSPLPAPPRGTLRLPSGCSLSYRTISCINAMLTQIPPLTAPQITSLELTGNSIASIPDEAFNGLPNLERLDLSKNNITSSGIGPKAFKLLKKLMRLNMDGNNLIQIPSQLPSTLEELKVNENNLQAIDEESLSDLNQLVTLELEGNNLSEANVNPLAFKPLKSLAYLRLGKNKFRIIPQGLPGSIEELYLENNQIEEITEICFNHTRKINVIVLRYNKIEENRIAPLAWINQENLESIDLSYNKLYHVPSYLPKSLLHLVLLGNQIERIPGYVFGHMEPGLEYLYLSFNKLADDGMDRVSFYGAYHSLRELFLDHNDLKSIPPGIQEMKALHFLRLNNNKIR

SEQ ID NO: 750252 - protein, 624 aa, Homo sapiens
MEEKFESFSSFPGVESSYNVLPGKKGHCLVKGITMYNKAVWSPEPCTTCLCSDGRVLCDETMCHPQRCPQTVIPEGECCPVCSATVSYSLLSGIALNDRNEFSGDSSEQREPTNLLHKQLPPPQVGMDRIVRKEALQSEEDEEVKEEDTEQKRETPESRNQGQLYSEGDSRGGDRKQRPGEERRLAHQQQRQGREEEEDEEEEGEEGEEDEEDEEDPVRGDMFRMPSRSPLPAPPRGTLRLPSGCSLSYRTISCINAMLTQIPPLTAPQITSLELTGNSIASIPDEAFNGLPNLERLDLSKNNITSSGIGPKAFKLLKKLMRLNMDGNNLIQIPSQLPSTLEELKVNENNLQAIDEESLSDLNQLVTLELEGNNLSEANVNPLAFKPLKSLAYLRLGKNKFRIIPQGLPGSIEELYLENNQIEEITEICFNHTRKINVIVLRYNKIEENRIAPLAWINQENLESIDLSYNKLYHVPSYLPKSLLHLVLLGNQIERIPGYVFGHMEPGLEYLYLSFNKLADDGMDRVSFYGAYHSLRELFLDHNDLKSIPPGIQEMKALHFLRLNNNKIRNILPEEICNAEEDDDSNLEHLHLENNYIKIREIPSYTFSCIRSYSSIVLKPQNIK

SEQ ID NO: 750253 - protein, 416 aa, Homo sapiens [sequence omitted]

SEQ ID NO: 750254 - protein, 416 aa, Homo sapiens [sequence omitted]

SEQ ID NO: 750255 - protein, 416 aa, Homo sapiens [sequence omitted]

SEQ ID NO: 750256 - protein, 392 aa, Homo sapiens [sequence omitted]

SEQ ID NO: 750257 - protein, 392 aa, Homo sapiens
MPRQLSAAAALFASLAVILHDGSQMRAKAFPETRDYSQPTAAATVQDIKKPVQQPAKQAPHQTLAARFMDGHITFQTAATVKIPTTTPATTKNTATTSPITYTLVTTQATPNNSHTAPPVTEVTVGPSLAPYSLPPTITPPAHTTGTSSSTVSHTTGNTTQPSNQTTLPATLSIALHKSTTGQKPVQPTHHPCTSAIVSQDWNLSGSKRKQTLYKSRDGDQLIVQDKESVFSPRRYFNIDPNATQASGNCGTRKSNLLLNFQGGFVNLTFTKDEESYYISEVGAYLTVSDPETVYQGIKHAVVMFQTAVGHSFKCVSEQSLQLSAHLQVKTTDVQLQAFDFEDDHFGNVDECSSDYTIVLPVIGAIVVGLCLMGMGVYKIRLRCQSSGYQRI

SEQ ID NO: 750258 - protein, 416 aa, Homo sapiens [sequence omitted]

SEQ ID NO: 750259 - protein, 416 aa, Homo sapiens [sequence omitted]

SEQ ID NO: 750260 - protein, 113 aa, Homo sapiens
ALPTAFRSYFEIFNGPGEVDAQSLKNILLLMGFSVTLAQVEDALMSADVNGDGRVDFKDFLAVMTDTRRFFCSVEQNALSDMAPHNPHTLLFEILSLLVEMLALPEAVLEEIT

SEQ ID NO: 750261 - protein, 65 aa, Homo sapiens
LWGAGTDCGHGLGPCTLPPPASAMRPCVSACGGVLVCGLLCEHQSDSIHCLCHLCLCKCNYLCIR

SEQ ID NO: 750262 - protein, 309 aa, Homo sapiens
MASELGARDDGGCTELAKPLYLQYLERALRLDHFLRQTSAIFNRNISSDDSEDGLDDSNPLLPQSGDPLIQVKEEPPNSLLGETSGAGSSGMLNTYSLNGVLQSESKCDKGNLYNFSKLKKSRKWLKSILLSDESSEADSQSEDDDEEELNLSREELHNMLRLHKYKKLHQNKYSKDKELQQYQYYSAGLLSTYDPFYEQQRHLLGPKKKKFKEEKKLKAKLKKVKKKRRRDEELSSEESPRRHHHQTKVFAKFSHDAPPPGTKKKHLSIEQLNARRRKVWLSIVKKELPKAISRKLHARNLFSPYPRT

SEQ ID NO: 750263 - protein, 73 aa, Homo sapiens
MGCSQGGGPDKQDSFTRPWPASSLTGVTWGRMKRAGGARQGGLSRGFLPRGAVPWACQVPRASTLEKRFQSEA

SEQ ID NO: 750264 - protein, 354 aa, Homo sapiens
MYREWVVVNVFMMLYVQLVQGSSNEHGPVKRSSQSTLERSEQQIRAASSLEELLRITHSEDWKLWRCRLRLKSFTSMDSRSASHRSTRFAATFYDIETLKVIDEEWQRTQCSPRETCVEVASELGKSTNTFFKPPCVNVFRCGGCCNEESLICMNTSTSYISKQLFEISVPLTSVPELVPVKVANHTGCKCLPTAPRHPYSIIRRSIQIPEEDRCSHSKKLCPIDMLWDSNKCKCVLQEENPLAGTEDHSHLQEPALCGPHMMFDEDRCECVCKTPCPKDLIQHPKNCSCFECKESLETCCQKHKLFHPDTCSCEDRCPFHTRPCASGKTACAKHCRFPKEKRAAQGPHSRKNP

SEQ ID NO: 750265 - protein, 144 aa, Homo sapiens
KEMGESKLLTDDIKDTINLVIQMPHYNYLTNTFLFLLDHSHLQEPALCGPHMMFDEDRCECVCKTPCPKDLIQHPKNCSCFECKESLETCCQKHKLFHPDTCSCEDRCPFHTRPCASGKTACAKHCRFPKEKRAAQGPHSRKNP

SEQ ID NO: 750266 - protein, 159 aa, Homo sapiens
SWYGRDFRMKIHPDPKEDRCSHSKKLCPIDMLWDSNKCKCVLQEENPLAGTEDHSHLQEPALCGPHMMFDEDRCECVCKTPCPKDLIQHPKNCSCFECKESLETCCQKHKLFHPDTCSCEDRCPFHTRPCASGKTACAKHCRFPKEKRAAQGPHSRKNP

SEQ ID NO: 750267 - protein, 354 aa, Homo sapiens; identical to SEQ ID NO: 750264

SEQ ID NO: 750268 - protein, 1203 aa, Homo sapiens
MEQAPNMAEPRGPVDHGVQIRFITEPVSGAEMGTLRRGGRRPAKDARASTYGVAVRVQGIAGQPFVVLNSGEKGGDSFGVQIKGANDQGASGALSSDLELPENPYSQVKGFPAPSQSSTSDEEPGAYWNGKLLRSHSQASLAGPGPVDPSNRSNSMLELAPKVASPGSTIDTAPLSSVDSLINKFDSQLGGQARGRTGRRTRMLPPEQRKRSKSLDSRLPRDTFEERERQSTNHWTSSTKYDNHVGTSKQPAQSQNLSPLSGFSRSRQTQDWVLQSFEEPRRSAQDPTMLQFKSTPDLLRDQQEAAPPGSVDHMKATIYGILREGSSESETSVRRKVSLVLEKMQPLVMVSSGSTKAVAGQGELTRKVEELQRKLDEEVKKRQKLEPSQVGLERQLEEKTEECSRLQELLERRKGEAQQSNKELQNMKRLLDQGEDLRHGLETQVMELQNKLKHVQGPEPAKEVLLKDLLETRELLEEVLEGKQRVEEQLRLRERELTALKGALKEEVASRDQEVEHVRQQYQRDTEQLRRSMQDATQDHAVLEAERQKMSALVRGLQRELEETSEETGHWQSMFQKNKEDLRATKQELLQLRMEKEEMEEELGEKIEVLQRELEQARASAGDTRQVEVLKKELLRTQEELKELQAERQSQEVAGRHRDRELEKQLAVLRVEADRGRELEEQNLQLQKTLQQLRQDCEEASKAKMVAEAEATVLGQRRAAVETTLRETQEENDEFRRRILGLEQQLKETRGLVDGGEAVEARLRDKLQRLEAEKQQLEEALNASQEEEGSLAAAKRALEARLEEAQRGLARLGQEQQTLNRALEEEGKQREVLRRGKAELEEQKRLLDRTVDRLNKELEKIGEDSKQALQQLQAQLEDYKEKARREVADAQRQAKDWASEAEKTSGGLSRLQDEIQRLRQALQASQAERDTARLDKELLAQRLQGLEQEAENKKRSQDDRARQLKGLEEKVSRLETELDEEKNTVELLTDRVNRGRDQVDQLRTELMQERSARQDLECDKISLERQNKDLKTRLASSEGFQKPSASLSQLESQNQLLQERLQAEEREKTVLQSTNRKLERKVKELSIQIEDERQHVNDQKDQLSLRVKALKRQVDEAEEEIERLDGLRKKAQREVEEQHEVNEQLQARIKSLEKDSWRKASRSAAESALKNEGLSSDEEFDSVYDPSSIASLLTESNLQTSSC

SEQ ID NO: 750269 - protein, 141 aa, Homo sapiens
YVDFCSGVILRVHTEPTYHEGHHLCILREGSSESETSVRRKVSLVLEKMQPLVMVSSGSTKAVAGQGELTRKVEELQRKLDEEVKKRQKLEPSQVGLERQLEEKTEECSRLQELLERRKGEAQQSNKDDAEQKVDAGQKVD

SEQ ID NO: 750270 - protein, 654 aa, Homo sapiens [sequence omitted]

SEQ ID NO: 750271 - protein, 1181 aa, Homo sapiens
MEQAPNMAEPRGPVDHGVQIRFITEPVSGAEMGTLRRGGRRPAKDARASTYGVAVRVQGIAGQPFVVLNSGEKGGDSFGVQIKGANDQGASGALSSDLELPENPYSQVKGFPAPSQSSTSDEEPGAYWNGKLLRSHSQASLAGPGPVDPSNRSNSMLELAPKVASPGSTIDTAPLSSVDSLINKFDSQLGGQARGRTGRRTRMLPPEQRKRSKSLDSRLPRDTFEERERQSTNHWTSSTKYDNHVGTSKQPAQSQNLSPLSGFSRSRQTQDWVLQSFEEPRRSAQDPTMLQFKSTPDLLRDQQEAAPPGSVDHMKATIYGILREGSSESETSVRRKVSLVLEKMQPLVMVSSGSTKAVAGQGELTRKVEELQRKLDEEVKKRQKLEPSQVGLERQLEEKTEECSRLQELLERRKGEAQQSNKELQNMKRLLDQGEDLRHGLETQVMELQNKLKHVQGPEPAKEVLLKDLLETRELLEEVLEGKQRVEEQLRLRERELTALKGALKEEVASRDQEVEHVRQQYQRDTEQLRRSMQDATQDHAVLEAERQKMSALVRGLQRELEETSEETGHWQSMFQKNKEDLRATKQELLQLRMEKEEMEEELGEKIEVLQRELEQARASAGDTRQVEVLKKELLRTQEELKELQAERQSQEVAGRHRDRELEKQLAVLRVEADRGRELEEQNLQLQKTLQQLRQDCEEASKAKMVAEAEATVLGQRRAAVETTLRETQEENDEFRRRILGLEQQLKETRGLVDGGEAVEARLRDKLQRLEAEKQQLEEALNASQEEEGSLAAAKRALEARLEEAQRGLARLGQEQQTLNRALEEEGKQREVLRRGKAELEEQKRLLDRTVDRLNKELEKIGEDSKQALQQLQAQLEDYKEKARREVADAQRQAKDWASEAEKTSGGLSRLQDEIQRLRQALQASQAERDTARLDKELLAQRLQGLEQEAENKKRSQDDRARQLKGLEEKVSRLETELDEEKNTVELLTDRVNRGRDQVDQLRTELMQERSARQDLECDKISLERQNKDLKTRLASSEGFQKPSASLSQLESQNQLLQERLQAEEREKTVLQSTNRKLERKVKELSIQIEDERQHVNDQKDQLSLRVKALKRQVDEAEEEIERLDGLRKKAQREVEEQHEVNEQLQARIKSLEKDSWYGLPFCPCSIGTLEQGGNGLSCAG

SEQ ID NO: 750272 - protein, 1203 aa, Homo sapiens; identical to SEQ ID NO: 750268

SEQ ID NO: 750273 - protein, 1109 aa, Homo sapiens
MEQAPNMAEPRGPVDHGVQIRFITEPVSGAEMGTLRRGGRRPAKDARASTYGVAVRVQGIAGQPFVVLNSGEKGGDSFGVQIKGANDQGASGALSSDLELPENPYSQVKGFPAPSQSSTSDEEPGAYWNGKLLRSHSQASLAGPGPVDPSNRSNSMLELAPKVASPGSTIDTAPLSSVDSLINKFDSQLGGQARGRTGRRTRMLPPEQRKRSKSLDSRLPRDTFEERERQSTNHWTSSTKYDNHVGTSKQPAQSQNLSPLSGFSRSRQTQDWVLQSFEEPRRSAQDPTMLQFKSTPDLLRDQQEAAPPGSVDHMKATIYGILREGSSESETSVRRKVSLVLEKMQPLVMVSSGSTKAVAGQGELTRKVEELQRKLDEEVKKRQKLEPSQVGLERQLEEKTEECSRLQELLERRKGEAQQSNKELQNMKRLLDQGEDLRHGLETQVMELQNKLKHVQGPEPAKEVLLKDLLETRELLEEVLEGKQRVEEQLRLRERELTALKGALKEEVASRDQEVEHVRQQYQRDTEQLRRSMQDATQDHAVLEAERQKMSALVRGLQRELEETSEETGHWQSMFQKNKEDLRATKQELLQLRMEKEEMEEELGEKIEVLQRELEQARASAGDTRQVEVLKKELLRTQEELKELQAERQSQEVAGRHRDRELEKQLAVLRVEADRGRELEEQNLQLQKTLQQLRQDCEEASKAKMVAEAEATVLGQRRAAVETTLRETQEENDEFRRRILGLEQQLKETRGLVDGGEAVEARLRDKLQRLEAEKQQLEEALNASQEEEGSLAAAKRALEARLEEAQRGLARLGQEQQTLNRALEEEGKQREVLRRGKAELEEQKRLLDRTVDRLNKELEKIGEDSKQALQQLQAQLEDYKEKARREVADAQRQAKDWASEAEKTSGGLSRLQDEIQRLRQALQASQAERDTARLDKELLAQRLQGLEQEAENKKRSQDDRARQLKGLEEKVSRLETELDEEKNTVELLTDRVNRGRDQVDQLRTELMQERSARQDLECDKISLERQNKDLKTRLASSEGFQKPSASLSQLESQNQLLQERLQAEEREKTVLQSTNRKLERKVKELSIQIEDERQHVNDQKDQVRTWHPG

SEQ ID NO: 750274 - protein, 366 aa, Homo sapiens
MEQAPNMAEPRGPVDHGVQIRFITEPVSGAEMGTLRRGGRRPAKDARASTYGVAVRVQGIAGQPFVVLNSGEKGGDSFGVQIKGANDQGASGALSSDLELPENPYSQVKGFPAPSQSSTSDEEPGAYWNGKLLRSHSQASLAGPGPVDPSNRSNSMLELAPKVASPGSTIDTAPLSSVDSLINKFDSQLGGQARGRTGRRTRMLPPEQRKRSKSLDSRLPRDTFEERERQSTNHWTSSTKYDNHVGTSKQPAQSQNLSPLSGFSRSRQTQDWVLQSFEEPRRSAQDPTMLQFKSTPDLLRDQQEAAPPGSVDHMKATIYGILREGSSESETSVRRKVSLVLEKMQPLVMVAFIWSTLPGGAASCWS

SEQ ID NO: 750275 - protein, 173 aa, Homo sapiens
PHSGILVWLWVPHHIPVSFQELLRTQEELKELQAERQSQEVAGRHRDRELEKQLAVLRVEADRGRELEEQNLQLQKTLQQLRQDCEEASKAKMVAEAEATVLGQRRAAVETTLRETQEENDEFRRRILGLEQQLKETRGLVDGGEAVEARLRDKLQRLEVSGSALPALSAQPW

SEQ ID NO: 750276 - protein, 197 aa, Homo sapiens [sequence omitted]

SEQ ID NO: 750277 - protein, 105 aa, Homo sapiens
MPAQLSLRVKALKRQVDEAEEEIERLDGLRKKAQREVEEQHEVNEQLQARIKSLEKDSWRKASRSAAESALKNEGLSSDEEFDSVYDPSSIASLLTESNLQTSSC

SEQ ID NO: 750278 - protein, 1203 aa, Homo sapiens; identical to SEQ ID NO: 750268

SEQ ID NO: 750279 - protein, 618 aa, Homo sapiens
MEQAPNMAEPRGPVDHGVQIRFITEPVSGAEMGTLRRGGRRPAKDARASTYGVAVRVQGIAGQPFVVLNSGEKGGDSFGVQIKGANDQGASGALSSDLELPENPYSQVKGFPAPSQSSTSDEEPGAYWNGKLLRSHSQASLAGPGPVDPSNRSNSMLELAPKVASPGSTIDTAPLSSVDSLINKFDSQLGGQARGRTGRRTRMLPPEQRKRSKSLDSRLPRDTFEERERQSTNHWTSSTKYDNHVGTSKQPAQSQNLSPLSGFSRSRQTQDWVLQSFEEPRRSAQDPTMLQFKSTPDLLRDQQEAAPPGSVDHMKATIYGILREGSSESETSVRRKVSLVLEKMQPLVMVSSGSTKAVAGQGELTRKVEELQRKLDEEVKKRQKLEPSQVGLERQLEEKTEECSRLQELLERRKGEAQQSNKELQNMKRLLDQGEDLRHGLETQVMELQNKLKHVQGPEPAKEVLLKDLLETRELLEEVLEGKQRVEEQLRLRERELTALKGALKEEVASRDQEVEHVRQQYQRDTEQLRRSMQDATQDHAVLEAERQKMSALVRGLQRELEETSEETGHWQSMFQKNKEDLRATKQELLQLRMEKCAWVRTSHFCTQAHFCTQAHFC

SEQ ID NO: 750280 - protein, 107 aa, Homo sapiens
RKSPGVEIKSLRELDSGLEVHKIAEGFSESKKRSSEDENENKIEFRKKGGFEGGGFLGRKKVPYLASSPSTSDGGTDSPGTASPSPTKTTPSPRHKKSDSSGQEYSL

SEQ ID NO: 750281 - protein, 147 aa, Homo sapiens
QPPPAPTVEQPPSRSSPPAQLHVSPHRTHASDGEQRRALNAGSLRDSVCTPGPTEICTESCNSVVKKERAMLFHGWSMAFCLDDSEKRNLTTPSPPQCLTQTVYHHTGDSIFIDTIPQMGKLRQQVLWNSATQSLPDPGVLATSRAL

SEQ ID NO: 750282 - protein, 1042 aa, Homo sapiens
DGASSQPEDASGRCAQRFSTLFSELAVRMVFSVRQCGHVGRTEEVLLTFKIFLVIICLHVVLVTSLEEDTDNSSLSPPPAKLSVVSFAPSSNEVETTSLNDVTLSLLPSNETEKTKITIVKTFNASGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAAIAALERVKIRPMEHCCCSVRIPCPSSPEELGKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQVSLETQAPENSIGTITLPSSLMNNLPAHDMELASRVQFNFFETPALFQDPSLENLSLISYVISSSVANLTVRNLTRNVTVTLKHINPSQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSDWSKTATNGLKKQTVNQGVSSSSNSLQSSSNSTNSTTLLVNNDCSVHASGNGNASTERNGVSFSVQNGDVCLHDFTGKQHMFNEKEDSCNGKGRMALRRTSKRGSLHFIEQM

SEQ ID NO: 750283 - protein, 1042 aa, Homo sapiens; identical to SEQ ID NO: 750282

SEQ ID NO: 750284 - protein, 210 aa, Homo sapiens
PLFFFGKTQQNSRHDTIRARTPSLDIKRPILVRNPMNVKNVENPSAGSLTLLLIRELIQETNCTHVISVGNLLFIALGLLDTRGHILERNPMNVLNVGNLSDRAHISLVNSHSQLLQREVKYLGIQLTRDVKELFKENYKSLLNEIKENTTNERTIPCLWIGRINIVKMAILPKVIYRFNAIPIKLPMTFFTELEKTLKFMWNQKRARIA

SEQ ID NO: 750285 - protein, 439 aa, Homo sapiens
MDAKSLTAWSRTLVTFKDVFVDFTREEWKLLDTAQQIVYRNVMLENYKNLVSLGYQLTKPDVILRLEKGEEPWLVEREIHQETHPDSETAFEIKSSVSSRSIFKDKQSCDIKMEGMARNDLWYLSLEEVWKCRDQLDKYQENPERHLRHQLIHTGEKPYECKECGKSFSRSSHLIGHQKTHTGEEPYECKECGKSFSWFSHLVTHQRTHTGDKLYTCNQCGKSFVHSSRLIRHQRTHTGEKPYECPECGKSFRQSTHLILHQRTHVRVRPYECNECGKSYSQRSHLVVHHRIHTGLKPFECKDCGKCFSRSSHLYSHQRTHTGEKPYECHDCGKSFSQSSALIVHQRIHTGEKPYECCQCGKAFIRKNDLIKHQRIHVGEETYKCNQCGIIFSQNSPFIVHQIAHTGEQFLTCNQCGTALVNTSNLIGYQTNHIRENAY

SEQ ID NO: 750286 - protein, 573 aa, Homo sapiens
MDAKSLTAWSRTLVTFKDVFVDFTREEWKLLDTAQQIVYRNVMLENYKNLVSLGYQLTKPDVILRLEKGEEPWLVEREIHQETHPDSETAFEIKSSVSSRSIFKDKQSCDIKMEGMARNDLWYLSLEEVWKCRDQLDKYQENPERHLRQVAFTQKKVLTQERVSESGKYGGNCLLPAQLVLREYFHKRDSHTKSLKHDLVLNGHQDSCASNSNECGQTFCQNIHLIQFARTHTGDKSYKCPDNDNSLTHGSSLGISKGIHREKPYECKECGKFFSWRSNLTRHQLIHTGEKPYECKECGKSFSRSSHLIGHQKTHTGEEPYECKECGKSFSWFSHLVTHQRTHTGDKLYTCNQCGKSFVHSSRLIRHQRTHTGEKPYECPECGKSFRQSTHLILHQRTHVRVRPYECNECGKSYSQRSHLVVHHRIHTGLKPFECKDCGKCFSRSSHLYSHQRTHTGEKPYECHDCGKSFSQSSALIVHQRIHTGEKPYECCQCGKAFIRKNDLIKHQRIHVGEETYKCNQCGIIFSQNSPFIVHQIAHTGEQFLTCNQCGTALVNTSNLIGYQTNHIRENAY

SEQ ID NO: 750287 - protein, 399 aa, Homo sapiens
MDAKSLTAWSRTLVTFKDVFVDFTREEWKLLDTAQQIVYRNVMLENYKNLVSLGYQLTKPDVILRLEKGEEPWLVEREIHQETHPDSETAFEIKSSVSSRSIFKDKQSCDIKMEGMARNDLWYLSLEEVWKCRDQLDKYQENPERHLRQVAFTQKKVLTQERVSESGKYGGNCLLPAQLVLREYFHKRDSHTKSLKHDLVLNGHQDSCASNSNECGQTFCQNIHLIQFARTHTGDKSYKCPDNDNSLTHGSSLGISKGIHREKPYECKECGKFFSWRSNLTGISLFILEKNPMSVKNVESLSAGVLTSLDIKRPILVRNPMNVKNVENPSAGSLTLLLIRELIQETNCTHVISVGNLLFIALGLLDTRGHILERNPMNVLNVGNLSDRAHISFCIREPM

SEQ ID NO: 750288 - protein, 151 aa, Homo sapiens [sequence omitted]

SEQ ID NO: 750289 - protein, 841 aa, Homo sapiens
MAGGQAAAALPTWKMAARRSLSARGRGILQAAAGRLLPLLLLSCCCGAGGCAAVGENEETVIIGLRLEDTNDVSFMEGGALRVSERTRVKLRVYGQNINNETWSRIAFTEHERRRHSPGERGLGGPAPPEPDSGPQRCGIRTSDIIILPHIILNRRTSGIIEIEIKPLRKMEKSKSYYLCTSLSTPALGAGGSGSTGGAVGGKGGSGVAGLPPPPWAETTWIYHDGEDTKMIVGEEKKFLLPFWLQVIFISLLLCLSGMFSGLNLGLMALDPMELRIVQNCGTEKEKNYAKRIEPVRRQGNYLLCSLLLGNVLVNTTLTILLDDIAGSGLVAVVVSTIGIVIFGEIVPQAICSRHGLAVGANTIFLTKFFMMMTFPASYPVSKLLDCVLGQEIGTVYNREKLLEMLRVTDPYNDLVKEELNIIQGALELRTKTVEDVMTPLRDCFMITGEAILDFNTMSEIMESGYTRIPVFEGERSNIVDLLFVKDLAFVDPDDCTPLKTITKFYNHPLHFVFNDTKLDAMLEEFKKGKSHLAIVQRVNNEGEGDPFYEVLGIVTLEDVIEEIIKSEILDETDLYTDNRTKKKVAHRERKQDFSAFKQTDSEMKVKISPQLLLAMHRFLATEVEAFSPSQMSEKILLRLLKHPNVIQELKYDEKNKKAPEYYLYQRNKPVDYFVLILQGKVEVEAGKEGMKFEASAFSYYGVMALTASPGENKSPPRPCGLNHSDSLSRSDRIDAVTPTLGSSNNQLNSSLLQVYIPDYSVRALSDLQFVKISRQQYQNALMASRMDKTPQSSDSENTKIELTLTELHDGLPDETANLLNEQNCVTHSKANHSLHNEGAI

SEQ ID NO: 750290 - protein, 863 aa, Homo sapiens
MAGGQAAAALPTWKMAARRSLSARGRGILQAAAGRLLPLLLLSCCCGAGGCAAVGENEETVIIGLRLEDTNDVSFMEGGALRVSERTRVKLRVYGQNINNETWSRIAFTEHERRRHSPGERGLGGPAPPEPDSGPQRCGIRTSDIIILPHIILNRRTSGIIEIEIKPLRKMEKSKSYYLCTSLSTPALGAGGSGSTGGAVGGKGGSGVAGLPPPPWAETTWIYHDGEDTKMIVGEEKKFLLPFWLQVIFISLLLCLSGMFSGLNLGLMALDPMELRIVQNCGTEKEKNYAKRIEPVRRQGNYLLCSLLLGNVLVNTTLTILLDDIAGSGLVAVVVSTIGIVIFGEIVPQAICSRHGLAVGANTIFLTKFFMMMTFPASYPVSKLLDCVLGQEIGTVYNREKLLEMLRVTDPYNDLVKEELNIIQGALELRTKTVEDVMTPLRDCFMITGEAILDFNTMSEIMESGYTRIPVFEGERSNIVDLLFVKDLAFVDPDDCTPLKTITKFYNHPLHFVFNDTKLDAMLEEFKKGKSHLAIVQRVNNEGEGDPFYEVLGIVTLEDVIEEIIKSEILDETDLYTDNRTKKKVAHRERKQDFSAFKQTDSEMKVKISPQLLLAMHRFLATEVEAFSPSQMSEKILLRLLKHPNVIQELKYDEKNKKAPEYYLYQRNKPVDYFVLILQGKVEVEAGKEGMKFEASAFSYYGVMALTASPVPLSLSRTFVVSRTELLAAGSPGENKSPPRPCGLNHSDSLSRSDRIDAVTPTLGSSNNQLNSSLLQVYIPDYSVRALSDLQFVKISRQQYQNALMASRMDKTPQSSDSENTKIELTLTELHDGLPDETANLLNEQNCVTHSKANHSLHNEGAI

SEQ ID NO: 750291 - protein, 536 aa, Homo sapiens
MAGGQAAAALPTWKMAARRSLSARGRGILQAAAGRLLPLLLLSCCCGAGGCAAVGENEETVIIGLRLEDTNDVSFMEGGALRVSERTRVKLRVYGQNINNETWSRIAFTEHERRRHSPGERGLGGPAPPEPDSGPQRCGIRTSDIIILPHIILNRRTSGIIEIEIKPLRKMEKSKSYYLCTSLSTPALGAGGSGSTGGAVGGKGGSGVAGLPPPPWAETTWIYHDGEDTKMIVGEEKKFLLPFWLQVIFISLLLCLSGMFSGLNLGLMALDPMELRIVQNCGTEKEKNYAKRIEPVRRQGNYLLCSLLLGNVLVNTTLTILLDDIAGSGLVAVVVSTIGIVIFGEIVPQAICSRHGLAVGANTIFLTKFFMMMTFPASYPVSKLLDCVLGQEIGTVYNREKLLEMLRVTDPYNDLVKEELNIIQGALELRTKTVEDVMTPLRDCFMITGEAILDFNTMSEIMESGYTRIPVFEGERSNIVDLLFVKDLAFVDPDDCTPLKTITKFYNHPLHFVFNDTKLDAMLEEFKKGGKFWSLS

SEQ ID NO: 750292 - protein, 590 aa, Homo sapiens
MIGCGACEPKVKMAGGQAAAALPTWKMAARRSLSARGRGILQAAAGRLLPLLLLSCCCGAGGCAAVGENEETVIIGLRLEDTNDVSFMEGGALRVSERTRVKLRVYGQNINNETWSRIAFTEHERRRHSPGERGLGGPAPPEPDSGPQRCGIRTSDIIILPHIILNRRTSGIIEIEIKPLRKMEKSKSYYLCTSLSTPALGAGGSGSTGGAVGGKGGSGVAGLPPPPWAETTWIYHDGEDTKMIVGEEKKFLLPFWLQVIFISLLLCLSGMFSGLNLGLMALDPMELRIVQNCGTEKEKNYAKRIEPVRRQGNYLLCSLLLGNVLVNTTLTILLDDIAGSGLVAVVVSTIGIVIFGEIVPQAICSRHGLAVGANTIFLTKFFMMMTFPASYPVSKLLDCVLGQEIGTVYNREKLLEMLRVTDPYNDLVKEELNIIQGALELRTKTVEDVMTPLRDCFMITGEAILDFNTMSEIMESGYTRIPVFEGERSNIVDLLFVKDLAFVDPDDCTPLKTITKFYNHPLHFVFNDTKLDAMLEEFKKGKSHLAIVQRVNNEGEGDPFYEVLGIVTLEDVIEEIIKSEILDETDLYSK

SEQ ID NO: 750293 - protein, 73 aa, Homo sapiens
HITYNMSFRKFRKSLPKLFLVSKGKSHLAIVQRVNNEGEGDPFYEVLGIVTLEDVIEEIIKSEILDETDLYSK

SEQ ID NO: 750294 - protein, 109 aa, Homo sapiens
LLVIFRSASPKHGFTIMNRLSMENRTEPITKDLDFQLQDPFLLYRNARLSIYGIWFYDKEECQRIAELMKNLTQYEQLKAHTEPGALRDHQQPTHQAPAPGGTAVPHSE

SEQ ID NO: 750295 - protein, 643 aa, Homo sapiens
RGSSLVLRSIESGFQEPRAYVWEGGKMAAVAAGGLVGKGRDISLAALQRHDPYINRIVDVASQVALYTFGHRANEWEKTDVEGTLFVYTRSASPKHGFTIMNRLSMENRTEPITKDLDFQLQDPFLLYRNARLSIYGIWFYDKEECQRIAELMKNLTQYEQLKAHQGTGAGISPVILNSGEGKEVDILRMLIKAKDEYTKCKTCSEPKKITSSSAIYDNPNLIKPIPVKPSENQQQRIPQPNQTLDPEPQHLSLTALFGKQDKATCQETVEPPQTLHQQQQQQQQQQEKLPIRQGVVRSLSYEEPRRHSPPIEKQLCPAIQKLMVRSADLHPLSELPENRPCENGSTHSAGEFFTGPVQPGSPHNIGTSRGVQNASRTQNLFEKLQSTPGAANKCDPSTPAPASSAALNRSRAPTSVTPVAPGKGLAQPPQAYFNGSLPPQTVGHQAHGREQSTLPRQTLPISGSQTGSSGVISPQELLKKLQIVQQEQQLHASNRPALAAKFPVLAQSSGTGKPLESWINKTPNTEQQTPLFQVISPQRIPATAAPSLLMSPMVFAQPTSVPPKERESGLLPVGGQEPPAAATSLLLPIQSPEPSVITSSPLTKLQLQEALLYLIQNDDNFLNIIYEAYLFSMTQAAMKKTM

SEQ ID NO: 750296 - protein, 509 aa, Homo sapiens
RASFRMHCVRSWQTLLKGTRDLTQYEQLKAHQGTGAGISPVILNSGEGKEVDILRMLIKAKDEYTKCKTCSEPKKITSSSAIYDNPNLIKPIPVKPSENQQQRIPQPNQTLDPEPQHLSLTALFGKQDKATCQETVEPPQTLHQQQQQQQQQQEKLPIRQGVVRSLSYEEPRRHSPPIEKQLCPAIQKLMVRSADLHPLSELPENRPCENGSTHSAGEFFTGPVQPGSPHNIGTSRGVQNASRTQNLFEKLQSTPGAANKCDPSTPAPASSAALNRSRAPTSVTPVAPGKGLAQPPQAYFNGSLPPQTVGHQAHGREQSTLPRQTLPISGSQTGSSGVISPQELLKKLQIVQQEQQLHASNRPALAAKFPVLAQSSGTGKPLESWINKTPNTEQQTPLFQVISPQRIPATAAPSLLMSPMVFAQPTSVPPKERESGLLPVGGQEPPAAATSLLLPIQSPEPSVITSSPLTKLQLQEALLYLIQNDDNFLNIIYEAYLFSMTQAAMKKTM

SEQ ID NO: 750297 - protein, 515 aa, Homo sapiens
MQIKVSIYGIWFYDKEECQRIAELMKNLTQYEQLKAHQGTGAGISPVILNSGEGKEVDILRMLIKAKDEYTKCKTCSEPKKITSSSAIYDNPNLIKPIPVKPSENQQQRIPQPNQTLDPEPQHLSLTALFGKQDKATCQETVEPPQTLHQQQQQQQQQQEKLPIRQGVVRSLSYEEPRRHSPPIEKQLCPAIQKLMVRSADLHPLSELPENRPCENGSTHSAGEFFTGPVQPGSPHNIGTSRGVQNASRTQNLFEKLQSTPGAANKCDPSTPAPASSAALNRSRAPTSVTPVAPGKGLAQPPQAYFNGSLPPQTVGHQAHGREQSTLPRQTLPISGSQTGSSGVISPQELLKKLQIVQQEQQLHASNRPALAAKFPVLAQSSGTGKPLESWINKTPNTEQQTPLFQVISPQRIPATAAPSLLMSPMVFAQPTSVPPKERESGLLPVGGQEPPAAATSLLLPIQSPEPSVITSSPLTKLQLQEALLYLIQNDDNFLNIIYEAYLFSMTQAAMKKTM

SEQ ID NO: 750298 - protein, 408 aa, Homo sapiens
RGSSLVLRSIESGFQEPRAYVWEGGKMAAVAAGGLVGKGRDISLAALQRHDPYINRIVDVASQVALYTFGHRANEWEKTDVEGTLFVYTRSASPKHGFTIMNRLSMENRTEPITKDLDFQLQDPFLLYRNARLSIYGIWFYDKEECQRIAELMKNLTQYEQLKAHQGTGAGISPVILNSGEGKEVDILRMLIKAKDEYTKCKTCSEPKKITSSSAIYDNPNLIKPIPVKPSENQQQRIPQPNQTLDPEPQHLSLTALFGKQDKATCQETVEPPQTLHHSSSSSSSSSKRSFQLGRGLYAPCPMRNPEDTHPPLRSSSVQPFRNSWSGAQTSTHCQSCLKTGLVKMAVPILRENFLQDLSSQGLLTTLELLVVYKMLPELRTCSRNFRVPQGQQTSVTLVHQHLPAQLP

SEQ ID NO: 750299 - protein, 492 aa, Homo sapiens
RGSSLVLRSIESGFQEPRAYVWEGGKMAAVAAGGLVGKGRDISLAALQRHDPYINRIVDVASQVALYTFGHRANEWEKTDVEGTLFVYTRSASPKHGFTIMNRLSMENRTEPITKDLDFQLQDPFLLYRNARLSIYGIWFYDKEECQRIAELMKNLTQYEQLKAHQGTGAGISPVILNSGEGKEVDILRMLIKAKDEYTKCKTCSEPKKITSSSAIYDNPNLIKPIPVKPSENQQQRIPQPNQTLDPEPQHLSLTALFGKQDKATCQETVEPPQTLHQQQQQQQQQQEKLPIRQGVVRSLSYEEPRRHSPPIEKQLCPAIQKLMVRSADLHPLSELPENRPCENGSTHSAGEFFTGPVQPGSPHNIGTSRGVQNASRTQNLFEKLQSTPGAANKCDPSTPAPASSAALNRSRAPTSVTPVAPGKGLAQPPQAYFNGSLPPQTVGHQAHGREQSTLPRQTLPISGSQTGSSGVISPQELLKKLQIVQQMMTTS

SEQ ID NO: 750300 - protein, 125 aa, Homo sapiens
KGLAQPPQAYFNGSLPPQTVGHQAHGREQSTLPRQTLPISGSQTGSSGVISPQELLKKLQIVQQEQQLHASNRPALAAKFPVLAQSSGTGKPLESWINKTPNTEQQTPLFQVNMYQGQNKTAWAA

SEQ ID NO: 750301 - protein, 257 aa, Homo sapiens
MVSLFTPFKDMIRLVRSALSQRWGPLKLRARPHSRYRLANFSNAQRHVPKHERTRQGTTTSQEGEQQYHHGDESNRTEIPQRVDKHTYCLFLSAHLHLHARSQQHNRTNRRHNTQHTTQRTEETREKKKNSRAGESGEESEETHRAKERERERTRNRGRANRKQARRGARERKTRTGREIKTESGDDRESERDSEKAEERYREAEDSRSDENPRREQNTSDEEADRTPHETRSKRGKTQRRHQADSKTQQEEKKRQN

SEQ ID NO: 750302 - protein, 135 aa, Homo sapiens
MYRAVRICGSGPGSVLSVISICSTNEIWVMSELEYYINNENVVPSARAFVERESPECNTGPNLHGLFGRKTGQAPGYSYTAANKNKGIIWGEDTLMEYLENPKKYIPGTKMIFVGIKKKEERADLIAYLKKATNE

SEQ ID NO: 750303 - protein, 128 aa, Homo sapiens
REWGRPASERECSLCQRLKRELNMGDVEKGKKIFIMKCSQCHTVEKGGKHKTGPNLHGLFGRKTGQAPGYSYTAANKNKGIIWGEDTLMEYLENPKKYIPGTKMIFVGIKKKEERADLIAYLKKATNE

SEQ ID NO: 750304 - protein, 82 aa, Homo sapiens
MPIKELNNPKTLLRGRDLPANPPVTGEQKFPEGAGTGVSVSGTAKDGKRKTPGVDKGDFSSDLGLWISPQQKSFWCPRGLEK

SEQ ID NO: 750305 - protein, 97 aa, Homo sapiens [sequence omitted]

SEQ ID NO: 750306 - protein, 145 aa, Homo sapiens
MDSQKEALQRIISTLANKNDEIQNFIDTLHHTLKGVQENSSNILSELDEEFDSLYSILDEVKESMINCIKQEQARKSQELQSQISQCNNALENSEELLEFATRSLDIKEPEEFSKVHKNCINTLNKGSCIFKKAFLFFFSFGFLY

SEQ ID NO: 750307 - protein, 93 aa, Homo sapiens
CPHSRPLTCPGSPGVRLGKEGKECVSRDWPEPISTLSPGTGGEGGRGENLREQGLRQGAPARPSPLPKMRGLHSMPSPQNLGKRVSEFRSLRS

SEQ ID NO: 750308 - protein, 122 aa, Homo sapiens
FFLRWSLALSPRLECNGAISAHCNLCLLSSSDSASASQVAGITGAGHQGWLIFVFLVEMRFLHVGQAGLELQTSGDPPVSPSQSAEGMSHCTRPRFFMRLPSCHLRNVLVVLRFGGEVWDND

SEQ ID NO: 750309 - protein, 632 aa, Homo sapiens
MRLAVGALLVCAVLGLCLAVPDKTVRWCAVSEHEATKCQSFRDHMKSVIPSDGPSVACVKKASYLDCIRAIAANEADAVTLDAGLVYDAYLAPNNLKPVVAEFYGSKEDPQTFYYAVAVVKKDSGFQMNQLRGKKSCHTGLGRSAGWNIPIGLLYCDLPEPRKPLEKAVANFFSGSCAPCADGTDFPQLCQLCPGCGCSTLNQYFGYSGAFKCLKDGAGDVAFVKHSTIFENLANKADRDQYELLCLDNTRKPVDEYKDCHLAQVPSHTVVARSMGGKEDLIWELLNQAQEHFGKDKSKEFQLFSSPHGKDLLFKDSAHGFLKVPPRMDAKMYLGYEYVTAIRNLREGTCPEAPTDECKPVKWCALSHHERLKCDEWSVNSVGKIECVSAETTEDCIAKIMNGEADAMSLDGGFVYIAGKCGLVPVLAENYNKSDNCEDTPEAGYFAVAVVKKSASDLTWDNLKGKKSCHTAVGRTAGWNIPMGLLYNKINHCRFDEFFSEGCAPGSKKDSSLCKLCMGSGLNLCEPNNKEGYYGYTGAFRCLVEKGDVAFVKHQTVPQNTGGKNPDPWAKNLNEKDYELLCLDGTRKPVEEYANCHLARAPNHAVVTRKDKEACVHKILRQQQHPIWKQRN

SEQ ID NO: 750310 - protein, 125 aa, Homo sapiens
VNSSTYLEATEYLVDASFLIFPCDHSVIRGSGQVAVRITPPQISWYHQGTATATLFGSNVTDCSGNFCLFRSETKDLLFRDDTVCLAKLHDRNTYEKYLGEEYVKAVGNLRKCSTSCTPGSLHFP

SEQ ID NO: 750311 - protein, 115 aa, Homo sapiens
MIYRGLVRVGVQQTLKSRPEEKRKGVGVKGAGIRQHLKALHRLRELHCERAVTFDTPRAKFGTSKDLLFRDDTVCLAKLHDRNTYEKYLGEEYVKAVGNLRKCSTSCTPGSLHFP

SEQ ID NO: 750312 - protein, 119 aa, Homo sapiens
MSCCALMVPGNLWRSMRTATWPEPRITLWSHGKIRKLASTRYYVNSSTLFGSNVTDCSGNFCLFRSETKDLLFRDDTVCLAKLHDRNTYEKYLGEEYVKAVGNLRKCSTSCTPGSLHFP

SEQ ID NO: 750313 - protein, 120 aa, Homo sapiens
ANRYHTQAETSLDKAELTRCAALAGGSPGCLVEKGDVAFVKHQTVPQNTGGKNPDPWAKNLNEKDYELLCLDGTRKPVEEYANCHLARAPNHAVVTRKDKEACVHKILRQQQHPIWKQRN

SEQ ID NO: 750314 - protein, 304 aa, Homo sapiens
LFDVCPLLPDDGAHSLGWDEEIHNLLLWIRVMMRERAKLVMGVQAGEVIRSNSVGKIECVSAETTEDCIAKIMNGEADAMSLDGGFVYIAGKCGLVPVLAENYNKSDNCEDTPEAGYFAVAVVKKSASDLTWDNLKGKKSCHTAVGRTAGWNIPMGLLYNKINHCRFDEFFSEGCAPGSKKDSSLCKLCMGSGLNLCEPNNKEGYYGYTGAFRCLVEKGDVAFVKHQTVPQNTGGKNPDPWAKNLNEKDYELLCLDGTRKPVEEYANCHLARAPNHAVVTRKDKEACVHKILRQQQHPIWKQRN

SEQ ID NO: 750315 - protein, 105 aa, Homo sapiens
MSCCALMVPGNLWRSMRTATWPEPRITLWSHGKIRKLASTRYYVNSSCLFRSETKDLLFRDDTVCLAKLHDRNTYEKYLGEEYVKAVGNLRKCSTSCTPGSLHFP

SEQ ID NO: 750316 - protein, 505 aa, Homo sapiens
MNQLRGKKSCHTGLGRSAGWNIPIGLLYCDLPEPRKPLEKAVANFFSGSCAPCADGTDFPQLCQLCPGCGCSTLNQYFGYSGAFKCLKDGAGDVAFVKHSTIFENLANKADRDQYELLCLDNTRKPVDEYKDCHLAQVPSHTVVARSMGGKEDLIWELLNQAQEHFGKDKSKEFQLFSSPHGKDLLFKDSAHGFLKVPPRMDAKMYLGYEYVTAIRNLREGTCPEAPTDECKPVKWCALSHHERLKCDEWSVNSVGKIECVSAETTEDCIAKIMNGEADAMSLDGGFVYIAGKCGLVPVLAENYNKSDNCEDTPEAGYFAVAVVKKSASDLTWDNLKGKKSCHTAVGRTAGWNIPMGLLYNKINHCRFDEFFSEGCAPGSKKDSSLCKLCMGSGLNLCEPNNKEGYYGYTGAFRCLVEKGDVAFVKHQTVPQNTGGKNPDPWAKNLNEKDYELLCLDGTRKPVEEYANCHLARAPNHAVVTRKDKEACVHKILRQQQHPIWKQRN

SEQ ID NO: 750317 - protein, 505 aa, Homo sapiens; identical to SEQ ID NO: 750316

SEQ ID NO: 750318 - protein, 635 aa, Homo sapiens
LPVKPDELGALLVCAVPGLCLAVPDKTVRWCAVSEHEATKCQSFRDHMKSVIPSDGPSVACVKKASYLDCIRAIAANEADAVTLDAGLVYDAYLAPNNLKPVVAEFYGSKEDPQTFYYAVAVVKKDSGFQMNQLRGKKSCHTGLGRSAGWNIPIGLLYCDLPEPRKPLEKAVANFFSGSCAPCADGTDFPQLCQLCPGCGCSTLNQYFGYSGAFKCLKDGAGDVAFVKHSTIFENLANKADRDQYELLCLDNTRKPVDEYKDCHLAQVPSHTVVARSMGGKEDLIWELLNQAQEHFGKDKSKEFQLFSSPHGKDLLFKDSAHGFLKVPPRMDAKMYLGYEYVTAIRNLREGTCPEAPTDECKPVKWCALSHHERLKCDEWSVNSVGKIECVSAETTEDCIAKIMNGEADAMSLDGGFVYIAGKCGLVPVLAENYNKSDNCEDTPEAGYFAVAVVKKSASDLTWDNLKGKKSCHTAVGRTAGWNIPMGLLYNKINHCRFDEFFSEGCAPGSKKDSSLCKLCMGSGLNLCEPNNKEGYYGYTGAFRCLVEKGDVAFVKHQTVPQNTGGKNPDPWAKNLNEKDYELLCLDGTRKPVEEYANCHLARAPNHAVVTRKDKEACVHKILRQQQHPIWKQRN

SEQ ID NO: 750319 - protein, 614 aa, Homo sapiens
MRLAVGALLVCAVLGLCLAVPDKTVRWCAVSEHEATKCQSFRDHMKSVIPSDGPSVACVKKASYLDCIRAIAANEADAVTLDAGLVYDAYLAPNNLKPVVAEFYGSKEDPQTFYYAVAVVKKDSGFQMNQLRGKKSCHTGLGRSAGWNIPIGLLYCDLPEPRKPLEKAVANFFSGSCAPCADGTDFPQLCQLCPGCGCSTLNQYFGYSGAFKCLKDGAGDVAFVKHSTIFENLANKADRDQYELLCLDNTRKPVDEYKDCHLAQVPSHTVVARSMGGKEDLIWELLNQAQEHFGKDKSKEFQLFSSPHGKDLLFKDSAHGFFAIRNLREGTCPEAPTDECKPVKWCALSHHERLKCDEWSVNSVGKIECVSAETTEDCIAKIMNGEADAMSLDGGFVYIAGKCGLVPVLAENYNKSDNCEDTPEAGYFAVAVVKKSASDLTWDNLKGKKSCHTAVGRTAGWNIPMGLLYNKINHCRFDEFFSEGCAPGSKKDSSLCKLCMGSGLNLCEPNNKEGYYGYTGAFRCLVEKGDVAFVKHQTVPQNTGGKNPDPWAKNLNEKDYELLCLDGTRKPVEEYANCHLARAPNHAVVTRKDKEACVHKILRQQQHPIWKQRN

SEQ ID NO: 750320 - protein, 385 aa, Homo sapiens
MRLAVGALLVCAVLGLCLAVPDKTVRWCAVSEHEATKCQSFRDHMKSVIPSDGPSVACVKKASYLDCIRAIAANEADAVTLDAGLVYDAYLAPNNLKPVVAEFYGSKEDPQTFYYAVAVVKKDSGFQMNQLRGKKSCHTGLGRSAGWNIPIGLLYCDLPEPRKPLEKAVANFFSGSCAPCADGTDFPQLCQLCPGCGCSTLNQYFGYSGAFKCLKDGAGDVAFVKHSTIFENLANKADRDQYELLCLDNTRKPVDEYKDCHLAQVPSHTVVARSMGGKEDLIWELLNQAQEHFGKDKSKEFQLFSSPHGKDLLFKDSAHGFLKVPPRMDAKMYLGYEYVTAIRNLREGTCPEAPTDECKPVKWCALSHHERLKCDEWSVMEKLMP

SEQ ID NO: 750321 - protein, 399 aa, Homo sapiens
MVLGMWPLSSTRLYLNTRKPVDEYKDCHLAQVPSHTVVARSMGGKEDLIWELLNQAQEHFGKDKSKEFQLFSSPHGKDLLFKDSAHGFLKVPPRMDAKMYLGYEYVTAIRNLREGTCPEAPTDECKPVKWCALSHHERLKCDEWSVNSVGKIECVSAETTEDCIAKIMNGEADAMSLDGGFVYIAGKCGLVPVLAENYNKSDNCEDTPEAGYFAVAVVKKSASDLTWDNLKGKKSCHTAVGRTAGWNIPMGLLYNKINHCRFDEFFSEGCAPGSKKDSSLCKLCMGSGLNLCEPNNKEGYYGYTGAFRCLVEKGDVAFVKHQTVPQNTGGKNPDPWAKNLNEKDYELLCLDGTRKPVEEYANCHLARAPNHAVVTRKDKEACVHKILRQQQHPIWKQRN

SEQ ID NO: 750322 - protein, 621 aa, Homo sapiens
MRLAVGALLVCAVLGLCLAVPDKTVRWCAVSEHEATKCQSFRDHMKSVIPSDGPSVACVKKASYLDCIRAIAANEADAVTLDAGLVYDAYLAPNNLKPVVAEFYGSKEDPQTFYYAVAVVKKDSGFQMNQLRGKKSCHTGLGRSAGWNIPIGLLYCDLPEPRKPLEKAVANFFSGSCAPCADGTDFPQLCQLCPGCGCSTLNQYFGYSGAFKCLKDGAGDVAFVKHSTIFENLANKADRDQYELLCLDNTRKPVDEYKDCHLAQVPSHTVVARSMGGKEDLIWELLNQAQEHFGKDKSKEFQLFSSPHGKDLLFKDSAHGFLKVPPRMDAKMYLGYEYVTAIRNLREGTCPEAPTDECKPVKWCALSHHERLKCDEWSVNSVGKIECVSAETTEDCIAKIMNGEADAMSLDGGFVYIAGKCGLVPVLAENYNRYFAVAVVKKSASDLTWDNLKGKKSCHTAVGRTAGWNIPMGLLYNKINHCRFDEFFSEGCAPGSKKDSSLCKLCMGSGLNLCEPNNKEGYYGYTGAFRCLVEKGDVAFVKHQTVPQNTGGKNPDPWAKNLNEKDYELLCLDGTRKPVEEYANCHLARAPNHAVVTRKDKEACVHKILRQQQHPIWKQRN

SEQ ID NO: 750323 - protein, 414 aa, Homo sapiens
MRLAVGALLVCAVLGLCLAVPDKTVRWCAVSEHEATKCQSFRDHMKSVIPSDGPSVACVKKASYLDCIRAIAANEADAVTLDAGLVYDAYLAPNNLKPVVAEFYGSKEDPQTFYYAVAVVKKDSGFQMNQLRPEAPTDECKPVKWCALSHHERLKCDEWSVNSVGKIECVSAETTEDCIAKIMNGEADAMSLDGGFVYIAGKCGLVPVLAENYNKSDNCEDTPEAGYFAVAVVKKSASDLTWDNLKGKKSCHTAVGRTAGWNIPMGLLYNKINHCRFDEFFSEGCAPGSKKDSSLCKLCMGSGLNLCEPNNKEGYYGYTGAFRCLVEKGDVAFVKHQTVPQNTGGKNPDPWAKNLNEKDYELLCLDGTRKPVEEYANCHLARAPNHAVVTRKDKEACVHKILRQQQHPIWKQRN

SEQ ID NO: 750324 - protein, 292 aa, Homo sapiens
PPPFLLPSFSPEAPTDECKPVKWCALSHHERLKCDEWSVNSVGKIECVSAETTEDCIAKIMNGEADAMSLDGGFVYIAGKCGLVPVLAENYNKSDNCEDTPEAGYFAVAVVKKSASDLTWDNLKGKKSCHTAVGRTAGWNIPMGLLYNKINHCRFDEFFSEGCAPGSKKDSSLCKLCMGSGLNLCEPNNKEGYYGYTGAFRCLVEKGDVAFVKHQTVPQNTGGKNPDPWAKNLNEKDYELLCLDGTRKPVEEYANCHLARAPNHAVVTRKDKEACVHKILRQQQHPIWKQRN

SEQ ID NO: 750325 - protein, 544 aa, Homo sapiens
MRLAVGALLVCAVLGLCLAVPDKTVRWCAVSEHEATKCQSFRDHMKSVIPSDGPSVACVKKASYLDCIRAIAANEADAVTLDAGLVYDAYLAPNNLKPVVAEFYGSKEDPQTFYYAVAVVKKDSGFQMNQLRGKKSCHTGLGRSAGWNIPIGLLYCDLPEPRKPLEKAVANFFSGSCAPCADGTDFPQLCQLCPGCGCSTLNQYFGYSGAFKCLKDGAGDVAFVKHSTIFENLANKADRDQYELLCLDNTRKPVDEYKDCHLAQVPSHTVVARSMGGKEDLIWELLNQAQEHFGKDKSKEFQLFSSPHGKDLLFKDSAHGFLKVPPRMDAKMYLGYEYVTAIRNLREGTCPEAPTDECKPVKWCALSHHERLKCDEWSVNSVGKIECVSAETTEDCIAKIMNGEADAMSLDGGFVYIAGKCGLVPVLAENYNKSDNCEDTPEAGYFAVAVVKKSASDLTWDNLKGKKSCHTAVGRTAGWNIPMGLLYNKINHCRFDEFFSEGCAPGSKKDSSLCKLCMGSGLNLCEPNNKEGYYGYTGAFRKKP

SEQ ID NO: 750326 - protein, 590 aa, Homo sapiens
MRLAVGALLVCAVLGLCLAVPDKTVRWCAVSEHEATKCQSFRDHMKSVIPSDGPSVACVKKASYLDCIRAIAANEADAVTLDAGLVYDAYLAPNNLKPVVAEFYGSKEDPQTFYYAVAVVKKDSGFQMNQLRGKKSCHTGLGRSAGWNIPIGLLYCDLPEPRKPLEKAVANFFSGSCAPCADGTDFPQLCQLCPGCGCSTLNQYFGYSGAFKCLKDGAGDVAFVKHSTIFENLANKADRDQYELLCLDNTRKPVDEYKDCHLAQVPSHTVVARSMGGKEDLIWELLNQAQEHFGKDKSKEFQLFSSPHGKDLLFKDSAHGFLKVPPRMDAKMYLGYEYVTAIRNLREGTCPEAPTDECKPVKWCALSHHERLKCDEWSVNSVGKIECVSAETTEDCIAKIMNGEADAMSLDGGFVYIAGKCGLVPVLAENYNKSDNCEDTPEAGYFAVAVVKKSASDLTWDNLKGKKSCHTAVGRTAGWNIPMGLLYNKINHCRFDEFFSEGCAPGSKKDSSLCKLCMGSGLNLCEPNNKEGYYGYTGAFRCLVEKGDVAFVKHQTVPQNTGGKNPDPWAKNLNVPPGQSPESRCGHTER

SEQ ID NO: 750327 - protein, 632 aa, Homo sapiens; identical to SEQ ID NO: 750309

SEQ ID NO: 750328 - protein, 632 aa, Homo sapiens; identical to SEQ ID NO: 750309

SEQ ID NO: 750329 - protein, 632 aa, Homo sapiens; identical to SEQ ID NO: 750309

SEQ ID NO: 750330 - protein, 632 aa, Homo sapiens; identical to SEQ ID NO: 750309

SEQ ID NO: 750331 - protein, 638 aa, Homo sapiens
MRLAVGALLVCAVLGLCLAVPDKTVRWCAVSEHEATKCQSFRDHMKSVIPSDGPSVACVKKASYLDCIRAIAANEADAVTLDAGLVYDAYLAPNNLKPVVAEFYGSKEDPQTFYYAVAVVKKDSGFQMNQLRGKKSCHTGLGRSAGWNIPIGLLYCDLPEPRKPLEKAVANFFSGSCAPCADGTDFPQLCQLCPGCGCSTLNQYFGYSGAFKCLKDGAGDVAFVKHSTIFENLANKADRDQYELLCLDNTRKPVDEYKDCHLAQVPSHTVVARSMGGKEDLIWELLNQAQEHFGKDKSKEFQLFSSPHGKDLLFKDSAHGFLKVPPRMDAKMYLGYEYVTAIRNLREGTCPEAPTDECKPVKWCALSHHERLKCDEWSVNSVGKIECVSAETTEDCIAKIMNGEADAMSLDGGFVYIAGKCGLVPVLAENYNKSDNCEDTPEAGYFAVAVVKKSASDLTWDNLKGKKSCHTAVGRTAGWNIPMGLLYNKINHCRFDEFFSEGCAPGSKKDSSLCKLCMGSGLNLCEPNNKEGYYGYTGAFRCLVEKGDVAFVKHQTVPQNTGGKNPDPWAKNLNEKDYELLCLDGTRKPVEEYANCHLARAPNHAVVTRKDKEACVHKILRQQQLFVPVGNQGPSVQR

SEQ ID NO: 750332 - protein, 135 aa, Homo sapiens
LPVKPDELGALLVCAVPGLCLAVPDKTVRWCAVSEHEATKCQSFRDHMKSVIPSDGPSVACVKKASYLDCIRAIAANEADAVTLDAGLVYDAYLAPNNCHLARAPNHAVVTRKDKEACVHKILRQQQHPIWKQRN

SEQ ID NO: 750333 - protein, 393 aa, Homo sapiens
MRLAVGALLVCAVLGLCLAVPDKTVRWCAVSEHEATKCQSFRDHMKSVIPSDGPSVACVKKASYLDCIRAIAANEADAVTLDAGLVYDAYLAPNNLKPVVAEFYGSKEDPQTFYYAVAVVKKDSGFQMNQLRGKKSCHTGLGRSAGWNIPIGLLYCDLPEPRKPLEKAVANFFSGSCAPCADGTDFPQLCQLCPGCGCSTLNQYFGYSGAFKCLKDGAGDVAFVKHSTIFENLANKADRDQYELLCLDNTRKPVDEYKDCHLAQVPSHTVVARSMGGKEDLIWELLNQAQEHFWAKKKKNKKKKIFLAPPLGPLRESFKRPIGWAGGPPSADEVTPGSHSWSPRKHPGHGNTGSRIPPPITTPPRQTRRSDTHPKAHSDTTQASTPDTNQAHV

SEQ ID NO: 750334 - protein, 178 aa, Homo sapiens
MNQLRGKKSCHTGLGRSAGWNIPIGLLYCDLPEPRKPLEKAVANFFSGSCAPCADGTDFPQLCQLCPGCGCSTLNQYFGYSGAFKCLKDGAGDVAFVKHSTIFENLANKADRDQYELLCLDNTRKPVDEYKDCHLAQVPSHTVVARSMGGKEDLIWELLNQAQEHFGKDFKSFLFALL

SEQ ID NO: 750335 - protein, 243 aa, Homo sapiens
MRLAVGALLVCAVLGLCLAVPDKTVRWCAVSEHEATKCQSFRDHMKSVIPSDGPSVACVKKASYLDCIRAIAANEADAVTLDAGLVYDAYLAPNNLKPVVAEFYGSKEDPQTFYYAVAVVKKDSGFQMNQLRGKKSCHTGLGRSAGWNIPIGLLYCDLPEPRKPLEKAVANFFSGSCAPCADGTDFPQLCQLCPGCGCSTLNQYFGYSGAFKCLKDGAGDVAFVKHSTIFENLQTAGRPSRYR

SEQ ID NO: 750336 - protein, 175 aa, Homo sapiens
MRLAVGALLVCAVLGLCLAVPDKTVRWCAVSEHEATKCQSFRDHMKSVIPSDGPSVACVKKASYLDCIRAIAANEADAVTLDAGLVYDAYLAPNNLKPVVAEFYGSKEDPQTFYYAVAVVKKDSGFQMNQLRGKKSCHTGLGRSAGWNIPIGLLYCDLPEPRKPLEKAVANFCVF

SEQ ID NO: 750337 - protein, 184 aa, Homo sapiens
SLPGITRGIGVKMEEYAREPCPWRIVDDCGGAFTMGTIGGGIFQAIKGFRNSPVGVNHRLRGSLTAIKTRAPQLGGSFAVWGGLFSMIDCSMVQVRGKEDPWNSITSGALTGAILAARNGPVAMVGSAAMGGILLALIEGAGILLTRLCLCTVSQWSSVCRRPLPVCLQLSYLPHLCGDYRQYQ

SEQ ID NO: 750338 - protein, 69 aa, Homo sapiens
LRNERQFKEEKLAEQLKQAEELRQYKVLVHSQERELTQLREKLREGRDASRSLNQHLLRIPGTPSQVVP

SEQ ID NO: 750339 - protein, 190 aa, Homo sapiens
KQWYQRRVPITAGGIGVKMEEYAREPCPWRIVDDCGGAFTMGTIGGGIFQAIKGFRNSPVGVNHRLRGSLTAIKTRAPQLGGSFAVWGGLFSMIDCSMVQVRGKEDPWNSITSGALTGAILAARNGPVAMVGSAAMGGILLALIEGAGILLTRLCLCTVSQWSSVCRRPLPVCLQLSYLPHLCGDYRQYQ

SEQ ID NO: 750340 - protein, 181 aa, Homo sapiens
KQWYQRRVPITAGGIGVKMEEYAREPCPWRIVDDCGGAFTMGTIGGGIFQAIKGFRNSPVGVNHRLRGSLTASSFAVWGGLFSMIDCSMVQVRGKEDPWNSITSGALTGAILAARNGPVAMVGSAAMGGILLALIEGAGILLTRLCLCTVSQWSSVCRRPLPVCLQLSYLPHLCGDYRQYQ

SEQ ID NO: 750341 - protein, 78 aa, Homo sapiens
AYAGLGMSSADVHSDRDIVRGLDDWDYSGRLFKQPKVVVKFSSWEKYTDSARDVDKLVKTQVCTVRSVALQFGEGCFP

SEQ ID NO: 750342 - protein, 184 aa, Homo sapiens; identical to SEQ ID NO: 750337

SEQ ID NO: 750343 - protein, 183 aa, Homo sapiens
SLPGITRGIGVKMEEYAREPCPWRIVDDCGGAFTMGTIGGGIFQAIKGFRNSPVGVNHRLRGSLTAIKTRAPQLGGSFAVWGGLFSMIDCSMVQVRGKEDPWNSITSGALTGAILAARNGPVAMVGSAAMGGILLALIEGAGILLTRLCLCTVSQCVPSTQLPSSPLWRLSTISVGLLSLGFL

SEQ ID NO: 750344 - protein, 89 aa, Homo sapiens
KQWYQRRVPITAGGIGVKMEEYAREPCPWRIVDDCGGAFTMGTIGGGIFQAIKGFRNSPVGVNHRLRGSLTAIKTRAPQLGGKQNFHFN

SEQ ID NO: 750345 - protein, 184 aa, Homo sapiens; identical to SEQ ID NO: 750337

SEQ ID NO: 750346 - protein, 101 aa, Homo sapiens
KQWYQRRVPITAGGIGVKMEEYAREPCPWRIVDDCGGAFTMGTIGGGIFQAIKGFRNSPVGVNHRLRGSLTAIKTRAPQLGVMKKLVLLLSPIFQMRKFSS

SEQ ID NO: 750347 - protein, 88 aa, Homo sapiens
KQWYQRRVPITAGGIGVKMEEYAREPCPWRIVDDCGGAFTMGTIGGGIFQAIKGFRNSPVGVNHRLRGSLTAIKTRAPQLGAWIGLHL

SEQ ID NO: 750348 - protein, 147 aa, Homo sapiens
KQWYQRRVPITAGGIGVKMEEYAREPCPWRIVDDCGGAFTMGTIGGGIFQAIKGFRNSPVGVNHRLRGSLTAIKTRAPQLGDGPVAMVGSAAMGGILLALIEGAGILLTRLCLCTVSQWSSVCRRPLPVCLQLSYLPHLCGDYRQYQ

SEQ ID NO: 750349 - protein, 100 aa, Homo sapiens
AVVSTQSAHYGRGHWSQDGGVRARALVSFTAVFAFLLPPCPLPSFSLVQAPKVQARLNRSLVDLGLVTGQCGLSRPVGFLALYLVPPRPREPPSPNPAPV

SEQ ID NO: 750350 - protein, 183 aa, Homo sapiens
MSAARESHPHGVKRSASPDDDLGSSNWEAADLGNEERKQKFLRLMGAGKKEHTGRLVIGDHKSTSHFRTGEEDKKINEELESQYQQSMDSKLSGRYRRHCGLGFSEVEDHDGEGDVAGDDDDDDDDSPDPESPDDSESDSESEKEESAEELQAAEHPDEVEDPKNKKDAKSNYKMMFVKSSGS

SEQ ID NO: 750351 - protein, 79 aa, Homo sapiens
MEKVMWLEMMMMTMMIHLILKVQMILKAIQSQRKEESAEETPKLLSTLTVKAGDPPHKVPNGLINDARYTHGPYPPSPF

SEQ ID NO: 750352 - protein, 74 aa, Homo sapiens
MWEAARLGYMNERKRKVLETYGCMRNEQNILVVLFIRRSQINISLPNRTCNLLKNWRLISATFAHATYRPTRDS

SEQ ID NO: 750353 - protein, 80 aa, Homo sapiens
YLEDPELLLRENLCWFCGWEERREGSAFFVGIPVEGCSAAMKSLTRHGVNAFMPSLETDDLGSSTWEAAGSRGSSRNSRG

SEQ ID NO: 750354 - protein, 183 aa, Homo sapiens; identical to SEQ ID NO: 750350

SEQ ID NO: 750355 - protein, 183 aa, Homo sapiens; identical to SEQ ID NO: 750350

SEQ ID NO: 750356 - protein, 183 aa, Homo sapiens; identical to SEQ ID NO: 750350

SEQ ID NO: 750357 - protein, 183 aa, Homo sapiens; identical to SEQ ID NO: 750350

SEQ ID NO: 750358 - protein, 183 aa, Homo sapiens; identical to SEQ ID NO: 750350

SEQ ID NO: 750359 - protein, 183 aa, Homo sapiens; identical to SEQ ID NO: 750350

SEQ ID NO: 750360 - protein, 88 aa, Homo sapiens
VVALLWRPSARDCKLLVQRGKHGAQRSGSRQFIQSRIAQSKGCMCGAMNDVVPGQCGIERWVHDTSPSRLTNLGDRSNLARQASTVGT

SEQ ID NO: 750361 - protein, 148 aa, Homo sapiens
MMSLTRHGVNAFMPSLETDDMGLSSFRKTSSKLPLSLHYAGDLAMWEAARLGYMNERKRKVLETYGCMRNEQNILVVLFIRRSQINISLPNRQEDIGDIVDCGFSEVEDHDGEGDVAGDDDDDDDDSPDPESPDDSESDSESEKRRIC

SEQ ID NO: 750362 - protein, 81 aa, Homo sapiens
MMEKVMWLEMMMMTMMIHLILKVQMILKAIQSQRKEESAEETPKLLSTLTCTAGSQHPNTFTQHTLHSTSALTCLPHSPRP

SEQ ID NO: 750363 - protein, 106 aa, Homo sapiens [sequence omitted]

SEQ ID NO: 750364 - protein, 98 aa, Homo sapiens
RWRGTGFSPGPQLEAGSRARRSRPCPVTTGKKKVLPRRRSGDLAMWEAARLGYMNERKRKVLETYGCMRNEQNILVVLFIRRSQINISLPNRGRRQEN

SEQ ID NO: 750365 - protein, 104 aa, Homo sapiens
MWEAARLGYMNERKRKVLETYGCMRNEQNILVVLFIRRSQINISLPNRQEDIGDIVDCGFSEVEDHDGEGDVAGDDDDDDDDSPDPESPDDSESDSESEKRRIC

SEQ ID NO: 750366 - protein, 183 aa, Homo sapiens; identical to SEQ ID NO: 750350

SEQ ID NO: 750367 - protein, 183 aa, Homo sapiens; identical to SEQ ID NO: 750350

SEQ ID NO: 750368 - protein, 183 aa, Homo sapiens; identical to SEQ ID NO: 750350

SEQ ID NO: 750369 - protein, 183 aa, Homo sapiens; identical to SEQ ID NO: 750350

SEQ ID NO: 750370 - protein, 183 aa, Homo sapiens; identical to SEQ ID NO: 750350

SEQ ID NO: 750371 - protein, 233 aa, Homo sapiens
MYHGMNPSNGDGFLEQQQQQQQPQSPQRLLAVILWFQLALCFGPAQLTGGFDDLQVCADPGIPENGFRTPSGGVFFEGSVARFHCQDGFKLKGATKRLCLKHFNGTLGWIPSDNSICVQEDCRIPQIEDAEIHNKTYRHGEKLIITCHEGFKIRYPDLHNMVSLCRDDGTWNNLPICQGPLAPQHTPAQGTRTQAQGSQKPVTASQALLSCSKVCIHLPGAKRAPTLLRTTLT

SEQ ID NO: 750372 - protein, 290 aa, Homo sapiens
MYHGMNPSNGDGFLEQQQQQQQPQSPQRLLAVILWFQLALCFGPAQLTGGFDDLQVCADPGIPENGFRTPSGGVFFEGSVARFHCQDGFKLKGATKRLCLKHFNGTLGWIPSDNSICVQEDCRIPQIEDAEIHNKTYRHGEKLIITCHEGFKIRYPDLHNMVSLCRDDGTWNNLPICQGCLRPLASSNGYVNISELQTSFPVGTVISYRCFPGFKLDGSAYLECLQNLIWSSSPPRCLALEGGRPEHLFPVLYFPHIRLAAAVLYFCPVLKSSPTPAPTCSSTSTTTSLF

SEQ ID NO: 750373 - protein, 233 aa, Homo sapiens; identical to SEQ ID NO: 750371

SEQ ID NO: 750374 - protein, 255 aa, Homo sapiens [sequence omitted]

SEQ ID NO: 750375 - protein, 110 aa, Homo sapiens
GALEMLLTGNLSPSEHGLVLSAWPLILWGLFLLWLLSVAEQPDFFACGRNLPLQSGSCKITSSPEGHWCHILLVRTNLMASPDSGGGKHNPPFDRLFPKTATAISYQKST

SEQ ID NO: 750376 - protein, 115 aa, Homo sapiens
SFPYPHLPSLLLEPRKKPSAELAFRRFFFKYQFPFVPRQPPIRAGVCWVWRKAGIVFHAPGGKVVHLLFFLIRFPAILQESQWLQLLLSAISGGSPCLRPYTLIPWQEEKNKTKQ

SEQ ID NO: 750377 - protein, 408 aa, Homo sapiens
MAEGTAEAPLENGGGGDSGAGALERGVAPIKRQYLTTKEQFHQFLEAKGQEKTCRETELDIRGKLYLAPLTTCGNLPFRRICKRFGADVTCGEMAVCTNLLQGQMSEWALLKRHQCEDIFGVQLEGAFPDTMTKCAELLSRTVEVDFVDINVGCPIDLVYKKGGGCALMNRSTKFQQIVRGMNQVLDVPLTVKIRTGVQERVNLAHRLLPELRDWGVALVTLHGRSREQRYTKLADWQYIEECVQAASPMPLFGNGDILSFEDANRAMQTGVTGIMIARGALLKPWLFTEIKEQRHWDISSSERLDILRDFTNYGLEHWGSDTQGVEKTRRFLLEWLSFLCRYVPVGLLERLPQRINERPPYYLGRDYLETLMASQKAADWIRISEMLLGPVPPSFAFLPKHKANAYK

SEQ ID NO: 750378 - protein, 311 aa, Homo sapiens
MAEGTAEAPLENGGGGDSGAGALERGVAPIKRQYLTTKEQFHQFLEAKGQEKTCRETEVGDPAGNELAEPEAKRIRLEDGQTADGQTEEAAEPGEQLQTQKRARGQNKGRPHVKPTNYDKNRLCPSLIQESAAKCFFGDRCRFLHDVGRYLETKPADLGPRCVLFETFGRCPYGVTCRFAGAHLRPEGQNLVQEELAARGTQPPSIRNGLDKALQQQLRKREVRFERAEQALRRFSQGPTPAAAVPEGTAAEGAPRQENCGAQQVPAGPGTSTFQSPGELGPGGETASCGVKKGGSWNLAYRGRLERGRGE

SEQ ID NO: 750379 - protein, 686 aa, Homo sapiens
MAEGTAEAPLENGGGGDSGAGALERGVAPIKRQYLTTKEQFHQFLEAKGQEKTCRETEVGDPAGNELAEPEAKRIRLEDGQTADGQTEEAAEPGEQLQTQKRARGQNKGRPHVKPTNYDKNRLCPSLIQESAAKCFFGDRCRFLHDVGRYLETKPADLGPRCVLFETFGRCPYGVTCRFAGAHLRPEGQNLVQEELAARGTQPPSIRNGLDKALQQQLRKREVRFERAEQALRRFSQGPTPAAAVPEGTAAEGAPRQENCGAQQVPAGPGTSTPPSSPVRTCGPLTDEDVVRLRPCEKKRLDIRGKLYLAPLTTCGNLPFRRICKRFGADVTCGEMAVCTNLLQGQMSEWALLKRHQCEDIFGVQLEGAFPDTMTKCAELLSRTVEVDFVDINVGCPIDLVYKKGGGCALMNRSTKFQQIVRGMNQVLDVPLTVKIRTGVQERVNLAHRLLPELRDWGVALVTLHGRSREQRYTKLADWQYIEECVQAASPMPLFGNGDILSFEDANRAMQTGVTGIMIARGALLKPWLFTEIKEQRHWDISSSERLDILRDFTNYGLEHWGSDTQGVEKTRRFLLEWLSFLCRYVPVGLLERLPQRINERPPYYLGRDYLETLMASQKAADWIRIRCLGGLELGSCSRGPGVTEGTLQVLGLTSLFHLLSHSEMLLGPVPPSFAFLPKHKANAYK

SEQ ID NO: 750380 - protein, 650 aa, Homo sapiens
MAEGTAEAPLENGGGGDSGAGALERGVAPIKRQYLTTKEQFHQFLEAKGQEKTCRETEVGDPAGNELAEPEAKRIRLEDGQTADGQTEEAAEPGEQLQTQKRARGQNKGRPHVKPTNYDKNRLCPSLIQESAAKCFFGDRCRFLHDVGRYLETKPADLGPRCVLFETFGRCPYGVTCRFAGAHLRPEGQNLVQEELAARGTQPPSIRNGLDKALQQQLRKREVRFERAEQALRRFSQGPTPAAAVPEGTAAEGAPRQENCGAQQVPAGPGTSTPPSSPVRTCGPLTDEDVVRLRPCEKKRLDIRGKLYLAPLTTCGNLPFRRICKRFGADVTCGEMAVCTNLLQGQMSEWALLKRHQCEDIFGVQLEGAFPDTMTKCAELLSRTVEVDFVDINVGCPIDLVYKKGGGCALMNRSTKFQQIVRGMNQVLDVPLTVKIRTGVQERVNLAHRLLPELRDWGVALVTLHGRSREQRYTKLADWQYIEECVQAASPMPLFGNGDILSFEDANRAMQTGVTGIMIARGALLKPWLFTEIKEQRHWDISSSERLDILRDFTNYGLEHWGSDTQGVEKTRRFLLEWLSFLCRYVPVGLLERLPQRINERPPYYLGRDYLETLMASQKAADWIRISEMLLGPVPPSFAFLPKHKANAYK

SEQ ID NO: 750381 - protein, 639 aa, Homo sapiens
MAEGTAEAPLENGGGGDSGAGALERGVAPIKRQYLTTKEQFHQFLEAKGQEKTCRETEVGDPAGNELAEPEAKRIRLEDGQTADGQTEEAAEPGEQLQTQKRARGQNKGRPHVKPTNYDKNRLCPSLIQESAAKCFFGDRCRFLHDVGRYLETKPADLGPRCVLFETFGRCPYGVTCRFAGAHLRPEGQNLVQEELAARGTQPPSIRNGLDKALQQQLRKREVRFERAEQALRRFSQGPTPAAAVPEGTAAEGAPRQENCGAQQVPAGPGTSTPPSSPVRTCGPLTDEDVVRLRPCEKKRLDIRGKLYLAPLTTCGNLPFRRICKRFGADVTCGEMAVCTNLLQGQMSEWALLKRHQCEDIFGVQLEGAFPDTMTKCAELLSRTVEVDFVDINVGCPIDLVYKKGGGCALMNRSTKFQQIVRGMNQVLDVPLTVKIRTGVQERVNLAHRLLPELRDWGVALVTLHGRSREQRYTKLADWQYIEECVQAASPMPLFGNGDILSFEDANRAMQTGVTGIMIARGALLKPWLFTEIKEQRHWDISSSERLDILRDFTNYGLEHWGSDTQGVEKTRRFLLEWLSFLCRYVPVGLLERLPQRINERPPYYLGRDYLETLMASQKAADWIRISNAPCRALNPLST

SEQ ID NO: 750382 - protein, 691 aa, Homo sapiens
MAEGTAEAPLENGGGGDSGAGALERGVAPIKRQYLTTKEQFHQFLEAKGQEKTCRETEVGDPAGNELAEPEAKRIRLEDGQTADGQTEEAAEPGEQLQTQKRARGQNKGRPHVKPTNYDKNRLCPSLIQESAAKCFFGDRCRFLHDVGRYLETKPADLGPRCVLFETFGRCPYGVTCRFAGAHLRPEGQNLVQEELAARGTQPPSIRNGLDKALQQQLRKREVRFERAEQALRRFSQGPTPAAAVPEGTAAEGAPRQENCGAQQVPAGPGTSTPPSSPVRTCGPLTDEDVVRLRPCEKKRLDIRGKLYLAPLTTCGNLPFRRICKRFGADVTCGEMAVCTNLLQGQMSEWALLKRHQCEDIFGVQLEGAFPDTMTKCAELLSRTVEVDFVDINVGCPIDLVYKKGGGCALMNRSTKFQQIVRGMNQVRPATSSHWLPNNSPGPCLPPPPTVSHHLPPSPTTSHHRLQVLDVPLTVKIRTGVQERVNLAHRLLPELRDWGVALVTLHGRSREQRYTKLADWQYIEECVQAASPMPLFGNGDILSFEDANRAMQTGVTGIMIARGALLKPWLFTEIKEQRHWDISSSERLDILRDFTNYGLEHWGSDTQGVEKTRRFLLEWLSFLCRYVPVGLLERLPQRINERPPYYLGRDYLETLMASQKAADWIRISEMLLGPVPPSFAFLPKHKANAYK

SEQ ID NO: 750383 - protein, 726 aa, Homo sapiens
MAEGTAEAPLENGGGGDSGAGALERGVAPIKRQYLTTKEQFHQFLEAKGQEKTCRETEVGDPAGNELAEPEAKRIRLEDGQTADGQTEEAAEPGEQLQTQKRARGQNKGRPHVKPTNYDKNRLCPSLIQESAAKCFFGDRCRFLHDVGRYLETKPADLGPRCVLFETFGRCPYGVTCRFAGAHLRPEGQNLVQEELAARGTQPPSIRNGLDKALQQQLRKREVRFERAEQALRRFSQGPTPAAAVPEGTAAEGAPRQENCGAQQVPAGPGTSTPPSSPVRTCGPLTDEDVVRLRPCEKKRLDIRGKLYLAPLTTCGNLPFRRICKRFGADVTCGEMAVCTNLLQGQMSEWALLKRHQCEDIFGVQLEGAFPDTMTKCAELLSRTVEVDFVDINVGCPIDLVYKKVAALDVCLGFPIWAEEALTQPAMSRWRVRGLGSSVALESLPFLQVGVSWWGPPGSRGEGSWVSPRPALPPPACLFQGGGCALMNRSTKFQQIVRGMNQVLDVPLTVKIRTGVQERVNLAHRLLPELRDWGVALVTLHGRSREQRYTKLADWQYIEECVQAASPMPLFGNGDILSFEDANRAMQTGVTGIMIARGALLKPWLFTEIKEQRHWDISSSERLDILRDFTNYGLEHWGSDTQGVEKTRRFLLEWLSFLCRYVPVGLLERLPQRINERPPYYLGRDYLETLMASQKAADWIRISEMLLGPVPPSFAFLPKHKANAYK

SEQ ID NO: 750384 - protein, 743 aa, Homo sapiens
MAEGTAEAPLENGGGGDSGAGALERGVAPIKRQYLTTKEQFHQFLEAKGQEKTCRETEVGDPAGNELAEPEAKRIRLEDGQTADGQTEEAAEPGEQLQTQKRARGQNKGRPHVKPTNYDKNRLCPSLIQESAAKCFFGDRCRFLHDVGRYLETKPADLGPRCVLFETFGRCPYGVTCRFAGAHLRPEGQNLVQEELAARGTQPPSIRNGLDKALQQQLRKREVRFERAEQALRRFSQGPTPAAAVPEGTAAEGAPRQENCGAQQVPAGPGTSTPPSSPVRTCGPLTDEDVVRLRPCEKKRLDIRGKLYLAPLTTCGNLPFRRICKRFGADVTCGEMAVCTNLLQGQMSEWALLKRHQCEDIFGVQLEGAFPDTMTKCAELLSRTVEVDFVDINVGCPIDLVYKKGGGCALMNRSTKFQQIVRGMNQVLDVPLTVKIRTGVQERVNLAHRLLPELRDWGVALVTPGSLGLFLSAVSLSASYPAWRLLPQLHGRSREQRYTKLADWQYIEECVQAASPMPLFGGCSGKPPPSPLPPLVTHTSGLFAFHLGPPRTTLMGATGSAKTPEGLVSRTPGPTCPCLPETPASVSSGNGDILSFEDANRAMQTGVTGIMIARGALLKPWLFTEIKEQRHWDISSSERLDILRDFTNYGLEHWGSDTQGVEKTRRFLLEWLSFLCRYVPVGLLERLPQRINERPPYYLGRDYLETLMASQKAADWIRISEMLLGPVPPSFAFLPKHKANAYK

SEQ ID NO: 750385 - protein, 485 aa, Homo sapiens
MAEGTAEAPLENGGGGDSGAGALERGVAPIKRQYLTTKEQFHQFLEAKGQEKTCRETEVGDPAGNELAEPEAKRIRLEDGQTADGQTEEAAEPGEQLQTQKRARGQNKGRPHVKPTNYDKNRLCPSLIQESAAKCFFGDRCRFLHDVGRYLETKPADLGPRCVLFETFGRCPYGVTCRFAGAHLRPEGQNLVQEELAARGTQPPSIRNGLDKALQQQLRKREVRFERAEQALRRFSQGPTPAAAVPEGTAAEGAPRQENCGAQQVPAGPGTSTPPSSPVRTCGPLTDEDVVRLRPCEKKRLDIRGKLYLAPLTTCGNLPFRRICKRFGADVTCGEMAVCTNLLQGQMSEWALLKRHQCEDIFGVQLEGAFPDTMTKCAELLSRTVEVDFVDINVGCPIDLVYKKGGGCALMNRSTKFQQIVRGMNQVLDVPLTVKIRTGVQERVNLAHRLLPELRDWGVALVTEMGTSCHLRMPTAPCRLVSPGS

SEQ ID NO: 750386 - protein, 539 aa, Homo sapiens [sequence omitted]

SEQ ID NO: 750387 - protein, 311 aa, Homo sapiens; identical to SEQ ID NO: 750378

SEQ ID NO: 750388 - protein, 284 aa, Homo sapiens
MAEGTAEAPLENGGGGDSGAGALERGVAPIKRQYLTTKEQFHQFLEAKGQEKTCRETEVGDPAGNELAEPEAKRIRLEDGQTADGQTEEAAEPGEQLQTQKRARGQNKGRPHVKPTNYDKNRLCPSLIQESAAKCFFGDRCRFLHDVGRYLETKPADLGPRCVLFETFGRCPYGVTCRFAGAHLRPEGQNLLEHWGSDTQGVEKTRRFLLEWLSFLCRYVPVGLLERLPQRINERPPYYLGRDYLETLMASQKAADWIRISEMLLGPVPPSFAFLPKHKANAYK

SEQ ID NO: 750389 - protein, 153 aa, Homo sapiens
MASRGHTIPGRLVAGPTDRHPSHSGALLKPWLFTEIKEQRHWDISSSERLDILRDFTNYGLEHWGSDTQGVEKTRRFLLEWLSFLCRYVPVGLLERLPQRINERPPYYLGRDYLETLMASQKAADWIRISEMLLGPVPPSFAFLPKHKANAYK

SEQ ID NO: 750390 - protein, 83 aa, Homo sapiens
LLPGPRLPGDADGQPEGSRLDPHQVPGWAGVGELQSGARGHGGYFAGPGPDLAFHLLSHSEMLLGPVPPSFAFLPKHKANAYK

SEQ ID NO: 750391 - protein, 650 aa, Homo sapiens; identical to SEQ ID NO: 750380

SEQ ID NO: 750392 - protein, 650 aa, Homo sapiens; identical to SEQ ID NO: 750380

SEQ ID NO: 750393 - protein, 640 aa, Homo sapiens
MAEGTAEAPLENGGGGDSGAGALERGVAPIKRQYLTTKEQFHQFLEAKGQEKTCRETEVGDPAGNELAEPEAKRIRLEDGQTADGQTEEAAEPGEQLQTQKRARGQNKGRPHVKPTNYDKNRLCPSLIQESAAKCFFGDRCRFLHDVGRYLETKPADLGPRCVLFETFGRCPYGVTCRFAGAHLRPEGQNLVQEELAARGTQPPSIRNGLDKALQQQLRKREVRFERAEQALRRFSQGPTPAAAVPEGTAAEGAPRQENCGAQQVPAGPGTSTPPSSPVRTCGPLTDEDVVRLRPCEKKRLDIRGKLYLAPLTTCGNLPFRRICKRFGADVTCGEMAVCTNLLQGQMSEWALLKRHQCEDIFGVQLEGAFPDTMTKCAELLSRTVEVDFVDINVGCPIDLVYKKGGGCALMNRSTKFQQIVRGMNQVLDVPLTVKIRTGVQERVNLAHRLLPELRDWGVALVTLHGRSREQRYTKLADWQYIEECVQAASPMPLFGNGDILSFEDANRAMQTGVTGIMIARGALLKPWLFTEIKEQRHWDISSSERLDILRDFTNYGLEHWGSDTQGVEKTRRFLLEWLSFLCRYVPVGLLERLPQRINERPPYYLGRDYLETLMASQKAADWIRISKCSLSCDWDTLGH

SEQ ID NO: 750394 - protein, 722 aa, Homo sapiens
MAEGTAEAPLENGGGGDSGAGALERGVAPIKRQYLTTKEQFHQFLEAKGQEKTCRETEVGDPAGNELAEPEAKRIRLEDGQTADGQTEEAAEPGEQLQTQKRARGQNKGRPHVKPTNYDKNRLCPSLIQESAAKCFFGDRCRFLHDVGRYLETKPADLGPRCVLFETFGRCPYGVTCRFAGAHLRPEGQNLVQEELAARGTQPPSIRNGLDKALQQQLRKREVRFERAEQALRRFSQGPTPAAAVPEGTAAEGAPRQENCGAQQVPAGPGTSTPPSSPVRTCGPLTDEDVVRLRPCEKKRLDIRGKLYLAPLTTCGNLPFRRICKRFGADVTCGEMAVCTNLLQGQMSEWALLKRHQCEDIFGVQLEGAFPDTMTKCAELLSRTVEVDFVDINVGCPIDLVYKKGGGCALMNRSTKFQQIVRGMNQVLDVPLTVKIRTGVQERVNLAHRLLPELRDWGVALVTVGLGTPRALGPRGRPRVPSYMAPLLPSLPLHLHTSLCLRLCLSLSLSAWLSWSLPLCVSLSASYPAWRLLPQLHGRSREQRYTKLADWQYIEECVQAASPMPLFGNGDILSFEDANRAMQTGVTGIMIARGALLKPWLFTEIKEQRHWDISSSERLDILRDFTNYGLEHWGSDTQGVEKTRRFLLEWLSFLCRYVPVGLLERLPQRINERPPYYLGRDYLETLMASQKAADWIRISEMLLGPVPPSFAFLPKHKANAYK

SEQ ID NO: 750395 - protein, 675 aa, Homo sapiens
MAEGTAEAPLENGGGGDSGAGALERGVAPIKRQYLTTKEQFHQFLEAKGQEKTCRETEVGDPAGNELAEPEAKRIRLEDGQTADGQTEEAAEPGEQLQTQKRARGQNKGRPHVKPTNYDKNRLCPSLIQESAAKCFFGDRCRFLHDVGRYLETKPADLGPRCVLFETFGRCPYGVTCRFAGAHLRPEGQNLVQEELAARGTQPPSIRNGLDKALQQQLRKREVRFERAEQALRRFSQGPTPAAAVPEGTAAEGAPRQENCGAQQVPAGPGTSTPPSSPVRTCGPLTDEDVVRLRPCEKKRLDIRGKLYLAPLTTCGNLPFRRICKRFGADVTCGEMAVCTNLLQGQMSEWALLKRHQCEDIFGVQLEGAFPDTMTKCAELLSRTVEVDFVDINVGCPIDLVYKKGGGCALMNRSTKFQQIVRGMNQVLDVPLTVKIRTGVQERVNLAHRLLPELRDWGVALVTPGSLGLFLSAVSLSASYPAWRLLPQLHGRSREQRYTKLADWQYIEECVQAASPMPLFGNGDILSFEDANRAMQTGVTGIMIARGALLKPWLFTEIKEQRHWDISSSERLDILRDFTNYGLEHWGSDTQGVEKTRRFLLEWLSFLCRYVPVGLLERLPQRINERPPYYLGRDYLETLMASQKAADWIRISEMLLGPVPPSFAFLPKHKANAYK

SEQ ID NO: 750396 - protein, 767 aa, Homo sapiens
MAEGTAEAPLENGGGGDSGAGALERGVAPIKRQYLTTKEQFHQFLEAKGQEKTCRETEVGDPAGNELAEPEAKRIRLEDGQTADGQTEEAAEPGEQLQTQKRARGQNKGRPHVKPTNYDKNRLCPSLIQESAAKCFFGDRCRFLHDVGRYLETKPADLGPRCVLFETFGRCPYGVTCRFAGAHLRPEGQNLVQEELAARGTQPPSIRNGLDKALQQQLRKREVRFERAEQALRRFSQGPTPAAAVPEGTAAEGAPRQENCGAQQVPAGPGTSTPPSSPVRTCGPLTDEDVVRLRPCEKKRLDIRGKLYLAPLTTCGNLPFRRICKRFGADVTCGEMAVCTNLLQGQMSEWALLKRHQCEDIFGVQLEGAFPDTMTKCAELLSRTVEVDFVDINVGCPIDLVYKKVAALDVCLGFPIWAEEALTQPAMSRWRVRGLGSSVALESLPFLQVGVSWWGPPGSRGEGSWVSPRPALPPPACLFQGGGCALMNRSTKFQQIVRGMNQVRPATSSHWLPNNSPGPCLPPPPTVSHHLPPSPTTPTTVLQVLDVPLTVKIRTGVQERVNLAHRLLPELRDWGVALVTLHGRSREQRYTKLADWQYIEECVQAASPMPLFGNGDILSFEDANRAMQTGVTGIMIARGALLKPWLFTEIKEQRHWDISSSERLDILRDFTNYGLEHWGSDTQGVEKTRRFLLEWLSFLCRYVPVGLLERLPQRINERPPYYLGRDYLETLMASQKAADWIRISEMLLGPVPPSFAFLPKHKANAYK

SEQ ID NO: 750397 - protein, 662 aa, Homo sapiens
AEGEKPPALHSGPFFRLQGGQRRYLRSCTLGPVTCAKDTTCMLGRYLTTKEQFHQFLEAKGQEKTCRETEVGDPAGNELAEPEAKRIRLEDGQTADGQTEEAAEPGEQLQTQKRARGQNKGRPHVKPTNYDKNRLCPSLIQESAAKCFFGDRCRFLHDVGRYLETKPADLGPRCVLFETFGRCPYGVTCRFAGAHLRPEGQNLVQEELAARGTQPPSIRNGLDKALQQQLRKREVRFERAEQALRRFSQGPTPAAAVPEGTAAEGAPRQENCGAQQVPAGPGTSTPPSSPVRTCGPLTDEDVVRLRPCEKKRLDIRGKLYLAPLTTCGNLPFRRICKRFGADVTCGEMAVCTNLLQGQMSEWALLKRHQCEDIFGVQLEGAFPDTMTKCAELLSRTVEVDFVDINVGCPIDLVYKKGGGCALMNRSTKFQQIVRGMNQVLDVPLTVKIRTGVQERVNLAHRLLPELRDWGVALVTLHGRSREQRYTKLADWQYIEECVQAASPMPLFGNGDILSFEDANRAMQTGVTGIMIARGALLKPWLFTEIKEQRHWDISSSERLDILRDFTNYGLEHWGSDTQGVEKTRRFLLEWLSFLCRYVPVGLLERLPQRINERPPYYLGRDYLETLMASQKAADWIRISEMLLGPVPPSFAFLPKHKANAYK

SEQ ID NO: 750398 - protein, 304 aa, Homo sapiens
MSEWALLKRHQCEDIFGVQLEGAFPDTMTKCAELLSRTVEVDFVDINVGCPIDLVYKKGGGCALMNRSTKFQQIVRGMNQVLDVPLTVKIRTGVQERVNLAHRLLPELRDWGVALVTLHGRSREQRYTKLADWQYIEECVQAASPMPLFGNGDILSFEDANRAMQTGVTGIMIARGALLKPWLFTEIKEQRHWDISSSERLDILRDFTNYGLEHWGSDTQGVEKTRRFLLEWLSFLCRYVPVGLLERLPQRINERPPYYLGRDYLETLMASQKAADWIRISEMLLGPVPPSFAFLPKHKANAYK

SEQ ID NO: 750399 - protein, 352 aa, Homo sapiens
MAEGTAEAPLENGGGGDSGAGALERGVAPIKRQYLTTKEQFHQFLEAKGQEKTCRETEVGDPAGNELAEPEAKRIRLEDGQTADGQTEEAAEPGEQLQTQKRARGQNKGRPHVKPTNYDKNRLCPSLIQESAAKCFFGDRCRFLHDVGRYLETKPADLGPRCVLFETFGRCPYGVTCRFAGAHLRPEGQNLPSLCSSGNGDILSFEDANRAMQTGVTGIMIARGALLKPWLFTEIKEQRHWDISSSERLDILRDFTNYGLEHWGSDTQGVEKTRRFLLEWLSFLCRYVPVGLLERLPQRINERPPYYLGRDYLETLMASQKAADWIRISEMLLGPVPPSFAFLPKHKANAYK

SEQ ID NO: 750400 - protein, 183 aa, Homo sapiens
MEAEATRSQAGWWLGPLIVTRPTVAPCSSRGSSRRSRSSGTGTSRRPSAWTSCGTSPTTAWSTGARTRRAWRRPGAFCSSGCPSCAGGHRGWLGWAARGPRLVRADSSLSCPPTRRRYVPVGLLERLPQRINERPPYYLGRDYLETLMASQKAADWIRISEMLLGPVPPSFAFLPKHKANAYK

SEQ ID NO: 750401 - protein, 109 aa, Homo sapiens
GLIGTCRGPAKEPDHLGQVCPRLWVEGRLQGLSSWGGGQAPLVCIFFPPAGHPWQTLPGPPHHGRTWVRWLVGWQGGSVVIPTGLSVCPHLLDCGAGAHIQGSAVCVCV

SEQ ID NO: 750402 - protein, 118 aa, Homo sapiens
MTSQSQGIHQLLQAEKRAKDKLEEAKKRKGKRLKQAKEEAMVEIDQYRMQRDKEFRLKQSKIMGSQNNLSDEIEEQTLGKIQELNGHYNKYMESVMNQLLSMVCDMKPEIHVNYRATN

SEQ ID NO: 750403 - protein, 106 aa, Homo sapiens
MTSQSQGIHQLLQAEKRAKDKLEEAKKRKGKRLKQAKEEAMVEIDQYRMQRDKEFRLKQSKIMGSQNNLSDEIEEQTLGKIQELNGHYNKYMESVMNQLLSMVPDM

SEQ ID NO: 750404 - protein, 141 aa, Homo sapiens
RPVSNLRCGNNLLCHLGKSFPNQEGVSFRKQKLLQLFLAEGDLRESGYLKYMGRLEKSPPGSSHWSWDQNVLSCLPSPVSTQEAGLGPWDMGWDCHSCLLTPTKPEAWCCCRRTEHLQGWARRANFLGPVSSIHILQRTPH

SEQ ID NO: 750405 - protein, 141 aa, Homo sapiens; identical to SEQ ID NO: 750404

SEQ ID NO: 750406 - protein, 123 aa, Homo sapiens
MPEFFVITVTLGHRTPYSLPSRLLKVPPDTQQEVPLRPSSDPGESQGSHSGGWRRVWRPTAPETLTRALSTPGRARAPGPRQPARSPRPTHRTQSAKAPATLSLSRTRKLPSRPARASSSSAA

SEQ ID NO: 750407 - protein, 458 aa, Homo sapiens
MSDLLSVFLHLLLLFKLVAPVTFRHHRYDDLVRTLYKVQNECPGITRVYSIGRSVEGRHLYVLEFSDHPGIHEPLEPEVKYVGNMHGNEALGRELMLQLSEFLCEEFRNRNQRIVQLIQDTRIHILPSMNPDGYEVAAAQGPNKPGYLVGRNNANGVDLNRNFPDLNTYIYYNEKYGGPNHHLPLPDNWKSQVEPETRAVIRWMHSFNFVLSANLHGGAVVANYPYDKSFEHRVRGVRRTASTPTPDDKLFQKLAKVYSYAHGWMFQGWNCGDYFPDGITNGASWYSLSKGMQDFNYLHTNCFEITLELSCDKFPPEEELQREWLGNREALIQFLEQVHQGIKGMVLDENYNNLANAVISVSGINHDVTSGDHGDYFRLLLPGIYTVSATAPGYDPETVTVTVGPAEPTLVNFHLKRSIPQVSPVRRAPSRRHGVRAKVQPQARKKEMEMRQLQRGPA

SEQ ID NO: 750408 - protein, 374 aa, Homo sapiens
MHGNEALGRELMLQLSEFLCEEFRNRNQRIVQLIQDTRIHILPSMNPDGYEVAAAQGPNKPGYLVGRNNANGVDLNRNFPDLNTYIYYNEKYGGPNHHLPLPDNWKSQVEPETRAVIRWMHSFNFVLSANLHGGAVVANYPYDKSFEHRVRGVRRTASTPTPDDKLFQKLAKVYSYAHGWMFQGWNCGDYFPDGITNGASWYSLSKGMQDFNYLHTNCFEITLELSCDKFPPEEELQREWLGNREALIQFLEQVHQGIKGMVLDENYNNLANAVISVSGINHDVTSGDHGDYFRLLLPGIYTVSATAPGYDPETVTVTVGPAEPTLVNFHLKRSIPQVSPVRRAPSRRHGVRAKVQPQARKKEMEMRQLQRGPA

SEQ ID NO: 750409 - protein, 74 aa, Homo sapiens
EFRNRNQRIVQLIQDTRIHILPSMNPDGYEVAAAQDEVQGRCRGEIKAFLGNKVQWTRFPLCPTVNITNVKSKR

SEQ ID NO: 750410 - protein, 41 aa, Homo sapiens
STIKFQMKKVLCLAVAVGHVKMTDDELVYNIHLAVNFLVSL

SEQ ID NO: 750411 - protein, 72 aa, Homo sapiens
AGLLRDGFSTSLPFKASISATAASAWFLSIPSTFPPQGLGACSSSASLLVYAWLVLISFEFGRGAPHERGLP

SEQ ID NO: 750412 - protein, 460 aa, Homo sapiens
MAESENRKELSESSQEEAGNQIMVEGLGEHLERGEDAAAGLGDDGKCGEEAAAGLGEEGENGEDTAAGSGEDGKKGGDTDEDSEADRPKGLIGYVLDTDFVESLPVKVKYRVLALKKLQTRAANLESKFLREFHDIERKFAEMYQPLLEKRRQIINAIYEPTEEECEYKSDSEDCDDEEMCHEEMYGNEEGMVHEYVDEDDGYEDYYYDYAVEEEEEEEEEDDIEATGEENKEEEDPKGIPDFWLTVLKNVDTLTPLIKKYDEPILKLLTDIKVKLSDPGEPLSFTLEFHFKPNEYFKNELLTKTYVLKSKLAYYDPHPYRGTAIEYSTGCEIDWNEGKNVTLKTIKKKQKHRIWGTIRTVTEDFPKDSFFNFFSPHGITSNGRDGNDDFLLGHNLRTYIIPRSVLFFSGDALESQQEGVVREVNDAIYDKIIYDNWMAAIEEVKACCKNLEALVEDIDR

SEQ ID NO: 750413 - protein, 460 aa, Homo sapiens; identical to SEQ ID NO: 750412

SEQ ID NO: 750414 - protein, 215 aa, Homo sapiens
MAESENRKELSESSQEEAGNQIMVEGLGEHLERGEDAAAGLGDDGKCGEEAAAGLGEEGENGEDTAAGSGEDGKKGGDTDEDSEADRPKGLIGYVLDTDFVESLPVKVKYRVLALKKLQTRAANLESKFLREFHDIERKFAEMYQPLLEKRRQIINAIYEPTEEECEYKSDSEDCDDEEMCHEEMYGNEEGMVHEYVDEDDGYEDYYYDYAVEEV

SEQ ID NO: 750415 - protein, 74 aa, Homo sapiens
VVREGYNQHFRGMGPIAYLASCRIRHVESQQEGVVREVNDAIYDKIIYDNWMAAIEEVKACCKNLEALVEDIDR

SEQ ID NO: 750416 - protein, 364 aa, Homo sapiens
GPRLPRVRATELRRPWVSSAKGLFTECFWYLQPRWGSDRGSGIGLHNYSRARTLLGWKELERPLQAVTGSWCWHWLRLSHTHTRTHTHTHTRTGTPLVAFTVFTFRLKAGSAGDMRGTPKTHLLAFSLLCLLSKVRTQLCPTPCTCPWPPPRCPLGVPLVLDGCGCCRVCARRLGEPCDQLHVCDASQGLVCQPGAGPGGRGALCLLAEDDSSCEVNGRLYREGETFQPHCSIRCRCEDGGFTCVPLCSEDVRLPSWDCPHPRRVEVLGKCCPEWVCGQGGGLGTQPLPAQGPQFSGLVSSLPPGVPCPEWSTAWGPCSTTCGLGMATRVSNQNRFCRLETQRRLCLSRPCPPSRGRSPQNSAF

SEQ ID NO: 750417 - protein, 364 aa, Homo sapiens; identical to SEQ ID NO: 750416

SEQ ID NO: 750418 - protein, 250 aa, Homo sapiens
MRGTPKTHLLAFSLLCLLSKVRTQLCPTPCTCPWPPPRCPLGVPLVLDGCGCCRVCARRLGEPCDQLHVCDASQGLVCQPGAGPGGRGALCLLAEDDSSCEVNGRLYREGETFQPHCSIRCRCEDGGFTCVPLCSEDVRLPSWDCPHPRRVEVLGKCCPEWVCGQGGGLGTQPLPAQGPQFSGLVSSLPPGVPCPEWSTAWGPCSTTCGLGMATRVSNQNRFCRLETQRRLCLSRPCPPSRGRSPQNSAF

SEQ ID NO: 750419 - protein, 242 aa, Homo sapiens
MPRGFTWLRYLGIFLGVALGNEPLEMWPLTQNEECTVTGFLRDKLQYRSRLQYMKHYFPINYKISVPYEGVFRIANVTRLQRAQVSERELRYLWVLVSLSATESVQDVLLEGHPSWKYLQEVQTLLLNVQQGLTDVEVSPKVESVLSLLNAPGPNLKLVRPKALLDNCFRVMELLYCSCCKQSSVLNWQDCEVPSPQSCSPEPSLQYAATQLYPPPPWSPSSPPHSTGSVRPVRAQGEGLLP

SEQ ID NO: 750420 - protein, 242 aa, Homo sapiens; identical to SEQ ID NO: 750419

SEQ ID NO: 750421 - protein, 242 aa, Homo sapiens; identical to SEQ ID NO: 750419

SEQ ID NO: 750422 - protein, 242 aa, Homo sapiens; identical to SEQ ID NO: 750419

SEQ ID NO: 750423 - protein, 141 aa, Homo sapiens
MTTSRCSHLPEVLPDCTSSAAPVVKTVEDCGSLVNGQPQYVMQVSAKDGQLLSTVVRTLATQSPFNDRPMCRICHEGSSQEDLLSPCECTGTLGTIHRSCLEHWLSSSNTSYCELCHFRFAVERKPRPLVEWLETLGPPIE

SEQ ID NO: 750424 - protein, 253 aa, Homo sapiens
MTTSRCSHLPEVLPDCTSSAAPVVKTVEDCGSLVNGQPQYVMQVSAKDGQLLSTVVRTLATQSPFNDRPMCRICHEGSSQEDLLSPCECTGTLGTIHRSCLEHWLSSSNTSYCELCHFRFAVERKPRPLVEWLRNPGPQHEKRTLFGDMVCFLFITPLATISGWLCLRGAVDHLHFSSRLEAVGLIALTVALFTIYLFWTLVSFRYHCRLYNEWRRTNQRVILLIPKSVNVPSNQPSLLGLHSVKRNSKETVV

SEQ ID NO: 750425 - protein, 253 aa, Homo sapiens; identical to SEQ ID NO: 750424

SEQ ID NO: 750426 - protein, 148 aa, Homo sapiens
CGEKTGTGEGKQRLGCSDSLNYPPLQWLRNPGPQHEKRTLFGDMVCFLFITPLATISGWLCLRGAVDHLHFSSRLEAVGLIALTVALFTIYLFWTLVSFRYHCRLYNEWRRTNQRVILLIPKSVNVPSNQPSLLGLHSVKRNSKETVV

SEQ ID NO: 750427 - protein, 105 aa, Homo sapiens
MVCFLFITPLATISGWLCLRGAVDHLHFSSRLEAVGLIALTVALFTIYLFWTLVSFRYHCRLYNEWRRTNQRVILLIPKSVNVPSNQPSLLGLHSVKRNSKETVV

SEQ ID NO: 750428 - protein, 253 aa, Homo sapiens; identical to SEQ ID NO: 750424

SEQ ID NO: 750429 - protein, 253 aa, Homo sapiens; identical to SEQ ID NO: 750424

SEQ ID NO: 750430 - protein, 133 aa, Homo sapiens
LKLRASVKTNKWLRNPGPQHEKRTLFGDMVCFLFITPLATISGWLCLRGAVDHLHFSSRLEAVGLIALTVALFTIYLFWTLVSFRYHCRLYNEWRRTNQRVILLIPKSVNVPSNQPSLLGLHSVKRNSKETVV

SEQ ID NO: 750431 - protein, 487 aa, Homo sapiens
FQAVRLRVTPERSGSPSSSDVSIPARSLRRGRRAEAEWDRCGSFWGFLSTKMDNSSDPPGILESWRTQKTAEVTAEDATPHGSPPRATVSQVPAPSSAQASCWPPAVSATRWVGRRRPEAPVSPPLQVARRAGVRTGTCTELWEVCGAGVLFAEIARSRSERFPESPGFHLWLGDPVRNSSFLGPQLPPGGVPMGQLSSAPPAGARYWRVDPRCGWLLAPQRYARGGSEGSWSLSANGLLGPPPPSRAARVPLQRVPQRPPAATALRNNQLPRRRRVPPACPRPQATGRRLRGGPSATTTGCRLRQSWADDAPGLAPPLAAAPPPLQSLVGLPCFPPHSLSRSVNCQRAVGDCVAAAAARLAALPLRCPPEPMCPGPLGREQPPTGGNLALRTAAGTSVCYRDSARTMEILYECGTVGLIALTVALFTIYLFWTLVSFRYHCRLYNEWRRTNQRVILLIPKSVNVPSNQPSLLGLHSVKRNSKETVV

SEQ ID NO: 750432 - protein, 99 aa, Homo sapiens
QNRPDLADRWYKIWQGPCRASHRFSGAGCKLKLQALLSLEPSGTAQFAHLPNRPWVRDTDAGVFKSLGLEVQRHQLSPPLSSDIPRLPFPLSVSQFSHL

SEQ ID NO: 750433 - protein, 270 aa, Homo sapiens
MNPFQKNESKETLFSPVSIEEVPPRPPSPPKKPSPTICGSNYPLSIAFIVVNEFCERFSYYGMKAVLILYFLYFLHWNEDTSTSIYHAFSSLCYFTPILGAAIADSWLGKFKVLSLIGLSLIALGTGGIKPCVAAFGGDQFEEKHAEERTRYFSVFYLSINAGSLISTFITPMLRGDVQCFGEDCYALAFGVPGLLMVIALVRVANGNARIYNKTPPEGHHSWLKFSNCLWSLITQSLSRNRSETSKATRMANTGGAKFQSSHQAVTPDK

SEQ ID NO: 750434 - protein, 729 aa, Homo sapiens
MNPFQKNESKETLFSPVSIEEVPPRPPSPPKKPSPTICGSNYPLSIAFIVVNEFCERFSYYGMKAVLILYFLYFLHWNEDTSTSIYHAFSSLCYFTPILGAAIADSWLGKFKTIIYLSLVYVLGHVIKSLGALPILGGQVVHTVLSLIGLSLIALGTGGIKPCVAAFGGDQFEEKHAEERTRYFSVFYLSINAGSLISTFITPMLRGDVQCFGEDCYALAFGVPGLLMVIALVVFAMGSKIYNKPPPEGNIVAQVFKCIWFAISNRFKNRSGDIPKRQHWLDWAAEKYPKQLIMDVKALTRVLFLYIPLPMFWALLDQQGSRWTLQAIRMNRNLGFFVLQPDQMQVLNPLLVLIFIPLFDFVIYRLVSKCGINFSSLRKMAVGMILACLAFAVAAAVEIKINEMAPAQPGPQEVFLQVLNLADDEVKVTVVGNENNSLLIESIKSFQKTPHYSKLHLKTKSQDFHFHLKYHNLSLYTEHSVQEKNWYSLVIREDGNSISSMMVKDTESRTTNGMTTVRFVNTLHKDVNISLSTDTSLNVGEDYGVSAYRTVQRGEYPAVHCRTEDKNFSLNLGLLDFGAAYLFVITNNTNQGLQAWKIEDIPANKMSIAWQLPQYALVTAGEVMFSVTGLEFSYSQAPSSMKSVLQAAWLLTIAVGNIIVLVVAQFSGLVQWAEFILFSCLLLVICLIFSIMGYYYVPVKTEDMRGPADKHIPHIQGNMIKLETKKTKL

SEQ ID NO: 750435 - protein, 729 aa, Homo sapiens; identical to SEQ ID NO: 750434

SEQ ID NO: 750436 - protein, 729 aa, Homo sapiens; identical to SEQ ID NO: 750434

SEQ ID NO: 750437 - protein, 375 aa, Homo sapiens [sequence omitted]

SEQ ID NO: 750438 - protein, 190 aa, Homo sapiens
FPSLDIYSNLNSSCSRYPAVHCRTEDKNFSLNLGLLDFGAAYLFVITNNTNQGLQAWKIEDIPANKMSIAWQLPQYALVTAGEVMFSVTGLEFSYSQAPSSMKSVLQAAWLLTIAVGNIIVLVVAQFSGLVQWAEFILFSCLLLVICLIFSIMGYYYVPVKTEDMRGPADKHIPHIQGNMIKLETKKTKL

SEQ ID NO: 750439 - protein, 69 aa, Homo sapiens
PYSSHIYFPLQWAEFILFSCLLLVICLIFSIMGYYYVPVKTEDMRGPADKHIPHIQGNMIKLETKKTKL

SEQ ID NO: 750440 - protein, 711 aa, Homo sapiens
KKEKKKGKKKKIKKIFFTICGSNYPLSIAFIVVNEFCERFSYYGMKAVLILYFLYFLHWNEDTSTSIYHAFSSLCYFTPILGAAIADSWLGKFKTIIYLSLVYVLGHVIKSLGALPILGGQVVHTVLSLIGLSLIALGTGGIKPCVAAFGGDQFEEKHAEERTRYFSVFYLSINAGSLISTFITPMLRGDVQCFGEDCYALAFGVPGLLMVIALVVFAMGSKIYNKPPPEGNIVAQVFKCIWFAISNRFKNRSGDIPKRQHWLDWAAEKYPKQLIMDVKALTRVLFLYIPLPMFWALLDQQGSRWTLQAIRMNRNLGFFVLQPDQMQVLNPLLVLIFIPLFDFVIYRLVSKCGINFSSLRKMAVGMILACLAFAVAAAVEIKINEMAPAQPGPQEVFLQVLNLADDEVKVTVVGNENNSLLIESIKSFQKTPHYSKLHLKTKSQDFHFHLKYHNLSLYTEHSVQEKNWYSLVIREDGNSISSMMVKDTESRTTNGMTTVRFVNTLHKDVNISLSTDTSLNVGEDYGVSAYRTVQRGEYPAVHCRTEDKNFSLNLGLLDFGAAYLFVITNNTNQGLQAWKIEDIPANKMSIAWQLPQYALVTAGEVMFSVTGLEFSYSQAPSSMKSVLQAAWLLTIAVGNIIVLVVAQFSGLVQWAEFILFSCLLLVICLIFSIMGYYYVPVKTEDMRGPADKHIPHIQGNMIKLETKKTKL

SEQ ID NO: 750441 - protein, 569 aa, Homo sapiens
KKEKKKGKKKKIKKIFFTICGSNYPLSIAFIVVNEFCERFSYYGMKAVLILYFLYFLHWNEDTSTSIYHAFSSLCYFTPILGAAIADSWLGKFKTIIYLSLVYVLGHVIKSLGALPILGGQVVHTVLSLIGLSLIALGTGGIKPCVAAFGGDQFEEKHAEERTRYFSVFYLSINAGSLISTFITPMLRGDVQCFGEDCYALAFGVPGLLMVIALDHLGKWLLVMILACLAFAVAAAVEIKINEMAPAQPGPQEVFLQVLNLADDEVKVTVVGNENNSLLIESIKSFQKTPHYSKLHLKTKSQDFHFHLKYHNLSLYTEHSVQEKNWYSLVIREDGNSISSMMVKDTESRTTNGMTTVRFVNTLHKDVNISLSTDTSLNVGEDYGVSAYRTVQRGEYPAVHCRTEDKNFSLNLGLLDFGAAYLFVITNNTNQGLQAWKIEDIPANKMSIAWQLPQYALVTAGEVMFSVTGLEFSYSQAPSSMKSVLQAAWLLTIAVGNIIVLVVAQFSGLVQWAEFILFSCLLLVICLIFSIMGYYYVPVKTEDMRGPADKHIPHIQGNMIKLETKKTKL

SEQ ID NO: 750442 - protein, 350 aa, Homo sapiens
MAVGMILACLAFAVAAAVEIKINEMAPAQPGPQEVFLQVLNLADDEVKVTVVGNENNSLLIESIKSFQKTPHYSKLHLKTKSQDFHFHLKYHNLSLYTEHSVQEKNWYSLVIREDGNSISSMMVKDTESRTTNGMTTVRFVNTLHKDVNISLSTDTSLNVGEDYGVSAYRTVQRGEYPAVHCRTEDKNFSLNLGLLDFGAAYLFVITNNTNQGLQAWKIEDIPANKMSIAWQLPQYALVTAGEVMFSVTGLEFSYSQAPSSMKSVLQAAWLLTIAVGNIIVLVVAQFSGLVQWAEFILFSCLLLVICLIFSIMGYYYVPVKTEDMRGPADKHIPHIQGNMIKLETKKTKL

SEQ ID NO: 750443 - protein, 76 aa, Homo sapiens
GTKGSRLQSHGRGYAGRGGDTVVRRDCDPRTGKSKKKSAPSILSNGRIGQVGKFKNGTLILSPVDIKKINSSRVAK

SEQ ID NO: 750444 - protein, 302 aa, Homo sapiens
PEAGVQRGRMRVDSSADPTMSQEQGPGSSTPPSSPTLLDALLQNLYDFGGTEGETEQKKIIKKRENKKRDVMASAALAAEPSPLPGSLIRGQRKSASSFFKELREERHCAPSGTPTGPEILAAAVPPSSLKNNREQVEVVEFHSNKKRKLTPDHNKNTKQANPSVLERDVDTQEFNLEKARLEVHRFGITGYGKGKERILEQERAIMLGAKPPKKSYVNYKVLQEQIKEKKAAKEEEKRLAQETDIFKKKKRKGQEDRKSKKKSAPSILSNGRIGQVGKFKNGTLILSPVDIKKINSSRVAK

SEQ ID NO: 750445 - protein, 248 aa, Homo sapiens
PEAGVQRGRMRVDSSADPTMSQEQGPGSSTPPSSPTLLDALLQNLYDFGGTEGETEQKKIIKKRENKKRDVMASAALAAEPSPLPGSLIRGQRKSASSFFKELREERHCAPSGTPTGPEILAAAVPPSSLKNNREQVEVVEFHSNKKRKLTPDHNKNTKQANPSVLERDVDTQEFNLEKARLEVHRFGITGYGKGKERILEQERAIMLGAKPPKKSYVNYKVLQEQIKEKKAAKEEEKRLECLMLRNL

SEQ ID NO: 750446 - protein, 302 aa, Homo sapiens; identical to SEQ ID NO: 750444

SEQ ID NO: 750447 - protein, 250 aa, Homo sapiens
PEAGVQRGRMRVDSSADPTMSQEQGPGSSTPPSSPTLLDALLQNLYDFGGTEGETEQKKIIKKRENKKRDVMASAALAAEPSPLPGSLIRGQRKSASSFFKELREERHCAPSGTPTGPEILAAAVPPSSLKNNREQVEVVEFHSNKKRKLTPDHNKNTKQANPSVLERDVDTQEFNLEKARLEVHRFGITGYGKGKERILEQERAIMLGAKPPKKSYVNYKVLQEQIKEKKAAKEEEKRLVGVMVCPLFN

SEQ ID NO: 750448 - protein, 53 aa, Homo sapiens
CIFIRTEPSQCPLSVDVDVFIIPGCSNKVASTEWPINNRNLFLTVLEARSLRS

SEQ ID NO: 750449 - protein, 67 aa, Homo sapiens
QCVLEALPTLIVVKSEPAYTVQAHHVAFRTLLSKPAQHRNACSLFPLPVLSDLYQRPVLADSDCVLL

SEQ ID NO: 750450 - protein, 113 aa, Homo sapiens
RRSLALSLRLECSGAIAAHCNFYLPGSSNSLASISRVAGIIGAHQHAQLIFVFLVETGFHHVGQVGPEFLTSGDPPNQASQSAGITGVSHHARPVFSTKCFILQYVKVIKGAS

SEQ ID NO: 750451 - protein, 377 aa, Homo sapiens
MRGQRSLLLGPARLCLRLLLLLGYRRRCPPLLRGLVQRWRYGKVCLRSLLYNSFGGSDTAVDAAFEPVYWLVDNVIRWFGVVFVVLVIVLTGSIVAIAYLCVLPLILRTYSVPRLCWHFFYSHWNLILIVFHYYQAITTPPGYPPQGRNDIATVSICKKCIYPKPARTHHCSICNRCVLKMDHHCPWLNNCVGHYNHRYFFSFCFFMTLGCVYCSYGSWDLFREAYAAIEKMKQLDKNKLQAVANQTYHQTPPPTFSFRERMTHKSLVYLWFLCSSVALALGALTVWHAVLISRGETSIERHINKKERRRLQAKGRVFRNPYNYGCLDNWKVFLGVDTGRHWLTRVLLPSSHLPHGNGMSWEPPPWVTAHSASVMAV

SEQ ID NO: 750452 - protein, 246 aa, Homo sapiens
MRGQRSLLLGPARLCLRLLLLLGYRRRCPPLLRGLVQRWRYGKVCLRSLLYNSFGGSDTAVDAAFEPVYWLVDNVIRWFGVVFVVLVIVLTGSIVAIAYLCVLPLILRTYSVPRLCWHFFYSHWNLILIVFHYYQAITTPPGYPPQGRNDIATVSICKKCIYPKPARTHHCSICNRCVLKMDHHCPWLNNCVGHYNHRYFFSFCFFMTLGCVYCSYGSWDLPEGMCLEMKGEKITGCTILNTRFEK

SEQ ID NO: 750453 - protein, 361 aa, Homo sapiens
MRGQRSLLLGPARLCLRLLLLLGYRRRCPPLLRGLVQRWRYGKVCLRSLLYNSFGGSDTAVDAAFEPVYWLVDNVIRWFGVVFVVLVIVLTGSIVAIAYLCVLPLILRTYSVPRLCWHFFYSHWNLILIVFHYYQAITTPPGYPPQGRNDIATVSICKKCIYPKPARTHHCSICNRCVLKMDHHCPWLNNCVGHYNHRYFFSFCFFMTLGCVYCSYGSWDLFREAYAAIETYHQTPPPTFSFRERMTHKSLVYLWFLCSSVALALGALTVWHAVLISRGETSIERHINKKERRRLQAKGRVFRNPYNYGCLDNWKVFLGVDTGRHWLTRVLLPSSHLPHGNGMSWEPPPWVTAHSASVMAV

SEQ ID NO: 750454 - protein, 359 aa, Homo sapiens
MRGQRSLLLGPARLCLRLLLLLGYRRRCPPLLRGLVQRWRYGKVCLRSLLYNSFGGSDTAVDAAFEPVYWLVDNVIRWFGVVFVVLVIVLTGSIVAIAYLCVLPLILRTYSVPRLCWHFFYSHWNLILIVFHYYQAITTPPGYPPQGRNDIATVSICKKCIYPKPARTHHCSICNRCVLKMDHHCPWLNNCVGHYNHRYFFSFCFFMTLGCVYCSYGSWDLFREAYAAIEKMKQLDKNKLQAVANQTYHQTPPPTFSFRERMTHKSLVYLWFLCSRGETSIERHINKKERRRLQAKGRVFRNPYNYGCLDNWKVFLGVDTGRHWLTRVLLPSSHLPHGNGMSWEPPPWVTAHSASVMAV

SEQ ID NO: 750455 - protein, 361 aa, Homo sapiens; identical to SEQ ID NO: 750453

SEQ ID NO: 750456 - protein, 368 aa, Homo sapiens
MRGQRSLLLGPARLCLRLLLLLGYRRRCPPLLRGLVQRWRYGKVCLRSLLYNSFGGSDTAVDAAFEPVYWLVDNVIRWFGVVFVVLVIVLTGSIVAIAYLCVLPLILRTYSVPRLCWHFFYSHWNLILIVFHYYQAITTPPGYPPQGRNDIATVSICKKCIYPKPARTHHCSICNRCVLKMDHHCPWLNNCVGHYNHRYFFSFCFFMTLGCVYCSYGSWDLFREAYAAIETYHQTPPPTFSFRERMTHKSLVYLWFLCSLRPSFLSSVALALGALTVWHAVLISRGETSIERHINKKERRRLQAKGRVFRNPYNYGCLDNWKVFLGVDTGRHWLTRVLLPSSHLPHGNGMSWEPPPWVTAHSASVMAV

SEQ ID NO: 750457 - protein, 322 aa, Homo sapiens
MRGQRSLLLGPARLCLRLLLLLGYRRRCPPLLRGLVQRWRYGKVCLRSLLYNSFGGSDTAVDAAFEPVYWLVDNVIRWFGVVFVVLVIVLTGSIVAIAYLCVLPLILRTYSVPRLCWHFFYSHWNLILIVFHYYQAITTPPGYPPQGRNDIATVSICKKCIYPKPARTHHCSICNSYGSWDLFREAYAAIETYHQTPPPTFSFRERMTHKSLVYLWFLCSSVALALGALTVWHAVLISRGETSIERHINKKERRRLQAKGRVFRNPYNYGCLDNWKVFLGVDTGRHWLTRVLLPSSHLPHGNGMSWEPPPWVTAHSASVMAV

SEQ ID NO: 750458 - protein, 377 aa, Homo sapiens; identical to SEQ ID NO: 750451

SEQ ID NO: 750459 - protein, 440 aa, Homo sapiens
QPHIRLSTRPRVNRPRAGPGPLPGAAGGGPWWFGLSRARPGRRVGGGGSERRQRLRGSVWLRTMRGQRSLLLGPARLCLRLLLLLGYRRRCPPLLRGLVQRWRYGKVCLRSLLYNSFGGSDTAVDAAFEPVYWLVDNVIRWFGVVFVVLVIVLTGSIVAIAYLCVLPLILRTYSVPRLCWHFFYSHWNLILIVFHYYQAITTPPGYPPQGRNDIATVSICKKCIYPKPARTHHCSICNRCVLKMDHHCPWLNNCVGHYNHRYFFSFCFFMTLGCVYCSYGSWDLFREAYAAIEKMKQLDKNKLQAVANQTYHQTPPPTFSFRERMTHKSLVYLWFLCSSVALALGALTVWHAVLISRGETSIERHINKKERRRLQAKGRVFRNPYNYGCLDNWKVFLGVDTGRHWLTRVLLPSSHLPHGNGMSWEPPPWVTAHSASVMAV

SEQ ID NO: 750460 - protein, 307 aa, Homo sapiens
MRGQRSLLLGPARLCLRLLLLLGYRRRCPPLLRGLVQRWRYGKVCLRSLLYNSFGGSDTAVDAAFEPVYWLVDNVIRWFGVVFVVLVIVLTGSIVAIAYLCVLPLILRTYSVPRLCWHFFYSHWNLILIVFHYYQAITTPPGYPPQGRNDIATVSICKKCIYPKPARTHHCSICNRCVLKMDHHCHILPPALSKLPTSLRPSFLSSVALALGALTVWHAVLISRGETSIERHINKKERRRLQAKGRVFRNPYNYGCLDNWKVFLGVDTGRHWLTRVLLPSSHLPHGNGMSWEPPPWVTAHSASVMAV

SEQ ID NO: 750461 - protein, 313 aa, Homo sapiens
ASRGRVVNGRCAVDAAFEPVYWLVDNVIRWFGVVFVVLVIVLTGSIVAIAYLCVLPLILRTYSVPRLCWHFFYSHWNLILIVFHYYQAITTPPGYPPQGRNDIATVSICKKCIYPKPARTHHCSICNRCVLKMDHHCPWLNNCVGHYNHRYFFSFCFFMTLGCVYCSYGSWDLFREAYAAIETYHQTPPPTFSFRERMTHKSLVYLWFLCSSVALALGALTVWHAVLISRGETSIERHINKKERRRLQAKGRVFRNPYNYGCLDNWKVFLGVDTGRHWLTRVLLPSSHLPHGNGMSWEPPPWVTAHSASVMAV

SEQ ID NO: 750462 - protein, 314 aa, Homo sapiens
MLGRGRFYRPREARGSVGSLLYNSFGGSDTAVDAAFEPVYWLVDNVIRWFGVVFVVLVIVLTGSIVAIAYLCVLPLILRTYSVPRLCWHFFYSHWNLILIVFHYYQAITTPPGYPPQGRNDIATVSICKKCIYPKPARTHHCSICNRCVLKMDHHCPWLNNCVGHYNHRYFFSFCFFMTLGCVYCSYGSWDLFREAYAAIETYHQTPPPTFSFRERMTHKSLVYLWFLCSRGETSIERHINKKERRRLQAKGRVFRNPYNYGCLDNWKVFLGVDTGRHWLTRVLLPSSHLPHGNGMSWEPPPWVTAHSASVMAV

SEQ ID NO: 750463 - protein, 324 aa, Homo sapiens
MRGQRSLLLGPARLCLRLLLLLGYRRRCPPLLRGLVQRWRYGKVCLRSLLYNSFGGSDTAVDAAFEPVYWLVDNVIRWFGVVFVVLVIVLTGSIVAIAYLCVLPLILRTYSVPRLCWHFFYSHWNLILIVFHYYQAITTPPGYPPQGRNDIATVSICKKCIYPKPARTHHCSICNRCVLKMDHHCPWLNNCVGHYNHRYFFSFCFFMTLGCVYCSYGSWDLFREAYAAIETYHQTPPPTFSFRERMTHKSLVYLWFLCSSVALALGALTVWHAVLISRGETSIERHINKKERRRLQAKGRVFRNPYNYGCLDNWKVFLGVDTGR

SEQ ID NO: 750464 - protein, 71 aa, Homo sapiens
QDEVKGKPAVERRASFNYGCLDNWKVFLGVDTGRHWLTRVLLPSSHLPHGNGMSWEPPPWVTAHSASVMAV

SEQ ID NO: 750465 - protein, 69 aa, Homo sapiens
QPHIRLSTRPRVNRPRAGPGPLPGAAGGGPWWFGLSRARPGRRVGGGGSERRQRLRGSVWLTGESAGGR

SEQ ID NO: 750466 - protein, 361 aa, Homo sapiens; identical to SEQ ID NO: 750453

SEQ ID NO: 750467 - protein, 361 aa, Homo sapiens; identical to SEQ ID NO: 750453

SEQ ID NO: 750468 - protein, 296 aa, Homo sapiens
MRGQRSLLLGPARLCLRLLLLLGYRRRCPPLLRGLVQRWRYGKVCLRSLLYNSFGGSDTAVDAAFEPVYWLVDNVIRWFGVGRNDIATVSICKKCIYPKPARTHHCSICNRCVLKMDHHCPWLNNCVGHYNHRYFFSFCFFMTLGCVYCSYGSWDLFREAYAAIETYHQTPPPTFSFRERMTHKSLVYLWFLCSSVALALGALTVWHAVLISRGETSIERHINKKERRRLQAKGRVFRNPYNYGCLDNWKVFLGVDTGRHWLTRVLLPSSHLPHGNGMSWEPPPWVTAHSASVMAV

SEQ ID NO: 750469 - protein, 343 aa, Homo sapiens
MRGQRSLLLGPARLCLRLLLLLGYRRRCPPLLRGLVQRWRYGKVCLRSLLYNSFGGSDTAVDAAFEPVYWLVDNVIRWFGVVFVVLVIVLTGSIVAIAYLCVLPLILRTYSVPRLCWHFFYSHWNLILIVFHYYQAITTPPGYPPQGRNDIATVSICKKCIYPKPARTHHCSICNRCVLKMDHHCPWLNNCVGHYNHRYFFSFCFFMTLGCVYCSYGSWDLFREAYAAIETYHQTPPPTFSFRERMTHKSLVYLWFLCSRGETSIERHINKKERRRLQAKGRVFRNPYNYGCLDNWKVFLGVDTGRHWLTRVLLPSSHLPHGNGMSWEPPPWVTAHSASVMAV

SEQ ID NO: 750470 - protein, 377 aa, Homo sapiens; identical to SEQ ID NO: 750451

SEQ ID NO: 750471 - protein, 377 aa, Homo sapiens; identical to SEQ ID NO: 750451

SEQ ID NO: 750472 - protein, 333 aa, Homo sapiens
VSLGRGRFYRPREARGSVGSLLYNSFGGSDTAVDAAFEPVYWLVDNVIRWFGVVFVVLVIVLTGSIVAIAYLCVLPLILRTYSVPRLCWHFFYSHWNLILIVFHYYQAITTPPGYPPQGRNDIATVSICKKCIYPKPARTHHCSICNRCVLKMDHHCPWLNNCVGHYNHRYFFSFCFFMTLGCVYCSYGSWDLFREAYAAIETYHQTPPPTFSFRERMTHKSLVYLWFLCSSVALALGALTVWHAVLISRGETSIERHINKKERRRLQAKGRVFRNPYNYGCLDNWKVFLGVDTGRHWLTRVLLPSSHLPHGNGMSWEPPPWVTAHSASVMAV

SEQ ID NO: 750473 - protein, 361 aa, Homo sapiens; identical to SEQ ID NO: 750453

SEQ ID NO: 750474 - protein, 179 aa, Homo sapiens
MDHHCPWLNNCVGHYNHRYFFSFCFFMTLGCVYCSYGSWDLFREAYAAIEKMKQLDKNKLQAVANQTYHQTPPPTFSFRERMTHKSLVYLWFLCSRGETSIERHINKKERRRLQAKGRVFRNPYNYGCLDNWKVFLGVDTGRHWLTRVLLPSSHLPHGNGMSWEPPPWVTAHSASVMAV

SEQ ID NO: 750475 - protein, 194 aa, Homo sapiens
MRGQRSLLLGPARLCLRLLLLLGYRRRCPPLLRGLVQRWRYGKVCLRSLLYNSFGGSDTAVDAAFEPVYWLVDNVIRWFGVVFVVLVIVLTGSIVAIAYLCVLPLILRTYSVPRLCWHFFYSHWNLILIVFHYYQAITTPPGYPPQGRNDIATVSICKKCIYPKPARTHHCSICNSQLARQFWQTRVVVSRKNG

SEQ ID NO: 750476 - protein, 138 aa, Homo sapiens
NETFFCPLRSSRLRALLQVYGSIQVNPKKSVCGGVHTTNYYGEEDKEDMDRRRMALRPGSRRPTAFFFHSRWLVPNLLAFFLGLSGAGPIHLPMPWPNGRRHRVLDPHTQLSTHEAPGRWKPVAPRRMKACPQVLLEW

SEQ ID NO: 750477 - protein, 126 aa, Homo sapiens
TKLNIFCTGSIQVNPKKSVCGGVHTTNYYGEEDKEDMDRRRMALRPGSRRPTAFFFHSRWLVPNLLAFFLGLSGAGPIHLPMPWPNGRRHRVLDPHTQLSTHEAPGRWKPVAPRRMKACPQVLLEW

SEQ ID NO: 750478 - protein, 538 aa, Homo sapiens
MRHVQAEPSPSSEPEAGPSQPPVRQGALQGGLLMGYSPAGGATSPGVYQVSIFSPPAGTSEPHRALKRQAPSTEGPRELKRGPGLGAREGLPPEEPSTVGLLGPEGPGLGLGVASQHFSHRGLCVVEQRSSVTSSWTSGAWSPPCPPSNASCNTLHTRDWASPDPGGQGSLGESPGPAPPGQLHTLDTDLHSLAQIGGKSPVAGVGNGGSLWPRESPGTANGHSPEHTPPGPGPPGPCPTKRRLLPAGEAPDVSSEEEGPAPRRRRGSLGHPTAANSSDAKATPFWSHLLPGPKEPVLDPTDCGPMGRRLKGARRLKLSPLRSLRKGPGLLSPPSASPVPTPAVSRTLLGNFEESLLRGRFAPSGHIEGFTAEIGASGSYCPQHVTLPVTVTFFDVSEQNAPAPFLGIVDLNPLGRKGYSVPKVGTVQVTLFNPNQTVVKMFLVTFDFSDMPAAHMTFLRHRLFLVPVGEEGNANPTHRLLCYLLHLRFRSSRSGRLSLHGDIRLLFSRRSLELDTGLPYELQAVTEAPHNPRYSPLP

SEQ ID NO: 750479 - protein, 538 aa, Homo sapiens; identical to SEQ ID NO: 750478

SEQ ID NO: 750480 - protein, 476 aa, Homo sapiens
MRHVQAEPSPSSEPEAGPSQPPVRQGALQGGLLMGYSPAGGATSPGVYQVSIFSPPAGTSEPHRALKRQAPSTEGPRELKRGPGLGAREGLPPEEPSTVGLLGPEGPGLGLGVASQHFSHRGLCVVEQRSSVTSSWTSGAWSPPCPPSNASCNTLHTRDWASPDPGGQGSLGESPGPAPPGQLHTLDTDLHSLAQIGGKSPVAGVGNGGSLWPRESPGTANGHSPEHTPPGPGPPGPCPTKRRLLPAGEAPDVSSEEEGPAPRRRRGSLGHPTAANSSDAKATPFWSHLLPGPKEPVLDPTDCGPMGRRLKGARRLKLSPLRSLRKGPGLLSPPSASPVPTPAVSRTLLGNFEESLLRGRFAPSGHIEGFTAEIGASGSYCPQHVTLPVTVTFFDVSEQNAPAPFLGIVDLNPLGRKGYSVPKVGTVQVPCPSPVPSLPLPSDLSLKAKLCVCVCAQACLCVVCVCECACMHTHRG

SEQ ID NO: 750481 - protein, 233 aa, Homo sapiens
MGRRLKGARRLKLSPLRSLRKGPGLLSPPSASPVPTPAVSRTLLGNFEESLLRGRFAPSGHIEGFTAEIGASGSYCPQHVTLPVTVTFFDVSEQNAPAPFLGIVDLNPLGRKGYSVPKVGTVQVTLFNPNQTVVKMFLVTFDFSDMPAAHMTFLRHRLFLVPVGEEGNANPTHRLLCYLLHLRFRSSRSGRLSLHGDIRLLFSRRSLELDTGLPYELQAVTEAPHNPRYSPLP

SEQ ID NO: 750482 - protein, 538 aa, Homo sapiens; identical to SEQ ID NO: 750478

SEQ ID NO: 750483 - protein, 538 aa, Homo sapiens; identical to SEQ ID NO: 750478

SEQ ID NO: 750484 - protein, 130 aa, Homo sapiens
GSGERGKQPSGPTNLDCPVPETLFNPNQTVVKMFLVTFDFSDMPAAHMTFLRHRLFLVPVGEEGNANPTHRLLCYLLHLRFRSSRSGRLSLHGDIRLLFSRRSLELDTGLPYELQAVTEAPHNPRYSPLP

SEQ ID NO: 750485 - protein, 71 aa, Homo sapiens
EDEQAVTVLFQSQGVDEGYLYVAVGSDNYTNTTTSPSATGPTELQVWGRVSVEEGTRMGVRFADDLETAVC

SEQ ID NO: 750486 - protein, 538 aa, Homo sapiens; identical to SEQ ID NO: 750478

SEQ ID NO: 750487 - protein, 538 aa, Homo sapiens; identical to SEQ ID NO: 750478

SEQ ID NO: 750488 - protein, 538 aa, Homo sapiens; identical to SEQ ID NO: 750478

SEQ ID NO: 750489 - protein, 165 aa, Homo sapiens [sequence omitted]

SEQ ID NO: 750490 - protein, 108 aa, Homo sapiens
PLPCTELSLGQQLLRATTDEDLQTAILLLAHGSREEVNETCGEGDGCTALHLACRKGNVVLEQLLIWYGVDVMARDAHGNTALTYARQASSQECINVLLQYGCPDECV

SEQ ID NO: 750491 - protein, 124 aa, Homo sapiens
KKKPIKRLRARAGLGLKGHSPTSPVPFPLHHIPLDKLPPPLLPPAPSSVSCPQLPHGASLPIIMIVKLKCTSAALGECTKFRLLGPPSGFLIQEAWGRGLRLCIPSKFPGDADAAGPGPHFENC

SEQ ID NO: 750492 - protein, 70 aa, Homo sapiens
RVNLETWQESPGLPSCWGHVALGAAVAIFTATQESLPESETNTEQQRQRQTGSRAFSPSAGSQLEPWPFQ

SEQ ID NO: 750493 - protein, 104 aa, Homo sapiens
MLPSMQTVPSADVGSLTGARWLGLISAQIHWLTTKLSSHSLIREMQIKAITTTTRMAKIKKTDNPSVDKDMRKPESSQIAGGNIKQYGHDGKQFGSFLKSSIYT

SEQ ID NO: 750494 - protein, 170 aa, Homo sapiens
DFFPDYRDSRLSRTWQRALEEMSQERRGQDRGSPGPGSGFEVPASQLLASGGRESGRARSCGSDVQLRVWGGGPRRAPGEGSRRRCGELAWATPLSVQTSLLPGLGQPLLPDPNSGLQSPGEVVAFTPNTPSRTVNFIGWARQRPFASAQRSPLRPLSLWRAGGRPSPRQ

SEQ ID NO: 750495 - protein, 1007 aa, Homo sapiens
MEQAGTRPAATEHPRLRRPMPWLLLLPLLLLLLLLLPGPAASQLRYSVPEEQAPGALVGNVARALGLELRRLGPGCLRINHLGAPSPRYLELDLTSGALFVNERIDREALCEQRPRCLLSLEVLAHNPVAVSAVEVEILDINDNSPRFPRPNYQLQVSESVAPGARFHIESAQDPDVGANSVQTYELSPSEHFELDLKPLQENSKVLELVLRKGLDREQAALHHLVLTAVDGGIPARSGTAQISVRVLDTNDNSPAFDQSTYRVQLREDSPPGTLVVKLNASDPDEGSNGELRYSLSSYTSDRERQLFSIDASTGEVRVIGGLDYEEASSYQIYVQATDRGPVPMAGHCKVLVDIVDVNDNAPEVVLTDLYSPVPENATPNTIVAVLSVNDQDSGPNRKVSLGLEATLPFRLNGFGNSYTLVVSGPLDRERVAVYNITVTATDGGIPQLTSLRTLKVEISDINDNPPSFLEDSYSIYIQENNLPGVLLCTVQATDPDEKENAEVTYSLLEREIQGLPVTSYVSINSASGSLYAVNSFDYEKFREFFVTVEAQDKGSPPLSSTVTANVYVVDMNDHAPHILYPTSTNSSAAFEMVPRTAPAGYLVTKVIAMDSDSGQNAWLFYHLAQTSDLDLFKVELHTGEIRTTRKMGDESGSTFNLTVVVRDNGEPSLSASVAITVAVVDRVSKILPDTQRHVKSPRTYSEITLYLIIALSTVSFIFLLTIIILSIIKCYRYTAYGTACCGGFCGVRERSPAELYKQANNNIDARIPHGLKVQPHFIEVRGNGSLTKTYCYKACLTAGSGSDTFMFYNTGAQTGPGPSGAQAAVTDSRNLTGQSGQNAGNLIILKNEAVSQNEPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 750496 - protein, 818 aa, Homo sapiens
MVGCGVAVLCLWVSCGAAAGQLEYSVPEETERGVAVGNLSADLRLPAAAMSSRNFRFLSSHRELYFGVDLPSGNLVVREPADREQLCRAKAACVLTYDLVLEDPLELHKIRIHVLDTNDNSPLFPAGDVQLHIPEFLTPGARFTLPNAQDDDEGSNGILSYSLSPSQHFRLDMGSRVDGSEYPELVLEKALDREQRATHLLVLTARDGGLPARSGDAQVTIIVVDTNDNAPVFERSVYRTKVPETAPNGTVLFRVQALDPDEGSNGEVQYSLSNSTQAELRHRFHVHPKSGEVQVAASLGPPETLLEAYIEARDEGVFGLASTAKLLVEVTDVNDHAPELDFLTLSNPVPEDAAPGTVIALFSVKDEDLDSNGRVICGMSSAGPFQLTASFDNYYSLLIDGPLDREQISEYQVLITASDSGSPPLSTRRTITVSVADVNDNTPNFPQPQQELFVAENNGPGASLGRVFAQDPDLGKNGLVSYELLDVISEGPSASSLVAVESSSGAITAKTSFDFEQLRGFHFQVEGRDGGIPPRSATVTINLFVVDRNDNYPVILFPLPRNGSVPVEIVPRSARTGHLVTKVVAEDADSGSNAWLSYHISRASDSSLFRISANIGELRTARLVLPTDAVKQRVVVVVRDHGDPPLSSSVTLGVLLSNSVPQLLPDFEDVWEPGGQLSAQNLYLVIALACISFLFLGCLLFFVCTKLHQSPGCCAQSCCRSTEDLRYGSKMVSNPCMTSATIDVTTVERLSQTYLYRASLGLGSDNNSLLLRGEYNAADLRNLATGVGLNLPISCIQIRNRKGDHANVNAMVSKFYGI

SEQ ID NO: 750497 - protein, 963 aa, Homo sapiens [sequence omitted]

SEQ ID NO: 750498 - protein, 884 aa, Homo sapiens
MEQAGTRPAATEHPRLRRPMPWLLLLPLLLLLLLLLPGPAASQLRYSVPEEQAPGALVGNVARALGLELRRLGPGCLRINHLGAPSPRYLELDLTSGALFVNERIDREALCEQRPRCLLSLEVLAHNPVAVSAVEVEILDINDNSPRFPRPNYQLQVSESVAPGARFHIESAQDPDVGANSVQTYELSPSEHFELDLKPLQENSKVLELVLRKGLDREQAALHHLVLTAVDGGIPARSGTAQISVRVLDTNDNSPAFDQSTYRVQLREDSPPGTLVVKLNASDPDEGSNGELRYSLSSYTSDRERQLFSIDASTGEVRVIGGLDYEEASSYQIYVQATDRGPVPMAGHCKVLVDIVDVNDNAPEVVLTDLYSPVPENATPNTIVAVLSVNDQDSGPNRKVSLGLEATLPFRLNGFGNSYTLVVSGPLDRERVAVYNITVTATDGGIPQLTSLRTLKVEISDINDNPPSFLEDSYSIYIQENNLPGVLLCTVQATDPDEKENAEVTYSLLEREIQGLPVTSYVSINSASGSLYAVNSFDYEKFREFFVTVEAQDKGSPPLSSTVTANVYVVDMNDHAPHILYPTSTNSSAAFEMVPRTAPAGYLVTKVIAMDSDSGQNAWLFYHLAQTSDLDLFKVELHTGEIRTTRKMGDESGSTFNLTVVVRDNGEPSLSASVAITVAVVDRVSKILPDTQRHVKSPRTYSEITLYLIIALSTVSFIFLLTIIILSIIKCYRYTAYGTACCGGFCGVRERSPAELYKQANNNIDARIPHGLKVQPHFIEVRGNGSLTKTYCYKACLTAGSGSDTFMFYNTGAQTGPGPSGAQAAVTDSRNLTGQSGQNAGNLIILKNEAVSQNEVRQWSGGLLQTHAFVTHPPISCDLALLSH

SEQ ID NO: 750499 - protein, 290 aa, Homo sapiens
MNTIVFNKLSGAVLFEDGGASERERGGRPYSGVLDSPHARPEVGIPDGPPLKDNLGLRHRRTGARQNGGKVRHKRQALQDMARPLKQWLYKHRDNPYPTKTEKILLALGSQMTLVQVSNWFANARRRLKNTVRQPDLSWALRIKLYNKYVQGNAERLSVSSDDSCSEDGENPPRTHMNEGGYNTPVHHPVIKSENSVIKAGVRPESRASEDYVAPPKYKSSLLNRYLNDSLRHVMATNTTMMGKTRQRNHSGSFSSNEFEEELVSPSSSETEGNFVYRTGKSVLSVVIPA

SEQ ID NO: 750500 - protein, 534 aa, Homo sapiens [sequence omitted]

SEQ ID NO: 750501 - protein, 480 aa, Homo sapiens [sequence omitted]

SEQ ID NO: 750502 - protein, 592 aa, Homo sapiens
MRVLCAFPEAMPSSNSRPPACLAPGALYLALLLHLSLSSQAGDRRPLPVDRAAGLKEKTLILLDVSTKNPVRTVNENFLSLQLDPSIIHDGWLDFLSSKRLVTLARGLSPAFLRFGGKRTDFLQFQNLRNPAKSRGGPGPDYYLKNYEDDIVRSDVALDKQKGCKIAQHPDVMLELQREKAAQMHLVLLKEQFSNTYSNLILTARSLDKLYNFADCSGLHLIFALNALRRNPNNSWNSSSALSLLKYSASKKYNISWELGNEPNNYRTMHGRAVNGSQLGKDYIQLKSLLQPIRIYSRASLYGPNIGRPRKNVIALLDGFMKVAGSTVDAVTWQHCYIDGRVVKVMDFLKTRLLDTLSDQIRKIQKVVNTYTPGKKIWLEGVVTTSAGGTNNLSDSYAAGFLWLNTLGMLANQGIDVVIRHSFFDHGYNHLVDQNFNPLPDYWLSLLYKRLIGPKVLAVHVAGLQRKPRPGRVIRDKLRIYAHCTNHHNHNYVRGSITLFIINLHRSRKKIKLAGTLRDKLVHQYLLQPYGQEGLKSKSVQLNGQPLVMVDDGTLPELKPRPLRAGRTLVIPPVTMGFFVVKNVNALACRYR

SEQ ID NO: 750503 - protein, 229 aa, Homo sapiens
MQPSLDIKPFMSFPVDSSSAVGLFPNFNTMDPVQKAVINHTFGVSIPPKKKQVISCNVCQLRFNSDSQAEAHYKGSKHAKKVKALDATKNKPKMVPSKDSAKANPSCSITPITGNNSDKSEDKGKLKASSSSQPSSSESGSFLLKSGTTPLPPGAATSPSKSTNWQPPRLHAVVETPQRRKKAQQHSLYSVHMTKWAWDNSLVLNIAGPTTKAHQSTKTTARNPEKRAR

SEQ ID NO: 750504 - protein, 368 aa, Homo sapiens
MQPSLDIKPFMSFPVDSSSAVGLFPNFNTMDPVQKAVINHTFGVSIPPKKKQVISCNVCQLRFNSDSQAEAHYKGSKHAKKVKALDATKNKPKMVPSKDSAKANPSCSITPITGNNSDKSEDKGKLKASSSSQPSSSESGSFLLKSGTTPLPPGAATSPSKSTNGAPGTVVESEEEKAKKLLYCSLCKVAVNSLSQLEAHNTGSKHKTMVEARNGAGPIKSYPRPGSRLKMQNGSKGSGLQNKTFHCEICDVHVNSEIQLKQHISSRRHKDRVAGKPLKPKYSPYNKLQRSPSILAAKLAFQKDMMKPLAPAFLSSPLAAAAAVSSALSLPPRPSASLFQAPAIPPALLRPGHGPIRATPASILFAPY

SEQ ID NO: 750505 - protein, 368 aa, Homo sapiens; identical to SEQ ID NO: 750504

SEQ ID NO: 750506 - protein, 433 aa, Homo sapiens
FERDHSCKVWQRLGKVDYKLLENRDYVFFNNVYTTSSRLFGTWQMLGSTCHTTTLPALVRTPTLMMQPSLDIKPFMSFPVDSSSAVGLFPNFNTMDPVQKAVINHTFGVSIPPKKKQVISCNVCQLRFNSDSQAEAHYKGSKHAKKVKALDATKNKPKMVPSKDSAKANPSCSITPITGNNSDKSEDKGKLKASSSSQPSSSESGSFLLKSGTTPLPPGAATSPSKSTNGAPGTVVESEEEKAKKLLYCSLCKVAVNSLSQLEAHNTGSKHKTMVEARNGAGPIKSYPRPGSRLKMQNGSKGSGLQNKTFHCEICDVHVNSEIQLKQHISSRRHKDRVAGKPLKPKYSPYNKLQRSPSILAAKLAFQKDMMKPLAPAFLSSPLAAAAAVSSALSLPPRPSASLFQAPAIPPALLRPGHGPIRATPASILFAPY

SEQ ID NO: 750507 - protein, 368 aa, Homo sapiens; identical to SEQ ID NO: 750504

SEQ ID NO: 750508 - protein, 390 aa, Homo sapiens [sequence omitted]

SEQ ID NO: 750509 - protein, 368 aa, Homo sapiens; identical to SEQ ID NO: 750504

SEQ ID NO: 750510 - protein, 381 aa, Homo sapiens
MQPSLDIKPFMSFPVDSSSAVGLFPNFNTKRRGLFETNKFCQMDPVQKAVINHTFGVSIPPKKKQVISCNVCQLRFNSDSQAEAHYKGSKHAKKVKALDATKNKPKMVPSKDSAKANPSCSITPITGNNSDKSEDKGKLKASSSSQPSSSESGSFLLKSGTTPLPPGAATSPSKSTNGAPGTVVESEEEKAKKLLYCSLCKVAVNSLSQLEAHNTGSKHKTMVEARNGAGPIKSYPRPGSRLKMQNGSKGSGLQNKTFHCEICDVHVNSEIQLKQHISSRRHKDRVAGKPLKPKYSPYNKLQRSPSILAAKLAFQKDMMKPLAPAFLSSPLAAAAAVSSALSLPPRPSASLFQAPAIPPALLRPGHGPIRATPASILFAPY

SEQ ID NO: 750511 - protein, 127 aa, Homo sapiens
MDAAENAVKGVGSTLITHQKILRGGVPGLEGGGSTLTTDSEDTAREHSRWEESQVLATVLLTAMTYNGEGISQGRRCGRGRGDQPQRGTLPRRSHTGRSGCEHRCGMLTGKLCETQFPGLLPRLAVR

SEQ ID NO: 750512 - protein, 155 aa, Homo sapiens [sequence omitted]

SEQ ID NO: 750513 - protein, 75 aa, Homo sapiens
MFPSDSIPGLTEEEEETHKIGSLAENAFSDPAGSANPLEPSQDEKSIPLIWGAVLLVGLLVAAVVLFAVMAKRKQ

SEQ ID NO: 750514 - protein, 154 aa, Homo sapiens
ATRMVSTYQNSKLSWRNCRATIKDLKNARVVILITFPFTLPIWLWRVTVDYHKLNPGDFNCRYFFQMCFCCWSKSIQSLTFGMQILIWHTLLFCIPISKDHQNQFTFDWQGLHYTLTNLHQGYIKSYDVSSLMQRTWIAPSFHIFCLSVMLIPC

SEQ ID NO: 750515 - protein, 72 aa, Homo sapiens
MHFTSIGVRTDCAGGTPPGGTAAWGACYPAAPVMARVELGALEGTRKRCHKPKREGKQLLGEDLHAVAGKQR

SEQ ID NO: 750516 - protein, 327 aa, Homo sapiens
MEVAVPVKQEAEGLALDSPWHRFRRFHLGDAPGPREALGLLRALCRDWLRPEVHTKEQMLELLVLEQFLSALPADTQAWVCSRQPQSGEEAVALLEELWGPAASPDGSSATRVPQDVTQGPGATGGKEDSGMIPLAGTAPGAEGPAPGDSQAVRPYKQEPSSPPLAPGLPAFLAAPGTTSCPECGKTSLKPAHLLRHRQSHSGEKPHACPECGKAFRRKEHLRRHRDTHPGSPGSPGPALRPLPAREKPHACCECGKTFYWREHLVRHRKTHSGARPFACWECGKGFGRREHVLRHQRIHGRAAASAQGAVAPGPDGGGPFPPWPLG

SEQ ID NO: 750517 - protein, 299 aa, Homo sapiens
GFKMAPWQGVGRRPWFLTWGPLCGAASVSPSMTVASPQQGWDCTAGRRWLGEGEIEALAQVSEFKTVLSFQGPAASPDGSSATRVPQDVTQGPGATGGKEDSGMIPLAGTAPGAEGPAPGDSQAVRPYKQEPSSPPLAPGLPAFLAAPGTTSCPECGKTSLKPAHLLRHRQSHSGEKPHACPECGKAFRRKEHLRRHRDTHPGSPGSPGPALRPLPAREKPHACCECGKTFYWREHLVRHRKTHSGARPFACWECGKGFGRREHVLRHQRIHGRAAASAQGAVAPGPDGGGPFPPWPLG

SEQ ID NO: 750518 - protein, 72 aa, Homo sapiens
MEVAVPVKQEAEGLALDSPWHRFRRFHLGDAPGPREALGLLRALCRDWLRPEVPRKPFFTVWWENNDSVGRL

SEQ ID NO: 750519 - protein, 327 aa, Homo sapiens; identical to SEQ ID NO: 750516

SEQ ID NO: 750520 - protein, 327 aa, Homo sapiens; identical to SEQ ID NO: 750516

SEQ ID NO: 750521 - protein, 196 aa, Homo sapiens
MIPLAGTAPGAEGPAPGDSQAVRPYKQEPSSPPLAPGLPAFLAAPGTTSCPECGKTSLKPAHLLRHRQSHSGEKPHACPECGKAFRRKEHLRRHRDTHPGSPGSPGPALRPLPAREKPHACCECGKTFYWREHLVRHRKTHSGARPFACWECGKGFGRREHVLRHQRIHGRAAASAQGAVAPGPDGGGPFPPWPLG

SEQ ID NO: 750522 - protein, 433 aa, Homo sapiens
MRAEGLGGLERFCSPGKGRGLRALQPFQVGDLLFSCPAYAYVLTVNERGNHCEYCFTRKEGLSKCGRCKQAFYCNVECQKEDWPMHKLECSPMVVFGENWNPSETVRLTARILAKQKIHPERTPSEKLLAVKEFESHLDKLDNEKKDLIQSDIAALHHFYSKHLEFPDNDSLVVLFAQVNCNGFTIEDEELSHLGSAIFPDVALMNHSCCPNVIVTYKGTLAEVRAVQEIKPGEEVFTSYIDLLYPTEDRNDRLRDSYFFTCECQECTTKDKDKAKVEIRKLSDPPKAEAIRDMVRYARNVIEEFRRAKHYKSPSELLEICELSQEKMSSVFEDSNVYMLHMMYQAMGVCLYMQDWEGALQYGQKIIKPYSKHYPLYSLNVASMWLKLGRLYMGLEHKAAGEKALKKAIAIMEVAHGKDHPYISEIKQEIESH

SEQ ID NO: 750523 - protein, 433 aa, Homo sapiens; identical to SEQ ID NO: 750522

SEQ ID NO: 750524 - protein, 349 aa, Homo sapiens
MHKLECSPMVVFGENWNPSETVRLTARILAKQKIHPERTPSEKLLAVKEFESHLDKLDNEKKDLIQSDIAALHHFYSKHLEFPDNDSLVVLFAQVNCNGFTIEDEELSHLGSAIFPDVALMNHSCCPNVIVTYKGTLAEVRAVQEIKPGEEVFTSYIDLLYPTEDRNDRLRDSYFFTCECQECTTKDKDKAKVEIRKLSDPPKAEAIRDMVRYARNVIEEFRRAKHYKSPSELLEICELSQEKMSSVFEDSNVYMLHMMYQAMGVCLYMQDWEGALQYGQKIIKPYSKHYPLYSLNVASMWLKLGRLYMGLEHKAAGEKALKKAIAIMEVAHGKDHPYISEIKQEIESH

SEQ ID NO: 750525 - protein, 407 aa, Homo sapiens
QSNIGIQESLPAYAYVLTVNERGNHCEYCFTRKEGLSKCGRCKQAFYCNVECQKEDWPMHKLECSPMVVFGENWNPSETVRLTARILAKQKIHPERTPSEKLLAVKEFESHLDKLDNEKKDLIQSDIAALHHFYSKHLEFPDNDSLVVLFAQVNCNGFTIEDEELSHLGSAIFPDVALMNHSCCPNVIVTYKGTLAEVRAVQEIKPGEEVFTSYIDLLYPTEDRNDRLRDSYFFTCECQECTTKDKDKAKVEIRKLSDPPKAEAIRDMVRYARNVIEEFRRAKHYKSPSELLEICELSQEKMSSVFEDSNVYMLHMMYQAMGVCLYMQDWEGALQYGQKIIKPYSKHYPLYSLNVASMWLKLGRLYMGLEHKAAGEKALKKAIAIMEVAHGKDHPYISEIKQEIESH

SEQ ID NO: 750526 - protein, 433 aa, Homo sapiens; identical to SEQ ID NO: 750522

SEQ ID NO: 750527 - protein, 433 aa, Homo sapiens; identical to SEQ ID NO: 750522

SEQ ID NO: 750528 - protein, 244 aa, Homo sapiens
NNKGLGLTRLFLVALMNHSCCPNVIVTYKGTLAEVRAVQEIKPGEEVFTSYIDLLYPTEDRNDRLRDSYFFTCECQECTTKDKDKAKVEIRKLSDPPKAEAIRDMVRYARNVIEEFRRAKHYKSPSELLEICELSQEKMSSVFEDSNVYMLHMMYQAMGVCLYMQDWEGALQYGQKIIKPYSKHYPLYSLNVASMWLKLGRLYMGLEHKAAGEKALKKAIAIMEVAHGKDHPYISEIKQEIESH

SEQ ID NO: 750529 - protein, 229 aa, Homo sapiens [sequence omitted]

SEQ ID NO: 750530 - protein, 421 aa, Homo sapiens
MRAEGLGGLERFCSPGKGRGLRALQPFQVGDLLFSCPAYAYVLTVNERGNHCEYCFTRKEGLSKCGRCKQAFYCNVECQKEDWPMHKLECSPMVVFGENWNPSETVRLTARILAKQKIHPERTPSEKLLAVKEFESHLDKLDNEKKDLIQSDIAALHHFYSKHLEFPDNDSLVVLFAQVNCNGFTIEDEELSHLGSAIFPDVALMNHSCCPNVIVTYKGTLAEVRAVQEIKPGEEVFTSYIDLLYPTEDRNDRLRDSYFFTCECQECTTKDKDKAKVEIRKLSDPPKAEAIRDMVRYARNVIEEFRRAKHYKSPSELLEICELSQEKMSSVFEDSNVYMLHMMYQAMGVCLYMQDWEGALQYGQKIIKPYSKHYPLYSLNVASMWLKLGRLYMGLEHKAAGEKALKKPCHHGYRRDPLDAT

SEQ ID NO: 750531 - protein, 272 aa, Homo sapiens
MRAEGLGGLERFCSPGKGRGLRALQPFQVGDLLFSCPAYAYVLTVNERGNHCEYCFTRKEGLSKCGRCKQAFYCNVECQKEDWPMHKLECSPMVVFGENWNPSETVRLTARILAKQKIHPERTPSEKLLAVKEFESHLDKLDNEKKDLIQSDIAALHHFYSKHLEFPDNDSLVVLFAQVNCNGFTIEDEELSHLGSAIFPDVALMNHSCCPNVIVTYKGTLAEVRAVQEIKPGEEVFTSYIDLLYPTEDRNDRLRDSYFFTCECQECTTKDK

SEQ ID NO: 750532 - protein, 76 aa, Homo sapiens
LSYVVKGKGRSLEHKHYPLYSLNVASMWLKLGRLYMGLEHKAAGEKALKKAIAIMEVAHGKDHPYISEIKQEIESH

SEQ ID NO: 750533 - protein, 254 aa, Homo sapiens
AGGRPPFRGAGSRRRVRRAAPTPPPAALGDASPITARREPQLGHSRRPRPAATMRAEGLGGLERFCSPGKGRGLRALQPFQVGDLLFSCPAYAYVLTVNERGNHCEYCFTRKEGLSKCGRCKQAFYCNVECQKEDWPMHKLECSPMVVFGENWNPSETVRLTARILAKQKIHPERTPSEKLLAVKEFESHLDKLDNEKKDLIQSDIAALHHFYSKHLEFPDNDSLVVLFAQVNCNGFTIEDEELSHLGSAIFPE

SEQ ID NO: 750534 - protein, 224 aa, Homo sapiens
RIPSLGNPPRAGKFRDCTGKSRPGEEVFTSYIDLLYPTEDRNDRLRDSYFFTCECQECTTKDKDKAKVEIRKLSDPPKAEAIRDMVRYARNVIEEFRRAKHYKSPSELLEICELSQEKMSSVFEDSNVYMLHMMYQAMGVCLYMQDWEGALQYGQKIIKPYSKHYPLYSLNVASMWLKLGRLYMGLEHKAAGEKALKKAIAIMEVAHGKDHPYISEIKQEIESH

SEQ ID NO: 750535 - protein, 400 aa, Homo sapiens
MRAEGLGGLERFCSPGKGRGLRALQPFQVGDLLFSCPAYAYVLTVNERGNHCEYCFTRKEGLSKCGRCKQAFYCNVECQKEDWPMHKLECSPMVVFGENWNPSETVRLTARILAKQKIHPERTPSEKLLAVKEFESHLDKLDNEKKDLIQSDIAALHHFYSKHLEFPDNDSLVVLFAQVNCNGFTIEDEELSHLGSAIFPDVALMNHSCCPNVIVTYKGTLAEVRAVQEIKPGEEVFTSYIDLLYPTEDRNDRLRDSYFFTCECQECTTKDKDKAKVEIRKLSDPPKAEAIRDMVRYARNVIEEFRRAKHYKSPSELLEICELSQEKMSSVFEDSNVYMLHMMYQAMGVCLYMQDWEGALQYGQKIIKPYSKHYPLCSRPMKSLPSFNHREATLREYKVR

SEQ ID NO: 750536 - protein, 365 aa, Homo sapiens
AGGRPPFRGAGSRRRVRRAAPTPPPAALGDASPITARREPQLGHSRRPRPAATMRAEGLGGLERFCSPGKGRGLRALQPFQVGDLLFSCPAYAYVLTVNERGNHCEYCFTRKEGLSKCGRCKQAFYCNVECQKEDWPMHKLECSPMVVFGENWNPSETVRLTARILAKQKIHPERTPSEKLLAVKEFESHLDKLDNEKKDLIQSDIAALHHFYSKHLEFPDNDSLVVLFAQVNCNGFTIEDEELSHLGSAIFPDVALMNHSCCPNVIVTYKGTLAEVRAVQEIKPGEEVFTSYIDLLYPTEDRNDRLRDSYFFTCVKLPQRGKGLYHAKGGTKRGIKWAKVEIRKPFPKGPGKNFPPNAKKRQET

SEQ ID NO: 750537 - protein, 165 aa, Homo sapiens [sequence omitted]

SEQ ID NO: 750538 - protein, 126 aa, Homo sapiens
MSVATGSSEAAGGASGGGARVFFQSPRGGAGGSPGSSSGSGSSREDSAPVATAAAAGQVQQQQQRRHQQGKVTVKYDRKELRKRLVLEEWIVEQLGQLYGCEEFIKELLSRIRGMRKLSPPQKKSV

SEQ ID NO: 750539 - protein, 165 aa, Homo sapiens [sequence omitted]

SEQ ID NO: 750540 - protein, 165 aa, Homo sapiens [sequence omitted]

SEQ ID NO: 750541 - protein, 287 aa, Homo sapiens
MSVATGSSEAAGGASGGGARVFFQSPRGGAGGSPGSSSGSGSSREDSAPVATAAAAGQVQQQQQRRHQQGKVTVKYDRKELRKRLVLEEWIVEQLGQLYGCEEEEMPEVEIDIDDLLDADSDEERASKLQEALVDCYKPTETESRSVAQVGVQWCDLGSLQPPPPEFNQFSRLSLLSSWDYRRASPRPANFCIFSRDGVSPCWPGWSQTPDLRYSPASASQSAGITGVSHRTRPIGIYQRAAFSDKRHEETEPSAEEECMILEQGETLPETKKESWDLYFMKTFVKE

SEQ ID NO: 750542 - protein, 165 aa, Homo sapiens [sequence omitted]

SEQ ID NO: 750543 - protein, 116 aa, Homo sapiens
KRLAAGSFLKRKSRQDLLADWSGCERGVKDDTRDFCSWWALPCIRKGKTWEEQRVEVRSGVGFCACSVSEAFGEQIGDMLDWGVHCSRERSRLQIEIGVFGPGAVAHSCNPSTLGG

SEQ ID NO: 750544 - protein, 436 aa, Homo sapiens
CCEACPRTVNLQGREGGTSIKPKSWAFSPQGTERVKTPADSAGKEIMPSKSLSNLSVTTGANESGSVPEGWERDFLPASDGTTTELVIRCVIPSLYLLIITVGLLGNIMLVKIFITNSAMRSVPNIFISNLAAGDLLLLLTCVPVDASRYFFDEWMFGKVGCKLIPVIQLTSVGVSVFTLTALSADRYRAIVNPMDMQTSGALLRTCVKAMGIWVVSVLLAVPEAVFSEVARISSLDNSSFTACIPYPQTDELHPKIHSVLIFLVYFLIPLAIISIYYYHIAKTLIKSAHNLPGEYNEHTKKQMETRKRLAKIVLVFVGCFIFCWFPNHILYMYRSFNYNEIDPSLGHMIVTLVARVLSFGNSCVNPFALYLLSESFRRHFNSQLCCGRKSYQERGTSYLLSSSAVRMTSLKSNAKNMVTNSVLLNGHSMKQEMAL

SEQ ID NO: 750545 - protein, 406 aa, Homo sapiens
CCEACPRTVNLQGREGGTSIKPKSWAFSPQGTERVKTPADSAGKEIMPSKSLSNLSVTTGANESGSVPEGWERDFLPASDGTTTELVIRCVIPSLYLLIITVGLLGNIMLVKIFITNSAMRSVPNIFISNLAAGDLLLLLTCVPVDASRYFFDEWMFGKVGCKLIPVIQLTSVGVSVFTLTALSADRYRAIVNPMDMQTSGALLRTCVKAMGIWVVSVLLAVPEAVFSEVARISSLDNSSFTACIPYPQTDELHPKIHSVLIFLVYFLIPLAIISIYYYHIAKTLIKSAHNLPGEYNEHTKKQMETRKRLAKIVLVFVGCFIFCWFPNHILYMYRSFNYNEIDPSLGHMIVTLVARVLSFGNSCVNPFALYLLSESFRRHFNSQLCCGRKSYQERGTSYLLSSSAA

SEQ ID NO: 750546 - protein, 321 aa, Homo sapiens
AQPSPVSHQQQPQQSPLPPGIKPTIQIKQESGVKIITQQVQPSKILPKPVTATLPTSSNSPIMVVSSNGAIMTTKLVTTPTGTQATYTRPTVSPSIGRMAATPGAATYVKTTSGSIITVVPKSLATLGGKIISSNIVSGTTTKITTIPMTSKPNVIVVQKTTGKGTTIQGLPGKNVVTTLLNAGGEKTIQTVPTGAKPAILTATRPITKMIVTQPKGIGSTVQPAAKIIPTKIVYGQQGKTQVLIKPKPVTFQATVVSEQTRQLVTETLQQASRVAEAGNSSIQEGKEEPQNYTDSSSSSTESSQSSQGKIYFTSDLYKYY

SEQ ID NO: 750547 - protein, 331 aa, Homo sapiens
AQPSPVSHQQQPQQSPLPPGIKPTIQIKQESGVKIITQQVQPSKILPKPVTATLPTSSNSPIMVVSSNGAIMTTKLVTTPTGTQATYTRPTVSPSIGRMAATPGAATYVKTTSGSIITVVPKSLATLGGKIISSNIVSGTTTKITTIPMTSKPNVIVVQKTTGKGTTIQGLPGKNVVTTLLNAGGEKTIQTVPTGAKPAILTATRPITKMIVTQPKGIGSTVQPAAKIIPTKIVYGQQGKTQVLIKPKPVTFQATVVSEQTRQLVTETLQQASRVAEAGNSSIQEGKEEPQDSQPVVHVIASRRQDWSEHEIAMETSPTIIYQDVSSESQS

SEQ ID NO: 750548 - protein, 142 aa, Homo sapiens
AQPSPVSHQQQPQQSPLPPGIKPTIQIKQESGVKIITQQVQPSKILPKPVTATLPTSSNSPIMVVSSNGAIMTTKLVTTPTGTQATYTRPTVSPSIGRMAATPGAATYVKTTSGSIITVVPKSLATLGGKIISSNIVSGRYI

SEQ ID NO: 750549 - protein, 312 aa, Homo sapiens
MESALPAAGFLYWVGAGTVAYLALRISYSLFTALRVWGVGNEAGVGPGLGEWAVVTGSTDGIGKSYAEELAKHGMKVVLISRSKDKLDQVSSEIKEKFKVETRTIAVDFASEDIYDKIKTGLAGLEIGILVNNVGMSYEYPEYFLDVPDLDNVIKKMININILSVCKMTQLVLPGMVERSKGAILNISSGSGMLPVPLLTIYSATKTFVDFFSQCLHEEYRSKGVFVQSVLPYFVATKLAKIRKPTLDKPSPETFVKSAIKTVGLQSRTNGYLIHALMGSIISNLPSWIYLKIVMNMNKSTRAHYLKKTKKN

SEQ ID NO: 750550 - protein, 238 aa, Homo sapiens
MKVVLISRSKDKLDQVSSEIKEKFKVETRTIAVDFASEDIYDKIKTGLAGLEIGILVNNVGMSYEYPEYFLDVPDLDNVIKKMININILSVCKMTQLVLPGMVERSKGAILNISSGSGMLPVPLLTIYSATKTFVDFFSQCLHEEYRSKGVFVQSVLPYFVATKLAKIRKPTLDKPSPETFVKSAIKTVGLQSRTNGYLIHALMGSIISNLPSWIYLKIVMNMNKSTRAHYLKKTKKN

SEQ ID NO: 750551 - protein, 238 aa, Homo sapiens; identical to SEQ ID NO: 750550

SEQ ID NO: 750552 - protein, 125 aa, Homo sapiens
SRGSRGCKSPLLTIYSATKTFVDFFSQCLHEEYRSKGVFVQSVLPYFVATKLAKIRKPTLDKPSPETFVKSAIKTVGLQSRTNGYLIHALMGSIISNLPSWIYLKIVMNMNKSTRAHYLKKTKKN

SEQ ID NO: 750553 - protein, 312 aa, Homo sapiens; identical to SEQ ID NO: 750549

SEQ ID NO: 750554 - protein, 312 aa, Homo sapiens; identical to SEQ ID NO: 750549

SEQ ID NO: 750555 - protein, 312 aa, Homo sapiens; identical to SEQ ID NO: 750549

SEQ ID NO: 750556 - protein, 312 aa, Homo sapiens; identical to SEQ ID NO: 750549

SEQ ID NO: 750557 - protein, 268 aa, Homo sapiens
MESALPAAGFLYWVGAGTVAYLALRISYSLFTALRVWGVGNEAGVGPGLGEWAVVTGSTDGIGKSYAEELAKHGMKVVLISRSKDKLDQVSSEIKEKFKVETRTIAVDFASEDIYDKIKTGLAGLEIGILVNNVGMSYEYPEYFLDVPDLDNVIKKMININILSVCKMTQLVLPGMVERSKGAILNISSGSGMLPVPLLTIYSATKTFVDFFSQCLHEEYRSKGVFVQSVLPYFVATKLAKIRKPTLDKPSPETFVKSAIKTRCGRRY

SEQ ID NO: 750558 - protein, 156 aa, Homo sapiens
MESALPAAGFLYWVGAGTVAYLALRISYSLFTALRVWGVGNEAGVGPGLGEWAVVTGSTDGIGKSYAEELAKHGMKVVLISRSKDKLDQVSSEIKEKFKVETRTIAVDFASEDIYDKIKTGLAGLEIGILGWAGLKPQPSSHRVGLSGVQPHPGSS

SEQ ID NO: 750559 - protein, 312 aa, Homo sapiens; identical to SEQ ID NO: 750549

SEQ ID NO: 750560 - protein, 312 aa, Homo sapiens; identical to SEQ ID NO: 750549

SEQ ID NO: 750561 - protein, 102 aa, Homo sapiens
IILSPDTHLQTTPHDKPSSVLPYFVATKLAKIRKPTLDKPSPETFVKSAIKTVGLQSRTNGYLIHALMGSIISNLPSWIYLKIVMNMNKSTRAHYLKKTKKN

SEQ ID NO: 750562 - protein, 312 aa, Homo sapiens; identical to SEQ ID NO: 750549

SEQ ID NO: 750563 - protein, 138 aa, Homo sapiens
MESALPAAGFLYWVGAGTVAYLALRISYSLFTALRVWGVGNEAGVGPGLGEWAVVTGSTDGIGKSYAEELLRRLRQENRLNPGGGGCSEPRSHRGTPAWVTEQDSVSKKLAKHGMKVVLISRSKDKLDQVSSEISNYT

SEQ ID NO: 750564 - protein, 98 aa, Homo sapiens
MESALPAAGFLYWVGAGTVAYLALRISYSLFTALRVWGVGNEAGVGPGLGEWAVVTGSTDGIGKSYAEELAKHGMKVVLISRSKDKLDQVSSEISNYT

SEQ ID NO: 750565 - protein, 123 aa, Homo sapiens
MLKKSGESGLLVLFQFSKGMLSPFPHSVLCWLWVCIDGFYYIKEIMAQVAVSTLPMEDEESMEDEESIEDEESVEDDSVESRMVVTLLISALESTMLEFLMNLQSAFCMNCVWIHCLHWMMKT

SEQ ID NO: 750566 - protein, 301 aa, Homo sapiens
MLKKSGESGLLVLFQFSKGMLSPFPHSVLCWLWVCIDGFYYIKGSWHKLQFSTLPMEDEESMEDEESIEDEESVEDDSVESRMVVTFLISALESTMLEFLMNLQSAFCMNCVWIHCLHWMMKTGVLLLRPWCVMFPILCPSVLIVQFPPMSENMWCLVFCPCNSLLRMMVSSFIHVPTKYMNSSFFMLHSIPWCCVPEKVSEPLRGPSHEKGNRIVNGKGKGLLQTFFLGSLALKWKILCERSSTTERMCPTLERQNKALPGAFEGRARTVSTRTVDKKALPGAKQGDLVPKAKSRHQLRT

SEQ ID NO: 750567 - protein, 593 aa, Homo sapiens
METPPLPPACTKQGHQKPLDSKDDNTEKHCPVTVNPWHMKKAFKVMNELRSQNLLCDVTIVAEDMEISAHRVVLAACSPYFHAMFTGEMSESRAKRVRIKEVDGWTLRMLIDYVYTAEIQVTEENVQVLLPAAGLLQLQDVKKTCCEFLESQLHPVNCLGIRAFADMHACTDLLNKANTYAEQHFADVVLSEEFLNLGIEQVCSLISSDKLTISSEEKVFEAVIAWVNHDKDVRQEFMARLMEHVRLPLLPREYLVQRVEEEALVKNSSACKDYLIEAMKYHLLPTEQRILMKSVRTRLRTPMNLPKLMVVVGGQAPKAIRSVECYDFKEERWHQVAELPSRRCRAGMVYMAGLVFAVGGFNGSLRVRTVDSYDPVKDQWTSVANMRDRRSTLGAAVLNGLLYAVGGFDGSTGLSSVEAYNIKSNEWFHVAPMNTRRSSVGVGVVGGLLYAVGGYDGASRQYLSTVECYNATTNEWTYIAEMSTRRSGAGVGVLNNLLYAVGGHDGPLVRKSVEVYDPTTNAWRQVADMNMCRRNAGVCAVNGLLYVVGGDDGSCNLASVEYYNPTTDKWTVVSSCMSTGRSYAGVTVIDKPL

SEQ ID NO: 750568 - protein, 505 aa, Homo sapiens
MSESRAKRVRIKEVDGWTLRMLIDYVYTAEIQVTEENVQVLLPAAGLLQLQDVKKTCCEFLESQLHPVNCLGIRAFADMHACTDLLNKANTYAEQHFADVVLSEEFLNLGIEQVCSLISSDKLTISSEEKVFEAVIAWVNHDKDVRQEFMARLMEHVRLPLLPREYLVQRVEEEALVKNSSACKDYLIEAMKYHLLPTEQRILMKSVRTRLRTPMNLPKLMVVVGGQAPKAIRSVECYDFKEERWHQVAELPSRRCRAGMVYMAGLVFAVGGFNGSLRVRTVDSYDPVKDQWTSVANMRDRRSTLGAAVLNGLLYAVGGFDGSTGLSSVEAYNIKSNEWFHVAPMNTRRSSVGVGVVGGLLYAVGGYDGASRQYLSTVECYNATTNEWTYIAEMSTRRSGAGVGVLNNLLYAVGGHDGPLVRKSVEVYDPTTNAWRQVADMNMCRRNAGVCAVNGLLYVVGGDDGSCNLASVEYYNPTTDKWTVVSSCMSTGRSYAGVTVIDKPL

SEQ ID NO: 750569 - protein, 332 aa, Homo sapiens
METPPLPPACTKQGHQKPLDSKDDNTEKHCPVTVNPWHMKKAFKVMNELRSQNLLCDVTIVAEDMEISAHRVVLAACSPYFHAMFTGEMSESRAKRVRIKEVDGWTLRMLIDYVYTAEIQVTEENVQVLLPAAGLLQLQDVKKTCCEFLESQLHPVNCLGIRAFADMHACTDLLNKANTYAEQHFADVVLSEEFLNLGIEQVCSLISSDKLTISSEEKVFEAVIAWVNHDKDVRQEFMARLMEHVRLPLLPREYLVQRVEEEALVKNSSACKDYLIEAMKYHLLPTEQRILMKSVRTRLRTPMNLPKLMVVVGGQAPKAIRSVECYDYQTTR

SEQ ID NO: 750570 - protein, 577 aa, Homo sapiens
METPPLPPACTKQGHQKPLDSKDDNTEKHCPVTVNPWHMKKAFKVMNELRSQNLLCDVTIVAEDMEISAHRVVLAACSPYFHAMFTGEMSESRAKRVRIKEVDGWTLRMLIDYVYTAEIQVTEENVQTCCEFLESQLHPVNCLGIRAFADMHACTDLLNKANTYAEQHFADVVLSEEFLNLGIEQVCSLISSDKLTISSEEKVFEAVIAWVNHDKDVRQEFMARLMEHVRLPLLPREYLVQRVEEEALVKNSSACKDYLIEAMKYHLLPTEQRILMKSVRTRLRTPMNLPKLMVVVGGQAPKAIRSVECYDFKEERWHQVAELPSRRCRAGMVYMAGLVFAVGGFNGSLRVRTVDSYDPVKDQWTSVANMRDRRSTLGAAVLNGLLYAVGGFDGSTGLSSVEAYNIKSNEWFHVAPMNTRRSSVGVGVVGGLLYAVGGYDGASRQYLSTVECYNATTNEWTYIAEMSTRRSGAGVGVLNNLLYAVGGHDGPLVRKSVEVYDPTTNAWRQVADMNMCRRNAGVCAVNGLLYVVGGDDGSCNLASVEYYNPTTDKWTVVSSCMSTGRSYAGVTVIDKPL

SEQ ID NO: 750571 - protein, 537 aa, Homo sapiens
METPPLPPACTKQGHQKPLDSKDDNTEKHCPVTVNPWHMKKAFKVMNELRSQNLLCDVTIVAEDMEISAHRVVLAACSPYFHAMFTGEMSESRAKRVRIKEVDGWTLRMLIDYVYTAEIQVTEENVQHFADVVLSEEFLNLGIEQVCSLISSDKLTISSEEKVFEAVIAWVNHDKDVRQEFMARLMEHVRLPLLPREYLVQRVEEEALVKNSSACKDYLIEAMKYHLLPTEQRILMKSVRTRLRTPMNLPKLMVVVGGQAPKAIRSVECYDFKEERWHQVAELPSRRCRAGMVYMAGLVFAVGGFNGSLRVRTVDSYDPVKDQWTSVANMRDRRSTLGAAVLNGLLYAVGGFDGSTGLSSVEAYNIKSNEWFHVAPMNTRRSSVGVGVVGGLLYAVGGYDGASRQYLSTVECYNATTNEWTYIAEMSTRRSGAGVGVLNNLLYAVGGHDGPLVRKSVEVYDPTTNAWRQVADMNMCRRNAGVCAVNGLLYVVGGDDGSCNLASVEYYNPTTDKWTVVSSCMSTGRSYAGVTVIDKPL

SEQ ID NO: 750572 - protein, 146 aa, Homo sapiens
MDLTFPPISSFGGPTMKPLSLLQPYASAYSLSGPIQRWTHRGYRGWPSLLCFTDPTQDHTTSFHCLEMPCLLIPSSADEHLCCFHFLAITKMLLRASMIFAHLKKCFSPLLLWEISPWLCPFFVAQPSPRFWLSLSGSMSAPCLTS

SEQ ID NO: 750573 - protein, 146 aa, Homo sapiens; identical to SEQ ID NO: 750572

SEQ ID NO: 750574 - protein, 116 aa, Homo sapiens
SKSSAIKFEVYPTSLIKNNFEGLVVKLINRWIYDLPKDAFWSYFSQAQELFWESTDCVNNLCKDVVLNKKITTKLQESKFDVVLADALGACGELLAEHVKGMLNTCPLLTVSWLHT

SEQ ID NO: 750575 - protein, 622 aa, Homo sapiens
MSRQTTSVGSSCLDLWREKNDRLVRQAKVAQNSGLTLRRQQLAQDALEGLRGLLHSLQGLPAAVPVLPLELTVTCNFIILRASLAQGFTEDQAQDIQRSLERVLETQEQQGPRLEQGLRELWDSVLRASCLLPELLSALHRLVGLQAALWLSADRLGDLALLLETLNGSQSGASKDLLLLLKTWSPPAEELDAPLTLQDAQGLKDVLLTAFAYRQGLQELITGNPDKALSSLHEAASGLCPRPVLVQVYTALGSCHRKMGNPQRALLYLVAALKEGSAWGPPLLEASRLYQQLGDTTAELESLELLVEALNVPCSSKAPQFLIEVELLLPPPDLASPLHCGTQSQTKHILASRCLQTGRAGDAAEHYLDLLALLLDSSEPRFSPPPSPPGPCMPEVFLEAAVALIQAGRAQDALTLCEELLSRTSSLLPKMSRLWEDARKGTKELPYCPLWVSATHLLQGQAWVQLGAQKVAISEFSRCLELLFRATPEEKEQGAAFNCEQGCKSDAALQQLRAAALISRGLEWVASGQDTKALQDFLLSVQMCPGNRDTYFHLLQTLKRLDRRDEATALWWRLEAQTKGSHEDALWSLPLYLESYLSWIRPSDRDAFLEEFRTSLPKSCDL

SEQ ID NO: 750576 - protein, 221 aa, Homo sapiens
RVAANLTAKVRGWVVCEELLSRTSSLLPKMSRLWEDARKGTKELPYCPLWVSATHLLQGQAWVQLGAQKVAISEFSRCLELLFRATPEEKEQGAAFNCEQGCKSDAALQQLRAAALISRGLEWVASGQDTKALQDFLLSVQMCPGNRDTYFHLLQTLKRLDRRDEATALWWRLEAQTKGSHEDALWSLPLYLESYLSWIRPSDRDAFLEEFRTSLPKSCDL

SEQ ID NO: 750577 - protein, 622 aa, Homo sapiens; identical to SEQ ID NO: 750575

SEQ ID NO: 750578 - protein, 587 aa, Homo sapiens
MSRQTTSVGSSCLDLWREKNDRLVRQAKVAQNSGLTLRRQQLAQDALEGLRGLLHSLQGLPAAVPVLPLELTVTCNFIILRASLAQGFTEDQAQDIQRSLERVLETQEQQGPRLEQGLRELWDSVLRASCLLPELLSALHRLVGLQAALWLSADRLGDLALLLETLNGSQSGASKDLLLLLKTWSPPAEELDAPLTLQDAQGLKDVLLTAFAYRQGLQELITGNPDKALSSLHEAASGLCPRPVLVQVYTALGSCHRKMGNPQRALLYLVAALKEGSAWGPPLLEASRLYQQLGDTTAELESLELLVEALNVPCSSKAPQFLIEVELLLPPPDLASPLHCGTQSQTKHILASRCLQTGRAGDAAEHYLDLLALLLDSSEPRFSPPPSPPGPCMPEVFLEAAVALIQAGRAQDALTLCEELLSRTSSLLPKMSRLWEDARKGTKELPYCPLWVSATHLLQGQAWVQLGAQKVAISEFSRCLELLFRATPEEKEQGAAFNCEQGCKSDAALQQLRAAALISRGLEWVASGQDTKALQDFLLSVQMCPGNRDTYFHLLQTLKRLDRRDEATALWWRLEAQTKGSHEDALW

SEQ ID NO: 750579 - protein, 619 aa, Homo sapiens
MHPLPLLQGEKKGLILSDNPSLMWQVAQNSGLTLRRQQLAQDALEGLRGLLHSLQGLPAAVPVLPLELTVTCNFIILRASLAQGFTEDQAQDIQRSLERVLETQEQQGPRLEQGLRELWDSVLRASCLLPELLSALHRLVGLQAALWLSADRLGDLALLLETLNGSQSGASKDLLLLLKTWSPPAEELDAPLTLQDAQGLKDVLLTAFAYRQGLQELITGNPDKALSSLHEAASGLCPRPVLVQVYTALGSCHRKMGNPQRALLYLVAALKEGSAWGPPLLEASRLYQQLGDTTAELESLELLVEALNVPCSSKAPQFLIEVELLLPPPDLASPLHCGTQSQTKHILASRCLQTGRAGDAAEHYLDLLALLLDSSEPRFSPPPSPPGPCMPEVFLEAAVALIQAGRAQDALTLCEELLSRTSSLLPKMSRLWEDARKGTKELPYCPLWVSATHLLQGQAWVQLGAQKVAISEFSRCLELLFRATPEEKEQGAAFNCEQGCKSDAALQQLRAAALISRGLEWVASGQDTKALQDFLLSVQMCPGNRDTYFHLLQTLKRLDRRDEATALWWRLEAQTKGSHEDALWSLPLYLESYLSWIRPSDRDAFLEEFRTSLPKSCDL

SEQ ID NO: 750580 - protein, 364 aa, Homo sapiens
MGNPQRALLYLVAALKEGSAWGPPLLEASRLYQQLGDTTAELESLELLVEALNVPCSSKAPQFLIEVELLLPPPDLASPLHCGTQSQTKHILASRCLQTGRAGDAAEHYLDLLALLLDSSEPRFSPPPSPPGPCMPEVFLEAAVALIQAGRAQDALTLCEELLSRTSSLLPKMSRLWEDARKGTKELPYCPLWVSATHLLQGQAWVQLGAQKVAISEFSRCLELLFRATPEEKEQGAAFNCEQGCKSDAALQQLRAAALISRGLEWVASGQDTKALQDFLLSVQMCPGNRDTYFHLLQTLKRLDRRDEATALWWRLEAQTKGSHEDALWSLPLYLESYLSWIRPSDRDAFLEEFRTSLPKSCDL

SEQ ID NO: 750581 - protein, 298 aa, Homo sapiens
APGCRIGRGTLRRQQLAQDALEGLRGLLHSLQGLPAAVPVLPLELTVTASRCLQTGRAGDAAEHYLDLLALLLDSSEPRFSPPPSPPGPCMPEVFLEAAVALIQAGRAQDALTLCEELLSRTSSLLPKMSRLWEDARKGTKELPYCPLWVSATHLLQGQAWVQLGAQKVAISEFSRCLELLFRATPEEKEQGAAFNCEQGCKSDAALQQLRAAALISRGLEWVASGQDTKALQDFLLSVQMCPGNRDTYFHLLQTLKRLDRRDEATALWWRLEAQTKGSHEDALWHHPSFSPGLSPCT

SEQ ID NO: 750582 - protein, 119 aa, Homo sapiens [sequence omitted]

SEQ ID NO: 750583 - protein, 613 aa, Homo sapiens
MSRQTTSVGSSCLDLWREKNDRLVRQAKVAQNSGLTLRRQQLAQDALEGLRGLLHSLQGLPAAVPVLPLELTVTCNFIILRASLAQGFTEDQAQDIQRSLERVLETQEQQGPRLEQGLRELWDSVLRASCLLPELLSALHRLVGLQAALWLSADRLGDLALLLETLNGSQSGASKDLLLLLKTWSPPAEELDAPLTLQDAQGLKDVLLTAFAYRQGLQELITGNPDKALSSLHEAASGLCPRPVLVQVYTALGSCHRKMGNPQRALLYLVAALKEGSAWGPPLLEASRLYQQLGDTTAELESLELLVEALNVPCSSKAPQFLIEVELLLPPPDLASPLHCGTQSQTKHILAGDAAEHYLDLLALLLDSSEPRFSPPPSPPGPCMPEVFLEAAVALIQAGRAQDALTLCEELLSRTSSLLPKMSRLWEDARKGTKELPYCPLWVSATHLLQGQAWVQLGAQKVAISEFSRCLELLFRATPEEKEQGAAFNCEQGCKSDAALQQLRAAALISRGLEWVASGQDTKALQDFLLSVQMCPGNRDTYFHLLQTLKRLDRRDEATALWWRLEAQTKGSHEDALWSLPLYLESYLSWIRPSDRDAFLEEFRTSLPKSCDL

SEQ ID NO: 750584 - protein, 622 aa, Homo sapiens; identical to SEQ ID NO: 750575

SEQ ID NO: 750585 - protein, 600 aa, Homo sapiens
MSRQTTSVGSSCLDLWREKNDRLVRQAKVAQNSGLTLRRQQLAQDALEGLRGLLHSLQGLPAAVPVLPLELTVTCNFIILRASLAQGFTEDQAQDIQRSLERVLETQEQQGPRLEQGLRELWDSVLRASCLLPELLSALHRLVGLQAALWLSADRLGDLALLLETLNGSQSGASKDLLLLLKTWSPPAEELDAPLTLQDAQGLKDVLLTAFAYRQGLQELITGNPDKALSSLHEAASGLCPRPVLVQVYTALGSCHRKMGNPQRALLYLVAALKEGSAWGPPLLEASRLYQQLGDTTAELESLELLVEALNVPCSSKAPQFLIEVELLLPPPDLASPLHCGTQSQTKHILASRCLQTGRAGDAAEHYLDLLALLLDSSEPRFSPPPSPPGPCMPEVFLEAAVALIQAGRAQDALTLCEELLSRTSSLLPKMSRLWEDARKGTKELPYCPLWVSATHLLQGQAWVQLGAQKVAISEFSRCLELLFRATPEEKEQGAAFNCEQGCKSDAALQQLRAAALISRGLEWVASGQDTKALQDFLLSVQMCPGNRDTYFHLLQTLKRLDRRDEATALWWRLEAQTKGSHEDALWHHPSFSPGLSPCT

SEQ ID NO: 750586 - protein, 604 aa, Homo sapiens
MSRQTTSVGSSCLDLWREKNDRLVRQAKVAQNSGLTLRRQQLAQDALEGLRGLLHSLQGLPAAVPVLPLELTVTCNFIILRASLAQGFTEDQAQDIQRSLERVLETQEQQGPRLEQGLRELWDSVLRASCLLPELLSALHRLVGLQAALWLSADRLGDLALLLETLNGSQSGASKDLLLLLKTWSPPAEELDAPLTLQDAQGLKDVLLTAFAYRQGLQELITGNPDKALSSLHEAASGLCPRPVLVQVYTALGSCHRKMGNPQRALLYLVAALKEGSAWGPPLLEASRLYQQLGDTTAELESLELLVEALNVPCSSKAPQFLIEVELLLPPPDLASPLHCGTQSQTKHILASRCLQTGRAGDAAEHYLDLLALLLDSSEPRFSPPPSPPGPCMPEVFLEAAVALIQAGRAQDALTLCEELLSRTSSLLPKMSRLWEDARKGTKELPYCPLWVSATHLLQGQAWVQLGAQKVAISEFSRCLELLFRATPEEKEQGAAFNCEQGCKSDAALQQLRAAALISRGLEWVASGQDTKALQDFLLSVQMCPGNRDTYFHLLQTLIVTPSLKNFGHLCQSLVTCSCHVLKSLSWVPSGLSLCGEGFLLHHH

SEQ ID NO: 750587 - protein, 228 aa, Homo sapiens
QPLHPSDPTEKQQPKRLHVSNIPFRFRDPDLRQMFGQFGKILDVEIIFNERGSKGFGFVTFETSSDADRAREKLNGTIVEGRKIEVNNATARVMTNKKTGNPYTNGWKLNPVVGAVYGPEFYAVTGFPYPTTGTAVAYRGAHLRGRGRAVYNTFRAAPPPPPIPTYGAVVYQDGFYGAEIYGGYAAYRYAQPAAAAAAYSDSYGRVYAAADPYHHTIGPAATYSIGTM

SEQ ID NO: 750588 - protein, 457 aa, Homo sapiens
QPLHPSDPTEKQQPKRLHVSNIPFRFRDPDLRQMFGQFGKILDVEIIFNERGSKGFGFVTFETSSDADRAREKLNGTIVEGRKIEVNNATARVMTNKKTGNPYTNGWKLNPVVGAVYGPEFYAVTGFPYPTTGTAVAYRGAHLRGRGRAVYNTFRAAPPPPPIPTYGAVVYQDGFYGAEIYGGYAAYRYAQPAAAAAAYSDSYGRVYAAADPYHHTIGPAATYSIGTMASLCRGGYSRFTPYQQETQPLTAFTLTAYYTPNPTAQNQAQPPEDSAPLPVSDTHGWPPATLKSIDYFSPASWSPHPTCAGVCVFDPGFSCMSATVISYFDFVDVVLPKPLQVRCAHRGVQAGPGDQAAPNLGVAVAPYEGKSHISWPPRLHRTTETPGRASPKATRPAPCHGPSVQHPDAGREGLQAPSVGLPGLRVLPQAFTQPTTGVATAPPRPIQLKLIFFIKFY

SEQ ID NO: 750589 - protein, 228 aa, Homo sapiens; identical to SEQ ID NO: 750587

SEQ ID NO: 750590 - protein, 153 aa, Homo sapiens
TRIFNERGSKVNNATARVMTNKKTGNPYTNGWKLNPVVGAVYGPEFYAVTGFPYPTTGTAVAYRGAHLRGRGRAVYNTFRAAPPPPPIPTYGAVVYQDGFYGAEIYGGYAAYRYAQPAAAAAAYSDSYGRVYAAADPYHHTIGPAATYSIGTM

SEQ ID NO: 750591 - protein, 244 aa, Homo sapiens
RLTAAAPTMAETKLQLFVKASEDGESVGHCPSCQRLFMVLLLKGVPFTLTTVDTRRSPDVLKDFAPGSQLPILLYDSDAKTDTLQIEDFLEETLGPPDFPSLAPRYRESNTAGNDVFHKFSAFIKNPVPAQDEALYQQLLRALARLDSYLRAPLEHELAGEPQLRESRRRFLDGDRLTLADCSLLPKLHIVDTVCAHFRQAPIPAELRGVRRYLDSAMQEKEFKYTCPHSAEILAAYRPAVHPR

SEQ ID NO: 750592 - protein, 244 aa, Homo sapiens; identical to SEQ ID NO: 750591

SEQ ID NO: 750593 - protein, 244 aa, Homo sapiens; identical to SEQ ID NO: 750591

SEQ ID NO: 750594 - protein, 258 aa, Homo sapiens
LQLFVKASEDGESVGHCPSCQRLFMVLLLKGVPFTLTTVDTRRLRPHPVDPRLASHTGGPASSHPAAARRSPDVLKDFAPGSQLPILLYDSDAKTDTLQIEDFLEETLGPPDFPSLAPRYRESNTAGNDVFHKFSAFIKNPVPAQDEALYQQLLRALARLDSYLRAPLEHELAGEPQLRESRRRFLDGDRLTLADCSLLPKLHIVDTVCAHFRQAPIPAELRGVRRYLDSAMQEKEFKYTCPHSAEILAAYRPAVHPR

SEQ ID NO: 750595 - protein, 207 aa, Homo sapiens
MVLLLKGVPFTLTTVDTRRSPDVLKDFAPGSQLPILLYDSDAKTDTLQIEDFLEETLGPPDFPSLAPRYRESNTAGNDVFHKFSAFIKNPVPAQDEALYQQLLRALARLDSYLRAPLEHELAGEPQLRESRRRFLDGDRLTLADCSLLPKLHIVDTVCAHFRQAPIPAELRGVRRYLDSAMQEKEFKYTCPHSAEILAAYRPAVHPR

SEQ ID NO: 750596 - protein, 271 aa, Homo sapiens
RLTAAAPTMAETKLQLFVKASEDGESVGHCPSCQRLFMVLLLKGVPFTLTTVDTRRSPDVLKDFAPGSQLPILLYDSDAKTDTLQIEDFLEETLGPPDFPSLAPRYRESNTAGNDVFHKFSAFIKNPVPAQDEGEAGSGGRVPRREGALGLVLTAAACPLALYQQLLRALARLDSYLRAPLEHELAGEPQLRESRRRFLDGDRLTLADCSLLPKLHIVDTVCAHFRQAPIPAELRGVRRYLDSAMQEKEFKYTCPHSAEILAAYRPAVHPR

SEQ ID NO: 750597 - protein, 233 aa, Homo sapiens
AGTAHLSSRDMTGTPGAVATRDGEAPERSPPCSPSYDLTGKVMLLGDTGVGKTCFLIQFKDGAFLSGTFIATVGIDFRNKVVTVDGVRVKLQIWDTAGQERFRSVTHAYYRDAQALLLLYDITNKSSFDNIRAWLTEIHEYAQRDVVIMLLGNKADMSSERVIRSEDGETLAREYGVPFLETSAKTGMNVELAFLAIAKELKYRAGHQADEPSFQIRDYVESQKKRSSCCSFM

SEQ ID NO: 750598 - protein, 199 aa, Homo sapiens
AGTAHLSSRDMTGTPGAVATRDGEAPERSPPCSPSYDLTGKVMLLGDTGVGKTCFLIQFKDGAFLSGTFIATVGIDFRNKVVTVDGVRVKLQIWDTAGQERFRSVTHAYYRDAQALLLLYDITNKSSFDNIRAWLTEIHEYAQRDVVIMLLGNKADMSSERVIRSEDGETLAREYGVPFLETSAKTGMNVELAFLAIAK

SEQ ID NO: 750599 - protein, 233 aa, Homo sapiens; identical to SEQ ID NO: 750597

SEQ ID NO: 750600 - protein, 233 aa, Homo sapiens; identical to SEQ ID NO: 750597

SEQ ID NO: 750601 - protein, 233 aa, Homo sapiens; identical to SEQ ID NO: 750597

SEQ ID NO: 750602 - protein, 233 aa, Homo sapiens; identical to SEQ ID NO: 750597

SEQ ID NO: 750603 - protein, 152 aa, Homo sapiens
IPGFPALVYGKSPLTAWAWRMSARFISRSSSQQMGEPEGRWFSPGVGPLGGQALLRLPQPNSASLSFCRRPAGVRVPIVVLFCWRAPLDDQPLSSADVLLFTSGRLCVCLLGSRVFIGPGWGHGGSGWSWKCNIWTGKQECLSSPRSVGVEP

SEQ ID NO: 750604 - protein, 261 aa, Homo sapiens
LAAMRLSSSPPRGPQQLSSFGSVDWLSQSSCSGPTHTPRPADFSLGSLPGPGQTSGAREPPQAVSIKEAAGSSNLPAPERTMAGLSKEPNTLRAPRVRTAFTMEQVRTLEGVFQHHQYLSPLERKRLAREMQLSEVQIKTWFQNRRMKHKRQMQDPQLHSPFSGSLHAPPAFYSTSSGLANGLQLLCPWAPLSGPQALMLPPGSFWGLCQVAQEALASAGASCCGQPLASHPPTPGRPSLGPALSTGPRGLCAMPQTGDAF

SEQ ID NO: 750605 - protein, 101 aa, Homo sapiens
ETGEFTQLKELNIQGNCLTLLLPELGNLYLTGQKKVCKVENSPWVTPIAGQFQLDVSCVSECVCSETYEYLYGSTCRQIQNHQNIIITNQEKMSWETPDRQ

SEQ ID NO: 750606 - protein, 103 aa, Homo sapiens
RAWPPGDSGLALVNQLTAAADLGFRDTKRKTEGRRDEASGTSSGKRGPGTRGTVPCSLPLALSLTWHAECWAQRPQWHSGERVRRHNSVPPALAPHVHLRCTP

SEQ ID NO: 750607 - protein, 106 aa, Homo sapiens [sequence omitted]

SEQ ID NO: 750608 - protein, 395 aa, Homo sapiens
MWLPRVSSTAVTALLLAQTFLLLFLVSRPGPSSPAGGEARVHVLVLSSWRSGSSFVGQLFNQHPDVFYLMEPAWHVWTTLSQGSAATLHMAVRDLVRSVFLCDMDVFDAYLPWRRNLSDLFQWAVSRALCSPPACSAFPRGAISSEAVCKPLCARQSFTLAREACRSYSHVVLKEVRFFNLQVLYPLLSDPALNLRIVHLVRDPRAVLRSREQTAKALARDNGIVLGTNGTWVEADPGLRVVREVCRSHVRIAEAATLKPPPFLRGRYRLVRFEDLAREPLAEIRALYAFTGLSLTPQLEAWIHNITHGSGPGARREAFKTSSRNALNVSQAWRHALPFAKIRRVQELCAGALQLLGYRPVYSEDEQRNLALDLVLPRGLNGFTWASSTASHPRN

SEQ ID NO: 750609 - protein, 395 aa, Homo sapiens; identical to SEQ ID NO: 750608

SEQ ID NO: 750610 - protein, 395 aa, Homo sapiens; identical to SEQ ID NO: 750608

SEQ ID NO: 750611 - protein, 395 aa, Homo sapiens; identical to SEQ ID NO: 750608

SEQ ID NO: 750612 - protein, 114 aa, Homo sapiens [sequence omitted]

SEQ ID NO: 750613 - protein, 105 aa, Homo sapiens
GFPFPSDNQSSGEVRLLACPYPQMALKAPLQTPGTPRNPAAQPLLRTTWSLYSKGKKGPPGQVPRGCSNEVTDKAALQAAGGMRVQKHAADVSMGAFSHLPCSLY

SEQ ID NO: 750614 - protein, 108 aa, Homo sapiens
MGPQQRRWFWLIHLLSSSCSFSGRAFLEGHFCIIQEAVLKVNLKTTLLALLTIFKYQIAFIKSLPFKNMKRFAYPMWRPDEENLPGSYQVNTTCLIRKTQTRSEGAHV

SEQ ID NO: 750615 - protein, 74 aa, Homo sapiens
GTRLTDFKNEAVDSSRNSRSPWESHVLAKPSPGSRHCRSSTSPSLHSEALGTRERTPVLTSHIDPLYVLQLPPT

SEQ ID NO: 750616 - protein, 251 aa, Homo sapiens
RPQSSAPSARWALRRRSCWRLPTSRLASTGSSGGRTPRGPPTSTTPSVGASAAERRLRHLGGGDWEGNVGGVHLIEHLFCPKLSAIYRLSLITIGTVGMIVPFVGWLPEGVARILTHEAGITDIVVLQAALLHDTVEDTDTTLDEVELHFGAQVRRLVEEVTDDKTLPKLERKRLQVEQAPHSSPGAKLVKLADKLYNLRDLNRCTPEGWSEHRVQEYFEWAAQVVKGLQGTNRQLEEALKHLFKQRGLTI

SEQ ID NO: 750617 - protein, 152 aa, Homo sapiens
AAVVGPIRAMGSEAAQLLEAADFAARKHRQQRRKDPEGTPYINHPIGVARILTHEAGITDIVVLQAALLHDTVEDTDTTLDEVELHFGAQVRRLVEEVTDDKTLPKLERKRLQVEQAPHSSPGAKLVKLADKLYNLRDLNRCTPEGTLSYGL

SEQ ID NO: 750618 - protein, 152 aa, Homo sapiens; identical to SEQ ID NO: 750617

SEQ ID NO: 750619 - protein, 182 aa, Homo sapiens
AAVVGPIRAMGSEAAQLLEAADFAARKHRQQRRKDPEGTPYINHPIGVARILTHEAGITDIVVLQAALLHDTVEDTDTTLDEVELHFGAQVRRLVEEVTDDKTLPKLERKRLQVEQAPHSSPGAKLVKLADKLYNLRDLNRCTPEDGQNIESRNNSSGIDKHHRCHEEKRESGGTNIHSKSV

SEQ ID NO: 750620 - protein, 188 aa, Homo sapiens
AAVVGPIRAMGSEAAQLLEAADFAARKHRQQRRKDPEGTPYINHPIGVARILTHEAGITDIVVLQAALLHDTVEDTDTTLDEVELHFGAQVRRLVEEVTDDKTLPKLERKRLQVEQAPHSSPGAKLVKLADKLYNLRDLNRCTPEGWSEHRVQEYFEWAAQVVKGLQGTNRQLEEALKHLFKQRGLTI

SEQ ID NO: 750621 - protein, 188 aa, Homo sapiens; identical to SEQ ID NO: 750620

SEQ ID NO: 750622 - protein, 149 aa, Homo sapiens
AAVVGPIRAMGSEAAQLLEAADFAARKHRQQRRKDPEGTPYINHPIGVARILTHEAGITDIVVLQAALLHDTVEDTDTTLDEVELHFGAQVRRLVEEVTDDKTLPKLERKRLQVEQAPHSSPGAKLVKLADKLYNLRDLNRCTPEVKIQ

SEQ ID NO: 750623 - protein, 158 aa, Homo sapiens
RPQSSAPSARWALRRRSCWRLPTSRLASTGSSGGRTPRGPPTSTTPSVGASAAERRLRHLGGGDWEGNVGGVHLIEHLFCPKLSAIYRLSLITIGTVGMIVPFVGWLPEGKVLDQGHPASQSPQGATSGSPKPTTHRLGTTSDLTSCFAPPRQVWHGS

SEQ ID NO: 750624 - protein, 107 aa, Homo sapiens
LARLRIVPPSGSADIVSCVSAVAVEELKLGKMVCIPCIVIPVLLWIYKKFLEPYIYPLVSPFVSRIWPKKAIQESNDTNKGKVNFKGADMNGLPTKGPTEICDKKKD

SEQ ID NO: 750625 - protein, 107 aa, Homo sapiens; identical to SEQ ID NO: 750624

SEQ ID NO: 750626 - protein, 191 aa, Homo sapiens
LDPRSLRTRRTPRQSCKSRGSNLRVHFKNTRETAQAIKGMHIRKATKYLKDVTLQKQCVPFRRYNGGVGRCAQAKQWGWTQGRWPKKSAEFLLHMLKNAESNAELKGLDVDSLVIEHIQVNKAPKMRRRTYRAHGRINPYMSSPCHIEMILTEKEQIVPKPEEEVAQKNKDIPEETEETKTYGTGVNSALK

SEQ ID NO: 750627 - protein, 183 aa, Homo sapiens
MVRYSLDPENPTKSCKSRGSNLRVHFKNTRETAQAIKGMHIRKATKYLKDVTLQKQCVPFRRYNGGVGRCAQAKQWGWTQGRWPKKSAEFLLHMLKNAESNAELKGLDVDSLVIEHIQVNKAPKMRRRTYRAHGRINPYMSSPCHIEMILTEKEQIVPKPEEEVAQKNKDIQEELKNKNFGRE

SEQ ID NO: 750628 - protein, 78 aa, Homo sapiens
WLVEPVVESAEGSLSVSPALLRGPNPPAIAAILASGAPASRPPGGELLGLLNPRWRRWLLMREDVAEGLTLGAGSVGL

SEQ ID NO: 750629 - protein, 190 aa, Homo sapiens
MVRYSLDPENPTKSCKSRGSNLRVHFKNTRETAQAIKGMHIRKATKYLKDVTLQKQCVPFRRYNGGVGRCAQAKQWGWTQGRWPKKSAEFLLHMLKNAESNAELKGLDVDSLVIEHIQVNKAPKMRRRTYRAHGRINPYMSSPCHIEMILTEKEQIVPKPEEEVAQKNKDIPEETEETKTYGTGVNSALK

SEQ ID NO: 750630 - protein, 178 aa, Homo sapiens
MVRYSLDPENPTKSCKSRGSNLRVHFKNTRETAQAIKGMHIRKATKYLKDVTLQKQCVPFRRYNGGVGRCAQAKQWGWTQGRWPKKSAEFLLHMLKNAESNAELKGLDVDSLVIEHIQVNKAPKMRRRTYRAHGRINPYMSSPCHIEMILTEKEQIVPKPEEEVAQKNKDINAEGEET

SEQ ID NO: 750631 - protein, 190 aa, Homo sapiens; identical to SEQ ID NO: 750629

SEQ ID NO: 750632 - protein, 253 aa, Homo sapiens
MVRYSLDPENPTKSCKSRGSNLRVHFKNTRETAQAIKGMHIRKATKYLKDVTLQKQCVPFRRYNGGVGRCAQAKQWGWTQGRWPKKSAEFLLHMLKNAESNAELKGLDVDSLVIEHIQVNKAPKMRRRTYRAHGRINPYMSSPCHIEMILTEKEQIVPKPEEEVAQKNKVEELKLGKMVCIPCIVIPVLLWIYKKFLEPYIYPLVSPFVSRIWPKKAIQESNDTNKGKVNFKGADMNGLPTKGPTEICDKKKD

SEQ ID NO: 750633 - protein, 253 aa, Homo sapiens; identical to SEQ ID NO: 750632

SEQ ID NO: 750634 - protein, 253 aa, Homo sapiens; identical to SEQ ID NO: 750632

SEQ ID NO: 750635 - protein, 253 aa, Homo sapiens; identical to SEQ ID NO: 750632

SEQ ID NO: 750636 - protein, 190 aa, Homo sapiens; identical to SEQ ID NO: 750629

SEQ ID NO: 750637 - protein, 190 aa, Homo sapiens; identical to SEQ ID NO: 750629

SEQ ID NO: 750638 - protein, 190 aa, Homo sapiens; identical to SEQ ID NO: 750629

SEQ ID NO: 750639 - protein, 170 aa, Homo sapiens
MVRYSLDPENPTKSCKSRGSNLRVHFKNTRETAQAIKGMHIRKATKYLKDVTLQKQCVPFRRYNGGVGRCAQAKQWGWTQGRWPKKSAEFLLHMLKNAESNAELKGLDVDSLVIEHIQVNKAPKMRRRTYRAHGRINPYMSSPCHIEMILTEKEQIVPKPEEEVAQKNKG

SEQ ID NO: 750640 - protein, 170 aa, Homo sapiens; identical to SEQ ID NO: 750639

SEQ ID NO: 750641 - protein, 253 aa, Homo sapiens; identical to SEQ ID NO: 750632

SEQ ID NO: 750642 - protein, 180 aa, Homo sapiens
MVRYSLDPENPTKSCKSRGSNLRVHFKNTRETAQAIKGMHIRKATKYLKDVTLQKQCVPFRRYNGGVGRCAQAKQWGWTQGRWPKKSAEFLLHMLKNAESNAELKGLDVDSLVIEHIQVNKAPKMRRRTYRAHGRINPYMSSPCHIEMILTEKEQIVPKPEEEVAQKNKDIPDTTGKQTL

SEQ ID NO: 750643 - protein, 253 aa, Homo sapiens; identical to SEQ ID NO: 750632

SEQ ID NO: 750644 - protein, 160 aa, Homo sapiens
MLKNAESNAELKGLDVDSLVIEHIQVNKAPKMRRRTYRAHGRINPYMSSPCHIEMILTEKEQIVPKPEEEVAQKNKVEELKLGKMVCIPCIVIPVLLWIYKKFLEPYIYPLVSPFVSRIWPKKAIQESNDTNKGKVNFKGADMNGLPTKGPTEICDKKKD

SEQ ID NO: 750645 - protein, 243 aa, Homo sapiens
MRFIVVIQQFLMFHSKKNTRETAQAIKGMHIRKATKYLKDVTLQKQCVPFRRYNGGVGRCAQAKQWGWTQGRWPKKSAEFLLHMLKNAESNAELKGLDVDSLVIEHIQVNKAPKMRRRTYRAHGRINPYMSSPCHIEMILTEKEQIVPKPEEEVAQKNKVEELKLGKMVCIPCIVIPVLLWIYKKFLEPYIYPLVSPFVSRIWPKKAIQESNDTNKGKVNFKGADMNGLPTKGPTEICDKKKD

SEQ ID NO: 750646 - protein, 170 aa, Homo sapiens; identical to SEQ ID NO: 750639

SEQ ID NO: 750647 - protein, 105 aa, Homo sapiens
MVRYSLDPENPTKSCKSRGSNLRVHFKNTRETAQAIKGMHIRKATKYLKDVTLQKQCVPFRRYNGGVGRCAQAKQWGWTQGRWPKKSAEFLLHMLKPRGILTQVE

SEQ ID NO: 750648 - protein, 190 aa, Homo sapiens; identical to SEQ ID NO: 750629

SEQ ID NO: 750649 - protein, 105 aa, Homo sapiens; identical to SEQ ID NO: 750647

SEQ ID NO: 750650 - protein, 195 aa, Homo sapiens
MVRYSLDPENPTKSCKSRGSNLRVHFKNTRETAQAIKGMHIRKATKYLKDVTLQKQCVPFRRYNGGVGRCAQAKQWGWTQGRWPKKSAEFLLHMLKNAESNAELKGLDVDSLVIEHIQVNKAPKMRRRTYRAHGRINPYMSSPCHIEMILTEKEQIVPKPEEEVAQKNKDIPEETGETHHLSMIICLPCWPPCPN

SEQ ID NO: 750651 - protein, 144 aa, Homo sapiens
RSNIRMVTKQCVPFRRYNGGVGRCAQAKQWGWTQGRWPKKSAEFLLHMLKNAESNAELKGLDVDSLVIEHIQVNKAPKMRRRTYRAHGRINPYMSSPCHIEMILTEKEQIVPKPEEEVAQKNKDIPEETEETKTYGTGVNSALK

SEQ ID NO: 750652 - protein, 190 aa, Homo sapiens; identical to SEQ ID NO: 750629

SEQ ID NO: 750653 - protein, 190 aa, Homo sapiens; identical to SEQ ID NO: 750629

SEQ ID NO: 750654 - protein, 190 aa, Homo sapiens; identical to SEQ ID NO: 750629

SEQ ID NO: 750655 - protein, 190 aa, Homo sapiens; identical to SEQ ID NO: 750629

SEQ ID NO: 750656 - protein, 253 aa, Homo sapiens; identical to SEQ ID NO: 750632

SEQ ID NO: 750657 - protein, 253 aa, Homo sapiens; identical to SEQ ID NO: 750632

SEQ ID NO: 750658 - protein, 190 aa, Homo sapiens; identical to SEQ ID NO: 750629

SEQ ID NO: 750659 - protein, 190 aa, Homo sapiens; identical to SEQ ID NO: 750629

SEQ ID NO: 750660 - protein, 253 aa, Homo sapiens; identical to SEQ ID NO: 750632

SEQ ID NO: 750661 - protein, 186 aa, Homo sapiens
MVRYSLDPENPTKSCKSRGSNLRVHFKNTRETAQAIKGMHIRKATKYLKDVTLQKQCVPFRRYNGGVGRCAQAKQWGWTQGRWPKKSAEFLLHMLKNAESNAELKGLDVDSLVIEHIQVNKAPKMRRRTYRAHGRINPYMSSPCHIEMILTEKEQIVPKPEEEVAQKNKDIQKKWRTKLMAGSKSA

SEQ ID NO: 750662 - protein, 170 aa, Homo sapiens; identical to SEQ ID NO: 750639

SEQ ID NO: 750663 - protein, 183 aa, Homo sapiens; identical to SEQ ID NO: 750627

SEQ ID NO: 750664 - protein, 253 aa, Homo sapiens; identical to SEQ ID NO: 750632

SEQ ID NO: 750665 - protein, 243 aa, Homo sapiens
MSYSCKSRGSNLRVHFKNTRETAQAIKGMHIRKATKYLKDVTLQKQCVPFRRYNGGVGRCAQAKQWGWTQGRWPKKSAEFLLHMLKNAESNAELKGLDVDSLVIEHIQVNKAPKMRRRTYRAHGRINPYMSSPCHIEMILTEKEQIVPKPEEEVAQKNKVEELKLGKMVCIPCIVIPVLLWIYKKFLEPYIYPLVSPFVSRIWPKKAIQESNDTNKGKVNFKGADMNGLPTKGPTEICDKKKD

SEQ ID NO: 750666 - protein, 215 aa, Homo sapiens
MHIRKATKYLKDVTLQKQCVPFRRYNGGVGRCAQAKQWGWTQGRWPKKSAEFLLHMLKNAESNAELKGLDVDSLVIEHIQVNKAPKMRRRTYRAHGRINPYMSSPCHIEMILTEKEQIVPKPEEEVAQKNKVEELKLGKMVCIPCIVIPVLLWIYKKFLEPYIYPLVSPFVSRIWPKKAIQESNDTNKGKVNFKGADMNGLPTKGPTEICDKKKD

SEQ ID NO: 750667 - protein, 130 aa, Homo sapiens
MVRYSLDPENPTKSCKSRGSNLRVHFKNTRETAQAIKGMHIRKATKYLKDVTLQKQCVPFRRYNGGVGRCAQAKQWGWTQGRWPKKSAEFLLHMLKNAESNAELKVTQTTNILCNLGGCLINVGCSDLCP

SEQ ID NO: 750668 - protein, 180 aa, Homo sapiens
MSYSCKSRGSNLRVHFKNTRETAQAIKGMHIRKATKYLKDVTLQKQCVPFRRYNGGVGRCAQAKQWGWTQGRWPKKSAEFLLHMLKNAESNAELKGLDVDSLVIEHIQVNKAPKMRRRTYRAHGRINPYMSSPCHIEMILTEKEQIVPKPEEEVAQKNKDIPEETEETKTYGTGVNSALK

SEQ ID NO: 750669 - protein, 134 aa, Homo sapiens
RERQKGHREAERTVYIHIHSGLQEEEMYCLTVLSLTHSLRHPGIHTAASCHCKRLPELFLFIQEERKSRQRLREINKCISKEPERRCFHLAVLPSIQAQREMHSRTLTASTNSIPSHGAGRAHDTKCPTRRPSC

SEQ ID NO: 750670 - protein, 288 aa, Homo sapiens
SVGDGRDLLEEQRALVLARAAGGDVIDARHHVVLGREGHDGHARGRGHHGEVGQQLADEHELAAEVDFAHAGRIIHQEDKLQALAELPQQPHASPERLAQPLHSAPRRFVARSGRRGDTPGGPGRGLGEEAEAEIARRGHLLKGRPARNERQTPATKGQARPHRAGDRAAAPERRRRLGREEALGGRTRRGACAELGAGQRPRASAPFHLTLGTDTIQTPQQLGNSGGNGARSLPLSLSSFFLPSLLLLSLPEAYKMFEGKGAVKKNLPLPSFSPSLPLPAPVYFLYL

SEQ ID NO: 750671 - protein, 110 aa, Homo sapiens
FFEMESHSVTQAGVQSHDLSSLQPPPPGFKQSSLFGLPSSWDYRCVPPCPANFFVFLVETGFRHVGQAGLELLTSNDLPVSACQSAGITGVSHRSQRKSMILYEVTICYP

SEQ ID NO: 750672 - protein, 87 aa, Homo sapiens
RTVVHCFRCPRLSNWPRRSTSAKLPGSSSLATPAARSPAEAGKQRACAVGTGAGGEKRGAEGGRWSRVAYRAACDAGTPRAPNVAPV

SEQ ID NO: 750673 - protein, 87 aa, Homo sapiens; identical to SEQ ID NO: 750672

SEQ ID NO: 750674 - protein, 1327 aa, Homo sapiens
MRSFLQQDVNKTKSRLNVLNGLANNMDDLKINTDITGAKEELLDDNNFISDKESGVHKPKDCQTSFQKNNTLTLPEELSKDKSENALSGGQSSLFIHAGAPTVSSENFILPKGAAVNGPVSHSSLTKTSNMNKGSVSLTTGQPVDQPTTESCSTLKVAADLQLSTPQKASQHQVLFLLSDVAHAKNPTHSNKKLPTSASVGCDIQNSVGSNIKSDGTLINQVEVGEDGEDLLVKDDCVNTVTGISSGTDGFRSENDTNWDPQKEFIQFLMTNEETVDKAPPHSKIGLEKKKKAKMDVSKITRYTEDCFSDSNCVPNKSKMQEVDFLEQNEELQAVDSQKYALSKVKPESTDEDLESVDAFQHLIYNPDKCGEESSPVHTSTFLSNTLKKKCEESDSESPATFSTEEPSFYPCTKCNVNFREKKHLHRHMMYHLDGNSHFRHLNVPRPYACRECGRTFRDRNSLLKHMIIHQERRQKLMEEIRELKELQDEGRSARLQCPQCVFGTNCPKTFVQHAKTHEKDKRYYCCEECNFMAVTENELECHRGIAHGAVVKCPMVTSDIAQRKTQKKTFMKDSVVGSSKKSATYICKMCPFTTSAKSVLKKHTEYLHSSSCVDSFGSPLGLDKRKNDILEEPVDSDSTKTLTKQQSTTFPKNSALKQDVKRTFGSTSQSSSFSKIHKRPHRIQKARKSIAQSGVNMCNQNSSPHKNVTIKSSVDQKPKYFHQAAKEKSNAKANSHYLYRHKYENYRMIKKSGESYPVHFKKEEASSLNSLHLFSSSSNSHNNFISDPHKPDAKRPESFKDHRRVAVKRVIKESKKESSVGGEDLDSYPDFLHKMTVVVLQKLNSAEKKDSYETEDESSWDNVELGDYTTQAIEDETYSDINQEHVNLFPLFKSKVEGQEPGENATLSYDQNDGFYFEYYEDTGSNNFLHEIHDPQHLETADASLSKHSSVFHWTDLSLEKKSCPYCPATFETGVGLSNHVRGHLHRAGLSYEARHVVSPEQIATSDKMQHFKRTGTGTPVKRVRKAIEKSETTSEHTCQLCGGWFDTKIGLSNHVRGHLKRLGKTKWDAHKSPICVLNEMMQNEEKYEKILKALNSRRIIPRPFVAQKLASSDDFISQNVIPLEAYRNGLKTEALSVSASEEEGLNFLNEYDETKPELPSGKKNQSLTLIELLKNKRMGEERNSAISPQKIHNQTARKRFVQKCVLPLNEDSPLMYQPQKMDLTMHSALDCKQKKSRSRSGSKKKMLTLPHGADEVYILRCRFCGLVFRGPLSVQEDWIKHLQRHIVNANLPRTGAGMVEVTSLLKKPASITETSFSLLMAEAAS

SEQ ID NO: 750675 - protein, 1327 aa, Homo sapiens
MRSFLQQDVNKTKSRLNVLNGLANNMDDLKINTDITGAKEELLDDNNFISDKESGVHKPKDCQTSFQKNNTLTLPEELSKDKSENALSGGQSSLFIHAGAPTVSSENFILPKGAAVNGPVSHSSLTKTSNMNKGSVSLTTGQPVDQPTTESCSTLKVAADLQLSTPQKASQHQVLFLLSDVAHAKNPTHSNKKLPTSASVGCDIQNSVGSNIKSDGTLINQVEVGEDGEDLLVKDDCVNTVTGISSGTDGFRSENDTNWDPQKEFIQFLMTNEETVDKAPPHSKIGLEKKRKRKMDVSKITRYTEDCFSDSNCVPNKSKMQEVDFLEQNEELQAVDSQKYALSKVKPESTDEDLESVDAFQHLIYNPDKCGEESSPVHTSTFLSNTLKKKCEESDSESPATFSTEEPSFYPCTKCNVNFREKKHLHRHMMYHLDGNSHFRHLNVPRPYACRECGRTFRDRNSLLKHMIIHQERRQKLMEEIRELKELQDEGRSARLQCPQCVFGTNCPKTFVQHAKTHEKDKRYYCCEECNFMAVTENELECHRGIAHGAVVKCPMVTSDIAQRKTQKKTFMKDSVVGSSKKSATYICKMCPFTTSAKSVLKKHTEYLHSSSCVDSFGSPLGLDKRKNDILEEPVDSDSTKTLTKQQSTTFPKNSALKQDVKRTFGSTSQSSSFSKIHKRPHRIQKARKSIAQSGVNMCNQNSSPHKNVTIKSSVDQKPKYFHQAAKEKSNAKANSHYLYRHKYENYRMIKKSGESYPVHFKKEEASSLNSLHLFSSSSNSHNNFISDPHKPDAKRPESFKDHRRVAVKRVIKESKKESSVGGEDLDSYPDFLHKMTVVVLQKLNSAEKKDSYETEDESSWDNVELGDYTTQAIEDETYSDINQEHVNLFPLFKSKVEGQEPGENATLSYDQNDGFYFEYYEDTGSNNFLHEIHDPQHLETADASLSKHSSVFHWTDLSLEKKSCPYCPATFETGVGLSNHVRGHLHRAGLSYEARHVVSPEQIATSDKMQHFKRTGTGTPVKRVRKAIEKSETTSEHTCQLCGGWFDTKIGLSNHVRGHLKRLGKTKWDAHKSPICVLNEMMQNEEKYEKILKALNSRRIIPRPFVAQKLASSDDFISQNVIPLEAYRNGLKTEALSVSASEEEGLNFLNEYDETKPELPSGKKNQSLTLIELLKNKRMGEERNSAISPQKIHNQTARKRFVQKCVLPLNEDSPLMYQPQKMDLTMHSALDCKQKKSRSRSGSKKKMLTLPHGADEVYILRCRFCGLVFRGPLSVQEDWIKHLQRHIVNANLPRTGAGMVEVTSLLKKPASITETSFSLLMAEAAS

SEQ ID NO: 750676 - protein, 1327 aa, Homo sapiens; identical to SEQ ID NO: 750674

SEQ ID NO: 750677 - protein, 1330 aa, Homo sapiens
ARYDTASSLYTGCTGNQELNVLNGLANNMDDLKINTDITGAKEELLDDNNFISDKESGVHKPKDCQTSFQKNNTLTLPEELSKDKSENALSGGQSSLFIHAGAPTVSSENFILPKGAAVNGPVSHSSLTKTSNMNKGSVSLTTGQPVDQPTTESCSTLKVAADLQLSTPQKASQHQVLFLLSDVAHAKNPTHSNKKLPTSASVGCDIQNSVGSNIKSDGTLINQVEVGEDGEDLLVKDDCVNTVTGISSGTDGFRSENDTNWDPQKEFIQFLMTNEETVDKAPPHSKIGLEKKKKAKMDVSKITRYTEDCFSDSNCVPNKSKMQEVDFLEQNEELQAVDSQKYALSKVKPESTDEDLESVDAFQHLIYNPDKCGEESSPVHTSTFLSNTLKKKCEESDSESPATFSTEEPSFYPCTKCNVNFREKKHLHRHMMYHLDGNSHFRHLNVPRPYACRECGRTFRDRNSLLKHMIIHQERRQKLMEEIRELKELQDEGRSARLQCPQCVFGTNCPKTFVQHAKTHEKDKRYYCCEECNFMAVTENELECHRGIAHGAVVKCPMVTSDIAQRKTQKKTFMKDSVVGSSKKSATYICKMCPFTTSAKSVLKKHTEYLHSSSCVDSFGSPLGLDKRKNDILEEPVDSDSTKTLTKQQSTTFPKNSALKQDVKRTFGSTSQSSSFSKIHKRPHRIQKARKSIAQSGVNMCNQNSSPHKNVTIKSSVDQKPKYFHQAAKEKSNAKANSHYLYRHKYENYRMIKKSGESYPVHFKKEEASSLNSLHLFSSSSNSHNNFISDPHKPDAKRPESFKDHRRVAVKRVIKESKKESSVGGEDLDSYPDFLHKMTVVVLQKLNSAEKKDSYETEDESSWDNVELGDYTTQAIEDETYSDINQEHVNLFPLFKSKVEGQEPGENATLSYDQNDGFYFEYYEDTGSNNFLHEIHDPQHLETADASLSKHSSVFHWTDLSLEKKSCPYCPATFETGVGLSNHVRGHLHRAGLSYEARHVVSPEQIATSDKMQHFKRTGTGTPVKRVRKAIEKSETTSEHTCQLCGGWFDTKIGLSNHVRGHLKRLGKTKWDAHKSPICVLNEMMQNEEKYEKILKALNSRRIIPRPFVAQKLASSDDFISQNVIPLEAYRNGLKTEALSVSASEEEGLNFLNEYDETKPELPSGKKNQSLTLIELLKNKRMGEERNSAISPQKIHNQTARKRFVQKCVLPLNEDSPLMYQPQKMDLTMHSALDCKQKKSRSRSGSKKKMLTLPHGADEVYILRCRFCGLVFRGPLSVQEDWIKHLQRHIVNANLPRTGAGMVEVTSLLKKPASITETSFSLLMAEAAS

SEQ ID NO: 750678 - protein, 105 aa, Homo sapiens
MLIRQNLALDCKQKKSRSRSGSKKKMLTLPHGADEVYILRCRFCGLVFRGPLSVQEDWIKHLQRHIVNANLPRTGAGMVEVTSLLKKPASITETSFSLLMAEAAS

SEQ ID NO: 750679 - protein, 87 aa, Homo sapiens; identical to SEQ ID NO: 750672

SEQ ID NO: 750680 - protein, 87 aa, Homo sapiens; identical to SEQ ID NO: 750672

SEQ ID NO: 750681 - protein, 87 aa, Homo sapiens
ACGRGGRWGPRSLRSDSLAFVSLGSYSARGKQVCSTSPVNLKMSCPRLFSVIGNLGGGAKGYLLRDFYRQLLLGSIYGLATLVEKFS

SEQ ID NO: 750682 - protein, 1327 aa, Homo sapiens; identical to SEQ ID NO: 750675

SEQ ID NO: 750683 - protein, 126 aa, Homo sapiens [sequence omitted]

SEQ ID NO: 750684 - protein, 258 aa, Homo sapiens
MARPPVPGSVVVPNWHESAEGKEYLACILRKNRRRVFGLLERPVLLPPVSIDTASYKIFVSGKSGVGKTALVAKLAGLEVPVVHHGTTGIQTTVVFWPAKLQASSRVVMFRFEFWDCGESALKKFDHMLLACMENTDAFLFLFSFTDRASFEDLPGQLARIAGEAPGVVRMVIGSKFDQYMHTDVPERDLTAFRQAWELPLLRVKSVPGRRLADGRTLDGRAGLADVAHILNGLAEQLWHQDQVAAGLLPNPPESAPE

SEQ ID NO: 750685 - protein, 103 aa, Homo sapiens
RSSSMDQRTLGISCLLGSRTRETAEHRVTYLWAPTNRRPLRPAVCHPCPFLLWSGFLGFARDVFKCSAQNRGEGGVWWKFFVMMSVWKAAVQTFNCYYYVLQV

SEQ ID NO: 750686 - protein, 110 aa, Homo sapiens
SLKVQVHFKPHTNFLLFLLCTAKTGGLLTQKTGWESGLGPLSSPETPPPRQDAGRGIPFSPHGKEGAPSHRKPWAAPACSFFLEFSSFPTTCLGVVPIGVCVSVCAWICV

SEQ ID NO: 750687 - protein, 150 aa, Homo sapiens
GISVLPLKSRLYQKMLTGKGLDGLHVERLPIMDTSLKTINDEAPTVALSFQLLSSERPENFLTPSGPPETHRVSRAVGMPLSLTHPTLFQARHPSLFLTLDYVLVYPLTSGSVSSSIHHLRLKRLINETHNSAAGMQQIFTAPFQFAERL

SEQ ID NO: 750688 - protein, 165 aa, Homo sapiens
MALLALLLVVALPRVWTDANLTARQRDPEDSQRTDEGDNRVWCHVCERENTFECQNPRRCKWTEPYCVIAAVKIFPRFFMVAKQCSAGCAAMERPKPEEKRFLLEEPMPFFYLKCCKIRYCNLEGPPINSSVFKEYAGSMGESCGGLWLAILLLLASIAAGLSLS

SEQ ID NO: 750689 - protein, 165 aa, Homo sapiens; identical to SEQ ID NO: 750688

SEQ ID NO: 750690 - protein, 165 aa, Homo sapiens; identical to SEQ ID NO: 750688

SEQ ID NO: 750691 - protein, 105 aa, Homo sapiens
MALLALLLVVALPRVWTDANLTARQRDPEDSQRTDEGDNRVWCHVCERENTFECQNPRRCKWTEPYCVIAAVTVLRWLCSDGETQARGEAVSPGRAHALLLPQVL

SEQ ID NO: 750692 - protein, 158 aa, Homo sapiens
MRLQRPRQAPAGGRRAPRGGRGSPYRPDPGRGARRLRRFQKGGEGAPRADPPWAPLGTMALLALLLVVALPRVWTDANLTARQRDPEDSQRTDEGDNRVWCHVCERENTFECQNPRRCKWTEPYCVIAAVRRSSGLVNSDSAQQSLSSPSVSTKLVGC

SEQ ID NO: 750693 - protein, 931 aa, Homo sapiens
MRKGLRATAARCGLGLGYLLQMLVLPALALLSASGTGSAAQDDDFFHELPETFPSDPPEPLPHFLIEPEEAYIVKNKPVNLYCKASPATQIYFKCNSEWVHQKDHIVDERVDETSGLIVREVSIEISRQQVEELFGPEDYWCQCVAWSSAGTTKSRKAYVRIAYLRKTFEQEPLGKEVSLEQEVLLQCRPPEGIPVAEVEWLKNEDIIDPVEDRNFYITIDHNLIIKQARLSDTANYTCVAKNIVAKRKSTTATVIVYVNGGWSTWTEWSVCNSRCGRGYQKRTRTCTNPAPLNGGAFCEGQSVQKIACTTLCPVDGRWTPWSKWSTCGTECTHWRRRECTAPAPKNGGKDCDGLVLQSKNCTDGLCMQTAPDSDDVALYVGIVIAVIVCLAISVVVALFVYRKNHRDFESDIIDSSALNGGFQPVNIKAARQDLLAVPPDLTSAAAMYRGPVYALHDVSDKIPMTNSPILDPLPNLKIKVYNTSGAVTPQDDLSEFTSKLSPQMTQSLLENEALSLKNQSLARQTDPSCTAFGSFNSLGGHLIVPNSGVSLLIPAGAIPQGRVYEMYVTVHRKETMRPPMDDSQTLLTPVVSCGPPGALLTRPVVLTMHHCADPNTEDWKILLKNQAAQGQWEDVVVVGEENFTTPCYIKLDAEACHILTENLSTYALVGHSTTKAAAKRLKLAIFGPLCCSSLEYSIRVYCLDDTQDALKEILHLERQTGGQLLEEPKALHFKGSTHNLRLSIHDIAHSLWKSKLLAKYQEIPFYHVWSGSQRNLHCTFTLERFSLNTVELVCKLCVRQVEGEGQIFQLNCTVSEEPTGIDLPLLDPANTITTVTGPSAFSIPLPIRQKLCSSLDAPQTRGHDWRMLAHKLNLDRYLNYFATKSSPTGVILDLWEAQNFPDGNLSMLAAVLEEMGRHETVVSLAAEGQY

SEQ ID NO: 750694 - protein, 163 aa, Homo sapiens
MRKGLRATAARCGLGLGYLLQMLVLPALALLSASGTGSAAQDDDFFHELPETFPSDPPEPLPHFLIEPEEAYIVKNKPVNLYCKASPATQIYFKCNSEWVHQKDHIVDERVDETSGLIVREVSIEISRQQVEELFGPEDYWCQCVAWSSAGTTKSRKAYVRIA

SEQ ID NO: 750695 - protein, 571 aa, Homo sapiens
QSLTLQAVGPDTDSAAPASQPRTPSEAQAPGAALEGSPAPQPPVPSPLHLRAPLTLERHRELSRGGLGKFPGPLCQEVPGSPALHPPPPPRAVPGGAAPWSGEAGAVCSGSPDPSRSCVSQPPRPPADHAPAPLALQSHWAVSPPLPARQGLRAMGSAHPRPWLRLRPQPQPRPALWVLLFFLLLLAAAMPRSAPNDILDLRLPPGPVLNANTVCLTLPGLSRRQMEVCVRHPDVAASAIQGIQIAIHECQHQFRDQRWNCSSLETRNKIPYESPIFSRGFRESAFAYAIAAAGVVHAVSNACALGKLKACGCDASRRGDEEAFRRKLHRLQLDALQRGKGLSHGVPEHPALPTASPGLQDSWEWGGCSPDMGFGERFSKDFLDSREPHRDIHARMRLHNNRVGRQAVMENMRRKCKCHGTSGSCQLKTCWQVTPEFRTVGALLRSRFHRATLIRPHNRNGGQLEPGPAGAPSPAPGAPGPRRRASPADLVYFEKSPDFCEREPRLDSAGTVGRLCNKSSAGSDGCGSMCCGRGHNILRQTRSERCHCRFHWCCFVVCEECRITEWVSVCK

SEQ ID NO: 750696 - protein, 571 aa, Homo sapiens; identical to SEQ ID NO: 750695

SEQ ID NO: 750697 - protein, 417 aa, Homo sapiens [sequence omitted]

SEQ ID NO: 750698 - protein, 605 aa, Homo sapiens
QSLTLQAVGPDTDSAAPASQPRTPSEAQAPGAALEGSPAPQPPVPSPLHLRAPLTLERHRELSRGGLGKFPGPLCQEVPGSPALHPPPPPRAVPGGAAPWSGEAGAVCSGSPDPSRSCVSQPPRPPADHAPAPLALQSHWAVSPPLPARQGLRAMGSAHPRPWLRLRPQPQPRPALWVLLFFLLLLAAAMPRSAPNDILDLRLPPGPVLNANTVCLTLPGLSRRQMEVCVRHPDVAASAIQGIQIAIHECQHQFRDQRWNCSSLETRNKIPYESPIFSRGFRESAFAYAIAAAGVVHAVSNACALGKLKACGCDASRRGDEEAFRRKLHRLQLDALQRGKGLSHGVPEHPALPTASPGLQDSWEWGGCSPDMGFGERFSKDFLDSREPHRDIHARMRLHNNRVGRQAVMENMRRKCKCHGTSGSCQLKTCWQVTPEFRTVGALLRSRFHRATLIRPHNRNGGQLEPGPAGAPSPAPGAPGPRRRASPADLVYFEKSPDFCEREPRLDSAGTVGRLCNKSSAGSDGCGSMCCGRGHNILRQTRSERCHCRFHWCCFVVCEECRITEWVSVCKVSPCRPGWSAVVQSRLAAASTSRAQAILPPQPPE

SEQ ID NO: 750699 - protein, 393 aa, Homo sapiens
GCKCHAGGFGQPSPSMSSFDLPAPSPPRCSPQFPSIGQEPPEMNLYYENFFHPQGVPSPQRPSFEGGGEYGATPNPYLWFNGPTMTPPPYLPGPNASPFLPQAYGVQRPLLPSVSGLGGSDLGWLPIPSQEELMKLVRPPYSYSALIAMAIHGAPDKRLTLSQIYQYVADNFPFYNKSKAGWQNSIRHNLSLNDCFKKVPRDEDDPGKGNYWTLDPNCEKMFDNGNFRRKRKRKSDVSSSTASLALEKTESSLPVDSPKTTEPQDILDGASPGGTTSSPEKRPSPPPSGAPCLNSFLSSMTAYVSGGSPTSHPLVTPGLSPEPSDKTGQNSLTFNSFSPLTNLSNHSGGGDWANPMPTNMLSYGGSVLSQFSPHFYNSVNTSGVLYPREGTEV

SEQ ID NO: 750700 - protein, 1010 aa, Homo sapiens
HEAPRLRQLVVTEEDGGARPEALGKIAPRTPAELGARADQELVTALMCDLRRPAAGGMMDLAYVCEWEKWSKSTHCPSVPLACAWSCRNLITFTMDLRSDDQDLTRMIHILDTEHPWDLHSIPSEHHEAITCLEWDQSGSRLLSADADGQIKCWSMADHLANSWESSVGSLVEGDPIVALSWLHNGVKLALHVEKSGASSFGEKFSRVKFSPSLTLFGGKPMEGWIAVTVSGLVTVSLLKPSGQVLTSTESLCRLRGRVALADIAFTGGGNIVVATADGSSASPVQFYKVCVSVVSEKCRIDTEILPSLFMRCTTDLNRKDKFPAITHLKFLARDMSEQVLLCASSQTSSIVECWSLRKEGLPVNNIFQQISPVVGDKQPTILKWRILSATNDLDRVSAVALPKLPISLTNTDLKVASDTQFYPGLGLALAFHDGSVHIVHRLSLQTMAVFYSSAAPRPVDEPAMKRPRTAGPAVHLKAMQLSWTSLALVGIDSHGKLSVLRLSPSMGHPLEVGLALRHLLFLLEYCMVTGYDWWDILLHVQPSMVQSLVEKLHEEYTRQTAALQQVLSTRILAMKASLCKLSPCTVTRVCDYHTKLFLIAISSTLKSLLRPHFLNTPDKSPGDRLTEICTKITDVDIDKVMINLKTEEFVLDMNTLQALQQLLQWVGDFVLYLLASLPNQPCPTSEPCPTSEPSPPRSPPPPRSPPLHEASAGSLLRPGHSFLRDGTSLGMLRELMVVIRIWGLLKPSCLPVYTATSDTQDSMSLLFRLLTKLWICCRDEGPASEPDEALVDECCLLPSQLLIPSLDWLPASDGLVSRLQPKQPLRLQFGRAPTLPGSAATLQLDGLARAPGQPKIDHLRRLHLGACPTEECKACTRCGCVTMLKSPNRTTAVKQWEQRWIKNCLCGGLWWRVPLSYTLSPAAPQLLLSYPSAAPEPGCCKSHRSPWTLLGAVNLSPPCRAVEGRGPDACVTSRASEEAPAFVQLGPQSTHHSPRTPRSLDHLHPEDRP

SEQ ID NO: 750701 - protein, 797 aa, Homo sapiens
HEAPRLRQLVVTEEDGGARPEALGKIAPRTPAELGARADQELVTALMCDLRRPAAGGMMDLAYVCEWEKWSKSTHCPSVPLACAWSCRNLITFTMDLRSDDQDLTRMIHILDTEHPWDLHSIPSEHHEAITCLEWDQSGSRLLSADADGQIKCWSMADHLANSWESSVGSLVEGDPIVALSWLHNGVKLALHVEKSGASSFGEKFSRVKFSPSLTLFGGKPMEGWIAVTVSGLVTVSLLKPSGQVLTSTESLCRLRGRVALADIAFTGGGNIVVATADGSSASPVQFYKVCVSVVSEKCRIDTEILPSLFMRCTTDLNRKDKFPAITHLKFLARDMSEQVLLCASSQTSSIVECWSLRKEGLPVNNIFQQISPVVGDKQPTILKWRILSATNDLDRVSAVALPKLPISLTNTDLKVASDTQFYPGLGLALAFHDGSVHIVHRLSLQTMAVFYSSAAPRPVDEPAMKRPRTAGPAVHLKAMQLSWTSLALVGIDSHGKLSVLRLSPSMGHPLEVGLALRHLLFLLEYCMVTGYDWWDILLHVQPSMVQSLVEKLHEEYTRQTAALQQVLSTRILAMKASLCKLSPCTVTRVCDYHTKLFLIAISSTLKSLLRPHFLNTPDKSPGDRLTEICTKITDVDIDKVMINLKTEEFVLDMNTLQALQQLLQWVGDFVLYLLASLPNQVAMRAQRASRTRRWWMNAACCPASCLSPAWTGCQPATAWLAACSPSSPFVCSLAGRPRCLAVLPPCSSTASPGPQASPRSTTCGGCTLALAPRRNARPAPGAAVSPCSSRPTEPRR

SEQ ID NO: 750702 - protein, 923 aa, Homo sapiens
HEAPRLRQLVVTEEDGGARPEALGKIAPRTPAELGARADQELVTALMCDLRRPAAGGMMDLAYVCEWEKWSKSTHCPSVPLACAWSCRNLITFTMDLRSDDQDLTRMIHILDTEHPWDLHSIPSEHHEAITCLEWDQSGSRLLSADADGQIKCWSMADHLANSWESSVGSLVEGDPIVALSWLHNGVKLALHVEKSGASSFGEKFSRVKFSPSLTLFGGKPMEGWIAVTVSGLVTVSLLKPSGQVLTSTESLCRLRGRVALADIAFTGGGNIVVATADGSSASPVQFYKVCVSVVSEKCRIDTEILPSLFMRCTTDLNRKDKFPAITHLKFLARDMSEQVLLCASSQTSSIVECWSLRKEGLPVNNIFQQISPVVGDKQPTILKWRILSATNDLDRVSAVALPKLPISLTNTDLKVASDTQFYPGLGLALAFHDGSVHIVHRLSLQTMAVFYSSAAPRPVDEPAMKRPRTAGPAVHLKAMQLSWTSLALVGIDSHGKLSVLRLSPSMGHPLEVGLALRHLLFLLEYCMVTGYDWWDILLHVQPSMVQSLVEKLHEEYTRQTAALQQVLSTRILAMKASLCKLSPCTVTRVCDYHTKLFLIAISSTLKSLLRPHFLNTPDKSPGDRLTEICTKITDVDIDKVMINLKTEEFVLDMNTLQALQQLLQWVGDFVLYLLASLPNQGSLLRPGHSFLRDGTSLGMLRELMVVIRIWGLLKPSCLPVYTATSDTQDSMSLLFRLLTKLWICCRDEGPASEPDEALVDECCLLPSQLLIPSLDWLPASDGLVSRLQPKQPLRLQFGRAPTLPGSAATLQLDGLARAPGQPKIDHLRRLHLGACPTEECKACTRCGCVTMLKSPNRTTAVKQWEQRWIKNCLAVEGRGPDACVTSRASEEAPAFVQLGPQSTHHSPRTPRSLDHLHPEDRP

SEQ ID NO: 750703 - protein, 978 aa, Homo sapiens
HEAPRLRQLVVTEEDGGARPEALGKIAPRTPAELGARADQELVTALMCDLRRPAAGGMMDLAYVCEWEKWSKSTHCPSVPLACAWSCRNLITFTMDLRSDDQDLTRMIHILDTEHPWDLHSIPSEHHEAITCLEWDQSGSRLLSADADGQIKCWSMADHLANSWESSVGSLVEGDPIVALSWLHNGVKLALHVEKSGASSFGEKFSRVKFSPSLTLFGGKPMEGWIAVTVSGLVTVSLLKPSGQVLTSTESLCRLRGRVALADIAFTGGGNIVVATADGSSASPVQFYKVCVSVVSEKCRIDTEILPSLFMRCTTDLNRKDKFPAITHLKFLARDMSEQVLLCASSQTSSIVECWSLRKEGLPVNNIFQQISPVVGDKQPTILKWRILSATNDLDRVSAVALPKLPISLTNTDLKVASDTQFYPGLGLALAFHDGSVHIVHRLSLQTMAVFYSSAAPRPVDEPAMKRPRTAGPAVHLKAMQLSWTSLALVGIDSHGKLSVLRLSPSMGHPLEVGLALRHLLFLLEYCMVTGYDWWDILLHVQPSMVQSLVEKLHEEYTRQTAALQQVLSTRILAMKASLCKLSPCTVTRVCDYHTKLFLIAISSTLKSLLRPHFLNTPDKSPGDRLTEICTKITDVDIDKVMINLKTEEFVLDMNTLQALQQLLQWVGDFVLYLLASLPNQGSLLRPGHSFLRDGTSLGMLRELMVVIRIWGLLKPSCLPVYTATSDTQDSMSLLFRLLTKLWICCRDEGPASEPDEALVDECCLLPSQLLIPSLDWLPASDGLVSRLQPKQPLRLQFGRAPTLPGSAATLQLDGLARAPGQPKIDHLRRLHLGACPTEECKACTRCGCVTMLKSPNRTTAVKQWEQRWIKNCLCGGLWWRVPLSYTLSPAAPQLLLSYPSAAPEPGCCKSHRSPWTLLGAVNLSPPCRAVEGRGPDACVTSRASEEAPAFVQLGPQSTHHSPRTPRSLDHLHPEDRP

SEQ ID NO: 750704 - protein, 106 aa, Homo sapiens
NASSFLNSNQQRMKTSAQPAIRADKSTNAILSWVSLSNSTPEDEKYGPCAAPASHVIPDDHVLVPQVLQVFPVVPCAPTGSRSFYDTQEALKPEGWVFLHLLPQCS

SEQ ID NO: 750705 - protein, 101 aa, Homo sapiens
MANMNSDSRHLGTSEVDHERDPGPMNIQFEPSDLRSKRPFCIEPTNIVNVNHVIQRVSDHASAMNKRIHYYSRLTTPADKALIAPELSGREFILVAREFWT

SEQ ID NO: 750706 - protein, 251 aa, Homo sapiens
MANMNSDSRHLGTSEVDHERDPGPMNIQFEPSDLRSKRPFCIEPTNIVNVNHVIQRVSDHASAMNKRIHYYSRLTTPADKALIAPDHVVPAPEECYVYSPLGSAYKLQSYTEGYGKNTSLVTIFMIWNTMMGTSILSIPWGIKQAGFTTGMCVIILMGLLTLYCCYRVVKSRTMMFSLDTTSWEYPDVCRHYFGSFGQWSSLLFSLVSLIGAMIVYWVLMSNFLFNTGKFIFSKYLYHMLLTQYFQILLPL

SEQ ID NO: 750707 - protein, 67 aa, Homo sapiens
GFLHVSPCPWDGDAGITRPVGFSAMPFSNCGLSTYCMPGTTWGGDLGISLRDAVILFSELPDLWKSM

SEQ ID NO: 750708 - protein, 89 aa, Homo sapiens
AELPLDVPHIRLDSPPSFDNTTYTSLPLDSPSGKPSLPAPSSLPPLPPKVLVCSKPVTYATVIFPGGNKGGGTSCGPAQNPPNNQTPSS

SEQ ID NO: 750709 - protein, 150 aa, Homo sapiens
MGVQPPNFSWVLPGRLAGLALPRLPAHYQFLLDLGVRHLVSLTERGPPHSDSCPGLTLHRLRIPDFCPPAPDQIDRFVQIVDEANARGEAVGVHCALGFGRTGTMLACYLVKERGLAAGDAIAEIRRLRPGSIETYEQEKAVFQFYQRTK

SEQ ID NO: 750710 - protein, 162 aa, Homo sapiens
ADHVAREAPRPAMGVQPPNFSWVLPGRLAGLALPRLPAHYQFLLDLGVRHLVSLTERGPPHSDSCPGLTLHRLRIPDFCPPAPDQIDRFVQIVDEANARGEAVGVHCALGFGRTGTMLACYLVKERGLAAGDAIAEIRRLRPGSIETYEQEKAVFQFYQRTK

SEQ ID NO: 750711 - protein, 162 aa, Homo sapiens; identical to SEQ ID NO: 750710

SEQ ID NO: 750712 - protein, 150 aa, Homo sapiens; identical to SEQ ID NO: 750709

SEQ ID NO: 750713 - protein, 99 aa, Homo sapiens
AAAYYYYYCSNSSFKRCTGKSPPIPHAAPPQSQATSCLLLVGGGLLSPSSLTFNLTLTLHRAPTLHPSWKAGLMASHWPPPPDQSVLFRGLAPFPVSLK

SEQ ID NO: 750714 - protein, 276 aa, Homo sapiens
DLEDPRLNGEYKMPTPPLPLLKRQNGSWGPEERKTHMPFQKGMPFDLCFLVQSSDFKVMVNGILFVQYFHRVPFHRVDTISVNGSVQLSYISFQNPRTVPVQPAFSTVPFSQPVCFPPRPRGRRQKPPGVWPANPAPITQTVIHTVQSAPGQMFSTPAIPPMMYPHPAYPMPFITTILGGLYPSKSILLSGTVLPSAQRFHINLCSGNHIAFHLNPRFDENAVVRNTQIDNSWGSEERSLPRKMPFVRGQSFSVRHRSLELGEAPMGAQGEGVKEV

SEQ ID NO: 750715 - protein, 311 aa, Homo sapiens
MAFSGSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSSDFKVMVNGILFVQYFHRVPFHRVDTISVNGSVQLSYISFQTQTVIHTVQSAPGQMFSTPAIPPMMYPHPAYPMPFITTILGGLYPSKSILLSGTVLPSAQRFHINLCSGNHIAFHLNPRFDENAVVRNTQIDNSWGSEERSLPRKMPFVRGQSFSVWILCEAHCLKVAVDGQHLFEYYHRLRNLPTINRLEVGGDIQLTHVQT

SEQ ID NO: 750716 - protein, 266 aa, Homo sapiens
MGPFSAPVEPDGGYVVCNTRQNGSWGPEERKTHMPFQKGMPFDLCFLVQSSDFKVMVNGILFVQYFHRVPFHRVDTISVNGSVQLSYISFQPPGVWPANPAPITQTVIHTVQSAPGQMFSTPAIPPMMYPHPAYPMPFITTILGGLYPSKSILLSGTVLPSAQRFHINLCSGNHIAFHLNPRFDENAVVRNTQIDNSWGSEERSLPRKMPFVRGQSFSVWILCEAHCLKVAVDGQHLFEYYHRLRNLPTINRLEVGGDIQLTHVQT

SEQ ID NO: 750717 - protein, 298 aa, Homo sapiens
MGPFSAPVEPDGGYVVCNTRQNGSWGPEERKTHMPFQKGMPFDLCFLVQSSDFKVMVNGILFVQYFHRVPFHRVDTISVNGSVQLSYISFQNPRTVPVQPAFSTVPFSQPVCFPPRPRGRRQKPPGVWPANPAPITQTVIHTVQSAPGQMFSTPAIPPMMYPHPAYPMPFITTILGGLYPSKSILLSGTVLPSAQRFHINLCSGNHIAFHLNPRFDENAVVRNTQIDNSWGSEERSLPRKMPFVRGQSFSVWILCEAHCLKVAVDGQHLFEYYHRLRNLPTINRLEVGGDIQLTHVQT

SEQ ID NO: 750718 - protein, 234 aa, Homo sapiens
MAFSGSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSSDFKVMVNGILFVQYFHRVPFHRVDTISVNGSVQLSYISFQTQTVIHTVQSAPGQMFSTPAIPPMMYPHPAYPMPFITTILGGLYPSKSILLSGTVLPSAQRCGSCVKLTASRWPWMVSTCLNTTIA

SEQ ID NO: 750719 - protein, 149 aa, Homo sapiens [sequence omitted]

SEQ ID NO: 750720 - protein, 312 aa, Homo sapiens
MAFSGSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSSDFKVMVNGILFVQYFHRVPFHRVDTISVNGSVQLSYISFQPPGVWPANPAPITQTVIHTVQSAPGQMFSTPAIPPMMYPHPAYPMPFITTILGGLYPSKSILLSGTVLPSAQRFHINLCSGNHIAFHLNPRFDENAVVRNTQIDNSWGSEERSLPRKMPFVRGQSFSVWILCEAHCLKVAVDGQHLFEYYHRLRWPPQPLLSDL

SEQ ID NO: 750721 - protein, 219 aa, Homo sapiens
MAFSGSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSSDFKVMVNGILFVQYFHRVPFHRVDTISVNGSVQLSYISFQNPRTVPVQPAFSTVPFSQPVCFPPRPRGRRQKPPGVWPANPAPITQTVIHTVQSAPGQMFSTPPSQSTEIR

SEQ ID NO: 750722 - protein, 244 aa, Homo sapiens
MAFSGSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSSDFKVMVNGILFVQYFHRVPFHRVDTISVNGSVQLSYISFQVRLSTWHRPRGWDAGPSVAVSKPCWVGPSQSPTQVTLGTTSASLSQYLPAPSPLSLCPSFCVTVSVRNTCLGLPDSSAAPFSSSLSFHPGKEGILF

SEQ ID NO: 750723 - protein, 323 aa, Homo sapiens
MAFSGSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSSDFKVMVNGILFVQYFHRVPFHRVDTISVNGSVQLSYISFQPPGVWPANPAPITQTVIHTVQSAPGQMFSTPAIPPMMYPHPAYPMPFITTILGGLYPSKSILLSGTVLPSAQRFHINLCSGNHIAFHLNPRFDENAVVRNTQIDNSWGSEERSLPRKMPFVRGQSFSVWILCEAHCLKVAVDGQHLFEYYHRLRNLPTINRLEVGGDIQLTHVQT

SEQ ID NO: 750724 - protein, 355 aa, Homo sapiens
MAFSGSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSSDFKVMVNGILFVQYFHRVPFHRVDTISVNGSVQLSYISFQNPRTVPVQPAFSTVPFSQPVCFPPRPRGRRQKPPGVWPANPAPITQTVIHTVQSAPGQMFSTPAIPPMMYPHPAYPMPFITTILGGLYPSKSILLSGTVLPSAQRFHINLCSGNHIAFHLNPRFDENAVVRNTQIDNSWGSEERSLPRKMPFVRGQSFSVWILCEAHCLKVAVDGQHLFEYYHRLRNLPTINRLEVGGDIQLTHVQT

SEQ ID NO: 750725 - protein, 208 aa, Homo sapiens
MAFSGSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSSDFKVMVNGILFVQYFHRVPFHRVDTISVNGSVQLSYISFQNPRTVPVQPAFSTVPFSQPVCFPPRPRGRRQKPPGVWPANPAPITQTVIHTVLISIRGSS

SEQ ID NO: 750726 - protein, 187 aa, Homo sapiens
AYRGRIFTPAIPPMMYPHPAYPMPFITTILGGLYPSKSILLSGTVLPSAQRFHINLCSGNHIAFHLNPRFDENAVVRNTQIDNSWGSEERSLPRKMPFVRGQSFSVWILCEAHCLKVAVDGQHLFEYYHRLGTHAYLGYAGGEHHTGSHRGAAGNDTLRQAVPGRHGPKYILEQFLQQELLINITEH

SEQ ID NO: 750727 - protein, 362 aa, Homo sapiens
MCQQAFSFLYFKDTGKGASPLKRTLWSGGGGQWEAIRPAFLSSVSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSSDFKVMVNGILFVQYFHRVPFHRVDTISVNGSVQLSYISFQPPGVWPANPAPITQTVIHTVQSAPGQMFSTPAIPPMMYPHPAYPMPFITTILGGLYPSKSILLSGTVLPSAQRFHINLCSGNHIAFHLNPRFDENAVVRNTQIDNSWGSEERSLPRKMPFVRGQSFSVWILCEAHCLKVAVDGQHLFEYYHRLRNLPTINRLEVGGDIQLTHVQT

SEQ ID NO: 750728 - protein, 323 aa, Homo sapiens; identical to SEQ ID NO: 750723

SEQ ID NO: 750729 - protein, 149 aa, Homo sapiens [sequence omitted]

SEQ ID NO: 750730 - protein, 323 aa, Homo sapiens; identical to SEQ ID NO: 750723

SEQ ID NO: 750731 - protein, 298 aa, Homo sapiens
MAFSGSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSSDFKVMVNGILFVQYFHRVPFHRVDTISVNGSVQLSYISFQPPGVWPANPAPITQTVIHTVQSAPGQMFSTPAIPPMMYPHPAYPMPFITTILGGLYPSKSILLSGTVLPSAQRFHINLCSGNHIAFHLNPRFDENAVVRNTQIDNSWGSEERSLPRKMPFVRGQSFSVRHRSLELGEAPMGAQGEGVKEV

SEQ ID NO: 750732 - protein, 105 aa, Homo sapiens
GFRKATDDGEEMGLRIRWIKVQVGCPPQFHINLCSGNHIAFHLNPRFDENAVVRNTQIDNSWGSEERSLPRKMPFVRGQSFSVRHRSLELGEAPMGAQGEGVKEV

SEQ ID NO: 750733 - protein, 265 aa, Homo sapiens [sequence omitted]

SEQ ID NO: 750734 - protein, 265 aa, Homo sapiens [sequence omitted]

SEQ ID NO: 750735 - protein, 265 aa, Homo sapiens [sequence omitted]

SEQ ID NO: 750736 - protein, 264 aa, Homo sapiens
GRALRGCSDLERVLSGDEGVERAECVRFREHLVTLHLGAVGSNRFWRGGQIRTVISARVQEGGYLDVWVPHPLPEPFPQPYPCAEDEECGTDEYCASPTRGGDAGVQICLACRKRRKRCMRHAMCCPGNYCKNGICVSSDQNHFRGEIEETITESFGNDHSTLDGYSRRTTLSSKMYHTKGQEGSVCLRSSDCASGLCCARHFWSKICKPVLKEGQVCTKHRRKGSHGLEIFQRCYCGEGLSCRIQKDHHQASNSSRLHTCQRH

SEQ ID NO: 750737 - protein, 249 aa, Homo sapiens
MALGAAGATRVFVAMVAAALGGHPLLGVSATLNSVLNSNAIKNLPPPLGGAAGHPGSAVSAAPGILYPGGNKYQTIDNYQPYPCAEDEECGTDEYCASPTRGGDAGVQICLACRKRRKRCMRHAMCCPGNYCKNGICVSSDQNHFRGEIEETITESFGNDHSTLDGYSRRTTLSSKMYHTKGQEGSVCLRSSDCASGLCCARHFWSKICKPVLKEGQVCTKHRRKGSHGLEIFQRCYCGEGEFHISSFV

SEQ ID NO: 750738 - protein, 265 aa, Homo sapiens [sequence omitted]

SEQ ID NO: 750739 - protein, 265 aa, Homo sapiens [sequence omitted]

SEQ ID NO: 750740 - protein, 92 aa, Homo sapiens
VFNREEERSWEVSEEYVCLLIKIISEEKLRKPSLKALVMIIAPWMGIPEEPPCLQKCITPKDKKVLFVSGHQTVPQDCVVLDTSGPRSVNLS

SEQ ID NO: 750741 - protein, 163 aa, Homo sapiens
LGSEGEGLGETWLSHPASRVWHGQVCLCSEAYSHWAVTGEAWDPLSALSSSRLAALEARVAQLREARAQQAQQVEEWRAQNAVQRAAYEALRAHVGLREAALRRLQEEARDLLERLVQRKARAAAERNLRNERRERAKQARVSQELKKAAKRTVSISDVSISE

SEQ ID NO: 750742 - protein, 275 aa, Homo sapiens
MAGPGVPGAPAARWKRHIVRQLRLRDRTQKALFLELVPAYNHLLEKAELLDKFSKKLQPEPNSVTPTTHQGPWEESELDSDQVPSLVALRVKWQEEEEGLRLVCGEMAYQVVEKGAALGTLESELQQRQSRLAALEARVAQLREARAQQAQQVEEWRAQNAVQRAAYEALRAHVGLREAALRRLQEEARDLLERLVQRKARAAAERNLRNERRERAKQARVSQELKKAAKRTVSISEGPDTLGDGMRERRETLALAPEPEPLEKEACEKWKRPFR

SEQ ID NO: 750743 - protein, 350 aa, Homo sapiens
MPQGSWRLPPEKDLLNALLDPNPPYPSFKKRRGHSIGGAPEQRYQIIPVCVAARLPTRAQDVLDAHLSEVNAVRFGPNSSLLATGGADRLIHLWNVVGSRLEANQTLEGAGGSITSVDFDPSGYQVLAATYNQAAQLWKVGEAQSKETLSGHKDKVTAAKFKLTRHQAVTGSRDRTVKEWDLGRAYCSRTINVLSYCNDVVCGDHIIISGHNDQKIRFWDSRGPHCTQVIPVQGRVTSLSLSHDQLHLLSCSRDNTLKVIDLRVSNIRQVFRADGFKCGSDWTKAVFSPDRSYALAGSCDGALYIWDVDTGKLESRLQGPHCAAVNAVAWCYSGSHMVSVDQGRKVVLWQ

SEQ ID NO: 750744 - protein, 444 aa, Homo sapiens
MPVSGTEGGSSRPLEEGTGSSPACVRGAAPGSQDAFYPTRAKQARVSQELKKAAKRTVSISEGPDTLGDGMRERRETLALAPEPEPLEKEACEKWKRPFRSASATSLTLSHCVDVVKGLLDFKKRRGHSIGGAPEQRYQIIPVCVAARLPTRAQDVLDAHLSEVNAVRFGPNSSLLATGGADRLIHLWNVVGSRLEANQTLEGAGGSITSVDFDPSGYQVLAATYNQAAQLWKVGEAQSKETLSGHKDKVTAAKFKLTRHQAVTGSRDRTVKEWDLGRAYCSRTINVLSYCNDVVCGDHIIISGHNDQKIRFWDSRGPHCTQVIPVQGRVTSLSLSHDQLHLLSCSRDNTLKVIDLRVSNIRQVFRADGFKCGSDWTKAVFSPDRSYALAGSCDGALYIWDVDTGKLESRLQGPHCAAVNAVAWCYSGSHMVSVDQGRKVVLWQ

SEQ ID NO: 750745 - protein, 420 aa, Homo sapiens [sequence omitted]

SEQ ID NO: 750746 - protein, 436 aa, Homo sapiens
RPTRRRDLLERLVQRKARAAAERNLRNERRERAKQARVSQELKKAAKRTVSISEGPDTLGDGMRERRETLALAPEPEPLEKEACEKWKRPFRSASATSLTLSHCVDVVKGLLDFKKRRGHSIGGAPEQRYQIIPVCVAARLPTRAQDVLDAHLSEVNAVRFGPNSSLLATGGADRLIHLWNVVGSRLEANQTLEGAGGSITSVDFDPSGYQVLAATYNQAAQLWKVGEAQSKETLSGHKDKVTAAKFKLTRHQAVTGSRDRTVKEWDLGRAYCSRTINVLSYCNDVVCGDHIIISGHNDQKIRFWDSRGPHCTQVIPVQGRVTSLSLSHDQLHLLSCSRDNTLKVIDLRVSNIRQVFRADGFKCGSDWTKAVFSPDRSYALAGSCDGALYIWDVDTGKLESRLQGPHCAAVNAVAWCYSGSHMVSVDQGRKVVLWQ

SEQ ID NO: 750747 - protein, 297 aa, Homo sapiens
IRAGAKGFVLDAHLSEVNAVRFGPNSSLLATGGADRLIHLWNVVGSRLEANQTLEGAGGSITSVDFDPSGYQVLAATYNQAAQLWKVGEAQSKETLSGHKDKVTAAKFKLTRHQAVTGSRDRTVKEWDLGRAYCSRTINVLSYCNDVVCGDHIIISGHNDQKIRFWDSRGPHCTQVIPVQGRVTSLSLSHDQLHLLSCSRDNTLKVIDLRVSNIRQVFRADGFKCGSDWTKAVFSPDRSYALAGSCDGALYIWDVDTGKLESRLQGPHCAAVNAVAWCYSGSHMVSVDQGRKVVLWQ

SEQ ID NO: 750748 - protein, 116 aa, Homo sapiens
ESAAMAGPGVPGAPAARWKRHIVRQLRLRDRTQKALFLELVPAYNHLLEKAELLDKFSKKLQPEPNSVTPTTHQGPWEESELDSDQVPSLVALRVKWQEEEEGLRLVCGEVSWEGV

SEQ ID NO: 750749 - protein, 116 aa, Homo sapiens; identical to SEQ ID NO: 750748

SEQ ID NO: 750750 - protein, 117 aa, Homo sapiens
ESAAMAGPGVPGAPAARWKRHIVRQLRLRDRTQKALFLELVPAYNHLLEKAELLDKFSKKLQPEPNSVTPTTHQGPWEESELDSDQVPSLVALRVKWQEEEEGLRLVCGEIHRKLEG

SEQ ID NO: 750751 - protein, 319 aa, Homo sapiens
ESAAMAGPGVPGAPAARWKRHIVRQLRLRDRTQKALFLELVPAYNHLLEKAELLDKFSKKLQPEPNSVTPTTHQGPWEESELDSDQVPSLVALRVKWQEEEEGLRLVCGELAFQEGGGQVSSRLPERLRPRRDWRPGGASAPPCPPVRPQMAYQVVEKGAALGTLESELQQRQSRLAALEARVAQLREARAQQAQQVEEWRAQNAVQRAAYEALRAHVGLREAALRRLQEEARDLLERLVQRKARAAAERNLRNERRERAKQARVSQELKKAAKRTVSISEGPDTLGDGMRERRETLALAPEPEPLEKEACEKWKRPFR

SEQ ID NO: 750752 - protein, 275 aa, Homo sapiens; identical to SEQ ID NO: 750742

SEQ ID NO: 750753 - protein, 275 aa, Homo sapiens; identical to SEQ ID NO: 750742

SEQ ID NO: 750754 - protein, 423 aa, Homo sapiens
MPVSGTEGGSSRPLEEGTGSSPACVRGAAPGSQDAFYPTRAKQARVSQELKKAAKRTVSISEGPDTLGDGMRERRETLALAPEPEPLEKEACEKWKRPFSFKKRRGHSIGGAPEQRYQIIPVCVAARLPTRAQDVLDAHLSEVNAVRFGPNSSLLATGGADRLIHLWNVVGSRLEANQTLEGAGGSITSVDFDPSGYQVLAATYNQAAQLWKVGEAQSKETLSGHKDKVTAAKFKLTRHQAVTGSRDRTVKEWDLGRAYCSRTINVLSYCNDVVCGDHIIISGHNDQKIRFWDSRGPHCTQVIPVQGRVTSLSLSHDQLHLLSCSRDNTLKVIDLRVSNIRQVFRADGFKCGSDWTKAVFSPDRSYALAGSCDGALYIWDVDTGKLESRLQGPHCAAVNAVAWCYSGSHMVSVDQGRKVVLWQ

SEQ ID NO: 750755 - protein, 407 aa, Homo sapiens
ESAAMAGPGVPGAPAARWKRHIVRQLRLRDRTQKALFLELVPAYNHLLEKAELLDKFSKKLQPEPNSVTPTTHQGPWEESELDSDQVPSLVALRVKWQEEEEGLRLVCGEMAYQVVEKGAALGTLESELQQRQSRLAALEARVAQLREARAQQAQQVEEWRAQNAVQRAAYEALRAHVGLREAALRRLQEEARDLLERLVQRKARAAAERNLRNERRERAKQARVSQELKKAAKRTVSISEGPDTLGDGMRERRETLALAPEPEPLEKEACEKWKRPFRGPHCTQVIPVQGRVTSLSLSHDQLHLLSCSRDNTLKVIDLRVSNIRQVFRADGFKCGSDWTKAVFSPDRSYALAGSCDGALYIWDVDTGKLESRLQGPHCAAVNAVAWCYSGSHMVSVDQGRKVVLWQ

SEQ ID NO: 750756 - protein, 107 aa, Homo sapiens
QTTQVQQSGQSQVAGAVPEAPLKPAPPFPQRCRQRRGLVLLREPHGERGPGQEGCALAVGPRPACLGWSSCPKPEASFGAMQGLGLGLELALGFNGEEGLAGPGLFV

SEQ ID NO: 750757 - protein, 335 aa, Homo sapiens [sequence omitted]

SEQ ID NO: 750758 - protein, 454 aa, Homo sapiens
TLTAFLMMGNLSPNLKSHAVTMFEVGKLSDESLDSFLIELEKVQSTGEGEAQRYFDHALTLRNTILFLRHNKDLVAQTAQPDQPNYGFPLDLLRCESLLGLDPATCSRVLNKNYTLLVSMAPLTNEIRPVSSCTPQHIGPAIPEVSSVWFKLYIYHVTGQGPPSLLLSKGTRLRKLPDIFQSYDRLLITSWGHDPGVVPTSNVLTMLNDALTHSAVLIQGHGLHGIGETVHVPFPFDETELQGEFTRVNMGVHKALQILRNRVDLQHLCGYVTMLNASSQLADRKLSDASDERGEPDLASGSDVNGSTESFEMVIEEATIDSATKQTSGATTEADWVPLELCFGIPLFSSELNRKVCRKIAAHGLCRKESLQNLLHSSRKLSLQVLNFVHSFQEGASILDIHTEPSFSSLLSQSSYADMGVPLPAKNLIFKDGVLSEWSGRSPSSLLIANLHLQ

SEQ ID NO: 750759 - protein, 454 aa, Homo sapiens; identical to SEQ ID NO: 750758

SEQ ID NO: 750760 - protein, 454 aa, Homo sapiens; identical to SEQ ID NO: 750758

SEQ ID NO: 750761 - protein, 405 aa, Homo sapiens
TLTAFLMMGNLSPNLKSHAVTMFEVGKLSDESLDSFLIELEKVQSTGEGEAQRYFDHALTLRNTILFLRHNKDLVAQTAQPDQPNYGFPLDLLRCESLLGLDPATCSRVLNKNYTLLVSMAPLTNEIRPVSSCTPQHIGPAIPEVSSVWFKLYIYHVTGQGPPSLLLSKGTRLRKLPDIFQSYDRLLITSWGHDPGVVPTSNVLTMLNDALTHSAVLIQGHGLHGIGETVHVPFPFDETELQGEFTRVNMGVHKALQILRNRVDLQHLCGYVTMLNASSQLADRKLSDASDERGEPDLASGSDVNGSTESFEMVIEEATIDSATKQTSGATTEADWVPLELCFGIPLFSSELNRKVCRKIAAHGLCRKESLQNLLHSSRKLSLQVLNFVHSFQVTKTKKSKWYLY

SEQ ID NO: 750762 - protein, 454 aa, Homo sapiens; identical to SEQ ID NO: 750758

SEQ ID NO: 750763 - protein, 454 aa, Homo sapiens; identical to SEQ ID NO: 750758

SEQ ID NO: 750764 - protein, 107 aa, Homo sapiens
MWVAVAAPAAGPGRGIMNIDVEFHIRHNYPWNKLPANVRQSLGNSQREYEKQVVLYSIRNQLRYRNNLVKHVKKDERRYYEELLKYSRDHLMLYPNHQSDIVCYVCL

SEQ ID NO: 750765 - protein, 454 aa, Homo sapiens; identical to SEQ ID NO: 750758

SEQ ID NO: 750766 - protein, 929 aa, Homo sapiens
DPNSRPRRLERTALFLLTGGDGGCGGGGTRLLRGMKIGSGFLSGGGGTGSSGGSGSGGGGSGGGGGGGSSGRRAEMEPTFPQGMVMFNHRLPPVTSFTRPAGSAAPPPQCVLSSSTSAAPAAEPPPPPAPDMTFKKEPAASAAAFPSQRTSWGFLQSLVSIKQEKPADPEEQQSHHHHHHHHYGGLFAGAEERSPGLGGGEGGSHGVIQDLSILHQHVQQQPAQHHRDVLLSSSSRTDDHHGTEEPKQDTNVKKAKRPKPESQGIKAKRKPSASSKPSLVGDGEGAILSPSQKPHICDHCSAAFRSSYHLRRHVLIHTGERPFQCSQCSMGFIQKYLLQRHEKIHSREKPFGCDQCSMKFIQKYHMERHKRTHSGEKPYKCDTCQQYFSRTDRLLKHRRTCGEVIVKGATSAEPGSSNHTNMGNLAVLSQGNTSSSRRKTKSKSIAIENKEQKTGKTNESQISNNINMQSYSVEMPTVSSSGGIIGTGIDELQKRVPKLIFKKGSRKNTDKNYLNFVSPLPDIVGQKSLSGKPSGSLGIVSNNSVETIGLLQSTSGKQGQISSNYDDAMQFSKKRRYLPTASSNSAFSINVGHMVSQQSVIQSAGVSVLDNEAPLSLIDSSALNAEIKSCHDKSGIPDEVLQSILDQYSNKSESQKEDPFNIAEPRVDLHTSGEHSELVQEENLSPGTQTPSNDKASMLQEYSKYLQQAFEKSTNASFTLGHGFQFVSLSSPLHNHTLFPEKQIYTTSPLECGFGQSVTSVLPSSLPKPPFGMLFGSQPGLYLSALDATHQQLTPSQELDDLIDSQKNLETSSAFQSSSQKLTSQKEQKNLESSTGFQIPSQELASQIDPQKDIEPRTTYQIENFAQAFGSQFKSGSRVPMTFITNSNGEVDHRVRTSVSDFSGYTNMMSDVSEPCSTRVKTPTSQSYR

SEQ ID NO: 750767 - protein, 929 aa, Homo sapiens; identical to SEQ ID NO: 750766

SEQ ID NO: 750768 - protein, 929 aa, Homo sapiens; identical to SEQ ID NO: 750766

SEQ ID NO: 750769 - protein, 743 aa, Homo sapiens
HAGPGWCWAGCCWTCWGSHGVIQDLSILHQHVQQQPAQHHRDVLLSSSSRTDDHHGTEEPKQDTNVKKAKRPKPESQGIKAKRKPSASSKPSLVGDGEGAILSPSQKPHICDHCSAAFRSSYHLRRHVLIHTGERPFQCSQCSMGFIQKYLLQRHEKIHSREKPFGCDQCSMKFIQKYHMERHKRTHSGEKPYKCDTCQQYFSRTDRLLKHRRTCGEVIVKGATSAEPGSSNHTNMGNLAVLSQGNTSSSRRKTKSKSIAIENKEQKTGKTNESQISNNINMQSYSVEMPTVSSSGGIIGTGIDELQKRVPKLIFKKGSRKNTDKNYLNFVSPLPDIVGQKSLSGKPSGSLGIVSNNSVETIGLLQSTSGKQGQISSNYDDAMQFSKKRRYLPTASSNSAFSINVGHMVSQQSVIQSAGVSVLDNEAPLSLIDSSALNAEIKSCHDKSGIPDEVLQSILDQYSNKSESQKEDPFNIAEPRVDLHTSGEHSELVQEENLSPGTQTPSNDKASMLQEYSKYLQQAFEKSTNASFTLGHGFQFVSLSSPLHNHTLFPEKQIYTTSPLECGFGQSVTSVLPSSLPKPPFGMLFGSQPGLYLSALDATHQQLTPSQELDDLIDSQKNLETSSAFQSSSQKLTSQKEQKNLESSTGFQIPSQELASQIDPQKDIEPRTTYQIENFAQAFGSQFKSGSRVPMTFITNSNGEVDHRVRTSVSDFSGYTNMMSDVSEPCSTRVKTPTSQSYR

SEQ ID NO: 750770 - protein, 893 aa, Homo sapiens
DPNSRPRRLERTALFLLTGGDGGCGGGGTRLLRGMKIGSGFLSGGGGTGSSGGSGSGGGGSGGGGGGGSSGRRAEMEPTFPQAPAAEPPPPPAPDMTFKKEPAASAAAFPSQRTSWGFLQSLVSIKQEKPADPEEQQSHHHHHHHHYGGLFAGAEERSPGLGGGEGGSHGVIQDLSILHQHVQQQPAQHHRDVLLSSSSRTDDHHGTEEPKQDTNVKKAKRPKPESQGIKAKRKPSASSKPSLVGDGEGAILSPSQKPHICDHCSAAFRSSYHLRRHVLIHTGERPFQCSQCSMGFIQKYLLQRHEKIHSREKPFGCDQCSMKFIQKYHMERHKRTHSGEKPYKCDTCQQYFSRTDRLLKHRRTCGEVIVKGATSAEPGSSNHTNMGNLAVLSQGNTSSSRRKTKSKSIAIENKEQKTGKTNESQISNNINMQSYSVEMPTVSSSGGIIGTGIDELQKRVPKLIFKKGSRKNTDKNYLNFVSPLPDIVGQKSLSGKPSGSLGIVSNNSVETIGLLQSTSGKQGQISSNYDDAMQFSKKRRYLPTASSNSAFSINVGHMVSQQSVIQSAGVSVLDNEAPLSLIDSSALNAEIKSCHDKSGIPDEVLQSILDQYSNKSESQKEDPFNIAEPRVDLHTSGEHSELVQEENLSPGTQTPSNDKASMLQEYSKYLQQAFEKSTNASFTLGHGFQFVSLSSPLHNHTLFPEKQIYTTSPLECGFGQSVTSVLPSSLPKPPFGMLFGSQPGLYLSALDATHQQLTPSQELDDLIDSQKNLETSSAFQSSSQKLTSQKEQKNLESSTGFQIPSQELASQIDPQKDIEPRTTYQIENFAQAFGSQFKSGSRVPMTFITNSNGEVDHRVRTSVSDFSGYTNMMSDVSEPCSTRVKTPTSQSYR

SEQ ID NO: 750771 - protein, 929 aa, Homo sapiens; identical to SEQ ID NO: 750766

SEQ ID NO: 750772 - protein, 936 aa, Homo sapiens
TAPRLRSTREAFNSIVERTALFLLTGGDGGCGGGGTRLLRGMKIGSGFLSGGGGTGSSGGSGSGGGGSGGGGGGGSSGRRAEMEPTFPQGMVMFNHRLPPVTSFTRPAGSAAPPPQCVLSSSTSAAPAAEPPPPPAPDMTFKKEPAASAAAFPSQRTSWGFLQSLVSIKQEKPADPEEQQSHHHHHHHHYGGLFAGAEERSPGLGGGEGGSHGVIQDLSILHQHVQQQPAQHHRDVLLSSSSRTDDHHGTEEPKQDTNVKKAKRPKPESQGIKAKRKPSASSKPSLVGDGEGAILSPSQKPHICDHCSAAFRSSYHLRRHVLIHTGERPFQCSQCSMGFIQKYLLQRHEKIHSREKPFGCDQCSMKFIQKYHMERHKRTHSGEKPYKCDTCQQYFSRTDRLLKHRRTCGEVIVKGATSAEPGSSNHTNMGNLAVLSQGNTSSSRRKTKSKSIAIENKEQKTGKTNESQISNNINMQSYSVEMPTVSSSGGIIGTGIDELQKRVPKLIFKKGSRKNTDKNYLNFVSPLPDIVGQKSLSGKPSGSLGIVSNNSVETIGLLQSTSGKQGQISSNYDDAMQFSKKRRYLPTASSNSAFSINVGHMVSQQSVIQSAGVSVLDNEAPLSLIDSSALNAEIKSCHDKSGIPDEVLQSILDQYSNKSESQKEDPFNIAEPRVDLHTSGEHSELVQEENLSPGTQTPSNDKASMLQEYSKYLQQAFEKSTNASFTLGHGFQFVSLSSPLHNHTLFPEKQIYTTSPLECGFGQSVTSVLPSSLPKPPFGMLFGSQPGLYLSALDATHQQLTPSQELDDLIDSQKNLETSSAFQSSSQKLTSQKEQKNLESSTGFQIPSQELASQIDPQKDIEPRTTYQIENFAQAFGSQFKSGSRVPMTFITNSNGEVDHRVRTSVSDFSGYTNMMSDVSEPCSTRVKTPTSQSYR

SEQ ID NO: 750773 - protein, 929 aa, Homo sapiens; identical to SEQ ID NO: 750766

SEQ ID NO: 750774 - protein, 256 aa, Homo sapiens
DPNSRPRRLERTALFLLTGGDGGCGGGGTRLLRGMKIGSGFLSGGGGTGSSGGSGSGGGGSGGGGGGGSSGRRAEMEPTFPQGMVMFNHRLPPVTSFTRPAGSAAPPPQCVLSSSTSAAPAAEPPPPPAPDMTFKKEPAASAAAFPSQRTSWGFLQSLVSIKQEKPADPEEQQSHHHHHHHHYGGLFAGAEERSPGLGGGEGGSHGVIQDLSILHQHVQQQPAQHHRDVLLSSSSRTDDHHGTEEPKQDTCQALPL

SEQ ID NO: 750775 - protein, 244 aa, Homo sapiens
MAAAASPAILPRLAILPYLLFDWSGTGRADAHSLWYNFTIIHLPRHGQQWCEVQSQVDQKNFLSYDCGSDKVLSMGHLEEQLYATDAWGKQLEMLREVGQRLRLELADTELEDFTPSGPLTLQVRMSCECEADGYIRGSWQFSFDGRKFLLFDSNNRKWTVVHAGARRMKEKWEKDSGLTTFFKMVSMRDCKSWLRDFLMHRKKRLEPTAPPTMAPGLAQPKAIATTLSPWSFLIILCFILPGI

SEQ ID NO: 750776 - protein, 288 aa, Homo sapiens
RGRAQRAGRWARWRLPSDSPRIPPAGAETPGRGSCRNYLPSSSPPPPEPSSFPSPPTSRGGPGSRDTMSDSEEESQDRQLKIVVLGDGASGKTSLTTCFAQETFGKQYKQTIGLDFFLRRITLPGNLNVTLQIWDIGGQTIGGKMLDKYIYGAQGVLLVYDITNYQSFENLEDWYTVVKKVSEESETQPLVALVGNKIDLEHMRTIKPEKHLRFCQENGFSSHFVSAKTGDSVFLCFQKVAAEILGIKLNKAEIEQSQRVVKADIVNYNQEPMSRTVNPPRSSMCAVQ

SEQ ID NO: 750777 - protein, 287 aa, Homo sapiens
RGRAQRAGRWARWRLPSDSPRIPPAGAETPGRGSCRNYLPSSSPPPPEPSSFPSPPTSRGGPGSRDTMSDSEEESQDRQLKIVVLGDGASGKTSLTTCFAQETFGKQYKQTIGLDFFLRRITLPGNLNVTLQIWDIGGQTIGGKMLDKYIYGAQGVLLVYDITNYQSFENLEDWYTVVKKVSEESETQPLVALVGNKIDLEHMRTIKPEKHLRFCQENGFSSHFVSAKTGDSVFLCFQKVAAEILGIKLNKAEIEQSQRIVRAEIVKYPEEENQHTTSTQSRICSVQ

SEQ ID NO: 750778 - protein, 287 aa, Homo sapiens; identical to SEQ ID NO: 750777

SEQ ID NO: 750779 - protein, 260 aa, Homo sapiens
RGRAQRAGRWARWRLPSDSPRIPPAGAETPGRGSCRNYLPSSSPPPPEPSSFPSPPTSRGGPGSRDTMSDSEEESQDRQLKIVVLGDGASGKTSLTTCFAQETFGKQYKQTIGLDFFLRRITLPGNLNVTLQIWDIGGQTIGGKMLDKYIYGAQGVLLVYDITNYQSFENLEDWYTVVKKVSEESETQPLVALVGNKIDLEHMRTIKPEKHLRFCQENGFSSHFVSAKTGDSVFLCFQKVAAEILGIKLNKAEIEQSQIY

SEQ ID NO: 750780 - protein, 122 aa, Homo sapiens
PRIPPAGADDTWVRVVPDLQLPVPSIRLPRPTEAFILTHCLTTPIEGGGAWYPEDIMIRRSEEREHRIGKLKIVVLGGQGASGKQLLNVRVLLKNTFGKQYKTNLYGLDYVYFEKDNSCQET

SEQ ID NO: 750781 - protein, 162 aa, Homo sapiens
RGRAQRAGRWARWRLPSDSPRIPPAGAETPGRGSCRNYLPSSSPPPPEPSSFPSPPTSRGGPGSRDTMSDSEEESQDRQLKIVVLGDGASGKTSLTTCFAQETFGKQYKQTIGLDFFLRRITLPGNLNVTLQIWDIGGQTIGGKMLDKYIYGAQLIWSICEQ

SEQ ID NO: 750782 - protein, 287 aa, Homo sapiens; identical to SEQ ID NO: 750777

SEQ ID NO: 750783 - protein, 206 aa, Homo sapiens
RGRAQRAGRWARWRLPSDSPRIPPAGAETPGRGSCRNYLPSSSPPPPEPSSFPSPPTSRGGPGSRDTMSDSEEESQDRQLKIVVLGDGASGKTSLTTCFAQETFGKQYKQTIGLDFFLRRITLPGNLNVTLQIWDIGGQTIGGKMLDKYIYGAQGVLLVYDITNYQSFENLEDWYTVVKKVSEESETQPLVALVGNKIDLEHFFYS

SEQ ID NO: 750784 - protein, 42 aa, Homo sapiens
TLVLWSPGQRLTGDACDSHWCAGRRVRDSLGTHVIHTGVLAA

SEQ ID NO: 750785 - protein, 121 aa, Homo sapiens
MQASQGSSVFPIVTLHGLRLHTVFVCTACQRVIMTSIWHRPVCPLSWLVPSAAFSNWGPGCRAVCSPRWATPAKIPTPKCDRVAHEEGSALRVPSRVHSSSQLLRVAPASPTSSLSPVMSR

SEQ ID NO: 750786 - protein, 121 aa, Homo sapiens; identical to SEQ ID NO: 750785

SEQ ID NO: 750787 - protein, 121 aa, Homo sapiens; identical to SEQ ID NO: 750785

SEQ ID NO: 750788 - protein, 113 aa, Homo sapiens
MGLRRSPYLWRRALRAAAGPLARDTLSPEPAAREAPLLLPSWVQELWQTRRRSSQAGIPVRAPRSPRAPEPALEPESLDFSGAGQRLRRDVSRPAVDPAANRLGLPCLAPGPF

SEQ ID NO: 750789 - protein, 167 aa, Homo sapiens
GRSTMSRPLEGPRGHAASPGLLWATRVTSTLAGLHELALSDETRHNWFASQMNKGSCLSPARLLSCCPRGFRSCGRRDAGAPRQGSPSVRPGARAPQSLRWNRSPWTSAELARDFGETSPAQRWTPQQTALACPAWPPDRSDSVPRPPVAPPRLTQEEWPRASRSRS

SEQ ID NO: 750790 - protein, 2223 aa, Homo sapiens
MAESASPPSSSAAAPAAEPGVTTEQPGPRSPPSSPPGLEEPLDGADPHVPHPDLAPIAFFCLRQTTSPRNWCIKMVCNPWFECVSMLVILLNCVTLGMYQPCDDMDCLSDRCKILQVFDDFIFIFFAMEMVLKMVALGIFGKKCYLGDTWNRLDFFIVMAGMVEYSLDLQNINLSAIRTVRVLRPLKAINRVPSMRILVNLLLDTLPMLGNVLLLCFFVFFIFGIIGVQLWAGLLRNRCFLEENFTIQGDVALPPYYQPEEDDEMPFICSLSGDNGIMGCHEIPPLKEQGRECCLSKDDVYDFGAGRQDLNASGLCVNWNRYYNVCRTGSANPHKGAINFDNIGYAWIVIFQVITLEGWVEIMYYVMDAHSFYNFIYFILLIIVGSFFMINLCLVVIATQFSETKQREHRLMLEQRQRYLSSSTVASYAEPGDCYEEIFQYVCHILRKAKRRALGLYQALQSRRQALGPEAPAPAKPGPHAKEPRHYHGKTKGQGDEGRHLGSRHCQTLHGPASPGNDHSGRELCPQHSPLDATPHTLVQPIPATLASDPASCPCCQHEDGRRPSGLGSTDSGQEGSGSGSSAGGEDEADGDGARSSEDGASSELGKEEEEEEQADGAVWLCGDVWRETRAKLRGIVDSKYFNRGIMMAILVNTVSMGIEHHEQPEELTNILEICNVVFTSMFALEMILKLAAFGLFDYLRNPYNIFDSIIVIISIWEIVGQADGGLSVLRTFRLLRVLKLVRFMPALRRQLVVLMKTMDNVATFCMLLMLFIFIFSILGMHIFGCKFSLRTDTGDTVPDRKNFDSLLWAIVTVFQILTQEDWNVVLYNGMASTSPWASLYFVALMTFGNYVLFNLLVAILVEGFQAEGDANRSYSDEDQSSSNIEEFDKLQEGLDSSGDPKLCPIPMTPNGHLDPSLPLGGHLGPAGAAGPAPRLSLQPDPMLVALGSRKSSVMSLGRMSYDQRSLSSSRSSYYGPWGRSAAWASRRSSWNSLKHKPPSAEHESLLSAERGGGARVCEVAADEGPPRAAPLHTPHAHHIHHGPHLAHRHRHHRRTLSLDNRDSVDLAELVPAVGAHPRAAWRAAGPAPGHEDCNGRMPSIAKDVFTKMGDRGDRGEDEEEIDYTLCFRVRKMIDVYKPDWCEVREDWSVYLFSPENRFRVLCQTIIAHKLFDYVVLAFIFLNCITIALERPQIEAGSTERIFLTVSNYIFTAIFVGEMTLKVVSLGLYFGEQAYLRSSWNVLDGFLVFVSIIDIVVSLASAGGAKILGVLRVLRLLRTLRPLRVISRAPGLKLVVETLISSLKPIGNIVLICCAFFIIFGILGVQLFKGKFYHCLGVDTRNITNRSDCMAANYRWVHHKYNFDNLGQALMSLFVLASKDGWVNIMYNGLDAVAVDQQPVTNHNPWMLLYFISFLLIVSFFVLNMFVGVVVENFHKCRQHQEAEEARRREEKRLRRLEKKRRKAQRLPYYATYCHTRLLIHSMCTSHYLDIFITFIICLNVVTMSLEHYNQPTSLETALKYCNYMFTTVFVLEAVLKLVAFGLRRFFKDRWNQLDLAIVLLSVMGITLEEIEINAALPINPTIIRIMRVLRIARVLKLLKMATGMRALLDTVVQALPQVGNLGLLFMLLFFIYAALGVELFGKLVCNDENPCEGMSRHATFENFGMAFLTLFQVSTGDNWNGIMKDTLRDCTHDERSCLSSLQFVSPLYFVSFVLTAQFVLINVVVAVLMKHLDDSNKEAQEDAEMDAELELEMAHGLGPGPRLPTGSPGAPGRGPGGAGGGGDTEGGLCRRCYSPAQENLWLDSVSLIIKDSLEGELTIIDNLSGSIFHHYSSPAGCKKCHHDKQEVQLAETEAFSLNSDRSSSILLGDDLSLEDPTACPPGRKDSKGELDPPEPMRVGDLGECFFPLSSTAVSPDPENFLCEMEEIPFNPVRSWLKHDSSQAPPSPFSPDASSPLLPMPAEFFHPAVSASQKGPEKGTGTGTLPKIALQGSWASLRSPRVNCTLLRQATGSDTSLDASPSSSAGSLQTTLEDSLTLSDSPRRALGPPAPAPGPRAGLSPAARRRLSLRGRGLFSLRGLRAHQRSHSSGGSTSPGCTHHDSMDPSDEEGRGGAGGGGAGSEHSETLSSLSLTSLFCPPPPPPAPGLTPARKFSSTSSLAAPGRPHAAALAHGLARSPSWAADRSKDPPGRAPLPMGLGPLAPPPQPLPGELEPGDAASKRKR

SEQ ID NO: 750791 - protein, 2016 aa, Homo sapiens
MAESASPPSSSAAAPAAEPGVTTEQPGPRSPPSSPPGLEEPLDGADPHVPHPDLAPIAFFCLRQTTSPRNWCIKMVCNPWFECVSMLVILLNCVTLGMYQPCDDMDCLSDRCKILQVFDDFIFIFFAMEMVLKMVALGIFGKKCYLGDTWNRLDFFIVMAGMVEYSLDLQNINLSAIRTVRVLRPLKAINRVPSMRILVNLLLDTLPMLGNVLLLCFFVFFIFGIIGVQLWAGLLRNRCFLEENFTIQGDVALPPYYQPEEDDEMPFICSLSGDNGIMGCHEIPPLKEQGRECCLSKDDVYDFGAGRQDLNASGLCVNWNRYYNVCRTGSANPHKGAINFDNIGYAWIVIFQVITLEGWVEIMYYVMDAHSFYNFIYFILLIIVGSFFMINLCLVVIATQFSETKQREHRLMLEQRQRYLSSSTVASYAEPGDCYEEIFQYVCHILRKAKRRALGLYQALQSRRQALGPEAPAPAKPGPHAKEPRHYHGKTKGQGDEGRHLGSRHCQTLHGPASPGNDHSGRELCPQHSPLDATPHTLVQPIPATLASDPASCPCCQHEDGRRPSGLGSTDSGQEGSGSGSSAGGEDEADGDGARSSEDGASSELGKEEEEEEQADGAVWLCGDVWRETRAKLRGIVDSKYFNRGIMMAILVNTVSMGIEHHEQPEELTNILEICNVVFTSMFALEMILKLAAFGLFDYLRNPYNIFDSIIVIISIWEIVGQADGGLSVLRTFRLLRVLKLVRFMPALRRQLVVLMKTMDNVATFCMLLMLFIFIFSILGMHIFGCKFSLRTDTGDTVPDRKNFDSLLWAIVTVFQILTQEDWNVVLYNGMASTSPWASLYFVALMTFGNYVLFNLLVAILVEGFQAEGDANRSYSDEDQSSSNIEEFDKLQEGLDSSGDPKLCPIPMTPNGHLDPSLPLGGHLGPAGAAGPAPRLSLQPDPMLVALGSRKSSVMSLGRMSYDQRSLSSSRSSYYGPWGRSAAWASRRSSWNSLKHKPPSAEHESLLSAERGGGARVCEVAADEGPPRAAPLHTPHAHHIHHGPHLAHRHRHHRRTLSLDNRDSVDLAELVPAVGAHPRAAWRAAGPAPGHEDCNGRMPSIAKDVFTKMGDRGDRGEDEEEIDYTLCFRVRKMIDVYKPDWCEVREDWSVYLFSPENRFRVLCQTIIAHKLFDYVVLAFIFLNCITIALERPQIEAGSTERIFLTVSNYIFTAIFVGEMTLKVVSLGLYFGEQAYLRSSWNVLDGFLVFVSIIDIVVSLASAGGAKILGVLRVLRLLRTLRPLRVISRAPGLKLVVETLISSLKPIGNIVLICCAFFIIFGILGVQLFKGKFYHCLGVDTRNITNRSDCMAANYRWVHHKYNFDNLGQALMSLFVLASKDGWVNIMYNGLDAVAVDQQPVTNHNPWMLLYFISFLLIVSFFVLNMFVGVVVENFHKCRQHQEAEEARRREEKRLRRLEKKRRKAQRLPYYATYCHTRLLIHSMCTSHYLDIFITFIICLNVVTMSLEHYNQPTSLETALKYCNYMFTTVFVLEAVLKLVAFGLRRFFKDRWNQLDLAIVLLSVMGITLEEIEINAALPINPTIIRIMRVLRIARVLKLLKMATGMRALLDTVVQALPQVGNLGLLFMLLFFIYAALGVELFGKLVCNDENPCEGMSRHATFENFGMAFLTLFQVSTGDNWNGIMKDTLRDCTHDERSCLSSLQFVSPLYFVSFVLTAQFVLINVVVAVLMKHLDDSNKEAQEDAEMDAELELEMAHGLGPGPRLPTGSPGAPGRGPGGAGGGGDTEGGLCRRCYSPAQENLWLDSVSLIIKDSLEGELTIIDNLSGSIFHHYSSPAGCKKCHHDKQEVQLAETEAFSLNSDRSSSILLGDDLSLEDPTACPPGRKDSKGELDPPEPMRVGDLGECFFPLSSTAVSPDPENFLCEMEEIPFNPVRSWLKHDSSQAPPSPFSPDASSPLLPMPAEFFHPAVSASQKGPEKGTGTGTLPKIALQGSWASLRSPRVNCTLLRQVPTPPRP

SEQ ID NO: 750792 - protein, 1981 aa, Homo sapiens
MAESASPPSSSAAAPAAEPGVTTEQPGPRSPPSSPPGLEEPLDGADPHVPHPDLAPIAFFCLRQTTSPRNWCIKMVCNPWFECVSMLVILLNCVTLGMYQPCDDMDCLSDRCKILQVFDDFIFIFFAMEMVLKMVALGIFGKKCYLGDTWNRLDFFIVMAGMVEYSLDLQNINLSAIRTVRVLRPLKAINRVPSMRILVNLLLDTLPMLGNVLLLCFFVFFIFGIIGVQLWAGLLRNRCFLEENFTIQGDVALPPYYQPEEDDEMPFICSLSGDNGIMGCHEIPPLKEQGRECCLSKDDVYDFGAGRQDLNASGLCVNWNRYYNVCRTGSANPHKGAINFDNIGYAWIVIFQVITLEGWVEIMYYVMDAHSFYNFIYFILLIIVGSFFMINLCLVVIATQFSETKQREHRLMLEQRQRYLSSSTVASYAEPGDCYEEIFQYVCHILRKAKRRALGLYQALQSRRQALGPEAPAPAKPGPHAKEPRHYQLCPQHSPLDATPHTLVQPIPATLASDPASCPCCQHEDGRRPSGLGSTDSGQEGSGSGSSAGGEDEADGDGARSSEDGASSELGKEEEEEEQADGAVWLCGDVWRETRAKLRGIVDSKYFNRGIMMAILVNTVSMGIEHHEQPEELTNILEICNVVFTSMFALEMILKLAAFGLFDYLRNPYNIFDSIIVIISIWEIVGQADGGLSVLRTFRLLRVLKLVRFMPALRRQLVVLMKTMDNVATFCMLLMLFIFIFSILGMHIFGCKFSLRTDTGDTVPDRKNFDSLLWAIVTVFQILTQEDWNVVLYNGMASTSPWASLYFVALMTFGNYVLFNLLVAILVEGFQAEGDANRSYSDEDQSSSNIEEFDKLQEGLDSSGDPKLCPIPMTPNGHLDPSLPLGGHLGPAGAAGPAPRLSLQPDPMLVALGSRKSSVMSLGRMSYDQRSLSSSRSSYYGPWGRSAAWASRRSSWNSLKHKPPSAEHESLLSAERGGGARVCEVAADEGPPRAAPLHTPHAHHIHHGPHLAHRHRHHRRTLSLDNRDSVDLAELVPAVGAHPRAAWRAAGPAPGHEDCNGRMPSIAKDVFTKMGDRGDRGEDEEEIDYTLCFRVRKMIDVYKPDWCEVREDWSVYLFSPENRFRVLCQTIIAHKLFDYVVLAFIFLNCITIALERPQIEAGSTERIFLTVSNYIFTAIFVGEMTLKVVSLGLYFGEQAYLRSSWNVLDGFLVFVSIIDIVVSLASAGGAKILGVLRVLRLLRTLRPLRVISRAPGLKLVVETLISSLKPIGNIVLICCAFFIIFGILGVQLFKGKFYHCLGVDTRNITNRSDCMAANYRWVHHKYNFDNLGQALMSLFVLASKDGWVNIMYNGLDAVAVDQQPVTNHNPWMLLYFISFLLIVSFFVLNMFVGVVVENFHKCRQHQEAEEARRREEKRLRRLEKKRRKAQRLPYYATYCHTRLLIHSMCTSHYLDIFITFIICLNVVTMSLEHYNQPTSLETALKYCNYMFTTVFVLEAVLKLVAFGLRRFFKDRWNQLDLAIVLLSVMGITLEEIEINAALPINPTIIRIMRVLRIARVLKLLKMATGMRALLDTVVQALPQVGNLGLLFMLLFFIYAALGVELFGKLVCNDENPCEGMSRHATFENFGMAFLTLFQVSTGDNWNGIMKDTLRDCTHDERSCLSSLQFVSPLYFVSFVLTAQFVLINVVVAVLMKHLDDSNKEAQEDAEMDAELELEMAHGLGPGPRLPTGSPGAPGRGPGGAGGGGDTEGGLCRRCYSPAQENLWLDSVSLIIKDSLEGELTIIDNLSGSIFHHYSSPAGCKKCHHDKQEVQLAETEAFSLNSDRSSSILLGDDLSLEDPTACPPGRKDSKGELDPPEPMRVGDLGECFFPLSSTAVSPDPENFLCEMEEIPFNPVRSWLKHDSSQAPPSPFSPDASSPLLPMPAEFFHPAVSASQKGPEKGTGTGTLPKIALQGSWASLRSPRVNCTLLRQVPTPPRP

SEQ ID NO: 750793 - protein, 327 aa, Homo sapiens
MRVGDLGECFFPLSSTAVSPDPENFLCEMEEIPFNPVRSWLKHDSSQAPPSPFSPDASSPLLPMPAEFFHPAVSASQKGPEKGTGTGTLPKIALQGSWASLRSPRVNCTLLRQATGSDTSLDASPSSSAGSLQTTLEDSLTLSDSPRRALGPPAPAPGPRAGLSPAARRRLSLRGRGLFSLRGLRAHQRSHSSGGSTSPGCTHHDSMDPSDEEGRGGAGGGGAGSEHSETLSSLSLTSLFCPPPPPPAPGLTPARKFSSTSSLAAPGRPHAAALAHGLARSPSWAADRSKDPPGRAPLPMGLGPLAPPPQPLPGELEPGDAASKRKR

SEQ ID NO: 750794 - protein, 408 aa, Homo sapiens
MAESASPPSSSAAAPAAEPGVTTEQPGPRSPPSSPPGLEEPLDGADPHVPHPDLAPIAFFCLRQTTSPRNWCIKMVCNPWFECVSMLVILLNCVTLGMYQPCDDMDCLSDRCKILQVFDDFIFIFFAMEMVLKMVALGIFGKKCYLGDTWNRLDFFIVMAGMVEYSLDLQNINLSAIRTVRVLRPLKAINRVPSMRILVNLLLDTLPMLGNVLLLCFFVFFIFGIIGVQLWAGLLRNRCFLEENFTIQGDVALPPYYQPEEDDEMPFICSLSGDNGIMGCHEIPPLKEQGRECCLSKDDVYDFGAGRQDLNASGLCVNWNRYYNVCRTGSANPHKGAINFDNIGYAWIVIFQVITLEGWVEIMYYVMDAHSFYNFIYFILLIIPLLPAPPYGLPRVSSSTSSCLTAAS

SEQ ID NO: 750795 - protein, 120 aa, Homo sapiens
MITAGPPAITSVFQKGSRRWMLISPTVVGEQAHLILLCSLFQKDIHRRCYRRFGGKMSGHVVRALMDEKVLGKEPGKGNLSRANSTCKRPEVSESDLAGAQERRRGVEVGRAGPQAVLGT

SEQ ID NO: 750796 - protein, 1244 aa, Homo sapiens
MLIKEYHILLPMSLDEYQVAQLYMIQKKSREESSGEGSGVEILANRPYTDGPGGSGQYTHKVYHVGSHIPGWFRALLPKAALQVEEESWNAYPYTRTRYTCPFVEKFSIEIETYYLPDGGQQPNVFNLSGAERRQRILDTIDIVRDAVAPGEYKAEEDPRLYHSVKTGRGPLSDDWARTAAQTGPLMCAYKLCKVEFRYWGMQAKIEQFIHDVGLRRVMLRAHRQAWCWQDEWTELSMADIRALEEETARMLAQRMAKCNTGSEGSEAQPPGKPSTEARSAASNTGTPDGPEAPPGPDASPDASFGKQWSSSSRSSYSSQHGGAVSPQSLSEWRMQNIARDSENSSEEEFFDAHEGFSDSEEVFPKEMTKWNSNDFIDAFASPVEAEGTPEPGAEAAKGIEDGAQAPRDSEGLDGAGELGAEACAVHALFLILHSGNILDSGPGDANSKQADVQTLSSAFEAVTRIHFPEALGHVALRLVPCPPICAAAYALVSNLSPYSHDGDSLSRSQDHIPLAALPLLATSSSRYQGAVATVIARTNQAYSAFLRSPEGAGFCGQVALIGDGVGGILGFDALCHSANAGTGSRGSSRRGSMNNELLSPEFGPVRDPLADGVEGLGRGSPEPSALPPQRIPSDMASPEPEGSQNSLQAAPATTSSWEPRRASTAFCPPAASSEAPDGPSSTARLDFKVSGFFLFGSPLGLVLALRKTVMPALEAAQMRPACEQIYNLFHAADPCASRLEPLLAPKFQAIAPLTVPRYQKFPLGDGSSLLLADTLQTHSSLFLEELEMLVPSTPTSTSGAFWKGSELATDPPAQPAAPSTTSEVVKILERWWGTKRIDYSLYCPEALTAFPTVTLPHLFHASYWESADVVAFILRQVIEKERPQLAECEEPSIYSPAFPREKWQRKRTQVKIRNVTSNHRASDTVVCEGRPQVLSGRFMYGPLDVVTLTGEKVDVYIMTQPLSGKWIHFGTEVTNSSGRLTFPVPPERALGIGVYPVRMVVRGDHTYAECCLTVVARGTEAVVFSIDGSFTASVSIMGSDPKVRAGAVDVVRHWQDSGYLIVYVTGRPDMQKHRVVAWLSQHNFPHGVVSFCDGLTHDPLRQKAMFLQSLVQEVELNIVAGYGSPKDVAVYAALGLSPSQTYIVGRAVRKLQAQCQFLSDGYVAHLGQLEAGSHSHASSGPPRAALGKSSYGVAAPVDFLRKQSQLLRSRGPSQAEREGPGTPPTTLARGKARSISLKLDSEE

SEQ ID NO: 750797 - protein, 1420 aa, Homo sapiens
RRGGTAGAPAGGSRGRSGPWAGTAPREGPATAGTRGRGWGRSGLRPTGRPALPGLGEGRPPQARGGAEAARGPPSAFRMLIKEYHILLPMSLDEYQVAQLYMIQKKSREESSGEGSGVEILANRPYTDGPGGSGQYTHKVYHVGSHIPGWFRALLPKAALQVEEESWNAYPYTRTRGMGELGMVRGQEGSGPGGYSSEPHPCLLPRYTCPFVEKFSIEIETYYLPDGGQQPNVFNLSGAERRQRILGEAWSYGGTLAPLSGSWLPQWAASEKSQPSPGLMSCLQKDGNCHPVPRGCQERGLKGAGAAQCCRTPSDTIDIVRDAVAPGEYKAEEDPRLYHSVKTGRGPLSDDWARTAAQTGPLMCAYKLCKVEFRYWGMQAKIEQFIHDVGLRRVMLRAHRQAWCWQDEWTELSMADIRALEEETARMLAQRMAKCNTGSEGSEAQPPGKPSTEARSAASNTGTPDGPEAPPGPDASPDASFGKQWSSSSRSSYSSQHGGAVSPQSLSEWRMQNIARDSENSSEEEFFDAHEGFSDSEEVFPKEMTKWNSNDFIDAFASPVEAEGTPEPGAEAAKGIEDGAQAPRDSEGLDGAGELGAEACAVHALFLILHSGNILDSGPGDANSKQADVQTLSSAFEAVTRIHFPEALGHVALRLVPCPPICAAAYALVSNLSPYSHDGDSLSRSQDHIPLAALPLLATSSSRYQGAVATVIARTNQAYSAFLRSPEGAGFCGQVALIGDGVGGILGFDALCHSANAGTGSRGSSRRGSMNNELLSPEFGPVRDPLADGVEGLGRGSPEPSALPPQRIPSDMASPEPEGSQNSLQAAPATTSSWEPRRASTAFCPPAASSEAPDGPSSTARLDFKVSGFFLFGSPLGLVLALRKTVMPALEAAQMRPACEQIYNLFHAADPCASRLEPLLAPKFQAIAPLTVPRYQKFPLGDGSSLLLADTLQTHSSLFLEELEMLVPSTPTSTSGAFWKGSELATDPPAQPAAPSTTSEVVKILERWWGTKRIDYSLYCPEALTAFPTVTLPHLFHASYWESADVVAFILRQVIEKERPQLAECEEPSIYSPAFPREKWQRKRTQVKIRNVTSNHRASDTVVCEGRPQVLSGRFMYGPLDVVTLTGEKVDVYIMTQPLSGKWIHFGTEVTNSSGRLTFPVPPERALGIGVYPVRMVVRGDHTYAECCLTVVARGTEAVVFSIDGSFTASVSIMGSDPKVRAGAVDVVRHWQDSGYLIVYVTGRPDMQKHRVVAWLSQHNFPHGVVSFCDGLTHDPLRQKAMFLQSLVQEVELNIVAGYGSPKDVAVYAALGLSPSQTYIVGRAVRKLQAQCQFLSDGYVAHLGQLEAGSHSHASSGPPRAALGKSSYGVAAPVDFLRKQSQLLRSRGPSQAEREGPGTPPTTLARGKARSISLKLDSEE

SEQ ID NO: 750798 - protein, 1322 aa, Homo sapiens
RRGGTAGAPAGGSRGRSGPWAGTAPREGPATAGTRGRGWGRSGLRPTGRPALPGLGEGRPPQARGGAEAARGPPSAFRMLIKEYHILLPMSLDEYQVAQLYMIQKKSREESSGEGSGVEILANRPYTDGPGGSGQYTHKVYHVGSHIPGWFRALLPKAALQVEEESWNAYPYTRTRYTCPFVEKFSIEIETYYLPDGGQQPNVFNLSGAERRQRILDTIDIVRDAVAPGEYKAEEDPRLYHSVKTGRGPLSDDWARTAAQTGPLMCAYKLCKVEFRYWGMQAKIEQFIHDVGLRRVMLRAHRQAWCWQDEWTELSMADIRALEEETARMLAQRMAKCNTGSEGSEAQPPGKPSTEARSAASNTGTPDGPEAPPGPDASPDASFGKQWSSSSRSSYSSQHGGAVSPQSLSEWRMQNIARDSENSSEEEFFDAHEGFSDSEEVFPKEMTKWNSNDFIDAFASPVEAEGTPEPGAEAAKGIEDGAQAPRDSEGLDGAGELGAEACAVHALFLILHSGNILDSGPGDANSKQADVQTLSSAFEAVTRIHFPEALGHVALRLVPCPPICAAAYALVSNLSPYSHDGDSLSRSQDHIPLAALPLLATSSSRYQGAVATVIARTNQAYSAFLRSPEGAGFCGQVALIGDGVGGILGFDALCHSANAGTGSRGSSRRGSMNNELLSPEFGPVRDPLADGVEGLGRGSPEPSALPPQRIPSDMASPEPEGSQNSLQAAPATTSSWEPRRASTAFCPPAASSEAPDGPSSTARLDFKVSGFFLFGSPLGLVLALRKTVMPALEAAQMRPACEQIYNLFHAADPCASRLEPLLAPKFQAIAPLTVPRYQKFPLGDGSSLLLADTLQTHSSLFLEELEMLVPSTPTSTSGAFWKGSELATDPPAQPAAPSTTSEVVKILERWWGTKRIDYSLYCPEALTAFPTVTLPHLFHASYWESADVVAFILRQVIEKERPQLAECEEPSIYSPAFPREKWQRKRTQVKIRNVTSNHRASDTVVCEGRPQVLSGRFMYGPLDVVTLTGEKVDVYIMTQPLSGKWIHFGTEVTNSSGRLTFPVPPERALGIGVYPVRMVVRGDHTYAECCLTVVARGTEAVVFSIDGSFTASVSIMGSDPKVRAGAVDVVRHWQDSGYLIVYVTGRPDMQKHRVVAWLSQHNFPHGVVSFCDGLTHDPLRQKAMFLQSLVQEVELNIVAGYGSPKDVAVYAALGLSPSQTYIVGRAVRKLQAQCQFLSDGYVAHLGQLEAGSHSHASSGPPRAALGKSSYGVAAPVDFLRKQSQLLRSRGPSQAEREGPGTPPTTLARGKARSISLKLDSEE

SEQ ID NO: 750799 - protein, 434 aa, Homo sapiens
ADGCGAGGHPDSLPCRAVLERWWGTKRIDYSLYCPEALTAFPTVTLPHLFHASYWESADVVAFILRQVIEKERPQLAECEEPSIYSPAFPREKWQRKRTQVKIRNVTSNHRASDTVVCEGRPQVLSGRFMYGPLDVVTLTGEKVDVYIMTQPLSGKWIHFGTEVTNSSGRLTFPVPPERALGIGVYPVRMVVRGDHTYAECCLTVVARGTEAVVFSIDGSFTASVSIMGSDPKVRAGAVDVVRHWQDSGYLIVYVTGRPDMQKHRVVAWLSQHNFPHGVVSFCDGLTHDPLRQKAMFLQSLVQEVELNIVAGYGSPKDVAVYAALGLSPSQTYIVGRAVRKLQAQCQFLSDGYVAHLGQLEAGSHSHASSGPPRAALGKSSYGVAAPVDFLRKQSQLLRSRGPSQAEREGPGTPPTTLARGKARSISLKLDSEE

SEQ ID NO: 750800 - protein, 510 aa, Homo sapiens
RRGGTAGAPAGGSRGRSGPWAGTAPREGPATAGTRGRGWGRSGLRPTGRPALPGLGEGRPPQARGGAEAARGPPSAFRMLIKEYHILLPMSLDEYQVAQLYMIQKKSREESSGEGSGVEILANRPYTDGPGGSGQYTHKVYHVGSHIPGWFRALLPKAALQVEEESWNAYPYTRTRYTCPFVEKFSIEIETYYLPDGGQQPNVFNLSGAERRQRILDTIDIVRDAVAPGEYKAEEDPRLYHSVKTGRGPLSDDWARTAAQTGPLMCAYKLCKVEFRYWGMQAKIEQFIHDVGLRRVMLRAHRQAWCWQDEWTELSMADIRALEEETARMLAQRMAKCNTGSEGSEAQPPGKPSTEARSAASNTGTPDGPEAPPGPDASPDASFGKQWSSSSRSSYSSQHGGAVSPQSLSEWRMQNIARDSENSSEEEFFDAHEGFSDSEEVFPKEMTKWNSNDFIDAFASPVEAEGTPEPGAEAAKGIEDGAQAPRDSEGLDGAGELGAEAWAQRLFQCV

SEQ ID NO: 750801 - protein, 1322 aa, Homo sapiens; identical to SEQ ID NO: 750798

SEQ ID NO: 750802 - protein, 1269 aa, Homo sapiens
RRGGTAGAPAGGSRGRSGPWAGTAPREGPATAGTRGRGWGRSGLRPTGRPALPGLGEGRPPQARGGAEAARGPPSAFRMLIKEYHILLPMSLDEYQVAQLYMIQKKSREESSGEGSGVEILANRPYTDGPGGSGQYTHKVYHVGSHIPGWFRALLPKAALQVEEESWNAYPYTRTRYTCPFVEKFSIEIETYYLPDGGQQPNVFNLSGAERRQRILDTIDIVRDAVAPGEYKAEEDPRLYHSVKTGRGPLSDDWARTAAQTGPLMCAYKLCKVEFRYWGMQAKIEQFIHDVGLRRVMLRAHRQAWCWQDEWTELSMADIRALEEETARMLAQRMAKCNTGSEGSEAQPPGKPSTEARSAASNTGTPDGPEAPPGPDASPDASFGKQWSSSSRSSYSSQHGGAVSPQSLSEWRMQNIARDSENSSEEEFFDAHEGFSDSEEVFPKEMTKWNSNDFIDAFASPVEAEGTPEPGAEAAKGIEDGAQAPRDSEGLDGAGELGAEACAVHALFLILHSGNILDSGPGDANSKQADVQTLSSAFEAVTRIHFPEALGHVALRLVPCPPICAAAYALVSNLSPYSHDGDSLSRSQDHIPLAALPLLATSSSRYQGAVATVIARTNQAYSAFLRSPEGAGFCGQVALIGDGVGGILGFDALCHSANAGTGSRGSSRRGSMNNELLSPEFGPVRDPLADGVEGLGRGSPEPSALPPQRIPSDMASPEPEGSQNSLQAAPATTSSWEPRRASTAFCPPAASSEAPDGPSSTARLDFKVSGFFLFGSPLGLVLALRKTVMPALEAAQMRPACEQIYNLFHAADPCASRLEPLLAPKFQAIAPLTVPRYQKFPLGDGSSLLLADTLQTHSSLFLEELEMLVPSTPTSTSGAFWKGSELATDPPAQPAAPSTTSEVVKILERWWGTKRIDYSLYCPEALTAFPTVTLPHLFHASYWESADVVAFILRQVIEKERPQLAECEEPSIYSPAFPREKWQRKRTQVKIRNHFGTEVTNSSGRLTFPVPPERALGIGVYPVRMVVRGDHTYAECCLTVVARGTEAVVFSIDGSFTASVSIMGSDPKVRAGAVDVVRHWQDSGYLIVYVTGRPDMQKHRVVAWLSQHNFPHGVVSFCDGLTHDPLRQKAMFLQSLVQEVELNIVAGYGSPKDVAVYAALGLSPSQTYIVGRAVRKLQAQCQFLSDGYVAHLGQLEAGSHSHASSGPPRAALGKSSYGVAAPVDFLRKQSQLLRSRGPSQAEREGPGTPPTTLARGKARSISLKLDSEE

SEQ ID NO: 750803 - protein, 753 aa, Homo sapiens
RRGGTAGAPAGGSRGRSGPWAGTAPREGPATAGTRGRGWGRSGLRPTGRPALPGLGEGRPPQARGGAEAARGPPSAFRMLIKEYHILLPMSLDEYQVAQLYMIQKKSREESSGEGSGVEILANRPYTDGPGGSGQYTHKVYHVGSHIPGWFRALLPKAALQVEEESWNAYPYTRTRYTCPFVEKFSIEIETYYLPDGGQQPNVFNLSGAERRQRILDTIDIVRDAVAPGEYKAEEDPRLYHSVKTGRGPLSDDWARTAAQTGPLMCAYKLCKVEFRYWGMQAKIEQFIHDVGLRRVMLRAHRQAWCWQDEWTELSMADIRALEEETARMLAQRMAKCNTGSEGSEAQPPGKPSTEARSAASNTGTPDGPEAPPGPDASPDASFGKQWSSSSRSSYSSQHGGAVSPQSLSEWRMQNIARDSENSSEEEFFDAHEGFSDSEEVFPKEMTKWNSNDFIDAFASPVEAEGTPEPGAEAAKGIEDGAQAPRDSEGLDGAGELGAEACAVHALFLILHSGNILDSGPGDANSKQADVQTLSSAFEAVTRIHFPEALGHVALRLVPCPPICAAAYALVSNLSPYSHDGDSLSRSQDHIPLAALPLLATSSSRYQGAVATVIARTNQAYSAFLRSPEGAGFCGQVALIGDGVGGILGFDALCHSANAGTGSRGSSRRGSMNNELLSPEFGPVRDPLADGVEGLGRGSPEPSALPPQRIPSDMASPEPEGSQNRAVSLHTCCSQGTQSVLPEIDSQAHVENP

SEQ ID NO: 750804 - protein, 473 aa, Homo sapiens
RRGGTAGAPAGGSRGRSGPWAGTAPREGPATAGTRGRGWGRSGLRPTGRPALPGLGEGRPPQARGGAEAARGPPSAFRMLIKEYHILLPMSLDEYQVAQLYMIQKKSREESSGEGSGVEILANRPYTDGPGGSGQYTHKVYHVGSHIPGWFRALLPKAALQVEEESWNAYPYTRTRYTCPFVEKFSIEIETYYLPDGGQQPNVFNLSGAERRQRILDTIDIVRDAVAPGEYKAEEDPRLYHSVKTGRGPLSDDWARTAAQTGPLMCAYKLCKVEFRYWGMQAKIEQFIHDVGLRRVMLRAHRQAWCWQDEWTELSMADIRALEEETARMLAQRMAKCNTGSEGSEAQPPGKPSTEARSAASNTGTPDGPEAPPGPDASPDASFGKQWSSSSRSSYSSQHGGAVSPQSLSEWRMQNIARDSENSSEEEFFDAHEGFSDSEEVFPKEMTKWNSNDFIDAFASPVEAEGTPGKDTA

SEQ ID NO: 750805 - protein, 364 aa, Homo sapiens
MWAPREQLLGWTAEALPAKDSAWPWEEKPRYLGPVTFEDVAVLFTEAEWKRLSLEQRNLYKEVMLENLRNLVSLAESKPEVHTCPSCPLAFGSQQFLSQDELHNHPIPGFHAGNQLHPGNPCPEDQPQSQHPSDKNHRGAEAEDQRVEGGVRPLFWSTNERGALVGFSSLFQRPPISSWGGNRILEIQLSPAQNASSEEVDRISKRAETPGFGAVTFGECALAFNQKSNLFRQKAVTAEKSSDKRQSQVCRECGRGFSRKSQLIIHQRTHTGEKPYVCGECGRGFIVESVLRNHLSTHSGEKPYVCSHCGRGFSCKPYLIRHQRTHTREKSFMCTVCGRGFREKSELIKHQRIHTGDKPYVCRD

SEQ ID NO: 750806 - protein, 422 aa, Homo sapiens
MIDFQMLNQLCRTIINPSVIPCLKYCGDQIGPVTFEDVAVLFTEAEWKRLSLEQRNLYKEVMLENLRNLVSLAESKPEVHTCPSCPLAFGSQQFLSQDELHNHPIPGFHAGNQLHPGNPCPEDQPQSQHPSDKNHRGAEAEDQRVEGGVRPLFWSTNERGALVGFSSLFQRPPISSWGGNRILEIQLSPAQNASSEEVDRISKRAETPGFGAVTFGECALAFNQKSNLFRQKAVTAEKSSDKRQSQVCRECGRGFSRKSQLIIHQRTHTGEKPYVCGECGRGFIVESVLRNHLSTHSGEKPYVCSHCGRGFSCKPYLIRHQRTHTREKSFMCTVCGRGFREKSELIKHQRCQVTVPLEEWSLHLTTSFCNCVLPLASMTLSCFIFFYISSLCCFLSYPTFRFYSEFSLQPYNLRDTFTRSPS

SEQ ID NO: 750807 - protein, 104 aa, Homo sapiens
MWAPREQLLGWTAEALPAKDSAWPWEEKPRYLGPVTFEDVAVLFTEAEWKRLSLEQRNLYKEVMLENLRNLVSLVLELGSPRSGLLPLDLNLDFGFDVGPCVWI

SEQ ID NO: 750808 - protein, 119 aa, Homo sapiens [sequence omitted]

SEQ ID NO: 750809 - protein, 364 aa, Homo sapiens; identical to SEQ ID NO: 750805

SEQ ID NO: 750810 - protein, 119 aa, Homo sapiens [sequence omitted]

SEQ ID NO: 750811 - protein, 168 aa, Homo sapiens
MERSGSPCAQIKPVNTLSCPQVVTLRSTHNSKHQETSHNHFALKQVPDHNGVDSLLFTKLRPNIGFIFQKKKNTDRTKTVLGAAVALEKSILSHSVGAGGNEENWQLRCPRDSGHEGVCLPKKRGARRRHTSRWANGYKGQSDATPPGGTAKTARDEEETKQHSRRRE

SEQ ID NO: 750812 - protein, 362 aa, Homo sapiens
MIDFQMLNQLCRTIINPSVIPCLKYCGDQIGPVTFEDVAVLFTEAEWKRLSLEQRNLYKEVMLENLRNLVSLAESKPEVHTCPSCPLAFGSQQFLSQDELHNHPIPGFHAGNQLHPGNPCPEDQPQSQHPSDKNHRGAEAEDQRVEGGVRPLFWSTNERGALVGFSSLFQRPPISSWGGNRILEIQLSPAQNASSEEVDRISKRAETPGFGAVTFGECALAFNQKSNLFRQKAVTAEKSSDKRQSQVCRECGRGFSRKSQLIIHQRTHTGEKPYVCGECGRGFIVESVLRNHLSTHSGEKPYVCSHCGRGFSCKPYLIRHQRTHTREKSFMCTVCGRGFREKSELIKHQRIHTGDKPYVCRD

SEQ ID NO: 750813 - protein, 119 aa, Homo sapiens [sequence omitted]

SEQ ID NO: 750814 - protein, 81 aa, Homo sapiens
NRSSSSSSSSSSSSSGHCYMVSTYYTSRRPHHSPESYPRFTDEDEKSQRGRNLPAVAQLLSKWSGPRAASEFFLTIFLSVP

SEQ ID NO: 750815 - protein, 81 aa, Homo sapiens; identical to SEQ ID NO: 750814

SEQ ID NO: 750816 - protein, 68 aa, Homo sapiens
ITEQLDMGELAASANHGHSPCYPERKGTPGDLSKRKMLVHFYPRRHSHPRATQQWILKNKTLCRRIKE

SEQ ID NO: 750817 - protein, 127 aa, Homo sapiens
GGLATTVFFLLFICSWIFLKPFHHQPSSSLPAPWRLKLFPAYVREGEPETATSGVKGVSSEPRTMAFCHCLLSSCCWGLGLLAAASFSANQESREVGTASTKTLKMSGEDRLSPGAQPGQQGKTSSL

SEQ ID NO: 750818 - protein, 186 aa, Homo sapiens
FPSAGSVFWVWVCFLSCVWVFCRPWGRPVPGRPLCCLLKGLCPCPGFLVSRRENQLKLSHDWLCYLAPEIVREMTPGKDEDQLPFSKAADVYAFGTVWYELQARDWPLKNQAAEASIWQIGSGEGMKRVLTSVSLGKEVSEILSACWAFDLQERPSFSLLMDMLEKLPKLNRRLSHPGHFWKSAEL

SEQ ID NO: 750819 - protein, 191 aa, Homo sapiens
PGSPGLLGGTWTPAREGVLRLEVASSDVGLLILAKLVRYICKQRQCKLSVAPGERTPELNSYPRFSDWLYTFNVRPEVVQEIPRDLTLDALLEMNEAKVKETLRRCGASGDECGRLQYALTCLRKVTGLAFITLGGIGRRGRRDGNEGHVTSAYEGMQRRAAKVAQRCRPDGLSDGKNTQDSEPSTEEHTR

SEQ ID NO: 750820 - protein, 972 aa, Homo sapiens
AAAEGGAGAAASRALQQCGQLQKLIDISIGSLRGLRTKCAVSNDLTQQEIRTLEAKLVRYICKQRQCKLSVAPGERTPELNSYPRFSDWLYTFNVRPEVVQEIPRDLTLDALLEMNEAKVKETLRRCGASGDECGRLQYALTCLRKVTGLGGEHKEDSSWSSLDARRESGSGPSTDTLSAASLPWPPGSSQLGRAGNSAQGPRSISVSALPASDSPTPSFSEGLSDTCIPLHASGRLTPRALHSFITPPTTPQLRRHTKLKPPRTPPPPSRKVFQLLPSFPTLTRSKSHESQLGNRIDDVSSMRCACLLPHLETSQGQLTEPSSEARSKLEDQARRGEPHHATGLAWPAPVLMDIDQGDAYIINHCAPLYPVVSELGSHGHELSPAEFLSLPIRPLSLQISRMDPQQMVRRDIGLSVTHRFSTKSWLSQVCHVCQKSMIFGVKCKHCRLKCHNKCTKEAPACRISFLPLTRLRRTESVPSDINNPVDRAAEPHFGTLPKALTKKEHPPAMNHLDSSSNPSSTTSSTPSSPAPFPTSSNPSSATTPPNPSPGQRDSRFNFPAAYFIHHRQQFIFPDISAFAHAAPLPEAADGTRLDDQPKADVLEAHEAEAEEPEAGKSEAEDDEDEVDDLPSSRRPWRGPISRKASQTSVYLQEWDIPFEQVELGEPIGQGRWGRVHRGRWHGEVAIRLLEMDGHNQDHLKLFKKEVMNYRQTRHENVVLFMGACMNPPHLAIITSFCKGRTLHSFVRDPKTSLDINKTRQIAQEIIKGMGYLHAKGIVHKDLKSKNVFYDNGKVVITDFGLFGISGVVREGRRENQLKLSHDWLCYLAPEIVREMTPGKDEDQLPFSKAADVYAFGTVWYELQARDWPLKNQAAEASIWQIGSGEGMKRVLTSVSLGKEVSEILSACWAFDLQERPSFSLLMDMLEKLPKLNRRLSHPGHFWKSADINSSKVVPRFERFGLGVLESSNPKM

SEQ ID NO: 750821 - protein, 905 aa, Homo sapiens
MAKLVRYICKQRQCKLSVAPGERTPELNSYPRFSDWLYTFNVRPEVVQEIPRDLTLDALLEMNEAKVKETLRRCGASGDECGRLQYALTCLRKVTGLGGEHKEDSSWSSLDARRESGSGPSTDTLSAASLPWPPGSSQLGRAGNSAQGPRSISVSALPASDSPTPSFSEGLSDTCIPLHASGRLTPRALHSFITPPTTPQLRRHTKLKPPRTPPPPSRKVFQLLPSFPTLTRSKSHESQLGNRIDDVSSMRCACLLPHLETSQGQLTEPSSEARSKLEDQARRGEPHHATGLAWPAPVLMDIDQGDAYIINHCAPLYPVVSELGSHGHELSPAEFLSLPIRPLSLQISRMDPQQMVRRDIGLSVTHRFSTKSWLSQVCHVCQKSMIFGVKCKHCRLKCHNKCTKEAPACRISFLPLTRLRRTESVPSDINNPVDRAAEPHFGTLPKALTKKEHPPAMNHLDSSSNPSSTTSSTPSSPAPFPTSSNPSSATTPPNPSPGQRDSRFNFPDISAFAHAAPLPEAADGTRLDDQPKADVLEAHEAEAEEPEAGKSEAEDDEDEVDDLPSSRRPWRGPISRKASQTSVYLQEWDIPFEQVELGEPIGQGRWGRVHRGRWHGEVAIRLLEMDGHNQDHLKLFKKEVMNYRQTRHENVVLFMGACMNPPHLAIITSFCKGRTLHSFVRDPKTSLDINKTRQIAQEIIKGMGYLHAKGIVHKDLKSKNVFYDNGKVVITDFGLFGISGVVREGRRENQLKLSHDWLCYLAPEIVREMTPGKDEDQLPFSKAADVYAFGTVWYELQARDWPLKNQAAEASIWQIGSGEGMKRVLTSVSLGKEVSEILSACWAFDLQERPSFSLLMDMLEKLPKLNRRLSHPGHFWKSADINSSKVVPRFERFGLGVLESSNPKM

SEQ ID NO: 750822 - protein, 435 aa, Homo sapiens
LQFRSSLLRWPFCVCDSPPLLFKAAYFIHHRQQFIFPDISAFAHAAPLPEAADGTRLDDQPKADVLEAHEAEAEEPEAGKSEAEDDEDEVDDLPSSRRPWRGPISRKASQTSVYLQEWDIPFEQVELGEPIGQGRWGRVHRGRWHGEVAIRLLEMDGHNQDHLKLFKKEVMNYRQTRHENVVLFMGACMNPPHLAIITSFCKGRTLHSFVRDPKTSLDINKTRQIAQEIIKGMGYLHAKGIVHKDLKSKNVFYDNGKVVITDFGLFGISGVVREGRRENQLKLSHDWLCYLAPEIVREMTPGKDEDQLPFSKAADVYAFGTVWYELQARDWPLKNQAAEASIWQIGSGEGMKRVLTSVSLGKEVSEILSACWAFDLQERPSFSLLMDMLEKLPKLNRRLSHPGHFWKSADINSSKVVPRFERFGLGVLESSNPKM

SEQ ID NO: 750823 - protein, 103 aa, Homo sapiens [sequence omitted]

SEQ ID NO: 750824 - protein, 353 aa, Homo sapiens
MEASASCMGWLPDERTPRSSTRHTSSHSWLSWHDTSFLICEGPECECTRDPDGGPVTLRNARALCRSELDGRESADVEYCCRLLVRGLGGGMHVVAVRVEMIARLTLAVPDRCVAGAGQGGMRHNRQCTPSFGSSIWNCAGRVESRASKRRFLRVRPRRTARRPAIALWPLEGSSSRHVRQAVEATSVPSGPSAYQSFRSVRSRSPGAYNEASPASPEVIPLRGSSYRIRLVIRPFADSPMCGAGPLEAVPGFPDEPQGVTLSKPPVFTWLPPKPGTPLGASGGQALPFEGLTRWGANAGRFGARCGSPGGHPGCAGDTLRPTRGGPLSSLVAYSGRRSQQSSVAVAESKTLP

SEQ ID NO: 750825 - protein, 155 aa, Homo sapiens
AAAEGGAGAAASRALQQCGQLQKLIDISIGSLRGLRTKCAVSNDLTQQEIRTLEVSGSGTRLGSRSGPGHLPPGPSTPGRVASLSPRRPPWRLPLPPALADAAAGGPGTSPHLGQDLWGGCVVGTGMEARGARAGWAARGHPLSPLLRPHPISSL

SEQ ID NO: 750826 - protein, 919 aa, Homo sapiens
MAKLVRYICKQRQCKLSVAPGERTPELNSYPRFSDWLYTFNVRPEVVQEIPRDLTLDALLEMNEAKVKETLRRCGASGDECGRLQYALTCLRKVTGLGGEHKEDSSWSSLDARRESGSGPSTDTLSAASLPWPPGSSQLGRAGNSAQGPRSISVSALPASDSPTPSFSEGLSDTCIPLHASGRLTPRALHSFITPPTTPQLRRHTKLKPPRTPPPPSRKVFQLLPSFPTLTRSKSHESQLGNRIDDVSSMRCACLLPHLETSQGQLTEPSSEARSKLEDQARRGEPHHATGLAWPAPVLMDIDQGDAYIINHCAPLYPVVSELGSHGHELSPAEFLSLPIRPLSLQISRMDPQQMVRRDIGLSVTHRFSTKSWLSQVCHVCQKSMIFGVKCKHCRLKCHNKCTKEAPACRISFLPLTRLRRTESVPSDINNPVDRAAEPHFGTLPKALTKKEHPPAMNHLDSSSNPSSTTSSTPSSPAPFPTSSNPSSATTPPNPSPGQRDSRFNFPAAYFIHHRQQFIFPDISAFAHAAPLPEAADGTRLDDQPKADVLEAHEAEAEEPEAGKSEAEDDEDEVDDLPSSRRPWRGPISRKASQTSVYLQEWDIPFEQVELGEPIGQGRWGRVHRGRWHGEVAIRLLEMDGHNQDHLKLFKKEVMNYRQTRHENVVLFMGACMNPPHLAIITSFCKGRTLHSFVRDPKTSLDINKTRQIAQEIIKGMGYLHAKGIVHKDLKSKNVFYDNGKVVITDFGLFGISGVVREGRRENQLKLSHDWLCYLAPEIVREMTPGKDEDQLPFSKAADVYAFGTVWYELQARDWPLKNQAAEASIWQIGSGEGMKRVLTSVSLGKEVSEILSACWAFDLQERPSFSLLMDMLEKLPKLNRRLSHPGHFWKSADINSSKVVPRFERFGLGVLESSNPKM

SEQ ID NO: 750827 - protein, 565 aa, Homo sapiens
MVRRDIGLSVTHRFSTKSWLSQVCHVCQKSMIFGVKCKHCRLKCHNKCTKEAPACRISFLPLTRLRRTESVPSDINNPVDRAAEPHFGTLPKALTKKEHPPAMNHLDSSSNPSSTTSSTPSSPAPFPTSSNPSSATTPPNPSPGQRDSRFNFPAAYFIHHRQQFIFPDISAFAHAAPLPEAADGTRLDDQPKADVLEAHEAEAEEPEAGKSEAEDDEDEVDDLPSSRRPWRGPISRKASQTSVYLQEWDIPFEQVELGEPIGQGRWGRVHRGRWHGEVAIRLLEMDGHNQDHLKLFKKEVMNYRQTRHENVVLFMGACMNPPHLAIITSFCKGRTLHSFVRDPKTSLDINKTRQIAQEIIKGMGYLHAKGIVHKDLKSKNVFYDNGKVVITDFGLFGISGVVREGRRENQLKLSHDWLCYLAPEIVREMTPGKDEDQLPFSKAADVYAFGTVWYELQARDWPLKNQAAEASIWQIGSGEGMKRVLTSVSLGKEVSEILSACWAFDLQERPSFSLLMDMLEKLPKLNRRLSHPGHFWKSADINSSKVVPRFERFGLGVLESSNPKM

SEQ ID NO: 750828 - protein, 919 aa, Homo sapiens; identical to SEQ ID NO: 750826

SEQ ID NO: 750829 - protein, 880 aa, Homo sapiens
MNEAKVKETLRRCGASGDECGRLQYALTCLRKVTGLGGEHKEDSSWSSLDARRESGSGPSTDTLSAASLPWPPGSSQLGRAGNSAQGPRSISVSALPASDSPTPSFSEGLSDTCIPLHASGRLTPRALHSFITPPTTPQLRRHTKLKPPRTPPPPSRKVFQLLPSFPTLTRSKSHESQLGNRIDDVSSMRCACLLPHLETSQGQLTEPSSEARSKLEDQARRGEPHHATGLAWPAPVLMDIDQGDAYIINHCAPLYPVVSELGSHGHELSPAEFLSLPIRPLSLQISRMDPQQMVRRDIGLSVTHRFSTKSWLSQVCHVCQKSMIFGVKCKHCRLKCHNKCTKEAPACRISFLPLTRLRRTESVPSDINNPVDRAAEPHFGTLPKALTKKEHPPAMNHLDSSSNPSSTTSSTPSSPAPFPTSSNPSSATTPPNPSPGQRDSRFNFPAAYFIHHRQQFIFPVPSAGHCWKCLLIAESLKENAFNISAFAHAAPLPEAADGTRLDDQPKADVLEAHEAEAEEPEAGKSEAEDDEDEVDDLPSSRRPWRGPISRKASQTSVYLQEWDIPFEQVELGEPIGQGRWGRVHRGRWHGEVAIRLLEMDGHNQDHLKLFKKEVMNYRQTRHENVVLFMGACMNPPHLAIITSFCKGRTLHSFVRDPKTSLDINKTRQIAQEIIKGMGYLHAKGIVHKDLKSKNVFYDNGKVVITDFGLFGISGVVREGRRENQLKLSHDWLCYLAPEIVREMTPGKDEDQLPFSKAADVYAFGTVWYELQARDWPLKNQAAEASIWQIGSGEGMKRVLTSVSLGKEVSEILSACWAFDLQERPSFSLLMDMLEKLPKLNRRLSHPGHFWKSADINSSKVVPRFERFGLGVLESSNPKM

SEQ ID NO: 750830 - protein, 397 aa, Homo sapiens
MPLSPVTWLGLQEKEETSRAQICCPSLFFLLSFQAEEPEAGKSEAEDDEDEVDDLPSSRRPWRGPISRKASQTSVYLQEWDIPFEQVELGEPIGQGRWGRVHRGRWHGEVAIRLLEMDGHNQDHLKLFKKEVMNYRQTRHENVVLFMGACMNPPHLAIITSFCKGRTLHSFVRDPKTSLDINKTRQIAQEIIKGMGYLHAKGIVHKDLKSKNVFYDNGKVVITDFGLFGISGVVREGRRENQLKLSHDWLCYLAPEIVREMTPGKDEDQLPFSKAADVYAFGTVWYELQARDWPLKNQAAEASIWQIGSGEGMKRVLTSVSLGKEVSEILSACWAFDLQERPSFSLLMDMLEKLPKLNRRLSHPGHFWKSADINSSKVVPRFERFGLGVLESSNPKM

SEQ ID NO: 750831 - protein, 222 aa, Homo sapiens
FPAGTVDLAQPSQPVDELELSVLERQPEENTPLNGADKVFPSLDEEVPPAEANKESPWSSCNKNVVGRCKLWMIITSIFLGVITVIIIGLCLAAVTYVDEDENEILELSSNKTFFIMLKIPEECVAEEELPHLLTERLTDVYSTSPSLSRYFTSVEIVDFSGENATVTYDLQFGVPSDDENFMKYMMSEELVLGILLQDFRDQNIPGCESLGLDPTSLLLYE

SEQ ID NO: 750832 - protein, 71 aa, Homo sapiens
AGAVASRGAAQTFPAGTVDLAQPSQPVDELELSVLERQPEENTPLNGADKVFPSLDEEVPPAEVRSPWRWP

SEQ ID NO: 750833 - protein, 236 aa, Homo sapiens
MVVREASAAQASLSQVLPQLRYLHIFLEQVHTHFQEQSVGERGAAIQLAEGLARQLCTDCQLNKLFYREEFVLATLLDPCFKGKIEAILPWGPTDIDHWKQVLVYKVKEIRVSEYSLNSPSPLQSPRGLCVDPTRVAKSSGVEGRSQGEPLQSSSHSGAFLLAQREKGLLESMGLLASERSGGSLSTKSHWASIIVKKYLWENETVGAQDDPLAYWEKKREAWPPSICLTPHRSLL

SEQ ID NO: 750834 - protein, 236 aa, Homo sapiens; identical to SEQ ID NO: 750833

SEQ ID NO: 750835 - protein, 236 aa, Homo sapiens; identical to SEQ ID NO: 750833

SEQ ID NO: 750836 - protein, 355 aa, Homo sapiens
RRRQACGRGGAELGRPWRNSASAAGGAGSGAAGSRATGFLLHRCAHRGRAPCRERGFSVRTLAPSPGKMKDRLAELLDLSKQYDQQFPDGDDEFDSPHEDIVFETDHILESLYRDIRDIQDENQLLVADVKRLGKQNARFLTSMRRLSSIKRDTNSIAKAIKARGEVIHCKLRAMKELSEAAEAQHGPHSAVARISRAQYNALTLTFQRAMHDYNQAEMKQRDNCKIRIQRQLEIMGKEVSGDQIEDMFEQGKWDVFSENLLADVKGARAALNEIESRHRELLRLESRIRDVHELFLQMAVLVEKQADTLNVIELNVQKTVDYTGQAKAQVRKAVQYEEKNPCRTLCCFCCPCLK

SEQ ID NO: 750837 - protein, 355 aa, Homo sapiens; identical to SEQ ID NO: 750836

SEQ ID NO: 750838 - protein, 355 aa, Homo sapiens; identical to SEQ ID NO: 750836

SEQ ID NO: 750839 - protein, 305 aa, Homo sapiens
EFAAASTSVRTLAPSPGKMKDRLAELLDLSKQYDQQFPDGDDEFDSPHEDIVFETDHILESLYRDIRDIQDENQLLVADVKRLGKQNARFLTSMRRLSSIKRDTNSIAKAIKARGEVIHCKLRAMKELSEAAEAQHGPHSAVARISRAQYNALTLTFQRAMHDYNQAEMKQRDNCKIRIQRQLEIMGKEVSGDQIEDMFEQGKWDVFSENLLADVKGARAALNEIESRHRELLRLESRIRDVHELFLQMAVLVEKQADTLNVIELNVQKTVDYTGQAKAQVRKAVQYEEKNPCRTLCCFCCPCLK

SEQ ID NO: 750840 - protein, 262 aa, Homo sapiens
LRPLPLVVVPGLLQLLFCDSKEVVHATEGLDWEDKDAPGTLVGNVVHSRIISPLRLFVKQSPVPKPGPMAYADSMENFWDWLANITEIQEPLARTKRRPIVKTGKFKKMFGWGDFHSNIKTVKLNLLITGKIVDHGNGTFSVYFRHNSTGLGNVSVSLVPPSKVVEFEVSPQSTLETKESKSFNCRIEYEKTDRAKKTALCNFDPSKICYQEQTQSHVSWLCSKPFKVICIYIAFYSVDYKLVQKVCPDYNYHSETPYLSSG

SEQ ID NO: 750841 - protein, 139 aa, Homo sapiens
LRPLPLVVVPGLLQLLFCDSKEVVHATEGLDWEDKDAPGTLVGNVVHSRIISPLRLFVKQSPVPKPGPMAYADSMENFWDWLANITEIQEPLARTKRRPIVKTGKFKKMFGWGDFHSNIKTVKLNLLITILMIPPEFEY

SEQ ID NO: 750842 - protein, 654 aa, Homo sapiens
MEEKKSSDKFKETSEVLERKISMRKPREELVKRGVLLEDPEQGGEDPGKPSDAMLKNGHTTPIGNARSSSPVQVEEEPVRLASLRKAIPEEDLKKRLGSTGSQPNSEAESVPENVPKPPLLPPKRPLSSSHEASEGQAKDATSSGGTARFIISTSITTAPAATTAATSLAKTVNLSVTPSPAPRTLPAAPASTNTTATPSLTHMVPAKQPPIPPPKPAHRNSNPVIAELSQAINSGTLLSKPSPPLPPKRGIPSTSVPTLESAAAITTKTPSDEREKSTCSMGSELLPMISPRSPSPPLPTHIPPEPPRTPPFPAKTFQVVPEIEFPPSLDLHQEIPQQEDQKKEVPKRILDQNFGEPHIPSRLPPLPLHIRIQQALTSPLPMTPILEGSHRAHSLLFENSDSFSEDSSTLGRTRSLPITIEMLKVPDDEEEEEQTCPSTFSEEMTPTSVIPKLPQCLREEEEKESDSDSEGPIQYRDEEDEDESYQSALANKVKRKDTLAMKLNHRPSEPELNLNSWPCKSKEEWNEIRHQIGNTLIRRLSQRPTPEELEQRNILQPKNEADRQAEKREIKRRLTRKLSQRPTVAELLARKILRFNEYVEVTDAQDYDRRADKPWTKLTPADKAAIRKELNEFKSSEMEVHEESKHFTRYHRP

SEQ ID NO: 750843 - protein, 654 aa, Homo sapiens; identical to SEQ ID NO: 750842

SEQ ID NO: 750844 - protein, 654 aa, Homo sapiens; identical to SEQ ID NO: 750842

SEQ ID NO: 750845 - protein, 654 aa, Homo sapiens; identical to SEQ ID NO: 750842

SEQ ID NO: 750846 - protein, 161 aa, Homo sapiens
HRTCFPFLHEKSLKPSEPELNLNSWPCKSKEEWNEIRHQIGNTLIRRLSQRPTPEELEQRNILQPKNEADRQAEKREIKRRLTRKLSQRPTVAELLARKILRFNEYVEVTDAQDYDRRADKPWTKLTPADKAAIRKELNEFKSSEMEVHEESKHFTRYHRP

SEQ ID NO: 750847 - protein, 102 aa, Homo sapiens
MKQESSRRGQTAPLSPAELGLQASQRPDTAQAMADALPMQAALTRSSLWLEGRRRSTPTGAAQRSALSSQTPHDPAHASPRQEHPSAEVLYAHSTCSVLFGD

SEQ ID NO: 750848 - protein, 72 aa, Homo sapiens
QTRNHENCTMCWSKSFLIFQISGSVGTRHILRKAWSTGTGAEDLSNRDGAAPSLTMRTKSNETQTTETILSD

SEQ ID NO: 750849 - protein, 608 aa, Homo sapiens
MTASPDYLVVLFGITAGATGAKLGSDEKELILLFWKVVDLANKKVGQLHEVLVRPDQLELTEDCKEETKIDVESLSSASQLDQALRQFNQSVSNELNIGVGTSFCLCTDGQLHVRQILHPEASKKNVLLPECFYSFFDLRKEFKKCCPGSPDIDKLDVATMTEYLNFEKSSSVSRYGASQVEDMGNIILAMISEPYNHRFSDPERVNYKFESGTCSKMELIDDNTVVRARGLPWQSSDQDIARFFKGLNIAKGGAALCLNAQGRRNGEALVRFVSEEHRDLALQRHKHHMGTRYIEVYKATGEDFLKIAGGTSNEVAQFLSKENQVIVRMRGLPFTATAEEVVAFFGQHCPITGGKEGILFVTYPDGRPTGDAFVLFACEEYAQNALRKHKDLLGKRYIELFRSTAAEVQQVLNRFSSAPLIPLPTPPIIPVLPQQFVPPTNVRDCIRLRGLPYAATIEDILDFLGEFATDIRTHGVHMVLNHQGRPSGDAFIQMKSADRAFMAAQKCHKKNMKDRYVEVFQCSAEEMNFVLMGGTLNRNGLSPPPCKLPCLSPPSYTFPAPAAVIPTEAAIYQPSVILNPRALQPSTAYYPAGTQLFMNYTAYYPSV

SEQ ID NO: 750850 - protein, 681 aa, Homo sapiens
MTASPDYLVVLFGITAGATGAKLGSDEKELILLFWKVVDLANKKVGQLHEVLVRPDQLELTEDCKEETKIDVESLSSASQLDQALRQFNQSVSNELNIGVGTSFCLCTDGQLHVRQILHPEASKKNVLLPECFYSFFDLRKEFKKCCPGSPDIDKLDVATMTEYLNFEKSSSVSRYGASQVEDMGNIILAMISEPYNHRFSDPERVNYKFESGTCSKMELIDDNTVVRARGLPWQSSDQDIARFFKGLNIAKGGAALCLNAQGRRNGEALVRFVSEEHRDLALQRHKHHMGTRYIEVYKATGEDFLKIAGGTSNEVAQFLSKENQVIVRMRGLPFTATAEEVVAFFGQHCPITGGKEGILFVTYPDGRPTGDAFVLFACEEYAQNALRKHKDLLGKRYIELFRSTAAEVQQVLNRFSSAPLIPLPTPPIIPVLPQQFVPPTNVRDCIRLRGLPYAATIEDILDFLGEFATDIRTHGVHMVLNHQGRPSGDAFIQMKSADRAFMAAQKCHKKNMKDRYVEVFQCSAEEMNFVLMGGTLNRNGLSPPPCKLPCLSPPSYTFPAPAAVIPTEAAIYQPSVILNPRALQPSTAYYPAGTQLFMNYTAYYPSPPGSPNSLGYFPTAANLSGVPPQPGTVVRMQGLAYNTGVKEILNFFQGYQYATEDGLIHTNDQARTLPKEWVCI

SEQ ID NO: 750851 - protein, 663 aa, Homo sapiens
MTASPDYLVVLFGITAGATGAKLGSDEKELILLFWKVVDLANKKVGQLHEVLVRPDQLELTEDCKEETKIDVESLSSASQLDQALRQFNQSVSNELNIGVGTSFCLCTDGQLHVRQILHPEASKKNVLLPECFYSFFDLRKEFKKCCPGSPDIDKLDVATMTEYLNFEKSSSVSRYGASQVEDMGNIILAMISEPYNHRFSDPERVNYKFESGTCSKMELIDDNTVVRARGLPWQSSDQDIARFFKGLNIAKGGAALCLNAQGRRNGEALVRFVSEEHRDLALQRHKHHMGTRYIEVYKATGEDFLKIAGGTSNEVAQFLSKENQVIVRMRGLPFTATAEEVVAFFGQHCPITGGKEGILFVTYPDGRPTGDAFVLFACEEYAQNALRKHKDLLGKRYIELFRSTAAEVQQVLNRFSSAPLIPLPTPPIIPVLPQQFVPPTNVRDCIRLRGLPYAATIEDILDFLGEFATDIRTHGVHMVLNHQGRPSGDAFIQMKSADRAFMAAQKCHKKNMKDRYVEVFQCSAEEMNFVLMGGTLNRNGLSPPPCKLPCLSPPSYTFPAPAAVIPTEAAIYQPSVILNPRALQPSTAYYPAGTQLFMNYTAYYPSPPGSPNSLGYFPTAANLSGVPPQPGTVVRMQGLAYNTGVKEILNFFQGYQCLKDVW

SEQ ID NO: 750852 - protein, 663 aa, Homo sapiens; identical to SEQ ID NO: 750851

SEQ ID NO: 750853 - protein, 681 aa, Homo sapiens; identical to SEQ ID NO: 750850

SEQ ID NO: 750854 - protein, 663 aa, Homo sapiens; identical to SEQ ID NO: 750851

SEQ ID NO: 750855 - protein, 681 aa, Homo sapiens; identical to SEQ ID NO: 750850

SEQ ID NO: 750856 - protein, 568 aa, Homo sapiens
MTASPDYLVVLFGITAGATGAKLGSDEKELILLFWKVVDLANKKVGQLHEVLVRPDQLELTEDCKEETKIDVESLSSASQLDQALRQFNQSVSNELNIGVGTSFCLCTDGQLHVRQILHPEASKKNVLLPECFYSFFDLRKEFKKCCPGSPDIDKLDVATMTEYLNFEKSSSVSRYGASQVEDMGNIILAMISEPYNHRFSDPERVNYKFESGTCSKMELIDDNTVVRARGLPWQSSDQDIARFFKGLNIAKGGAALCLNAQGRRNGEALVRFVSEEHRDLALQRHKHHMGTRYIEVYKATGEDFLKIAGGTSNEVAQFLSKENQVIVRMRGLPFTATAEEVVAFFGQHCPITGGKEGILFVTYPDGRPTGDAFVLFACEEYAQNALRKHKDLLGKRYIELFRSTAAEVQQVLNRFSSAPLIPLPTPPIIPVLPQQFVPPTNVRDCIRLRGLPYAATIEDILDFLGEFATDIRTHGVHMVLNHQGRPSGDAFIQMKSADRAFMAAQKCHKKNMKDRYVEVFQCSAEEMNFVLMGGTLNRNGLSPPPCKLPCKFFLGLGAILRYMLVGA

SEQ ID NO: 750857 - protein, 423 aa, Homo sapiens
MTASPDYLVVLFGITAGATGAKLGSDEKELILLFWKVVDLANKKVGQLHEVLVRPDQLELTEDCKEETKIDVESLSSASQLDQALRQFNQSVSNELNIGVGTSFCLCTDGQLHVRQILHPEASKKNVLLPECFYSFFDLRKEFKKCCPGSPDIDKLDVATMTEYLNFEKSSSVSRYGASQVEDMGNIILAMISEPYNHRFSDPERVNYKFESGTCSKMELIDDNTVVRARGLPWQSSDQDIARFFKGLNIAKGGAALCLNAQGRRNGEALVRFVSEEHRDLALQRHKHHMGTRYIEVYKATGEDFLKIAGGTSNEVAQFLSKENQVIVRMRGLPFTATAEEVVAFFGQHCPITGGKEGILFVTYPDGRPTGDAFVLFACEEYAQNALRKHKDLLGKRYIELFRSTAAEVQQVGFKNKYVVPLH

SEQ ID NO: 750858 - protein, 627 aa, Homo sapiens
MTASPDYLVVLFGITAGATGAKLGSDEKELILLFWKVVDLANKKVGQLHEVLVRPDQLELTEDCKEETKIDVESLSSASQLDQALRQFNQSVSNELNIGVGTSFCLCTDGQLHVRQILHPEASKKNVLLPECFYSFFDLRKEFKKCCPGSPDIDKLDVATMTECILKIITQESFEKIVPEKSLPLFTQAGVKWRDLGSLQPSPPGFKRFSCLSRPDHRFSDPERVNYKFESGTCSKMELIDDNTVVRARGLPWQSSDQDIARFFKGLNIAKGGAALCLNAQGRRNGEALVRFVSEEHRDLALQRHKHHMGTRYIEVYKATGEDFLKIAGGTSNEVAQFLSKENQVIVRMRGLPFTATAEEVVAFFGQHCPITGGKEGILFVTYPDGRPTGDAFVLFACEEYAQNALRKHKDLLGKRYIELFRSTAAEVQQVLNRFSSAPLIPLPTPPIIPVLPQQFVPPTNVRDCIRLRGLPYAATIEDILDFLGEFATDIRTHGVHMVLNHQGRPSGDAFIQMKSADRAFMAAQKCHKKNMKDRYVEVFQCSAEEMNFVLMGGTLNRNGLSPPPCKLPCLSPPSYTFPAPAAVIPTEAAIYQPSVILNPRALQPSTAYYPAGTQLFMNYTAYYPSV

SEQ ID NO: 750859 - protein, 636 aa, Homo sapiens
MTASPDYLVVLFGITAGATGAKLGSDEKELILLFWKVVDLANKKVGQLHEVLVRPDQLELTEDCKEETKIDVESLSSASQLDQALRQFNQSVSNELNIGVGTSFCLCTDGQLHVRQILHPEASKKNVLLPECFYSFFDLRKEFKKCCPGSPDIDKLDVATMTEYLNFEKSSSVSRYGASQVEDMGNIILAMISEPYNHRFSDPERVNYKFESGTCSKMELIDDNTVVRARGLPWQSSDQDIARFFKGLNIAKGGAALCLNAQGRRNGEALVRFVSEEHRDLALQRHKHHMGTRYIEVYKATGEDFLKIAGGTSNEVAQFLSKENQVIVRMRGLPFTATAEEVVAFFGQHCPITGGKEGILFVTYPDGRPTGDAFVLFACEEYAQNALRKHKDLLGKRYIELFRSTAAEVQQVLNRFSSAPLIPLPTPPIIPVLPQQFVPPTNVRDCIRLRGLPYAATIEDILDFLGEFATDIRTHGVHMVLNHQGRPSGDAFIQMKSADRAFMAAQKCHKKNMKDRYVEVFQCSAEEMNFVLMGGTLNRNGLSPPPCKLPCLSPPSYTFPAPAAVIPTEAAIYQPSVILNPRALQPSTAYYPAGTQLFMNYTAYYPSMQPRMDLYTQMTRPGLYPKNGFVFKGPSS

SEQ ID NO: 750860 - protein, 636 aa, Homo sapiens; identical to SEQ ID NO: 750859

SEQ ID NO: 750861 - protein, 608 aa, Homo sapiens; identical to SEQ ID NO: 750849

SEQ ID NO: 750862 - protein, 681 aa, Homo sapiens; identical to SEQ ID NO: 750850

SEQ ID NO: 750863 - protein, 607 aa, Homo sapiens
MTASPDYLVVLFGITAGATGAKLGSDEKELILLFWKVVDLANKKVGQLHEVLVRPDQLELTEDCKEETKIDVESLSSASQLDQALRQFNQSVSNELNIGVGTSFCLCTDGQLHVRQILHPEASKKNVLLPECFYSFFDLRKEFKKCCPGSPDIDKLDVATMTEYLNFEKSSSVSRYGASQVEDMGNIILAMISEPYNHRFSDPERVNYKFESGTCSKMELIDDNTVVRARGLPWQSSDQDIARFFKGLNIAKGGAALCLNAQGRRNGEALVRFVSEEHRDLALQRHKHHMGTRYIEVYKATGEDFLKIAGGTSNEVAQFLSKENQVIVRMRGLPFTATAEEVVAFFGQHCPITGGKEGILFVTYPDGRPTGDAFVLFACEEYAQNALRKHKDLLGKRYIELFRSTAAEVQQVLNRFSSAPLIPLPTPPIIPVLPQQFVPPTNVRDCIRLRGLPYAATIEDILDFLGEFATDIRTHGVHMVLNHQGRPSGDAFIQMKSADRAFMAAQKCHKKNMKDRYVEVFQCSAEEMNFVLMGGTLNRNGLSPPPCKLPCLSPPSYTFPAPAAVIPTEAAIYQPSVILNPRALQPSTAYYPAGTQLFMNYTAYYPR

SEQ ID NO: 750864 - protein, 175 aa, Homo sapiens
PLSPSPPIVMTASPDYLVVLFGITAGATGAKLGSDEKELILLFWKVVDLANKKVGQLHEVLVRPDQLELTEDCKEETKIDVESLSSASQLDQALRQFNQSVSNELNIGVGTSFCLCTDGQLHVRQILHPEASKKNVLLPECFYSFFDLRKEFKKCCPGSPDIDKLDVATMTECIL

SEQ ID NO: 750865 - protein, 180 aa, Homo sapiens
MESWWGLPCLAFLCFLMHARGQRDFDLADALDDPEPTKKPNSDIYPKPKPPYYPQPENPDSGGNIYPRPKPRPQPQPGNSGNSGGYFNDVDRDDGRYPPRPRPRPPAGGGGGGYSSYGNSDNTHGGDHHSTYGNPEGNMVAKIVSPIVSVVVVTLLGAAASYFKLNNRRNCFRTHEPENV

SEQ ID NO: 750866 - protein, 138 aa, Homo sapiens
MESWWGLPCLAFLCFLMHARGQRDFDLADALDDPEPTKKPNSDIYPKPKPPYYPQPENPDSGGNIYPRPKPRPQPQPGNSGNSGGYFNDVDRDDGRYPPRPRPRPPAGGGGGGYSSYGNSDNTHGGDHHSTYGNPEGN

SEQ ID NO: 750867 - protein, 179 aa, Homo sapiens [sequence omitted]

SEQ ID NO: 750868 - protein, 521 aa, Homo sapiens
SPGCLELSCGKARLLFDRPRGVRVRVAEGALRGPRRGCSGCCRRRGSNITYLSLSLLTLLCQGCRVGGGGQSAVGVSFPYWRGSWGREGEKKGVFAHSCFALELGSLLPKDALSGALLPTSHVFVCPLTFRLRTFSLEPSGGDGGSLAENSAGVASPGSPRSGETPRLERDPERAAAATGARRGSSQGLVERRAPSSMNCMKGPLHLEHRAAGTKLSAVSSSSCHHPQPLAMASVLAPGQPRSLDSSKHRLEVHTISDTSSPEAAEKDKSQQGKNEDVGAEDPSKKKRQRRQRTHFTSQQLQELEATFQRNRYPDMSTREEIAVWTNLTEARVRVWFKNRRAKWRKRERNQQAELCKNGFGPQFNGLMQPYDDMYPGYSYNNWAAKGLTSASLSTKSFPFFNSMNVNPLSSQSMFSPPNSISSMSMSSSMVPSAVTGVPGSSLNSLNNLNNLSSPSLNSAVPTPACPYAPPTPPYVYRDTCNSSLASLRLKAKQHSSFGYASVQNPASNLSACQYAVDRPV

SEQ ID NO: 750869 - protein, 390 aa, Homo sapiens
PPGAEQSPSRKAGKGPAAAPKRTTAKQEGRRKGEGDEPPGDRGPAASRGGTPRAGRGTAARKKSDRGGRGAGRRERGRETNGRKRGAAGGQGGGQPAAGEGRGAKDAEKKGEGTDAPESRKEAASSKPRQQPGAEKDKSQQGKNEDVGAEDPSKKKRQRRQRTHFTSQQLQELEATFQRNRYPDMSTREEIAVWTNLTEARVRVWFKNRRAKWRKRERNQQAELCKNGFGPQFNGLMQPYDDMYPGYSYNNWAAKGLTSASLSTKSFPFFNSMNVNPLSSQSMFSPPNSISSMSMSSSMVPSAVTGVPGSSLNSLNNLNNLSSPSLNSAVPTPACPYAPPTPPYVYRDTCNSSLASLRLKAKQHSSFGYASVQNPASNLSACQYAVDRPV

SEQ ID NO: 750870 - protein, 390 aa, Homo sapiens; identical to SEQ ID NO: 750869

SEQ ID NO: 750871 - protein, 643 aa, Homo sapiens
GKAEAISAERVSRAAARRGGAGGPQAGGCRAQGADLLERGPGHEAESRRAARLVEAPGQAADSLRLREPQQDRPGGAMEGSPIPVLTVPTAPYEDQRQAAAGVCGTHRLFEGQRKYLPNFIQSVLSSIDLRERQGCTMVVGSDGRYFSRTAIEIVVQMAAANGIGRLIIGQNGILSTPAVSCIIRKIKAAGGIILTASHCPGGPGGEFGVKFNVANGGPAPDVVSDKIYQISKTIEEYAICPDLRIDLSRLGRQEFDLENKFKPFRVEIVDPVDIYLNLLRTIFDFHAIKGLLTGPSQLKIRIDAMHGVMGPYVRKVLCDELGAPANSAINCVPLEDFGGQHPDPNLTYATTLLEAMKGGEYGFGAAFDADGDRYMILGQNGFFVSPSDSLAIIAANLSCIPYFRQMGVRGFGRSMPTSMALDRVAKSMKVPVYETPAGWRFFSNLMDSGRCNLCGEESFGTGSDHLREKDGLWAVLVWLSIIAARKQSVEEIVRDHWAKFGRHYYCRFDYEGLDPKTTYYIMRDLEALVTDKSFIGQQFAVGSHVYSVAKTDSFEYVDPVDGTVTKKQGLRIIFSDASRLIFRLSSSSGVRATLRLYAESYERDPSGHDQEPQAVLSPLIAIALKISQIHERTGRRGPTVIT

SEQ ID NO: 750872 - protein, 643 aa, Homo sapiens; identical to SEQ ID NO: 750871

SEQ ID NO: 750873 - protein, 643 aa, Homo sapiens; identical to SEQ ID NO: 750871

SEQ ID NO: 750874 - protein, 56 aa, Homo sapiens
MQLSLLCTPVQGTRLLPVGSAWSLCHPHLGLGFFPATVGVRTHLHFLQHLKELRRL

SEQ ID NO: 750875 - protein, 49 aa, Homo sapiens
MSVISCISYSVKETKLNEKYIFKKVAILNYGREIKISKTYLQSGSGGRS

SEQ ID NO: 750876 - protein, 71 aa, Homo sapiens
VGVPSGTGTTAKEAGLRGSSTPAPPFRQGVLRMNVFPSLPLGYPSAEILLLLCTVFSIPQADISIKQILEF

SEQ ID NO: 750877 - protein, 36 aa, Homo sapiens
MPPPQGDVTALFLGPPGLGKSALIAALCDKDVETLE

SEQ ID NO: 750878 - protein, 650 aa, Homo sapiens
GGGRGPLVALGTLYLWALESRHKSATELWRWWLRRRRRQRRRQLWGLRLGVCRPPLLLGPGMYRWLVRILGTIFRFCDRSVPPARALLKRRRSDSTLFSTVDTDEIPAKRPRLDCFIHQVKNSLYNAASLFGFPFQLTTKPMVTSACNGTRNVAPSGEVFSNSSSCELTGSGSWNNMLKLGNKSPNGISDYPKIRVTVTRDQPRRVLPSFGFTLNSEGCNRRPGGRRHSKGNPESSLMWKPQEQAVTEMISEESGKGLRRPHCTVEEGVQKEEREKYRKLLERLKESGHGNSVCPVTSNYHSSQRSQMDTLKTKGWGEEQNHGVKTTQFVPKQYRLVETRGPLCSLRSEKRCSKGKITDTEKMVGIRFENESRRGYQLEPDLSEEVSARLRLGSGSNGLLRRKVSIIETKEKNCSGKERDRRTDDLLELTEDMEKEISNALGHGPQDEILSSAFKLRITRGDIQTLKNYHWLNDEVINFYMNLLVERNKKQGYPALHVFSTFFYPKLKSGGYQAVKRWTKGVNLFEQEIILVPIHRKVHWSLVVIDLRKKCLKYLDSMGQKGHRICEILLQYLQDESKTKRNSDLNLLEWTHHSMKPHEIPQQLNGSDCGMFTCKYADYISRDKPITFTQHQMPLFRKKMVWEILHQQLL

SEQ ID NO: 750879 - protein, 260 aa, Homo sapiens
GFGGPGYPRPTEAPLLLGPGMYRWLVRILGTIFRFCDRSVPPARALLKRRRSDSTLFSTVDTDEIPAKRPRLDGFIHQVKNSLYKAASLFGFPFQLTTKPMVTSACNGTRNVAPSGEVFSNSSSCELTGSGSWNNMLKLGNKSPNGISDYPKIRVTVTRDQPRRVLPSFGFTLNSEGCNRRPGGRRHSKGNPESSLMWKPQEQAVTEMISEESGKGLRRPHCTVEEVSLFSLISLKKILQLFPRMLPRDTQNGSTFDIPL

SEQ ID NO: 750880 - protein, 241 aa, Homo sapiens
ASLAVVVKTAKAAAAATALGFASRGVSAAAAAWACTLFSTVDTDEIPAKRPRLDGFIHQVKNSLYKAASLFGFPFQLTTKPMVTSACNGTRNVAPSGEVFSNSSSCELTGSGSWNNMLKLGNKSPNGISDYPKIRVTVTRDQPRRVLPSFGFTLNSEGCNRRPGGRRHSKGNPESSLMWKPQEQAVTEMISEESGKGLRRPHCTVEEVSLFSLISLKKILQLFPRMLPRDTQNGSTFDIPL

SEQ ID NO: 750881 - protein, 650 aa, Homo sapiens; identical to SEQ ID NO: 750878

SEQ ID NO: 750882 - protein, 650 aa, Homo sapiens; identical to SEQ ID NO: 750878

SEQ ID NO: 750883 - protein, 650 aa, Homo sapiens; identical to SEQ ID NO: 750878

SEQ ID NO: 750884 - protein, 650 aa, Homo sapiens; identical to SEQ ID NO: 750878

SEQ ID NO: 750885 - protein, 253 aa, Homo sapiens
GKITDTETMVGIRFENESRRGYQLEPDLSEEVSARLRLGSGSNGLLRRKVSIIETKEKNCSGKERDRRTDDLLELTEVFINFYMNLLVERNKKQGYPALHVFSTFFYPKLKSGGYQAVKRWTKGVNLFEQEIILVPIHRKVHWSLVVIDLRKKCLKYLDSMGQKGHRICEILLQYLQDESKTKRNSDLNLLEWTHHSMKPHEIPQQLNGSDCGMFTCKYADYISRDKPITFTQHQMPLFRKKMVWEILHQQLL

SEQ ID NO: 750886 - protein, 184 aa, Homo sapiens
GKITDTETMVGIRFENESRRGYQLEPDLSEEVSARLRLGSGSNGLLRRKVSIIETKEKNCSGKERDRRTDDLLELTEVIDLRKKCLKYLDSMGQKGHRICEILLQYLQDESKTKRNSDLNLLEWTHHSMKPHEIPQQLNGSDCGMFTCKYADYISRDKPITFTQHQMPLFRKKMVWEILHQQLL

SEQ ID NO: 750887 - protein, 111 aa, Homo sapiens [sequence omitted]

SEQ ID NO: 750888 - protein, 652 aa, Homo sapiens
GGGRGPLVALGTLYLWALESRHKSATELWRWWLRRRRRQRRRQLWGLRLGVCRPPLLLGPGMYRWLVRILGTIFRFCDRSVPPARALLKRRRSDSTLFSTVDTDEIPAKRPRLDCFIHQVKNSLYNAASLFGFPFQLTTKPMVTSACNGTRNVAPSGEVFSNSSSCELTGSGSWNNMLKLGNKSPNGISDYPKIRVTVTRDQPRRVLPSFGFTLNSEGCNRRPGGRRHSKGNPESSLMWKPQEQAVTEMISEESGKGLRRPHCTVEEGVQKEEREKYRKLLERLKESGHGNSVCPVTSNYHSSQRSQMDTLKTKGWGEEQNHGVKTTQFVPKQYRLVETRGPLCSLRSEKRCSKGKITDTEKMVGIRFENESRRGYQLEPDLSEEVSARLRLGSGSNGLLRRKVSIIETKEKNCSGKERDRRTDDLLELTEDMEKEISNALGHGPQDEILSSAFKLRITRGDIQTLKNYHWLNDEVINFYMNLLVERNKKQGYPALHVFSTFFYPKLKSGGYQAVKRWTKGVNLFEQEIILVPIHRKVHWSLVVIDLRKKCLKYLDSMGQKGHRICEILLQYLQDESKTKRNSDLNLLEWTHHSMKPHEIPQQLNGSDCGMFTCKYADYISRDKPITFTQHQMPLFRKKIARVIPSNHDRPW

SEQ ID NO: 750889 - protein, 642 aa, Homo sapiens
GGGRGPLVALGTLYLWALESRHKSATELWRWWLRRRRRQRRRQLWGLRLGVCRPPLLLGPGMYRWLVRILGTIFRFCDRSVPPARALLKRRRSDSTLFSTVDTDEIPAKRPRLDCFIHQVKNSLYNAASLFGFPFQLTTKPMVTSACNGTRNVAPSGEVFSNSSSCELTGSGSWNNMLKLGNKSPNGISDYPKIRVTVTRDQPRRVLPSFGFTLNSEGCNRRPGGRRHSKGNPESSLMWKPQEQAVTEMISEESGKGLRRPHCTVEEGVQKEEREKYRKLLERLKESGHGNSVCPVTSNYHSSQRSQMDTLKTKGWGEEQNHGVKTTQFVPKQYRLVETRGPLCSLRSEKRCSKGKITDTEKMVGIRFENESRRGYQLEPDLSEEVSARLRLGSGSNGLLRRKVSIIETKEKNCSGKERDRRTDDLLELTEDMEKEISNALGHGPQDEILSSAFKLRITRGDIQTLKNYHWLNDEVINFYMNLLVERNKKQGYPALHVFSTFFYPKLKSGGYQAVKRWTKGVNLFEQEIILVPIHRKVHWSLVVIDLRKKCLKYLDSMGQKGHRICEILLQYLQDESKTKRNSDLNLLEWTHHSMKPHEIPQQLNGSDCGMFTCKYADYISRDKPITFTQVSEDPLHPFTCY

SEQ ID NO: 750890 - protein, 550 aa, Homo sapiens
GGGRGPLVALGTLYLWALESRHKSATELWRWWLRRRRRQRRRQLWGLRLGVCRPPLLLGPGMYRWLVRILGTIFRFCDRSVPPARALLKRRRSDSTLFSTVDTDEIPAKRPRLDCFIHQVKNSLYNAASLFGFPFQLTTKPMVTSACNGTRNVAPSGEVFSNSSSCELTGSGSWNNMLKLGNKSPNGISDYPKIRVTVTRDQPRRVLPSFGFTLNSEGCNRRPGGRRHSKGNPESSLMWKPQEQAVTEMISEESGKGLRRPHCTVEEGVQKEEREKYRKLLERLKESGHGNSVCPVTSNYHSSQRSQMDTLKTKGWGEEQNHGVKTTQFVPKQYRLVETRGPLCSLRSEKRCSKGKITDTEKMVGIRFENESRRGYQLEPDLSEEVSARLRLGSGSNGLLRRKVSIIETKEKNCSGKERDRRTDDLLELTEDMEKEISNALGHGPQDEILSSAFKLRITRGDIQTLKNYHWLNDEVINFYMNLLVERNKKQGYPALHVFSTFFYPKLKSGGYQAVKRWTKGVNLFEQEIILVPIHRKVHWSLVVIERVNG

SEQ ID NO: 750891 - protein, 35 aa, Homo sapiens
MALASAVTLLLKADWLNLTSWLACHPALENMFVQG

SEQ ID NO: 750892 - protein, 207 aa, Homo sapiens
MVPHDVGLTILKGAVLFGQAPGVVRVRRSPLTYGVGVLNRFVPGRHPPEKLLVRDGRRWCTDVFERFVAAEQSVALGEEVRRSYCPARPGQRRVLINLYCCAAEDARFITDPGVRKCGALSLELEPADCGQDTAGAPPGRREIRAAMQFGDTEIKVTAVDVSTNRSVRASIDFLSTEGAPARCQRRLPGPALFRFRGLRSGLGRGKR

SEQ ID NO: 750893 - protein, 207 aa, Homo sapiens; identical to SEQ ID NO: 750892

SEQ ID NO: 750894 - protein, 370 aa, Homo sapiens
GGPYGAVGVDLAFEQLLCRIFGEDFIATFKRQRPAAWVDLTIAFEARKRTAGPHRAGALNISLPFSFIDFYRKQRGHNVETALRRSSVNFVKWSSQGMLRMSCEAMNELFQPTVSGIIQHIEALLARPEVQGVKLLFLVGGFAESAVLQHAVQAALGARGLRVVVPHDVGLTILKGAVLFGQAPGVVRVRRSPLTYGVGVLNRFVPGRHPPEKLLVRDGRRWCTDVFERFVAAEQSVALGEEVRRSYCPARPGQRRVLINLYCCAAEDARFITDPGVRKCGALSLELEPADCGQDTAGAPPGRREIRAAMQFGDTEIKVTAVDVSTNRSVRASIDFLSTEGAPARCQRRLPGPALFRFRGLRSGLGRGKR

SEQ ID NO: 750895 - protein, 207 aa, Homo sapiens; identical to SEQ ID NO: 750892

SEQ ID NO: 750896 - protein, 120 aa, Homo sapiens
MTDFVRLAVLPTVPESPEEEVKASQLSVQQNKLSVQSNPSPQLRSVMKVESSENVPSPTHPPVVINAADDDEDDDDQFSEEGDETKTPTLQPTPEVHNGLRVTSVQKPAVNMKKDECLNF

SEQ ID NO: 750897 - protein, 86 aa, Homo sapiens
KKSSTHRFAYNLMDFTDILKRMDKNPKIQEKPSTWSAAQESLPVVQAMLSYSSHAGSCSLEKCYLQMCTSCVCVCCSACVQNTCFF

SEQ ID NO: 750898 - protein, 165 aa, Homo sapiens
SLLPPGMGCNECTHPSCQHSLSMLGIGQCVECESGVLVLDPTSGPKWKVACNKCNVVAHCFENAHRVRVSADTCSVCEAALLDVDFNKAKSPLPGDDEQHMGCVFCDPVFQELVELKHAASCHPMHRGGPGRRQGRGRGRARRPPGKPNPRRPKDKMSALAAYFV

SEQ ID NO: 750899 - protein, 292 aa, Homo sapiens
HKATGVFISTARWCWERLPSLALKASSLDLATAALTVMLDSVTHSTFLPNASFCDPLMSWTDLFSNEEYYPAFEHQTACDSYWTSVHPEYWTKRHVWEWLQFCCDQYKLDTNCISFCNFNISGLQLCSMTQEEFVEAAGLCGEYLYFILQNIRTQGYSFFNDAEESKATIKDYADSNCLKTSGIKSQDCHSHSRTSLQSSHLWEFVRDLLLSPEENCGILEWEDREQGIFRVVKSEALAKMWGQRKKNDRMTYEKLSRALRYYYKTGILERVDRRLVYKFGKNAHGWQEDKL

SEQ ID NO: 750900 - protein, 265 aa, Homo sapiens
MPSLPHSHRVMLDSVTHSTFLPNASFCDPLMSWTDLFSNEEYYPAFEHQTACDSYWTSVHPEYWTKRHVWEWLQFCCDQYKLDTNCISFCNFNISGLQLCSMTQEEFVEAAGLCGEYLYFILQNIRTQGYSFFNDAEESKATIKDYADSNCLKTSGIKSQDCHSHSRTSLQSSHLWEFVRDLLLSPEENCGILEWEDREQGIFRVVKSEALAKMWGQRKKNDRMTYEKLSRALRYYYKTGILERVDRRLVYKFGKNAHGWQEDKL

SEQ ID NO: 750901 - protein, 1113 aa, Homo sapiens
MNCLDCLDRTNTVQSFIALEVLHLQLKTLGLSSKPIVDRFVESFKAMWSLNGHSLSKVFTGSRALEGKAKVGKLKDGARSMSRTIQSNFFDGVKQEAIKLLLVGDVYGEEVADKGGMLLDSTALLVTPRILKAMTERQSEFTNFKRIRIAMGTWNVNGGKQFRSNVLRTAELTDWLLDSPQLSGATDSQDDSSPADIFAVGFEEMVELSAGNIVNASTTNKKMWGEQLQKAISRSHRYILLTSAQLVGVCLYIFVRPYHVPFIRDVAIDTVKTGMGGKAGNKGAVGIRFQFHSTSFCFICSHLTAGQSQVKERNEDYKEITQKLCFPMGRNVFSHDYVFWCGDFNYRIDLTYEEVFYFVKRQDWKKLLEFDQLQLQKSSGKIFKDFHEGAINFGPTYKYDVGSAAYDTSDKCRTPAWTDRVLWWRKKHPFDKTAGELNLLDSDLDVDTKVRHTWSPGALQYYGRAELQASDHRPVLAIVEVEVQEVDVGARERVFQEVSSFQGPLDATVVVNLQSPTLEEKNEFPEDLRTELMQTLGSYGTIVLVRINQGQMLVTFADSHSALSVLDVDGMKVKGRAVKIRPKTKDWLKGLREEIIRKRDSMAPVSPTANSCLLEENFDFTSLDYESEGDILEDDEDYLVDEFNQPGVSDSELGGDDLSDVPGPTALAPPSKSPALTKKKQHPTYKDDADLVELKRELEAVGEFRHRSPSRSLSVPNRPRPPQPPQRPPPPTGLMVKKSASDASISSGTHGQYSILQTARLLPGAPQQPPKARTGISKPYNVKQIKTTNAQEAEAAIRCLLEARGGASEEALSAVAPRDLEASSEPEPTPGAAKPETPQAPPLLPRRPPPRVPAIKKPTLRRTGKPLSPEEQFEQQTVHFTIGPPETSVEAPPVVTAPRVPPVPKPRTFQPGKAAERPSHRKPASDEAPPGAGASVPPPLEAPPLVPKVPPRRKKSAPAAFHLQVLQSNSQLLQGLTYNSSDSPSGHPPAAGTVFPQGDFLSTSSATSPDSDGTKAMKPEAAPLLGDYQDPFWNLLHHPKLLNNTWLSKSSDPLDSGTRSPKRDPIDPVSAGASAAKAELPPDHEHKTLGHWVTISDQEKRTALQVFDPLAKT

SEQ ID NO: 750902 - protein, 188 aa, Homo sapiens
GRAGSCRGQRALGRTWPRPPPAVGPTLMALSKGLRLLGRLGAEGDCSVLLEARGRDDCLLFEAGTVATLAPEEKEVIKGQYGKLTDAYGCLGELRLKSGGTSLSFLVLVTGCTSVGRIPDAEIYKITATDFYPLQEEAKEEERLIALKKILSSGVFYFSWPNDGSRFDLTVRTQKQGDDSSEWGNSFF

SEQ ID NO: 750903 - protein, 113 aa, Homo sapiens [sequence omitted]

SEQ ID NO: 750904 - protein, 147 aa, Homo sapiens
TPLTACGLGSRQVGKLKDGARSMSRTIQSNFFDGVKQEAIKLLLVGDVYGEEVADKGGMLLDSTALLVTPRILKAMTERQSEFTNFKRIRIAMGTWNVNGGKQFRSNVLRTAELTDWLLDSPQLSGATDSQGEGSDFGGDKIQLHLT

SEQ ID NO: 750905 - protein, 227 aa, Homo sapiens
LLIYTLCPTFSQPLSPEEQFEQQTVHFTIGPPETSVEAPPVVTAPRVPPVPKPRTFQPGKAAERPSHRKPASDEAPPGAGASVPPPLEAPPLVPKVPPRRKKSAPAAFHLQVLQSNSQLLQGLTYNSSDSPSGHPPAAGTVFPQGDFLSTSSATSPDSDGTKAMKPEAAPLLGDYQDPFWNLLHHPKLLNNTWLSKSSDPLDSGTRSPEILGPSVVALYLPLATDLA

SEQ ID NO: 750906 - protein, 119 aa, Homo sapiens
GRAGSCRGQRALGRTWPRPPPAVGPTLMALSKGLRLLGRLGAEGDCSVLLEARGRDDCLLFEAGTVATLGESGPGAATPGGEGARIRPASGRRVPPLPEGIGRRWDCRGVGVARRGVAV

SEQ ID NO: 750907 - protein, 1523 aa, Homo sapiens
GRAGSCRGQRALGRTWPRPPPAVGPTLMALSKGLRLLGRLGAEGDCSVLLEARGRDDCLLFEAGTVATLAPEEKEVIKGQYGKLTDAYGCLGELRLKSGGTSLSFLVLVTGCTSVGRIPDAEIYKITATDFYPLQEEAKEEERLIALKKILSSGVFYFSWPNDGSRFDLTVRTQKQGDDSSEWGNSFFWNQLLHVPLRQHQVSCCDWLLKIICGVVTIRTVYASHKQAKACLVSRVSCERTGTRFHTRGVNDDGHVSNFVETEQMIYMDDGVSSFVQIRGSVPLFWEQPGLQVGSHHLRLHRGLEANAPAFDRHMVLLKEQYGQQVVVNLLGSRGGEEVLNRAFKKLLWASCHAGDTPMINFDFHQFAKGGKLEKLETLLRPQLKLHWEDFDVFTKGENVSPRFQKGTLRMNCLDCLDRTNTVQSFIALEVLHLQLKTLGLSSKPIVDRFVESFKAMWSLNGHSLSKVFTGSRALEGKAKVGKLKDGARSMSRTIQSNFFDGVKQEAIKLLLVGDVYGEEVADKGGMLLDSTALLVTPRILKAMTERQSEFTNFKRIRIAMGTWNVNGGKQFRSNVLRTAELTDWLLDSPQLSGATDSQDDSSPADIFAVGFEEMVELSAGNIVNASTTNKKMWGEQLQKAISRSHRYILLTSAQLVGVCLYIFVRPYHVPFIRDVAIDTVKTGMGGKAGNKGAVGIRFQFHSTSFCFICSHLTAGQSQVKERNEDYKEITQKLCFPMGRNVFSHDYVFWCGDFNYRIDLTYEEVFYFVKRQDWKKLLEFDQLQLQKSSGKIFKDFHEGAINFGPTYKYDVGSAAYDTSDKCRTPAWTDRVLWWRKKHPFDKTAGELNLLDSDLDVDTKVRHTWSPGALQYYGRAELQASDHRPVLAIVEVEVQEVDVGARERVFQEVSSFQGPLDATVVVNLQSPTLEEKNEFPEDLRTELMQTLGSYGTIVLVRINQGQMLVTFADSHSALSVLDVDGMKVKGRAVKIRPKTKDWLKGLREEIIRKRDSMAPVSPTANSCLLEENFDFTSLDYESEGDILEDDEDYLVDEFNQPGVSDSELGGDDLSDVPGPTALAPPSKSPALTKKKQHPTYKDDADLVELKRELEAVGEFRHRSPSRSLSVPNRPRPPQPPQRPPPPTGLMVKKSASDASISSGTHGQYSILQTARLLPGAPQQPPKARTGISKPYNVKQIKTTNAQEAEAAIRCLLEARGGASEEALSAVAPRDLEASSEPEPTPGAAKPETPQAPPLLPRRPPPRVPAIKKPTLRRTGKPLSPEEQFEQQTVHFTIGPPETSVEAPPVVTAPRVPPVPKPRTFQPGKAAERPSHRKPASDEAPPGAGASVPPPLEAPPLVPKVPPRRKKSAPAAFHLQVLQSNSQLLQGLTYNSSDSPSGHPPAAGTVFPQGDFLSTSSATSPDSDGTKAMKPEAAPLLGDYQDPFWNLLHHPKLLNNTWLSKSSDPLDSGTRSPKRDPIDPVSAGASAAKAELPPDHEHKTLGHWVTISDQEKRTALQVFDPLAKT

SEQ ID NO: 750908 - protein, 1474 aa, Homo sapiens
MNRNEQETLADAFCDVFLPPAPEEKEVIKGQYGKLTDAYGCLGELRLKSGGTSLSFLVLVTGCTSVGRIPDAEIYKITATDFYPLQEEAKEEERLIALKKILSSGVFYFSWPNDGSRFDLTVRTQKQGDDSSEWGNSFFWNQLLHVPLRQHQVSCCDWLLKIICGVVTIRTVYASHKQAKACLVSRVSCERTGTRFHTRGVNDDGHVSNFVETEQMIYMDDGVSSFVQIRGSVPLFWEQPGLQVGSHHLRLHRGLEANAPAFDRHMVLLKEQYGQQVVVNLLGSRGGEEVLNRAFKKLLWASCHAGDTPMINFDFHQFAKGGKLEKLETLLRPQLKLHWEDFDVFTKGENVSPRFQKGTLRMNCLDCLDRTNTVQSFIALEVLHLQLKTLGLSSKPIVDRFVESFKAMWSLNGHSLSKVFTGSRALEGKAKVGKLKDGARSMSRTIQSNFFDGVKQEAIKLLLVGDVYGEEVADKGGMLLDSTALLVTPRILKAMTERQSEFTNFKRIRIAMGTWNVNGGKQFRSNVLRTAELTDWLLDSPQLSGATDSQDDSSPADIFAVGFEEMVELSAGNIVNASTTNKKMWGEQLQKAISRSHRYILLTSAQLVGVCLYIFVRPYHVPFIRDVAIDTVKTGMGGKAGNKGAVGIRFQFHSTSFCFICSHLTAGQSQVKERNEDYKEITQKLCFPMGRNVFSHDYVFWCGDFNYRIDLTYEEVFYFVKRQDWKKLLEFDQLQLQKSSGKIFKDFHEGAINFGPTYKYDVGSAAYDTSDKCRTPAWTDRVLWWRKKHPFDKTAGELNLLDSDLDVDTKVRHTWSPGALQYYGRAELQASDHRPVLAIVEVEVQEVDVGARERVFQEVSSFQGPLDATVVVNLQSPTLEEKNEFPEDLRTELMQTLGSYGTIVLVRINQGQMLVTFADSHSALSVLDVDGMKVKGRAVKIRPKTKDWLKGLREEIIRKRDSMAPVSPTANSCLLEENFDFTSLDYESEGDILEDDEDYLVDEFNQPGVSDSELGGDDLSDVPGPTALAPPSKSPALTKKKQHPTYKDDADLVELKRELEAVGEFRHRSPSRSLSVPNRPRPPQPPQRPPPPTGLMVKKSASDASISSGTHGQYSILQTARLLPGAPQQPPKARTGISKPYNVKQIKTTNAQEAEAAIRCLLEARGGASEEALSAVAPRDLEASSEPEPTPGAAKPETPQAPPLLPRRPPPRVPAIKKPTLRRTGKPLSPEEQFEQQTVHFTIGPPETSVEAPPVVTAPRVPPVPKPRTFQPGKAAERPSHRKPASDEAPPGAGASVPPPLEAPPLVPKVPPRRKKSAPAAFHLQVLQSNSQLLQGLTYNSSDSPSGHPPAAGTVFPQGDFLSTSSATSPDSDGTKAMKPEAAPLLGDYQDPFWNLLHHPKLLNNTWLSKSSDPLDSGTRSPKRDPIDPVSAGASAAKAELPPDHEHKTLGHWVTISDQEKRTALQVFDPLAKT

SEQ ID NO: 750909 - protein, 1542 aa, Homo sapiens
GRAGSCRGQRALGRTWPRPPPAVGPTLMALSKGLRLLGRLGAEGDCSVLLEARGRDDCLLFEAGTVATLAPEEKEVIKGQYGKLTDAYGCLGELRLKSGGTSLSFLVLVTGCTSVGRIPDAEIYKITATDFYPLQEEAKEEERLIALKKILSSGVFYFSWPNDGSRFDLTVRTQKQGDDSSEWGNSFFWNQLLHVPLRQHQVSCCDWLLKIICGVVTIRTVYASHKQAKACLVSRVSCERTGTRFHTRGVNDDGHVSNFVETEQMIYMDDGVSSFVQIRGSVPLFWEQPGLQVGSHHLRLHRGLEANAPAFDRHMVLLKEQYGQQVVVNLLGSRGGEEVLNRAFKKLLWASCHAGDTPMINFDFHQFAKGGKLEKLETLLRPQLKLHWEDFDVFTKGENVSPRGGSLRTVPRLLLGGSVSPRFQKGTLRMNCLDCLDRTNTVQSFIALEVLHLQLKTLGLSSKPIVDRFVESFKAMWSLNGHSLSKVFTGSRALEGKAKVGKLKDGARSMSRTIQSNFFDGVKQEAIKLLLVGDVYGEEVADKGGMLLDSTALLVTPRILKAMTERQSEFTNFKRIRIAMGTWNVNGGKQFRSNVLRTAELTDWLLDSPQLSGATDSQDDSSPADIFAVGFEEMVELSAGNIVNASTTNKKMWGEQLQKAISRSHRYILLTSAQLVGVCLYIFVRPYHVPFIRDVAIDTVKTGMGGKAGNKGAVGIRFQFHSTSFCFICSHLTAGQSQVKERNEDYKEITQKLCFPMGRNVFSHDYVFWCGDFNYRIDLTYEEVFYFVKRQDWKKLLEFDQLQLQKSSGKIFKDFHEGAINFGPTYKYDVGSAAYDTSDKCRTPAWTDRVLWWRKKHPFDKTAGELNLLDSDLDVDTKVRHTWSPGALQYYGRAELQASDHRPVLAIVEVEVQEVDVGARERVFQEVSSFQGPLDATVVVNLQSPTLEEKNEFPEDLRTELMQTLGSYGTIVLVRINQGQMLVTFADSHSALSVLDVDGMKVKGRAVKIRPKTKDWLKGLREEIIRKRDSMAPVSPTANSCLLEENFDFTSLDYESEGDILEDDEDYLVDEFNQPGVSDSELGGDDLSDVPGPTALAPPSKSPALTKKKQHPTYKDDADLVELKRELEAVGEFRHRSPSRSLSVPNRPRPPQPPQRPPPPTGLMVKKSASDASISSGTHGQYSILQTARLLPGAPQQPPKARTGISKPYNVKQIKTTNAQEAEAAIRCLLEARGGASEEALSAVAPRDLEASSEPEPTPGAAKPETPQAPPLLPRRPPPRVPAIKKPTLRRTGKPLSPEEQFEQQTVHFTIGPPETSVEAPPVVTAPRVPPVPKPRTFQPGKAAERPSHRKPASDEAPPGAGASVPPPLEAPPLVPKVPPRRKKSAPAAFHLQVLQSNSQLLQGLTYNSSDSPSGHPPAAGTVFPQGDFLSTSSATSPDSDGTKAMKPEAAPLLGDYQDPFWNLLHHPKLLNNTWLSKSSDPLDSGTRSPKRDPIDPVSAGASAAKAELPPDHEHKTLGHWVTISDQEKRTALQVFDPLAKT

SEQ ID NO: 750910 - protein, 839 aa, Homo sapiens
MGGKAGNKGAVGIRFQFHSTSFCFICSHLTAGQSQVKERNEDYKEITQKLCFPMGRNVFSHDYVFWCGDFNYRIDLTYEEVFYFVKRQDWKKLLEFDQLQLQKSSGKIFKDFHEGAINFGPTYKYDVGSAAYDTSDKCRTPAWTDRVLWWRKKHPFDKTAGELNLLDSDLDVDTKVRHTWSPGALQYYGRAELQASDHRPVLAIVEVEVQEVDVGARERVFQEVSSFQGPLDATVVVNLQSPTLEEKNEFPEDLRTELMQTLGSYGTIVLVRINQGQMLVTFADSHSALSVLDVDGMKVKGRAVKIRPKTKDWLKGLREEIIRKRDSMAPVSPTANSCLLEENFDFTSLDYESEGDILEDDEDYLVDEFNQPGVSDSELGGDDLSDVPGPTALAPPSKSPALTKKKQHPTYKDDADLVELKRELEAVGEFRHRSPSRSLSVPNRPRPPQPPQRPPPPTGLMVKKSASDASISSGTHGQYSILQTARLLPGAPQQPPKARTGISKPYNVKQIKTTNAQEAEAAIRCLLEARGGASEEALSAVAPRDLEASSEPEPTPGAAKPETPQAPPLLPRRPPPRVPAIKKPTLRRTGKPLSPEEQFEQQTVHFTIGPPETSVEAPPVVTAPRVPPVPKPRTFQPGKAAERPSHRKPASDEAPPGAGASVPPPLEAPPLVPKVPPRRKKSAPAAFHLQVLQSNSQLLQGLTYNSSDSPSGHPPAAGTVFPQGDFLSTSSATSPDSDGTKAMKPEAAPLLGDYQDPFWNLLHHPKLLNNTWLSKSSDPLDSGTRSPKRDPIDPVSAGASAAKAELPPDHEHKTLGHWVTISDQEKRTALQVFDPLAKT

SEQ ID NO: 750911 - protein, 1165 aa, Homo sapiens
MINFDFHQFAKGGKLEKLETLLRPQLKLHWEDFDVFTKGENVSPRFQKGTLRMNCLDCLDRTNTVQSFIALEVLHLQLKTLGLSSKPIVDRFVESFKAMWSLNGHSLSKVFTGSRALEGKAKVGKLKDGARSMSRTIQSNFFDGVKQEAIKLLLVGDVYGEEVADKGGMLLDSTALLVTPRILKAMTERQSEFTNFKRIRIAMGTWNVNGGKQFRSNVLRTAELTDWLLDSPQLSGATDSQDDSSPADIFAVGFEEMVELSAGNIVNASTTNKKMWGEQLQKAISRSHRYILLTSAQLVGVCLYIFVRPYHVPFIRDVAIDTVKTGMGGKAGNKGAVGIRFQFHSTSFCFICSHLTAGQSQVKERNEDYKEITQKLCFPMGRNVFSHDYVFWCGDFNYRIDLTYEEVFYFVKRQDWKKLLEFDQLQLQKSSGKIFKDFHEGAINFGPTYKYDVGSAAYDTSDKCRTPAWTDRVLWWRKKHPFDKTAGELNLLDSDLDVDTKVRHTWSPGALQYYGRAELQASDHRPVLAIVEVEVQEVDVGARERVFQEVSSFQGPLDATVVVNLQSPTLEEKNEFPEDLRTELMQTLGSYGTIVLVRINQGQMLVTFADSHSALSVLDVDGMKVKGRAVKIRPKTKDWLKGLREEIIRKRDSMAPVSPTANSCLLEENFDFTSLDYESEGDILEDDEDYLVDEFNQPGVSDSELGGDDLSDVPGPTALAPPSKSPALTKKKQHPTYKDDADLVELKRELEAVGEFRHRSPSRSLSVPNRPRPPQPPQRPPPPTGLMVKKSASDASISSGTHGQYSILQTARLLPGAPQQPPKARTGISKPYNVKQIKTTNAQEAEAAIRCLLEARGGASEEALSAVAPRDLEASSEPEPTPGAAKPETPQAPPLLPRRPPPRVPAIKKPTLRRTGKPLSPEEQFEQQTVHFTIGPPETSVEAPPVVTAPRVPPVPKPRTFQPGKAAERPSHRKPASDEAPPGAGASVPPPLEAPPLVPKVPPRRKKSAPAAFHLQVLQSNSQLLQGLTYNSSDSPSGHPPAAGTVFPQGDFLSTSSATSPDSDGTKAMKPEAAPLLGDYQDPFWNLLHHPKLLNNTWLSKSSDPLDSGTRSPKRDPIDPVSAGASAAKAELPPDHEHKTLGHWVTISDQEKRTALQVFDPLAKT

SEQ ID NO: 750912 - protein, 543 aa, Homo sapiens
MKVKGRAVKIRPKTKDWLKGLREEIIRKRDSMAPVSPTANSCLLEENFDFTSLDYESEGDILEDDEDYLVDEFNQPGVSDSELGGDDLSDVPGPTALAPPSKSPALTKKKQHPTYKDDADLVELKRELEAVGEFRHRSPSRSLSVPNRPRPPQPPQRPPPPTGLMVKKSASDASISSGTHGQYSILQTARLLPGAPQQPPKARTGISKPYNVKQIKTTNAQEAEAAIRCLLEARGGASEEALSAVAPRDLEASSEPEPTPGAAKPETPQAPPLLPRRPPPRVPAIKKPTLRRTGKPLSPEEQFEQQTVHFTIGPPETSVEAPPVVTAPRVPPVPKPRTFQPGKAAERPSHRKPASDEAPPGAGASVPPPLEAPPLVPKVPPRRKKSAPAAFHLQVLQSNSQLLQGLTYNSSDSPSGHPPAAGTVFPQGDFLSTSSATSPDSDGTKAMKPEAAPLLGDYQDPFWNLLHHPKLLNNTWLSKSSDPLDSGTRSPKRDPIDPVSAGASAAKAELPPDHEHKTLGHWVTISDQEKRTALQVFDPLAKT

SEQ ID NO: 750913 - protein, 1542 aa, Homo sapiens; identical to SEQ ID NO: 750909

SEQ ID NO: 750914 - protein, 314 aa, Homo sapiens [sequence omitted]

SEQ ID NO: 750915 - protein, 1542 aa, Homo sapiens; identical to SEQ ID NO: 750909

SEQ ID NO: 750916 - protein, 1220 aa, Homo sapiens
GRAGSCRGQRALGRTWPRPPPAVGPTLMALSKGLRLLGRLGAEGDCSVLLEARGRDDCLLFEAGTVATLAPEEKEVIKGQYGKLTDAYGCLGELRLKSGGTSLSFLVLVTGCTSVGRIPDAEIYKITATDFYPLQEEAKEEERLIALKKILSSGVFYFSWPNDGSRFDLTVRTQKQGDDSSEWGNSFFWNQLLHVPLRQHQVSCCDWLLKIICGVVTIRTVYASHKQAKACLVSRVSCERTGTRFHTRGVNDDGHVSNFVETEQMIYMDDGVSSFVQIRGSVPLFWEQPGLQVGSHHLRLHRGLEANAPAFDRHMVLLKEQYGQQVVVNLLGSRGGEEVLNRAFKKLLWASCHAGDTPMINFDFHQFAKGGKLEKLETLLRPQLKLHWEDFDVFTKGENVSPRGGSLRTVPRLLLGGSVSPRFQKGTLRMNCLDCLDRTNTVQSFIALEVLHLQLKTLGLSSKPIVDRFVESFKAMWSLNGHSLSKVFTGSRALEGKAKVGKLKDGARSMSRTIQSNFFDGVKQEAIKLLLVGDVYGEEVADKGGMLLDSTALLVTPRILKAMTERQSEFTNFKRIRIAMGTWNVNGGKQFRSNVLRTAELTDWLLDSPQLSGATDSQDDSSPADIFAVGFEEMVELSAGNIVNASTTNKKMWGEQLQKAISRSHRYILLTSAQLVGVCLYIFVRPYHVPFIRDVAIDTVKTGMGGKAGNKGAVGIRFQFHSTSFCFICSHLTAGQSQVKERNEDYKEITQKLCFPMGRNVFSHDYVFWCGDFNYRIDLTYEEVFYFVKRQDWKKLLEFDQLQLQKSSGKIFKDFHEGAINFGPTYKYDVGSAAYDTSDKCRTPAWTDRVLWWRKKHPFDKTAGELNLLDSDLDVDTKVRHTWSPGALQYYGRAELQASDHRPVLAIVEVEVQEVDVGARERVFQEVSSFQGPLDATVVVNLQSPTLEEKNEFPEDLRTELMQTLGSYGTIVLVRINQGQMLVTFADSHSALSVLDVDGMKVKGRAVKIRPKTKDWLKGLREEIIRKRDSMAPVSPTANSCLLEENFDFTSLDYESEGDILEDDEDYLVDEFNQPGVSDSELGGGKCHLSLGNAMAACRSFQRALELDHKNAQAQQEFKNANAVMEYEKIAETDFEKRDFRKVVFCMDRALEFAPACHRFKILKAECLAMLGRYPEAQSVASDILRMDSTNADALYVRGLCLYYEDRIEKAVSFRTGSQD

SEQ ID NO: 750917 - protein, 1072 aa, Homo sapiens
GDAGSCRGQRALGRTWPRPPPAVGPTLMALSKGLRLLGRLGAEGDCSVLLEARGRDDCLLFEAGTVATLAPEEKEVIKGQYGKLTDAYGCLGELRLKSGGTSLSFLVLVTGCTSVGRIPDAEIYKITATDFYPLQEEAKEEERLIALKKILSSGVFYFSWPNDGSRFDLTVRTQKQGDDSSEWGNSFFWNQLLHVPLRQHQVSCCDWLLKIICGVVTIRTVYASHKQAKACLVSRVSCERTGTRFHTRGVNDDGHVSNFVETEQMIYMDDGVSSFVQIRGSVPLFWEQPGLQVGSHHLRLHRGLEANAPAFDRHMVLLKEQYGQQVVVNLLGSRGGEEVLNRAFKKLLWASCHAGDTPMINFDFHQFAKGGKLEKLETLLRPQLKLHWEDFDVFTKGENVSPRGGSLRTVPRLLLGGSVSPRFQKGTLRMNCLDCLDRTNTVQSFIALEVLHLQLKTLGLSSKPIVDRFVESFKAMWSLNGHSLSKVFTGSRALEGKAKVGKLKDGARSMSRTIQSNFFDGVKQEAIKLLLVGDVYGEEVADKGGMLLDSTALLVTPRILKAMTERQSEFTNFKRIRIAMGTWNVNGGKQFRSNVLRTAELTDWLLDSPQLSGATDSQDDSSPADIFAVGFEEMVELSAGNIVNASTTNKKMWGEQLQKAISRSHRYILLTSAQLVGVCLYIFVRPYHVPFIRDVAIDTVKTGMGGKAGNKGAVGIRFQFHSTSFCFICSHLTAGQSQVKERNEDYKEITQKLCFPMGRNVFSHDYVFWCGDFNYRIDLTYEEVFYFVKRQDWKKLLEFDQLQLQKSSGKIFKDFHEGAINFGPTYKYDVGSAAYDTSDKCRTPAWTDRVLWWRKKHPFDKTAGELNLLDSDLDVDTKVRHTWSPGALQYYGRAELQASDHRPVLAIVEVEVQEVDVGARERVFQEVSSFQGPLDATVVVNLQSPTLEEKNEFPEDLRTELMQTLGSYGTIVLVRINQGQMLVTFADSHSALSVLDVDGMKVKGRAVKIRPKTKDWLKGLREEIIRKRDSMAPVSPTANSCLLEENFDFTSLDYESEGGYSCSTMIDYSADL

SEQ ID NO: 750918 - protein, 634 aa, Homo sapiens
GRAGSCRGQRALGRTWPRPPPAVGPTLMALSKGLRLLGRLGAEGDCSVLLEARGRDDCLLFEAGTVATLAPEEKEVIKGQYGKLTDAYGCLGELRLKSGGTSLSFLVLVTGCTSVGRIPDAEIYKITATDFYPLQEEAKEEERLIALKKILSSGVFYFSWPNDGSRFDLTVRTQKQGDDSSEWGNSFFWNQLLHVPLRQHQVSCCDWLLKIICGVVTIRTVYASHKQAKACLVSRVSCERTGTRFHTRGVNDDGHVSNFVETEQMIYMDDGVSSFVQIRGSVPLFWEQPGLQVGSHHLRLHRGLEANAPAFDRHMVLLKEQYGQQVVVNLLGSRGGEEVLNRAFKKLLWASCHAGDTPMINFDFHQFAKGGKLEKLETLLRPQLKLHWEDFDVFTKGENVSPRGGSLRTVPRLLLGGSVSPRFQKGTLRMNCLDCLDRTNTVQSFIALEVLHLQLKTLGLSSKPIVDRFVESFKAMWSLNGHSLSKVFTGSRALEGKAKVGKLKDGARSMSRTIQSNFFDGVKQEAIKLLLVGDVYGEEVADKGGMLLDSTALLVTPRILKAMTERQSEFTNFKRIRIAMGTWNVNGGKQFRSNVLRTAELTDWLLDSPQLSGATDSQGEGSDFGGDKIQLHLT

SEQ ID NO: 750919 - protein, 193 aa, Homo sapiens
GDAGSCRGQRALGRTWPRPPPAVGPTLMALSKGLRLLGRLGAEGDCSVLLEARGRDDCLLFEAGTVATLAPEEKEVIKGQYGKLTDAYGCLGELRLKSGGTSLSFLVLVTGCTSVGRIPDAEIYKITATDFYPLQEEAKEEERLIALKKILSSGVFYFSWPNDGSRFDLTPKPSPFYITIFSDFLPILKICFG

SEQ ID NO: 750920 - protein, 72 aa, Homo sapiens
RPPVLRSVSDTLTCGTDHCTHAPPCPPDDADLVELKRELEAVGEFRHRSPSRSLSVPNRPRPPQPPQRPPPP

SEQ ID NO: 750921 - protein, 80 aa, Homo sapiens
QSQKRLSGQGFLGSIHDHGLWDQGKLKIIITSAKQRTSKTGNNKARIGARRDELPSRSGSLSPPVREIMKEEAREDSWCV

SEQ ID NO: 750922 - protein, 112 aa, Homo sapiens
PGQASRWPLQDELLPSDGISRPQMVSGRWAPPRQGWASRRPPQAQVVLKSGSPGCISRPDSGPTPGPNNVFGLSSCPAPSGPGRPTTSLSQAPQAQLRPRGGLSRLSSWALR

SEQ ID NO: 750923 - protein, 107 aa, Homo sapiens
GVAQSLCRVSLWGPPAVLCPNLATPYICPHGSGFRMGVCVCVCVCLIECSLVPSFMAPHYRASLSNPWPKGRIWPRMVLNAAQHKLVNFLKTLRDFFVIFFQLISYR

SEQ ID NO: 750924 - protein, 107 aa, Homo sapiens; identical to SEQ ID NO: 750923

SEQ ID NO: 750925 - protein, 75 aa, Homo sapiens
MEHNGSASNADKIHQNRLSSVTEDEDQDAALTIVTVLDKVASIVDSVQASQKRIEERHREMENAIKSVQIDLLKL

SEQ ID NO: 750926 - protein, 438 aa, Homo sapiens
SEPQETQALAAPSALRLRRALLARDGPPRRRRIPRSPPPPGSAALALKPGPSRAAVRPAASPPAHPGGRRAVTMLPPLPSRLGLLLLLLLCPAHVGGLWWAVGSPLVMDPTSICRKARRLAGRQAELCQAEPEVVAELARGARLGVRECQFQFRFRRWNCSSHSKAFGRILQQDIRETAFVFAITAAGASHAVTQACSMGELLQCGCQAPRGRAPPRPSGLPGTPGPPGPAGSPEGSAAWEWGGCGDDVDFGDEKSRLFMDARHKRGRGDIRALVQLHNNEAGRLAVRSHTRTECKCHGLSGSCALRTCWQKLPPFREVGARLLERFHGASRVMGTNDGKALLPAVRTLKPPGRADLLYAADSPDFCAPNRRTGSPGTRGRACNSSAPDLSGCDLLCCGRGHRQESVQLEENCLCRFHWCCVVQCHRCRVRKELSLCL

SEQ ID NO: 750927 - protein, 204 aa, Homo sapiens
DFLPLNLRSPFVCIFLSSFHLPFPILFSVHPLGPSLHPLPVHMRPPLCLPQAVRSHTRTECKCHGLSGSCALRTCWQKLPPFREVGARLLERFHGASRVMGTNDGKALLPAVRTLKPPGRADLLYAADSPDFCAPNRRTGSPGTRGRACNSSAPDLSGCDLLCCGRGHRQESVQLEENCLCRFHWCCVVQCHRCRVRKELSLCL

SEQ ID NO: 750928 - protein, 365 aa, Homo sapiens
MLPPLPSRLGLLLLLLLCPAHVGGLWWAVGSPLVMDPTSICRKARRLAGRQAELCQAEPEVVAELARGARLGVRECQFQFRFRRWNCSSHSKAFGRILQQDIRETAFVFAITAAGASHAVTQACSMGELLQCGCQAPRGRAPPRPSGLPGTPGPPGPAGSPEGSAAWEWGGCGDDVDFGDEKSRLFMDARHKRGRGDIRALVQLHNNEAGRLAVRSHTRTECKCHGLSGSCALRTCWQKLPPFREVGARLLERFHGASRVMGTNDGKALLPAVRTLKPPGRADLLYAADSPDFCAPNRRTGSPGTRGRACNSSAPDLSGCDLLCCGRGHRQESVQLEENCLCRFHWCCVVQCHRCRVRKELSLCL

SEQ ID NO: 750929 - protein, 139 aa, Homo sapiens
MDSLYGDLFWYLDYNKDGTLDIFELQEGLEDVGAIQSLEEAKKIFTTGDVNKDGKLDFEEFMKYLKDHEKKMKLAFKSLDKNNDGKIEASEIVQSLQTLGLTISEQQAELILQSAMPVVPTEGTDHVYLVNSSMSTTLQ

SEQ ID NO: 750930 - protein, 601 aa, Homo sapiens [sequence omitted]

SEQ ID NO: 750931 - protein, 458 aa, Homo sapiens
MDSLYGDLFWYLDYNKDGTLDIFELQEGLEDVGAIQSLEEAKKIFTTGDVNKDGKLDFEEFMKYLKDHEKKMKLAFKSLDKNNDGKIEASEIVQSLQTLGLTISEQQAELILQSIDVDGTMTVDWNEWRDYFLFNPVTDIEEIIRFWKHSTGIDIGDSLTIPDEFTEDEKKSGQWWRQLLAGGIAGAVSRTSTAPLDRLKIMMQVHGSKSDKMNIFGGFRQMVKEGGIRSLWRGNGTNVIKIAPETAVKFWAYEQYKKLLTEEGQKIGTFERFISGSMAGATAQTFIYPMEVMKTRLAVGKTGQYSGIYDCAKKILKHEGLGAFYKGYVPNLLGIIPYAGIDLAVYELLKSYWLDNFAKDSVNPGVMVLLGCGALSSTCGQLASYPLALVRTRMQAQAMLEGSPQLNMVGLFRRIISKEGIPGLYRGITPNFMKVLPAVGISYVVYENMKQTLGVTQK

SEQ ID NO: 750932 - protein, 116 aa, Homo sapiens
RGLLFEVGDAVEGLELTEATPGYRWQIVPNASSPFGFWSQEGQPFRARLSGFFVAPETNNYTFWIQADSQASLHFSWSEEPRTKVKVASISVGTADWFDSWEQNRDEGTWQQKTPK

SEQ ID NO: 750933 - protein, 68 aa, Homo sapiens
RKTPGAGELCMDMQSRAAHLLLLTLPVPVRVCTHPGLALLPRLEYSGAITAHCSLNLLGPSNLPTLVS

SEQ ID NO: 750934 - protein, 95 aa, Homo sapiens
MVEKGSDHSSDKSPSTPEQGVQRSFSSQSGRSGGKNSKKSQSWYNVLSPTYKQRNEDFRKLFKQLPDTERLIVDYSCALQRDILLQGRLYLSENW

SEQ ID NO: 750935 - protein, 554 aa, Homo sapiens
MDANSKDKPPETKESAMNNAGNASFILGTGKIVTPQKHAELPPNPCTPDTFKSPLNFSTVTVEQLGITPESFVRNSAGKSSSYLKKCRRRSAVGARGSPETNHLIRFIARQQNIKNARKSPLAQDSPSQGSPALYRNVNTLRERISAFQSAFHSIKENEKMTGCLEFSEAGKESEMTDLTRKEGLSACQQSGFPAVLSSKRRRISYQRDSDENLTDAEGKVIGLQIFNIDTDRACAVETSVDLSEISSKLGSTQSGFLVEESLPLSELTETSNALKVADCVVGKGSSDAVSPDTFTAEVSSDAVPDVRSPATPACRRDLPTPKTFVLRSVLKKPSVKMCLESLQEHCNNLYDDDGTHPSLISNLPNCCKEKEAEDEENFEAPAFLNMRKRKRVTFGEDLSPEVFDESLPANTPLRKGGTPVCKKDFSGLSSLLLEQSPVPEPLPQPDFDDKGENLENIEPLQVSFAVLSSPNKSSISETLSGTDTFSSSNNHEKISSPKVGRITRTSNRRNQLVSVVEESVCNLLNTEVQPCKEKKINRRKSQETKCTKRALPK

SEQ ID NO: 750936 - protein, 1184 aa, Homo sapiens
SGVPEVTRQWQVSVVLGLTAARGGPSPSPGSHSSAEGEAWERSECARTGEGGGGGVIRRVNSVPRGGVGDLNRSAGGGGGWRRLPGRAQARISAGCESRSAVGTSGSGFEERLPAAGALPGEPFRTEEPGSGRSGRRDARLPRGSGSKPVCLAGLQVRREEMDANSKDKPPETKESAMNNAGNASFILGTGKIVTPQKHAELPPNPCTPDTFKSPLNFSTVTVEQLGITPESFVRNSAGKSSSYLKKCRRRSAVGARGSPETNHLIRFIARQQNIKNARKSPLAQDSPSQGSPALYRNVNTLRERISAFQSAFHSIKENEKMTGCLEFSEAGKESEMTDLTRKEGLSACQQSGFPAVLSSKRRRISYQRDSDENLTDAEGKVIGLQIFNIDTDRACAVETSVDLSEISSKLGSTQSGFLVEESLPLSELTETSNALKVADCVVGKGSSDAVSPDTFTAEVSSDAVPDVRSPATPACRRDLPTPKTFVLRSVLKKPSVKMCLESLQEHCNNLYDDDGTHPSLISNLPNCCKEKEAEDEENFEAPAFLNMRKRKRVTFGEDLSPEVFDESLPANTPLRKGGTPVCKKDFSGLSSLLLEQSPVPEPLPQPDFDDKGENLENIEPLQVSFAVLSSPNKSSISETLSGTDTFSSSNNHEKISSPKVGRITRTSNRRNQLVSVVEESVCNLLNTEVQPCKEKKINRRKSQETKCTKRALPKKSQVLKSCRKKKGKGKKSVQKSLYGERDIASKKPLLSPIPELPEVPEMTPSIPSIRRLGSGYFSSNGKLEEVKTPKNPVKRKDLLRHDPDLHMHQGYDKYDVSEFCSYIKSSSSLGNATSDEDPNTNIMNINENKNIPKAKNKSESENEPKAGTDSPVSCASVTEERVASDSPKPALTLQQGQEFSAGGQNAENLCQFFKISPDLNIKCERKDDFLGAAEGKLQCNRLMPNSQKDCHCLGDVLIENTKESKSQSEDLGRKPMESSSVVSCRDRKDRRRSMCYSDGRSLHLEKNGNHTPSSSVGSSVEISLENSELFKDLSDAIEQTFQRRNSETKVRRSTRLQKDLENEGLVWISLPLPSTSQKAKRRTICTFDSSGFESMSPIKETVSSRQKPQMAPPVSDPENSQGPAAGSSDEPGKRRKSFCISTLANTKATSQFKGYRRRSSLNGKGESSLTALERIEHNGERKQ

SEQ ID NO: 750937 - protein, 1184 aa, Homo sapiens; identical to SEQ ID NO: 750936

SEQ ID NO: 750938 - protein, 1001 aa, Homo sapiens
MDANSKDKPPETKESAMNNAGNASFILGTGKIVTPQKHAELPPNPCTPDTFKSPLNFSTVTVEQLGITPESFVRNSAGKSSSYLKKCRRRSAVGARGSPETNHLIRFIARQQNIKNARKSPLAQDSPSQGSPALYRNVNTLRERISAFQSAFHSIKENEKMTGCLEFSEAGKESEMTDLTRKEGLSACQQSGFPAVLKSNWSPDIQIDTDRACAVETSVDLSEISSKLGSTQSGFLVEESLPLSELTETSNALKVADCVVGKGSSDAVSPDTFTAEVSSDAVPDVRSPATPACRRDLPTPKTFVLRSVLKKPSVKMCLESLQEHCNNLYDDDGTHPSLISNLPNCCKEKEAEDEENFEAPAFLNMRKRKRVTFGEDLSPEVFDESLPANTPLRKGGTPVCKKDFSGLSSLLLEQSPVPEPLPQPDFDDKGENLENIEPLQVSFAVLSSPNKSSISETLSGTDTFSSSNNHEKISSPKVGRITRTSNRRNQLVSVVEESVCNLLNTEVQPCKEKKINRRKSQETKCTKRALPKKSQVLKSCRKKKGKGKKSVQKSLYGERDIASKKPLLSPIPELPEVPEMTPSIPSIRRLGSGYFSSNGKLEEVKTPKNPVKRKDLLRHDPDLHMHQGYDKYDVSEFCSYIKSSSSLGNATSDEDPNTNIMNINENKNIPKAKNKSESENEPKAGTDSPVSCASVTEERVASDSPKPALTLQQGQEFSAGGQNAENLCQFFKISPDLNIKCERKDDFLGAAEGKLQCNRLMPNSQKDCHCLGDVLIENTKESKSQSEDLGRKPMESSSVVSCRDRKDRRRSMCYSDGRSLHLEKNGNHTPSSSVGSSVEISLENSELFKDLSDAIEQTFQRRNSETKVRRSTRLQKDLENEGLVWISLPLPSTSQKAKRRTICTFDSSGFESMSPIKETVSSRQKPQMAPPVSDPENSQGPAAGSSDEPGKRRKSFCISTLANTKATSQFKGYRRRSSLNGKGESSLTALERIEHNGERKQ

SEQ ID NO: 750939 - protein, 302 aa, Homo sapiens
RSLTTAENSCTLQQGQEFSAGGQNAENLCQFFKISPDLNIKCERKDDFLGAAEGKLQCNRLMPNSQKDCHCLGDVLIENTKESKSQSEDLGRKPMESSSVVSCRDRKDRRRSMCYSDGRSLHLEKNGNHTPSSSVGSSVEISLENSELFKDLSDAIEQTFQRRNSETKVRRSTRLQKDLENEGLVWISLPLPSTSQKAKRRTICTFDSSGFESMSPIKETVSSRQKPQMAPPVSDPENSQGPAAGSSDEPGKRRKSFCISTLANTKATSQFKGYRRRSSLNGKGESSLTALERIEHNGERKQ

SEQ ID NO: 750940 - protein, 111 aa, Homo sapiens
MIHLVKPVPWALCKSPPPQASVQNRLRFTPNPETLSWVIFLSVRNLSLLNFPLLNPLLVCVHVLNSFLARDNHGCIPQAMEPFHYEVNTIKIIFKFFSKRWDSQLCSPGWS

SEQ ID NO: 750941 - protein, 118 aa, Homo sapiens
THWRLGFEMRGHPRSWLQLLPLPGTPPWELGGRALLGALPFASGFWPRAQGYGGFQSGDSLVLAGTSPSTSSQSPLGASQPQGCHFVVGSKLWSQQRLSSTLSVPSRYPVIPHSENLG

SEQ ID NO: 750942 - protein, 98 aa, Homo sapiens
DPGPPPTTEGSFCHQNLVVQRSRHLQAGCLGRGGVEVPMYLLLSSLKWERHKHLPCTSGSPGTWRTDPRPCVGPVPFTGSLSLKLPRHLGDQPSSVWG

SEQ ID NO: 750943 - protein, 103 aa, Homo sapiens
RSSPAQHHTSASIHIQPVSSLAPERAEDGPCHSQGQRLRHPWDRKLPNARVFISPTGYDLATRSSFTLTCLSSWPSPDISLFSFHQMLETSSWSIILLHVAIL

SEQ ID NO: 750944 - protein, 117 aa, Homo sapiens
MLCCLEISCVRYLKSSLSSSKFHRSVGNSRKKFLFSLFPAYLMPVSNTGAQCLQCLCIVRVTLLHFPTNSSSPSETTSAWTLLSISLLTFWSKPFNKSLGSSKLSHIFLSSSEPSKL

SEQ ID NO: 750945 - protein, 76 aa, Homo sapiens
SFPEKPFNTLSSSNLDPQPHEEDPIPTPIPKRELGFRELWSLDEGDWDQTELGPSQNPFSNHSFIHETTTCAQRCY

SEQ ID NO: 750946 - protein, 76 aa, Homo sapiens; identical to SEQ ID NO: 750945

SEQ ID NO: 750947 - protein, 227 aa, Homo sapiens
GSLRRSRPPARSAPGPGMTAAQAAGEEAPPGVRSVKVVLVGDGGCGKTSLLMVFADGAFPESYTPTVFERYMVNLQVKGKPVHLHIWDTAGQDDYDRLRPLFYPDASVLLLCFDVTSPNSFDNIFNRWYPEVNHFCKKVPIIVVGCKTDLRKDKSLVNKLRRNGLEPVTYHRGQEMARSVGAVAYLECSARLHDNVHAVFQEAAEVALSSRGRNFWRRITQGFCVVT

SEQ ID NO: 750948 - protein, 67 aa, Homo sapiens
GLTFQLAAAMELSAEYLREKLQRYLEAEHVEVEDTTLNRCSCSFRVLVVSAKFEGKPLLQRHRFCTE

SEQ ID NO: 750949 - protein, 104 aa, Homo sapiens
MELSAEYLREKLQRYLEAEHVEVEDTTLNRCSCSFRVLVVSAKFEGKPLLQRHRLECNGTISAHHNLRLLGSSDSLVSASQVAGITGSVQSNEMCDGCKPGVFF

SEQ ID NO: 750950 - protein, 92 aa, Homo sapiens
PASSPAWGRMCTHQEATKRGSDPSRFALGLGPRPPCGPRSEDLPGDRAGPLVPGPCSPKGRAVLGILETGAPPSTLTYSPGGQLSTAAEVGG

SEQ ID NO: 750951 - protein, 116 aa, Homo sapiens
KHAHILQAVPDSLLCIKEHLQMIQRPRRILSRHTCWRLLPETLQHPSCQIQSTCEDNEDQEKSLLGHRIQLILLPTFSDWPALLSLLRQLHLLLFMFLCLGPGLILLWSWWAASAL

SEQ ID NO: 750952 - protein, 119 aa, Homo sapiens
LTHCLNPAVYAPNSLADCSVLCPCLELASLLPSIRPFLTQSIGIMAPINCTSTCYLHTLLGTYLLHNFHKHMQNMQKLIYCVFVIAEKLLKSGDQLQFPLVSCMLLSFPRTPDLWAVIH

SEQ ID NO: 750953 - protein, 37 aa, Homo sapiens
MGYLYLVSHMLLTPRVPKAKYDPNPPPAFLPVFLPSR

SEQ ID NO: 750954 - protein, 49 aa, Homo sapiens
MARLVAVCRDGEEEFPFERRQIPLYIDDTLTVSGPGRAGPAAPLAAVSP

SEQ ID NO: 750955 - protein, 519 aa, Homo sapiens
MDLVGVASPEPGTAAAWGPSKCPWAIPQNTISCSLADVMSEQLAKELQLEEEAAVFPEVAVAEGPFITGENIDTSSDLMLAQMLQMEYDREYDAQLRREEKKFNGDSKVSISFENYRKVHPYEDSDSSEDEVDWQDTRDDPYRPAKPVPTPKKGFIGKGKDITTKHDEVVCGRKNTARMENFAPEFQVGDGIGMDLKLSNHVFNALKQHAYSEERRSARLHEKKEHSTAEKAVDPKTRLLMYKMVNSGMLETITGCISTGKESVVFHAYGGSMEDEKEDSKVIPTECAIKVFKTTLNEFKNRDKYIKDDFRFKDRFSKLNPRKIIRMWAEKEMHNLARMQRAGIPCPTVVLLKKHILVMSFIGHDQVPAPKLKEVKLNSEEMKEAYYQTLHLMRQLYHECTLVHADLSEYNMLWHAGKVWLIDVSQSVEPTHPHGLEFLFRDCRNVSQFFQKGGVKEALSERELFNAVSGLNITADNEADFLAEIEALEKMNEDHVQKNGRKAASFLKDDGDPPLLYDE

SEQ ID NO: 750956 - protein, 424 aa, Homo sapiens
MDLVGVASPEPGTAAAWGPSKCPWAIPQNTISCSLADVMSEQLAKELQLEEEAAVFPEVAVAEGPFITGENIDTSSDLMLAQMLQMEYDREYDAQLRREEKKFNGDSKVSISFENYRKVHPYEDSDSSEDEVDWQDTRDDPYRPAKPVPTPKKGFIGKGKDITTKHDEVVCGRKNTARMENFAPEFQVGDGIGMDLKLSNHVFNALKQHAYSEERRSARLHEKKEHSTAEKAVDPKTRLLMYKMVNSGMLETITGCISTGKESVVFHAYGGSMEDEKEDSKVIPTECAIKVFKTTLNEFKNRDKYIKDDFRFKDRFSKLNPRKIIRMWAEKEMHNLARMQRAGIPCPTVVLLKKHILVMSFIGHDQVPAPKLKEVKLNSEEMKEAYYQTLHLMRQLYHECTLVHADLSEYNMLWHAGKVRSTFC

SEQ ID NO: 750957 - protein, 272 aa, Homo sapiens
MDLVGVASPEPGTAAAWGPSKCPWAIPQNTISCSLADVMSEQLAKELQLEEEAAVFPEVAVAEGPFITGENIDTSSDLMLAQMLQMEYDREYDAQLRREEKKFNGDSKVSISFENYRKVHPYEDSDSSEDEVDWQDTRDDPYRPAKPVPTPKKGFIGKGKDITTKHDEVVCGRKNTARMENFAPEFQVGDGIGMDLKLSNHVFNALKQHAYSEERRSARLHEKKEHSTAEKAVDPKTRLLMYKMVNSGMLETITGCISTGKESVVFHAYGGR

SEQ ID NO: 750958 - protein, 550 aa, Homo sapiens
MDLVGVASPEPGTAAAWGPSKCPWAIPQNTISCSLADVMSEQLAKELQLEEEAAVFPEVAVAEGPFITGENIDTSSDLMLAQMLQMEYDREYDAQLRREEKKFNGDSKGIITLFDNFIDVVENTHNVLLSKSSTIFASEVSISFENYRKVHPYEDSDSSEDEVDWQDTRDDPYRPAKPVPTPKKGFIGKGKDITTKHDEVVCGRKNTARMENFAPEFQVGDGIGMDLKLSNHVFNALKQHAYSEERRSARLHEKKEHSTAEKAVDPKTRLLMYKMVNSGMLETITGCISTGKESVVFHAYGGSMEDEKEDSKVIPTECAIKVFKTTLNEFKNRDKYIKDDFRFKDRFSKLNPRKIIRMWAEKEMHNLARMQRAGIPCPTVVLLKKHILVMSFIGHDQVPAPKLKEVKLNSEEMKEAYYQTLHLMRQLYHECTLVHADLSEYNMLWHAGKVWLIDVSQSVEPTHPHGLEFLFRDCRNVSQFFQKGGVKEALSERELFNAVSGLNITADNEADFLAEIEALEKMNEDHVQKNGRKAASFLKDDGDPPLLYDE

SEQ ID NO: 750959 - protein, 503 aa, Homo sapiens
MDLVGVASPEPGTAAAWGPSKCPWAIPQNTISCSLADVMSEQLAKELQLEEEAAVFPEVADLMLAQMLQMEYDREYDAQLRREEKKFNGDSKVSISFENYRKVHPYEDSDSSEDEVDWQDTRDDPYRPAKPVPTPKKGFIGKGKDITTKHDEVVCGRKNTARMENFAPEFQVGDGIGMDLKLSNHVFNALKQHAYSEERRSARLHEKKEHSTAEKAVDPKTRLLMYKMVNSGMLETITGCISTGKESVVFHAYGGSMEDEKEDSKVIPTECAIKVFKTTLNEFKNRDKYIKDDFRFKDRFSKLNPRKIIRMWAEKEMHNLARMQRAGIPCPTVVLLKKHILVMSFIGHDQVPAPKLKEVKLNSEEMKEAYYQTLHLMRQLYHECTLVHADLSEYNMLWHAGKVWLIDVSQSVEPTHPHGLEFLFRDCRNVSQFFQKGGVKEALSERELFNAVSGLNITADNEADFLAEIEALEKMNEDHVQKNGRKAASFLKDDGDPPLLYDE

SEQ ID NO: 750960 - protein, 459 aa, Homo sapiens
MLVEGKFIALNAHKRKQERSKINTLTSQLKELEKQEQTNSKASRRQEITKIRAEMKEIETQKSLQKFNESQKLIFEKSNEIDRLLARLIKNKREKDQIDTIKNDKGDITTKHDEVVCGRKNTARMENVGDGIGMDLKLSNHVFNALKQHAYSEERRSARLHEKKEHSTAEKAVDPKTRLLMYKMVNSGMLETITGCISTGKESVVFHAYGGSMEDEKEDSKVIPTECAIKVFKTTLNEFKNRDKYIKDDFRFKDRFSKLNPRKIIRMWAEKEMHNLARMQRAGIPCPTVVLLKKHILVMSFIGHDQVPAPKLKEVKLNSEEMKEAYYQTLHLMRQLYHECTLVHADLSEYNMLWHAGKVWLIDVSQSVEPTHPHGLEFLFRDCRNVSQFFQKGGVKEALSERELFNAVSGLNITADNEADFLAEIEALEKMNEDHVQKNGRKAASFLKDDGDPPLLYDE

SEQ ID NO: 750961 - protein, 170 aa, Homo sapiens
MDLVGVASPEPGTAAAWGPSKCPWAIPQNTISCSLADVMSEQLAKELQLEEEAAVFPEVAVAEGPFITGENIDTSSDLMLAQMLQMEYDREYDAQLRREEKKFNGDSKVSISFENYRKVHPYEDSDSSEDEVDWQDTRDDPYRPAKPVPTPKRLSLDKDTGIREILETTP

SEQ ID NO: 750962 - protein, 61 aa, Homo sapiens
EARSSAKREKKEGGVEVWGGRNEHDNRENEKTNAVENLLSSSLSGGESSEQRLPQGSWKHL

SEQ ID NO: 750963 - protein, 73 aa, Homo sapiens
VYSNPAPELKISCGCQPSTSGKFPSREPGLSHFGCNPSVPGFLRDIWPLGITRAFSYALHSVELSPITDKPIL

SEQ ID NO: 750964 - protein, 274 aa, Homo sapiens
AEGRRATHPRAPTRTREKSQVEGNGGASGVECGEWGIWCKLGCVKEVTKSAEARLPALIRPLSPPLCLCFGPSVLWSDIFSPSGPRAKGRGLPQAVPGFRSRNKNGQLRCGFQAFVEDMPMAGLLKGLVRQLEQFRVQQQASKMPPKGKSGSGKAGKGGAASGSDSADKKAQGPKGGGNAVKVRHILCEKHGKIMEAMEKLKSGMRFNEVAAQYSEDKARQGGDLGWMTRGSMVGPFQEAAFALPVSGMDKPVFTDPPVKTKFGYHIIMVEGRK

SEQ ID NO: 750965 - protein, 274 aa, Homo sapiens; identical to SEQ ID NO: 750964

SEQ ID NO: 750966 - protein, 274 aa, Homo sapiens; identical to SEQ ID NO: 750964

SEQ ID NO: 750967 - protein, 124 aa, Homo sapiens
DAWVDPRVAKEKVVLEKRGKVERPERSRRMGAGEERREGTDSPSPESGTDAAGGAASGSDSADKKAQGPKGGGNAVKVRHILCEKHGKIMEAMEKLKSGMRFNEVAAQYSEDKARQGVCCSYYL

SEQ ID NO: 750968 - protein, 229 aa, Homo sapiens
AEGRRATHPRAPTRTREKSQVEGNGGASGVECGEWGIWCKLGCVKEVTKSAEARLPALIRPLSPPLCLCFGPSVLWSDIFSPSGPRAKGRGLPQAVPGFRSRNKNGQLRCGFQAFVEDMPMAGLLKGLVRQLEQFRVQQQASKMPPKGKSGSGKAGKGGAASGSDSADKKAQGPKGGGNAVKVRHILCEKHGKIMEAMEKLKSGMRFNEVAAQYSEDKARQGVCCSYYL

SEQ ID NO: 750969 - protein, 229 aa, Homo sapiens; identical to SEQ ID NO: 750968

SEQ ID NO: 750970 - protein, 274 aa, Homo sapiens; identical to SEQ ID NO: 750964

SEQ ID NO: 750971 - protein, 256 aa, Homo sapiens
AEGRRATHPRAPTRTREKSQVEGNGGASGVECGEWGIWCKLGCVKEVTKSAEARLPALIRPLSPPLCLCFGPSVLWSDIFSPSGPRAKGRGLPQAVPGFRSRNKNGQLRCGFQAFVEDMPMAGLLKGLVRQLEQFRVQQQASKMPPKGKSGSGKAGKGGAASGSDSADKKAQGPKGGGNAVKVRHILCEKHGKIMEAMEKLKSGMRFNEVAAQYSEDKARQGRMQQQGTILEAESSPHQIPILLAPSSWTLQPPEP

SEQ ID NO: 750972 - protein, 107 aa, Homo sapiens
AEGRRATHPRAPTRTREKSQVEGNGGASGVECGEWGIWCKLGCVKEVTKSAEARLPALIRPLSPPLCLCFGPSVLWSDIFSPSGPRAKGRGLPQAVPASGAAIRTVN

SEQ ID NO: 750973 - protein, 229 aa, Homo sapiens; identical to SEQ ID NO: 750968

SEQ ID NO: 750974 - protein, 224 aa, Homo sapiens
AEGRRATHPRAPTRTREKSQVEGNGGASGVECGEWGIWCKLGCVKEVTKSAEARLPALIRPLSPPLCLCFGPSVLWSDIFSPSGPRAKGRGLPQAVPGFRSRNKNGQLRCGFQAFVEDMPMAGLLKGLVRQLEQFRVQQQASKMPPKGKSGSGKAGKACQLSLVLAYFVWPKIILPLWPREAERLDTLVVKCLAEFPFEVWRYDGNIHSGCVLDLSVNMEVQFK

SEQ ID NO: 750975 - protein, 107 aa, Homo sapiens; identical to SEQ ID NO: 750972

SEQ ID NO: 750976 - protein, 326 aa, Homo sapiens
AEGRRATHPRAPTRTREKSQVEGNGGASGVECGEWGIWCKLGCVKEVTKSAEARLPALIRPLSPPLCLCFGPSVLWSDIFSPSGPRAKGRGLPQAVPASGAAIRRSIEMRLSGICLDMPMAGLLKGLVRQLEQFRVQQQASKMPPKGKSGSGKAGKACQLSLVLAYFVWPKIILPLWPREAERLDTLVVKCLAEFPFEVWRYDGNIHSGCVLDLSVNMEVQFEMSTCHLFSKGGAASGSDSADKKAQGPKGGGNAVKVRHILCEKHGKIMEAMEKLKSGMRFNEVAAQYSEDKARQGIPSLQQHAGHHRDLRSTLISLVSYLQTTP

SEQ ID NO: 750977 - protein, 123 aa, Homo sapiens
ALLSQALLSALAVARSGLGPRRAQALVTGDGAELPLRESWICAPRHGKGIRTPADLALTERRWGPWKGTPPVGAKSKKKMTLISQPRAGRKGGVGVVAPCPSSPTPTVRAHSPGVTRDVNPQA

SEQ ID NO: 750978 - protein, 119 aa, Homo sapiens
ALLSQALLSALAVARSGLGPRRAQALVTGDGAELPLRESWICAPRHGKGIRTPADLALTERRWGPWKGTPPVGAKSKKKMTLISQPRAGRKGGVGVVAPCPSSPTPTSPGVTRDVNPQA

SEQ ID NO: 750979 - protein, 190 aa, Homo sapiens
NHGLPGSLRQPDPVALLMLLVDADQPEPMRSGARELALFLTPEPGAEAKEVEETIEGMLLRLEEFCSLADLIRSDTSQILEENIPVLKAKLTEMRGIYAKVDRLEAFVKMVGHHVAFLEADVLQAERDHGAFPQALRRWLGSAGLPSFRNKSPAPVPVTYELPTLYRTEDYFPVDAGEAQHHPRTCPRPL

SEQ ID NO: 750980 - protein, 137 aa, Homo sapiens
SNRNRSYENSLSSPCGRQCGGIRGARELALFLTPEPGAEAKEVEETIEGMLLRLEEFCSLADLIRSDTSQILEENIPVLKAKLTEMRGIYAKVDRLEKSPAPVPVTYELPTLYRTEDYFPVDAGEAQHHPRTCPRPL

SEQ ID NO: 750981 - protein, 181 aa, Homo sapiens
MRNRSYENLLSSPCGRQCGGIRGARELALFLTPEPGAEAKEVEETIEGMLLRLEEFCSLADLIRSDTSQILEENIPVLKAKLTEMRGIYAKVDRLEAFVKMVGHHVAFLEADVLQAERDHGAFPQALRRWLGSAGLPSFRNKSPAPVPVTYELPTLYRTEDYFPVDAGEAQHHPRTCPRPL

SEQ ID NO: 750982 - protein, 198 aa, Homo sapiens
NHGLPGSLRQPDPVALLMLLVDADQPEPMRSGARELALFLTPEPGAEAKEVEETIEGMLLRLEEFCSLADLIRSDTSQILEENIPVLKAKLTEMRGIYAKVDRLEAFVKMVGHHVAFLEADVLQAERDHGAFPQALRRWLGSAGLPSFRNVECSGTIPARCNLRLPGSSDSPASASQVAGITEVTCTGARDVRAAHTV

SEQ ID NO: 750983 - protein, 181 aa, Homo sapiens; identical to SEQ ID NO: 750981

SEQ ID NO: 750984 - protein, 142 aa, Homo sapiens
MPNSVWISEEKPKAFGRGWRGRWSQRQLPSSLKKKIQFAKGRKSVSRLWPRKCPGTAGEFRSCLVPFRVWESLVRALPPPLGLQRLGDTEPLVGISRSLPASRKPASCPKWWLLLGARSLTDQACPCAAAAAAAAVAAEPPK

SEQ ID NO: 750985 - protein, 264 aa, Homo sapiens
MSENRKPLLGFVSKLTSGTALGNSGKTHCPLCLGLFKAPRLLPCLHTVCTTCLEQLEPFSVVDIRGGDSDTSSEGSIFQELKPRSLQSQIGILCPVCDAQVDLPMGGVKALTIDHLAVNDVMLESLRGEGQGLVCDLCNDREVEKRCQTCKANLCHFCCQAHRRQKKTTYHTMVDLKDLKGYSRIGKPILCPVHPAEELRLFCEFCDRPVCQDCVVGEHREHPCDFTSNVIHKAPARWVNSTCRSTLKTRRLWYNTPHTHSHPW

SEQ ID NO: 750986 - protein, 580 aa, Homo sapiens
MSENRKPLLGFVSKLTSGTALGNSGKTHCPLCLGLFKAPRLLPCLHTVCTTCLEQLEPFSVVDIRGGDSDTSSEGSIFQELKPRSLQSQIGILCPVCDAQVDLPMGGVKALTIDHLAVNDVMLESLRGEGQGLVCDLCNDREVEKRCQTCKANLCHFCCQAHRRQKKTTYHTMVDLKDLKGYSRIGKPILCPVHPAEELRLFCEFCDRPVCQDCVVGEHREHPCDFTSNVIHKHGDSVWELLKGTQPHVEALEEALAQIHIINSALQKRVEAVAADVRTFSEGYIKAIEEHRDKLLKQLEDIRAQKENSLQLQKAQLEQLLADMRTGVEFTEHLLTSGSDLEILITKRVVVERLRKLNKVQYSTRPGVNDKIRFCPQEKAGQCRGYEIYGTINTKEVDPAKCVLQGEDLHRAREKQTASFTLLCKDAAGEIMGRGGDNVQVAVVPKDKKDSPVRTMVQDNKDGTYYISYTPKEPGVYTVWVCIKEQHVQGSPFTVTVRRKHRPHSGVFHCCTFCSSGGQKTARCACGGTMPGGYLGCGHGHKGHPGHPHWSCCGKFNEKSECTWTGGQSAPRSLLRTVAL

SEQ ID NO: 750987 - protein, 351 aa, Homo sapiens
MSENRKPLLGFVSKLTSGTALGNSGKTHCPLCLGLFKAPRLLPCLHTVCTTCLEQLEPFSVVDIRGGDSDTSSEGSIFQELKPRSLQSQIGILCPVCDAQVDLPMGGVKALTIDHLAVNDVMLESLRGEGQGLVCDLCNDREVEKRCQTCKANLCHFCCQAHRRQKKTTYHTMVDLKDLKGYSRIGKPILCPVHPAEELRLFCEFCDRPVCQDCVVGEHREHPCDFTSNVIHKHGDSVWELLKGTQPHVEALEEALAQIHGSPFTVTVRRKHRPHSGVFHCCTFCSSGGQKTARCACGGTMPGGYLGCGHGHKGHPGHPHWSCCGKFNEKSECTWTGGQSAPRSLLRTVAL

SEQ ID NO: 750988 - protein, 283 aa, Homo sapiens
MEAQGVAEGAGPGAASGVPHPAALAPAAAPTLAPASVAAAASQFTLLVMQPCAGQDEAAAPGGSVGAGKPVRYLCEGAGDGEEEAGEDEADLLDTSDPPGGGESAASLEDLEDEETHSGGEGSSGGARRRGSGGGSMSKTCTYEGCSETTSQVAKQRKPWMCKKHRNKMYKDKYKKKKSDQALNCGGTASTGSAGNVKLEESADNILSIVKQRTGSFGDRPARPTLLEQVLNQKIVTKKSRSSAIFTETATAIKSASFGAKTTAVSRNINLRLKLSKRKTLKL

SEQ ID NO: 750989 - protein, 290 aa, Homo sapiens
MEAQGVAEGAGPGAASGVPHPAALAPAAAPTLAPASVAAAASQFTLLVMQPCAGQDEAAAPGGSVGAGKPVRYLCEGAGDGEEEAGEDEADLLDTSDPPGGGESAASLEDLEDEETHSGGEGSSGGARRRGSGGGSMSKTCTYEGCSETTSQVAKQRKPWMCKKHRNKMYKDKYKKKKSDQALNCGGTASTGSAGNVKLEESADNILSIVKQRTGSFGDRPARPTLLEQVLNQKTTAIKSASFGAKTTAVSRNINVRELTKHLHGFYLIVIDEHIFLPDINGVIIYACRT

SEQ ID NO: 750990 - protein, 305 aa, Homo sapiens
MEAQGVAEGAGPGAASGVPHPAALAPAAAPTLAPASVAAAASQFTLLVMQPCAGQDEAAAPGGSVGAGKPVRYLCEGAGDGEEEAGEDEADLLDTSDPPGGGESAASLEDLEDEETHSGGEGSSGGARRRGSGGGSMSKTCTYEGCSETTSQVAKQRKPWMCKKHRNKMYKDKYKKKKSDQALNCGGTASTGSAGNVKLEESADNILSIVKQRTGSFGDRPARPTLLEQVLNQKIVTKKSRSSAIFTETATAIKSASFGAKTTAVSRNINVRELTKHLHGFYLIVIDEHIFLPDINGVIIYACRT

SEQ ID NO: 750991 - protein, 134 aa, Homo sapiens
MTLQELVHKAASCYMDRVAVCFDECNNQLPVYYTYKTVVNAASELSNFLLLHCDFQGIREIGLYCQPGIDLPSWILGILQVPAAYVPIEPDSPPSLSTHFMKKCNLKYILVEKKQINVSLDVSIVFCLYYIYFN

SEQ ID NO: 750992 - protein, 123 aa, Homo sapiens
MKKCNLKYILVEKKQINKFKSFHETLLNYDTFTVEHNDLVLFRLHWKNTEVNLMLNDGKEKYEKEKIKSISSEHVNEEKAEEHMDLRLKHCLAYVLHTSGTTGIPKIVRVPHKCIVPNIQHFR

SEQ ID NO: 750993 - protein, 94 aa, Homo sapiens
MTLQELVHKAASCYMDRVAVCFDECNNQLPVYYTYKTVVNAASELSNFLLLHCDFQGIREIGLYCQPGIDLPSWILGNSPSPGWYCPFEPDIPT

SEQ ID NO: 750994 - protein, 223 aa, Homo sapiens
MTLQELVHKAASCYMDRVAVCFDECNNQLPVYYTYKTVVNAASELSNFLLLHCDFQGIREIGLYCQPGIDLPSWILGILQVPAAYVPIEPDSPPSLSTHFMKKCNLKYILVEKKQINKFKSFHETLLNYDTFTVEHNDLVLFRLHWKNTEVNLMLNDGKEKYEKEKIKSISSEHVNEEKAEEHMDLRLKHCLAYVLHTSGTTGIPKIVRVPHKCIVPNIQHFR

SEQ ID NO: 750995 - protein, 870 aa, Homo sapiens
MDSTKEKCDSYKDDLLLRMGLNDNKAGMEGLDKEKINKIIMEATKGSRFYGNELKKEKQVNQRIENMMQQKAQITSQQLRKAQLQVDRFAMELEQSRNLSNTIVHIDMDAFYAAVEMRDNPELKDKPIAVGSMSMLSTSNYHARRFGVRAAMPGFIAKRLCPQLIIVPPNFDKYRAVSKEVKEILADYDPNFMAMSLDEAYLNITKHLEERQNWPEDKRRYFIKMGSSVENDNPGKEVNKLSEHERSISPLLFEESPSDVQPPGDPFQVNFEEQNNPQILQNSVVFGTSAQEVVKEIRFRIEQKTTLTASAGIAPNTMLAKVCSDKNKPNGQYQILPNRQAVMDFIKDLPIRKVSGIGKVTEKMLKALGIITCTELYQQRALLSLLFSETSWHYFLHISLGLGSTHLTRDGERKSMSVERTFSEINKAEEQYSLCQELCSELAQDLQKERLKGRTVTIKLKNVNFEVKTRASTVSSVVSTAEEIFAIAKELLKTEIDADFPHPLRLRLMGVRISSFPNEEDRKHQQRSIIGFLQAGNQALSATECTLEKTDKDKFVKPLEMSHKKSFFDKKRSERKWSHQDTFKCEAVNKQSFQTSQPFQVLKKKMNENLEISENSDDCQILTCPVCFRAQGCISLEALNKHVDECLDGPSISENFKMFSCSHVSATKVNKKENVPASSLCEKQDYEAHPKIKEISSVDCIALVDTIDNSSKAESIDALSNKHSKEECSSLPSKSFNIEHCHQNSSSTVSLENEDVGSFRQEYRQPYLCEVKTGQALVCPVCNVEQKTSDLTLFNVHVDVCLNKSFIQELRKDKFNPVNQPKESSRSTGSSSGVQKAVTRTKRPGLMTKYSTSKKIKPNNPKHTLDIFFK

SEQ ID NO: 750996 - protein, 154 aa, Homo sapiens
MELEQSRNLSNTIVHIDMDAFYAAVEMRDNPELKDKPIAVGSMSMLSTSNYHARRFGVRAAMPGFIAKRLCPQLIIVPPNFDKYRAVSKEVKEILADYDPNFMAMSLDEAYLNITKHLEERQNWPEDKRRYFIKMGSSVENGKQLIKTIKPRSS

SEQ ID NO: 750997 - protein, 424 aa, Homo sapiens [sequence omitted]

SEQ ID NO: 750998 - protein, 870 aa, Homo sapiens; identical to SEQ ID NO: 750995

SEQ ID NO: 750999 - protein, 780 aa, Homo sapiens
MELEQSRNLSNTIVHIDMDAFYAAVEMRDNPELKDKPIAVGSMSMLSTSNYHARRFGVRAAMPGFIAKRLCPQLIIVPPNFDKYRAVSKEVKEILADYDPNFMAMSLDEAYLNITKHLEERQNWPEDKRRYFIKMGSSVENDNPGKEVNKLSEHERSISPLLFEESPSDVQPPGDPFQVNFEEQNNPQILQNSVVFGTSAQEVVKEIRFRIEQKTTLTASAGIAPNTMLAKVCSDKNKPNGQYQILPNRQAVMDFIKDLPIRKVSGIGKVTEKMLKALGIITCTELYQQRALLSLLFSETSWHYFLHISLGLGSTHLTRDGERKSMSVERTFSEINKAEEQYSLCQELCSELAQDLQKERLKGRTVTIKLKNVNFEVKTRASTVSSVVSTAEEIFAIAKELLKTEIDADFPHPLRLRLMGVRISSFPNEEDRKHQQRSIIGFLQAGNQALSATECTLEKTDKDKFVKPLEMSHKKSFFDKKRSERKWSHQDTFKCEAVNKQSFQTSQPFQVLKKKMNENLEISENSDDCQILTCPVCFRAQGCISLEALNKHVDECLDGPSISENFKMFSCSHVSATKVNKKENVPASSLCEKQDYEAHPKIKEISSVDCIALVDTIDNSSKAESIDALSNKHSKEECSSLPSKSFNIEHCHQNSSSTVSLENEDVGSFRQEYRQPYLCEVKTGQALVCPVCNVEQKTSDLTLFNVHVDVCLNKSFIQELRKDKFNPVNQPKESSRSTGSSSGVQKAVTRTKRPGLMTKYSTSKKIKPNNPKHTLDIFFK

SEQ ID NO: 751000 - protein, 759 aa, Homo sapiens
MDSTKEKCDSYKDDLLLRMGLNDNKAGMEGLDKEKINKIIMEATKGSRFYGNELKKEKQVNQRIENMMQQKAQITSQQLRKAQLQVDRFAMELEQSRNLSNTIVHIDMDAFYAAVEMRDNPELKDKPIAVGSMSMLSTSNYHARRFGVRAAMPGFIAKRLCPQLIIVPPNFDKYRAVSKEVKEILADYDPNFMAMSLDEAYLNITKHLEERQNWPEDKRRYFIKMGSSVENDNPGKEVNKLSEHERSISPLLFEESPSDVQPPGDPFQVNFEEQNNPQILQNSVVFGTSAQEVVKEIRFRIEQKTTLTASAGIAPNTMLAKVCSDKNKPNGQYQILPNRQAVMDFIKDLPIRKVSGIGKVTEKMLKALGIITCTELYQQRALLSLLFSETSWHYFLHISLGLGSTHLTRDGERKSMSVERTFSEINKAEEQYSLCQELCSELAQDLQKERLKGRTVTIKLKNVNFEVKTRASTVSSVVSTAEEIFAIAKELLKTEIDADFPHPLRLRLMGVRISSFPNEEDRKHQQRSIIGFLQAGNQALSATECTLEKTDKDKFVKPLEMSHKKSFFDKKRSERKWSHQDTFKCEAVNKQSFQTSQPFQVLKKKMNENLEISENSDDCQILTCPVCFRAQGCISLEALNKHVDECLDGPSISENFKMFSCSHVSATKVNKKENVPASSLCEKQDYEAHPKIKEISSVDCIALVDTIDNSSKAESIDALSNKHSKEECSSLPSKSFNIEHCHQNSSSTVSLENEDVGII

SEQ ID NO: 751001 - protein, 462 aa, Homo sapiens
MDSTKEKCDSYKDDLLLRMGLNDNKAGMEGLDKEKINKIIMEATKGSRFYGNELKKEKQVNQRIENMMQQKAQITSQQLRKAQLQVDRFAMELEQSRNLSNTIVHIDMDAFYAAVEMRDNPELKDKPIAVGSMSMLSTSNYHARRFGVRAAMPGFIAKRLCPQLIIVPPNFDKYRAVSKEVKEILADYDPNFMAMSLDEAYLNITKHLEERQNWPEDKRRYFIKMGSSVENDNPGKEVNKLSEHERSISPLLFEESPSDVQPPGDPFQVNFEEQNNPQILQNSVVFGTSAQEVVKEIRFRIEQKTTLTASAGIAPNTMLAKVCSDKNKPNGQYQILPNRQAVMDFIKDLPIRKVSGIGKVTEKMLKALGIITCTELYQQRALLSLLFSETSWHYFLHISLGLGSTHLTRDGERKSMSVERTFSEINKAEEQYSLCQELCSELAQDLQKERLKKKYLPLLRNC

SEQ ID NO: 751002 - protein, 845 aa, Homo sapiens
MDSTKEKCDSYKDDLLLRMGLNDNKAGMEGLDKEKINKIIMEATKGSRFYGNELKKEKQVNQRIENMMQQKAQITSQQLRKAQLQVDRFAMELEQSRNLSNTIVHIDMDAFYAAVEMRDNPELKDKPIAVGSMSMLSTSNYHARRFGVRAAMPGFIAKRLCPQLIIVPPNFDKYRAVSKEVKEILADYDPNFMAMSLDEAYLNITKHLEERQNWPEDKRRYFIKMGSSVENDNPGKEVNKLSEHERSISPLLFEESPSDVQPPGDPFQVNFEEQNNPQILQNSVVFGTSAQEVVKEIRFRIEQKTTLTASAGIAPNTMLAKVCSDKNKPNGQYQILPNRQAVMDFIKDLPIRKVSGIGKVTEKMLKALGIITCTELYQQRALLSLLFSETSWHYFLHISLGLGSTHLTRDGERKSMSVERTFSEINKAEEQYSLCQELCSELAQDLQKERLKGRTVTIKLKNVNFEVKTRASTVSSVVSTAEEIFAIAKELLKTEIDADFPHPLRLRLMGVRISSFPNEEDRKHQQRSIIGFLQAGNQALSATECTLEKTDKDKFVKPLEMSHKKSFFDKKRSERKWSHQDTFKCEAVNKQSFQTSQPFQVLKKKMNENLEISENSDDCQILTCPVCFRAQGCISLEALNKHVDECLDGPSISENFKMFSCSHVSATKVNKKENVPASSLCEKQDYEAHPKIKEISSVDCIALVDTIDNSSKAESIDALSNKHSKEECSSLPSKSFNIEHCHQNSSSTVSLENEDVGSFRQEYRQPYLCEVKTGQALVCPVCNVEQKTSDLTLFNVHVDVCLNKSFIQELRKDKFNPVNQPKESSRSTGSSSGVQKAVTRTKRYG

SEQ ID NO: 751003 - protein, 575 aa, Homo sapiens
MDSTKEKCDSYKDDLLLRMGLNDNKAGMEGLDKEKINKIIMEATKGSRFYGNELKKEKQVNQRIENMMQQKAQITSQQLRKAQLQVDRFAMELEQSRNLSNTIVHIDMDAFYAAVEMRDNPELKDKPIAVGSMSMLSTSNYHARRFGVRAAMPGFIAKRLCPQLIIVPPNFDKYRAVSKEVKEILADYDPNFMAMSLDEAYLNITKHLEERQNWPEDKRRYFIKMGSSVENDNPGKEVNKLSEHERSISPLLFEESPSDVQPPGDPFQVNFEEQNNPQILQNSVVFGTSAQEVVKEIRFRIEQKTTLTASAGIAPNTMLAKVCSDKNKPNGQYQILPNRQAVMDFIKDLPIRKVSGIGKVTEKMLKALGIITCTELYQQRALLSLLFSETSWHYFLHISLGLGSTHLTRDGERKSMSVERTFSEINKAEEQYSLCQELCSELAQDLQKERLKGRTVTIKLKNVNFEVKTRASTVSSVVSTAEEIFAIAKELLKTEIDADFPHPLRLRLMGSDIWFPNERAGTQQGAYWVLRRKQAVALVFKKRADIGNSKGLKVRKHARGSQNRRRTKTEKPLPD

SEQ ID NO: 751004 - protein, 313 aa, Homo sapiens
MDSTKEKCDSYKDDLLLRMGLNDNKAGMEGLDKEKINKIIMEATKGSRFYGNELKKEKQVNQRIENMMQQKAQITSQQLRKAQLQVDRFAMELEQSRNLSNTIVHIDMDAFYAAVEMRDNPELKDKPIAVGSMSMLSTSNYHARRFGVRAAMPGFIAKRLCPQLIIVPPNFDKYRAVSKEVKEILADYDPNFMAMSLDEAYLNITKHLEERQNWPEDKRRYFIKMGSSVENDNPGKEVNKLSEHERSISPLLFEESPSDVQPPGDPFQVNFEEQNNPQILQNSVVFGTSAQEVVKEIRFRIEQKTTLTASAGI

SEQ ID NO: 751005 - protein, 546 aa, Homo sapiens
QAEEHLAAYSVSDSDSGKDPSMECCRRATPGTLLLFLAFLLLSSRTARSEEDRDGLWDAWGPWSECSRTCGGGASYSLRRCLSSKSCEGRNIRYRTCSNVDCPPEAGDFRAQQCSAHNDVKHHGQFYEWLPVSNDPDNPCSLKCQAKGTTLVVELAPKVLDGTRCYTESLDMCISGLCQIVGCDHQLGSTVKEDNCGVCNGDGSTCRLVRGQYKSQLSATKSDDTVVAIPYGSRHIRLVLKGPDHLYLETKTLQGTKGENSLSSTGTFLVDNSSVDFQKFPDKEILRMAGPLTADFIVKIRNSGSADSTVQFIFYQPIIHRWRETDFFPCSATCGGGYQLTSAECYDLRSNRVVADQYCHYYPENIKPKPKLQECNLDPCPASDGYKQIMPYDLYHPLPRWEATPWTACSSSCGGGIQSRAVSCVEEDIQGHVTSVEEWKCMYTPKMPIAQPCNIFDCPKWLAQEWSPCTVTCGQGLRYRVVLCIDHRGMHTGGCSPKTKPHIKEECIVPTPCYKPKEKLPVEAKLPWFKQAQELEEGAAVSEEPS

SEQ ID NO: 751006 - protein, 704 aa, Homo sapiens
QAEEHLAAYSVSDSDSGKDPSMECCRRATPGTLLLFLAFLLLSSRTARSEEDRDGLWDAWGPWSECSRTCGGGASYSLRRCLSSKSCEGRNIRYRTCSNVDCPPEAGDFRAQQCSAHNDVKHHGQFYEWLPVSNDPDNPCSLKCQAKGTTLVVELAPKVLDGTRCYTESLDMCISGLCQIVGCDHQLGSTVKEDNCGVCNGDGSTCRLVRGQYKSQLSATKSDDTVVAIPYGSRHIRLVLKGPDHLYLETKTLQGTKGENSLSSTGTFLVDNSSVDFQKFPDKEILRMAGPLTADFIVKIRNSGSADSTVQFIFYQPIIHRWRETDFFPCSATCGGGYQLTSAECYDLRSNRVVADQYCHYYPENIKPKPKLQECNLDPCPASDGYKQIMPYDLYHPLPRWEATPWTACSSSCGGGIQSRAVSCVEEDIQGHVTSVEEWKCMYTPKMPIAQPCNIFDCPKWLAQEWSPCTVTCGQGLRYRVVLCIDHRGMHTGGCSPKTKPHIKEECIVPTPCYKPKEKLPVEAKLPWFKQAQELEEGAAVSEEPSFIPEAWSACTVTCGVGTQVRIVRCQVLLSFSQSVADLPIDECEGPKPASQRACYAGPCSGEIPEFNPDETDGLFGGLQDFDELYDWEYEGFTKCSESCGGGVQEAVVSCLNKQTREPAEENLCVTSRRPPQLLKSCNLDPCPARSSIDSAWNACNVLC

SEQ ID NO: 751007 - protein, 206 aa, Homo sapiens
QAEEHLAAYSVSDSDSGKDPSMECCRRATPGTLLLFLAFLLLSSRTARSEEDRDGLWDAWGPWSECSRTCGGGASYSLRRCLSSKSCEGRNIRYRTCSNVDCPPEAGDFRAQQCSAHNDVKHHGQFYEWLPVSNDPDNPCSLKCQAKGTTLVVELAPKVLDGTRCYTESLDMCISGLCQVSADLFSFNLSRGFQCLCVNGLHSLTL

SEQ ID NO: 751008 - protein, 80 aa, Homo sapiens
MQRQQHNNSRNMKNQENMTPPEEHNHFPITNSPKMEIYKLVYNEFRTIMLRKLSKLKGTPIDYSVKSGKQFMNKTRNSKK

SEQ ID NO: 751009 - protein, 107 aa, Homo sapiens
MSDSLVVCEVDPELTEKLRKFRFRKETDNAAIIMKVDKDRQMVVLEEEFQNISPEELKMELPERQPRFVVYSYKYVHDDGRVSYPLCFIFSSPVVQKPGTTDDVCRE

SEQ ID NO: 751010 - protein, 164 aa, Homo sapiens
GIFGFGSEAWVAEKKRRVDRTIMSDSLVVCEVDPELTEKLRKFRFRKETDNAAIIMKVDKDRQMVVLEEEFQNISPEELKMELPERQPRFVVYSYKYVHDDGRVSYPLCFIFSSPVVQSREQQMMYAGSKNRLVQTAELTKVFEIRTTDDLTEAWLQEKLSFFR

SEQ ID NO: 751011 - protein, 97 aa, Homo sapiens
GIFGFGSEAWVAEKKRRVDRTIMSDSLVVCEVDPELTEKLRKFRFRKETDNAAIIMKVDKDRQMVVLEEEFQNISPEELKMELPERQPRCAKAGNNR

SEQ ID NO: 751012 - protein, 302 aa, Homo sapiens
MLVIKKGNTKDLQLSGFPVVGNLPSQPVKNGTGPSVYKGLVPKPAAPPTKPTQWKSQTKENKVGTSFPHESTFGVGNFNAFKSTAKNFSPSTNSVKECNRSNSSSPVDKLNQQPRLTKLTRMRTDKKSEFLKALKRDRVEEEHEDESRAGSEKDDDSFNLHNSNSTHQERDINRNFDENEIPQENGNASVISQQIIRSSTFPQTDVLSSSLEAEHRLLKEMGWQEDSENDETCAPLTEDEMREFQVISEQLQKNGLRKNGILKNGLICDFKFGPWKNSTFKPTTENDDTETSSSDTSDDDDV

SEQ ID NO: 751013 - protein, 473 aa, Homo sapiens
MAQHDFAPAWLNFPTPPSSTKSSLNFEKHSENFAWTENRYDVNRRRHNSSDGFDSAIGRPNGGNFGRKEKNGWRTHGRNGTENINHRGGYHGGSSRSRSSIFHAGKSQGLHENNIPDNETGRKEDKRERKQFEAEDFPSLNPEYEREPNHNKSLAAGVWEYPPNPKSRAPRMLVIKKGNTKDLQLSGFPVVGNLPSQPVKNGTGPSVYKGLVPKPAAPPTKPTQWKSQTKENKVGTSFPHESTFGVGNFNAFKSTAKNFSPSTNSVKECNRSNSSSPVDKLNQQPRLTKLTRMRTDKKSEFLKALKRDRVEEEHEDESRAGSEKDDDSFNLHNSNSTHQERDINRNFDENEIPQENGNASVISQQIIRSSTFPQTDVLSSSLEAEHRLLKEMGWQEDSENDETCAPLTEDEMREFQVISEQLQKNGLRKNGILKNGLICDFKFGPWKNSTFKPTTENDDTETSSSDTSDDDDV

SEQ ID NO: 751014 - protein, 473 aa, Homo sapiens; identical to SEQ ID NO: 751013

SEQ ID NO: 751015 - protein, 473 aa, Homo sapiens; identical to SEQ ID NO: 751013

SEQ ID NO: 751016 - protein, 473 aa, Homo sapiens; identical to SEQ ID NO: 751013

SEQ ID NO: 751017 - protein, 458 aa, Homo sapiens
MAQHDFAPAWLNFPTPPSSTKSSLNFEKHSENFAWTENRYDVNRRRHNSSDGFDSAIGRPNGGNFGRKEKNGWRTHGRNGTENINHRGGYHGGSSRSRSSIFHAGKSQGLHENNIPDNETGRKEDKRERKQFEAEDFPSLNPEYEREPNHNKSLAAGVWEYPPNPKSRAPRMLVIKKGNTKDLQLSGFPVVGNLPSQPVKNGTGPSVYKGLVPKPAAPPTKPTQWKSQTKENKVGTSFPHESTFGVGNFNAFKSTAKNFSPSTNSVKEQPRLTKLTRMRTDKKSEFLKALKRDRVEEEHEDESRAGSEKDDDSFNLHNSNSTHQERDINRNFDENEIPQENGNASVISQQIIRSSTFPQTDVLSSSLEAEHRLLKEMGWQEDSENDETCAPLTEDEMREFQVISEQLQKNGLRKNGILKNGLICDFKFGPWKNSTFKPTTENDDTETSSSDTSDDDDV

SEQ ID NO: 751018 - protein, 473 aa, Homo sapiens; identical to SEQ ID NO: 751013

SEQ ID NO: 751019 - protein, 473 aa, Homo sapiens; identical to SEQ ID NO: 751013

SEQ ID NO: 751020 - protein, 302 aa, Homo sapiens; identical to SEQ ID NO: 751012

SEQ ID NO: 751021 - protein, 367 aa, Homo sapiens
QFDGDSHTQDFPSLNPEYEREPNHNKSLAAGVWGLHAQTHTYPTKKISQAPLLEYPPNPKSRAPRMLVIKKGNTKDLQLSGFPVVGNLPSQPVKNGTGPSVYKGLVPKPAAPPTKPTQWKSQTKENKVGTSFPHESTFGVGNFNAFKSTAKNFSPSTNSVKECNRSNSSSPVDKLNQQPRLTKLTRMRTDKKSEFLKALKRDRVEEEHEDESRAGSEKDDDSFNLHNSNSTHQERDINRNFDENEIPQENGNASVISQQIIRSSTFPQTDVLSSSLEAEHRLLKEMGWQEDSENDETCAPLTEDEMREFQVISEQLQKNGLRKNGILKNGLICDFKFGPWKNSTFKPTTENDDTETSSSDTSDDDDV

SEQ ID NO: 751022 - protein, 347 aa, Homo sapiens
SSVILWQFAAGVWGLHAQTHTYPTKKISQAPLLEYPPNPKSRAPRMLVIKKGNTKDLQLSGFPVVGNLPSQPVKNGTGPSVYKGLVPKPAAPPTKPTQWKSQTKENKVGTSFPHESTFGVGNFNAFKSTAKNFSPSTNSVKECNRSNSSSPVDKLNQQPRLTKLTRMRTDKKSEFLKALKRDRVEEEHEDESRAGSEKDDDSFNLHNSNSTHQERDINRNFDENEIPQENGNASVISQQIIRSSTFPQTDVLSSSLEAEHRLLKEMGWQEDSENDETCAPLTEDEMREFQVISEQLQKNGLRKNGILKNGLICDFKFGPWKNSTFKPTTENDDTETSSSDTSDDDDV

SEQ ID NO: 751023 - protein, 267 aa, Homo sapiens
FFKPAATAAQSTLEIPTQWKSQTKENKVGTSFPHESTFGVGNFNAFKSTAKNFSPSTNSVKECNRSNSSSPVDKLNQQPRLTKLTRMRTDKKSEFLKALKRDRVEEEHEDESRAGSEKDDDSFNLHNSNSTHQERDINRNFDENEIPQENGNASVISQQIIRSSTFPQTDVLSSSLEAEHRLLKEMGWQEDSENDETCAPLTEDEMREFQVISEQLQKNGLRKNGILKNGLICDFKFGPWKNSTFKPTTENDDTETSSSDTSDDDDV

SEQ ID NO: 751024 - protein, 181 aa, Homo sapiens [sequence omitted]

SEQ ID NO: 751025 - protein, 493 aa, Homo sapiens
MAQHDFAPAWLNFPTPPSSTKSSLNFEKHSENFAWTENRYDVNRRRHNSSDGFDSAIGRPNGGNFGRKEKNGWRTHGRNGTENINHRGGYHGGSSRSRSSIFHAGKSQGLHENNIPDNETGRKEDKRERKQFEAEDFPSLNPEYEREPNHNKSLAAGVWGLHAQTHTYPTKKISQAPLLEYPPNPKSRAPRMLVIKKGNTKDLQLSGFPVVGNLPSQPVKNGTGPSVYKGLVPKPAAPPTKPTQWKSQTKENKVGTSFPHESTFGVGNFNAFKSTAKNFSPSTNSVKECNRSNSSSPVDKLNQQPRLTKLTRMRTDKKSEFLKALKRDRVEEEHEDESRAGSEKDDDSFNLHNSNSTHQERDINRNFDENEIPQENGNASVISQQIIRSSTFPQTDVLSSSLEAEHRLLKEMGWQEDSENDETCAPLTEDEMREFQVISEQLQKNGLRKNGILKNGLICDFKFGPWKNSTFKPTTENDDTETSSSDTSDDDDV

SEQ ID NO: 751026 - protein, 473 aa, Homo sapiens; identical to SEQ ID NO: 751013

SEQ ID NO: 751027 - protein, 473 aa, Homo sapiens; identical to SEQ ID NO: 751013

SEQ ID NO: 751028 - protein, 335 aa, Homo sapiens
MAQHDFAPAWLNFPTPPSSTKSSLNFEKHSENFAWTENRYDVNRRRHNSSDGFDSAIGRPNGGNFGRKEKNGWRTHGRNGTENINHRGGYHGGSSRSRSSIFHAGKSQGLHENNIPDNETGRKEDKRERKQFEAEDFPSLNPEYEREPNHNKSLAAGVWEYPPNPKSRAPRMLVIKKGNTKDLQLSGFPVVGNLPSQPVKNGTGPSVYKGLVPKPAAPPTKPTQWKSQTKENKVGTSFPHESTFGVGNFNAFKSTAKNFSPSTNSVKECNRSNSSSPVDKLNQQPRLTKLTRMRTDKKSEFLKALKRDRVEEEHEDESRAGSEKIVKGNGLAGRQ

SEQ ID NO: 751029 - protein, 379 aa, Homo sapiens
MILRLVLNDLFLKCEMFIPTFFQPSLNPEYEREPNHNKSLAAGVWGLHAQTHTYPTKKISQAPLLEYPPNPKSRAPRMLVIKKGNTKDLQLSGFPVVGNLPSQPVKNGTGPSVYKGLVPKPAAPPTKPTQWKSQTKENKVGTSFPHESTFGVGNFNAFKSTAKNFSPSTNSVKECNRSNSSSPVDKLNQQPRLTKLTRMRTDKKSEFLKALKRDRVEEEHEDESRAGSEKDDDSFNLHNSNSTHQERDINRNFDENEIPQENGNASVISQQIIRSSTFPQTDVLSSSLEAEHRLLKEMGWQEDSENDETCAPLTEDEMREFQVISEQLQKNGLRKNGILKNGLICDFKFGPWKNSTFKPTTENDDTETSSSDTSDDDDV

SEQ ID NO: 751030 - protein, 427 aa, Homo sapiens
MAQHDFAPAWLNFPTPPSSTKSSLNFEKHSENFAWTENRYDVNRRRHNSSDGFDSAIGRPNGGNFGRKEKNGWRTHGRNGTENINHRGGYHGGSSRSRSSIFHAGKSQGLHENNIPDNETGRKEDKRERKQFEAEDFPSLNPEYEREPNHNKSLAAGVWEYPPNPKSRAPRMLVIKKGNTKDLQLSGFPVVGNLPSQPVKNGTGPSVYKGLVPKPAAPPTKPTQWKSQTKENKVGTSFPHESTFGVGNFNAFKSTAKNFSPSTNSVKECNRSNSSSPVDKLNQQPRLTKLTRMRTDKKSEFLKALKRDRVEEEHEDESRAGSEKDDDSFNLHNSNSTHQERDINRNFDENEIPQENGNASVISQQIIRSSTFPQTDVLSSSLEAEHRLLKEMGWQEDSENDETCAPLTEDEMREFQVISEQVREPES

SEQ ID NO: 751031 - protein, 78 aa, Homo sapiens
PLCTISRDLAQNIADRVGAILGLRLVVGEGKAAKGDYSKYRKPSPGIRRGGTPRPGAPLVGQKVIELLRYEDHHLGFV

SEQ ID NO: 751032 - protein, 185 aa, Homo sapiens
MQILECVPSVHISLSRRNEDIFHQPHEDESRAGSEKDDDSFNLHNSNSTHQERDINRNFDENEIPQENGNASVISQQIIRSSTFPQTDVLSSSLEAEHRLLKEMGWQEDSENDETCAPLTEDEMREFQVISEQLQKNGLRKNGILKNGLICDFKFGPWKNSTFKPTTENDDTETSSSDTSDDDDV

SEQ ID NO: 751033 - protein, 142 aa, Homo sapiens
MHPGPEEAGSGRYGPRYITDMGAGEDDEGFEDDLDLDISFEEVKPLPATKGGNKKFLVESKKMSISNPKTISRLIPPTSASLPVTTVAPQPIPIQRKGKNGVAIMSRLFDMPCDETLCSADSFCVNDYTWGGSRCQCTLGKG

SEQ ID NO: 751034 - protein, 152 aa, Homo sapiens
MRFKTTAKDGLLLWRGDSPMRPNSDFISLGLRDGALVFSYNLGSGVASIMVNGSFNDGRWHRVKAVRDGQSGKITVDDYGARTGKSPGMMRQLNINGALYVGGMKEIALHTNRQYMRGLVGCISHFTLSTDYHISLVEDAVDGKNINTCGAK

SEQ ID NO: 751035 - protein, 202 aa, Homo sapiens
RTTYYVTSFFCSVPAIIEAIEIPQFIGRSYLTYDNPDILKRVSGSRSNVFMRFKTTAKDGLLLWRGDSPMRPNSDFISLGLRDGALVFSYNLGSGVASIMVNGSFNDGRWHRVKAVRDGQSGKITVDDYGARTGKSPGMMRQLNINGALYVGGMKEIALHTNRQYMRGLVGCISHFTLSTDYHISLVEDAVDGKNINTCGAK

SEQ ID NO: 751036 - protein, 148 aa, Homo sapiens
MRFKTTAKDGLLLWRGDSPMRPNSDFISLGLRDGALVFSYNLGSGVASIMVNGSFNDGRWHRVKAVRDGQSGKITVDDYGARTGKSPGMMRQLNINGALYVGGMKEIALHTNRQYMRGLVGCISHFTLSTDYHISLVEDAVDGKSLLF

SEQ ID NO: 751037 - protein, 164 aa, Homo sapiens
MLYRDGLNGLLQLNNGTPVTGQSQGQYSKITFRTPLYLGGAPSAYWLVRATGTNRGFQGCVQSLAVNGRRIDMRPLRPCLMLYAEAQGPGVFPLTKKKVHTDEKLRTKTGIPGWPFLLTLHELTQQNSLCRKHRTLSIEYVAAARDHTSMQIPEPVCYSSVTVL

SEQ ID NO: 751038 - protein, 152 aa, Homo sapiens; identical to SEQ ID NO: 751034

SEQ ID NO: 751039 - protein, 135 aa, Homo sapiens
MLYRDGLNGLLQLNNGTPVTGQSQGQYSKITFRTPLYLGGAPSAYWLVRATGTNRGFQGCVQSLAVNGRRIDMRPWPLGKALSGADVGECSSGICDEASCIHGGTCTAIKADSYICLCPLGFKGRHCEDGEKEAS

SEQ ID NO: 751040 - protein, 336 aa, Homo sapiens
MLYRDGLNGLLQLNNGTPVTGQSQGQYSKITFRTPLYLGGAPSAYWLVRATGTNRGFQGCVQSLAVNGRRIDMRPWPLGKALSGADVGECSSGICDEASCIHGGTCTAIKADSYICLCPLGFKGRHCEDAFTLTIPQFRESLRSYAATPWPLEPQHYLSFMEFEITFRPDSGDGVLLYSYDTGSKDFLSINLAGGHVEFRFDCGSGTGVLRSEDPLTLGNWHELRVSRTAKNGILQVDKQKIVEGMARREASHQIKWQHPTLLHWRESPTTDDGARTTRVSESLEGAPETYLMTRPPVDDFTPAEVGSAPPVSFALWHLPEQTHMDPHRPQHELQN

SEQ ID NO: 751041 - protein, 273 aa, Homo sapiens
MLYRDGLNGLLQLNNGTPVTGQSQGNAAVESVMRPRASMVAPAQQSKPTPTFASVPLGLKVDTVKMLFTLTIPQFRESLRSYAATPWPLEPQHYLSFMEFEITFRPDSGDGVLLYSYDTGSKDFLSINLAGGHVEFRFDCGSGTGVLRSEDPLTLGNWHELRVSRTAKNGILQVDKQKIVEGMARREASHQIKWQHPTLLHWRESPTTDDGARTTRVSESLEGAPETYLMTRPPVDDFTPAEVGSAPPVSFALWHLPEQTHMDPHRPQHELQN

SEQ ID NO: 751042 - protein, 102 aa, Homo sapiens
TSKNVHSVNAEQMKGKVPLKLPHCGLEEAKISAQLPYHREPYSSLPRPSQENHFFWADVVFCHGAYVLTEILLLLSWVLQNSQQAILVTYLLVARQEILVKC

SEQ ID NO: 751043 - protein, 68 aa, Homo sapiens
LSFISRGHWRDTAGGKSYAAWFQYVHSIDSCKNTASPTPSSYRTGSFCSVWFLQHGVLQHRPYAVHGS

SEQ ID NO: 751044 - protein, 75 aa, Homo sapiens
MKGETPVNSTMSIGQARKMVEQLKIEASLCRIKVSKAAADLMTYCDAHACEDPLITPVPTSENPFREKKFFCALL

SEQ ID NO: 751045 - protein, 75 aa, Homo sapiens; identical to SEQ ID NO: 751044

SEQ ID NO: 751046 - protein, 793 aa, Homo sapiens
QELKRMGIELLCLFFLFLGRNDHVQGGCALGGAETCEDCLLIGPQCAWCAQENFTHPSGVGERCDTPANLLAKGCQLNFIENPVSQVEILKNKPLSVGRQKNSSDIVQIAPQSLILKLRPGGAQTLQVHVRQTEDYPVDLYYLMDLSASMDDDLNTIKELGSRLSKEMSKLTSNFRLGFGSFVEKPVSPFVKTTPEEIANPCSSIPYFCLPTFGFKHILPLTNDAERFNEIVKNQKISANIDTPEGGFDAIMQAAVCKEKIGWRNDSLHLLVFVSDADSHFGMDSKLAGIVIPNDGLCHLDSKNEYSMSTVLEYPTIGQLIDKLVQNNVLLIFAVTQEQVHLYENYAKLIPGATVGLLQKDSGNILQLIISAYEELRSEVELEVLGDTEGLNLSFTAICNNGTLFQHQKKCSHMKVGDTASFSVTVNIPHCERRSRHIIIKPVGLGDALELLVSPECNCDCQKEVEVNSSKCHHGNGSFQCGVCACHPGHMGPRCECGEDMLSTDSCKEAPDHPSCSGRGDCYCGQCICHLSPYGNIYGPYCQCDNFSCVRHKGLLCGGNGDCDCGECVCRSGWTGEYCNCTTSTDSCVSEDGVLCSGRGDCVCGKCVCTNPGASGPTCERCPTCGDPCNSKRSCIECHLSAAGQAREECVDKCKLAGATISEEEDFSKDGSVSCSLQGENECLITFLITTDNEGKTIIHSINEKDCPKPPNIPMIMLGVSLAILLIGVVLLCIWKLLVSFHDRKEVAKFEAERSKAKWQTGTNPLYRGSTSTFKNVTYKHREKQKVDLSTDC

SEQ ID NO: 751047 - protein, 793 aa, Homo sapiens; identical to SEQ ID NO: 751046

SEQ ID NO: 751048 - protein, 793 aa, Homo sapiens; identical to SEQ ID NO: 751046

SEQ ID NO: 751049 - protein, 802 aa, Homo sapiens
MDCGPPATLQPHLTGPPGTAHHPVAVCQQESLSFAELPALKPPSPVCLDLFPVAPEELRAPGSRWSLGTPAPLQGLLWPLSPGGSDTEITSGGMRPSRAGSWPHCPGAQPPALEGPWSPRHTQPQRRASHGSEKKSAWRKMRVYQREEVPGCPEAHAVFLEPGQVVQEQALSTEEPRVELSGSTRVSLEGPERRRFSASELMTRLHSSLRLGRNSAARALISGSGTGAAREGKASGMEARSVEMSGDRVSRPAPGDSREGDWSEPRLDTQEEPPLGSRSTNERRQSRFLLNSVLYQEYSDVASARELRRQQREEEGPGDEAEGAEEGPGPPRANLSPSSSFRAQRSARGSTFSLWQDIPDVRGSGVLATLSLRDCKLQEAKFELITSEASYIHSLSVAVGHFLGSAELSECLGAQDKQWLFSKLPEVKSTSERFLQDLEQRLEADVLRFSVCDVVLDHCPAFRRVYLPYVTNQAYQERTYQRLLLENPRFPGILARLEESPVCQRLPLTSFLILPFQRITRLKMLVENILKRTAQGSEDEDMATKAFNALKELVQECNASVQSMKRTEELIHLSKKIHFEGKIFPLISQARWLVRHGELVELAPLPAAPPAKLKLSSKAVYLHLFNDCLLLSRRKELGKFAVFVHAKMAELQVRDLSLKLQGIPGHVFLLQLLHGQHMKHQFLLRARTESEKQRWISALCPSSPQEDKEVISEGEDCPQVQCVRTYKALHPDELTLEKTDILSVRTWTSDGWLEGVRLADGEKGWVPQAYVEEISSLSARLRNLRENKRVTSATSKLGEAPV

SEQ ID NO: 751050 - protein, 802 aa, Homo sapiens; identical to SEQ ID NO: 751049

SEQ ID NO: 751051 - protein, 802 aa, Homo sapiens; identical to SEQ ID NO: 751049

SEQ ID NO: 751052 - protein, 790 aa, Homo sapiens
MDCGPPATLQPHLTGPPGTAHHPVAVCQQESLSFAELPALKPPSPVCLDLFPVAPEELRAPGSRWSLGTPAPLQGLLWPLSPGGSDTEITSGGMRPSRAGSWPHCPGAQPPALEGPWSPRHTQPQRRASHGSEKKSAWRKMRVYQREEVPGCPEAHAVFLEPGQVVQEQALSTEEPRVELSGSTRVSLEGPERRRFSASELMTRLHSSLRLGRNSAARALISGSGTGAAREGKASGMEARSVEMSGDRVSRPAPGDSREGDWSEPRLDTQEEPPLGSRSTNERRQSRFLLNSVLYQEYSDVASARELRRQQREEEGPGDEAEGAEEGPGPPRANLSPSSSFRAQRSARGSTFSLWQDIPDVRGSGVLATLSLRDCKLQEAKFELITSEASYIHSLSVAVGHFLGSAELSECLGAQDKQWLFSKLPEVKSTSERFLQDLEQRLEADVLRFSVCDVVLDHCPAFRRVYLPYVTNQAYQERTYQRLLLENPRFPGILARLEESPVCQRLPLTSFLILPFQRITRLKMLVENILKRTAQGSEDEDMATKAFNALKELVQECNASVQSMKRTEELIHLSKKIHFEGKIFPLISQARWLVRHGELVELAPLPAAPPAKLKLSSKAVYLHLFNDCLLLSRRKELGKFAVFVHAKMAELQVRDLSLKLQGIPGHVFLLQLLHGQHMKHQFLLRARTESEKQRWISALCPSSPQEDKEVISEGEDCPQVQCVRTYKALHPDELTLEKTDILSVRTWTSDGWLEGVRLADGEKGWVPQAYVEEISSLSARSSVSTLQGQG

SEQ ID NO: 751053 - protein, 791 aa, Homo sapiens
MDCGPPATLQPHLTGPPGTAHHPVAVCQQESLSFAELPALKPPSPVCLDLFPVAPEELRAPGSRWSLGTPAPLQGLLWPLSPGGSDTEITSGGMRPSRAGSWPHCPGAQPPALEGPWSPRHTQPQRRASHGSEKKSAWRKMRVYQREEVPGCPEAHAVFLEPGQVVQEQALSTEEPRVELSGSTRVSLEGPERRRFSASELMTRLHSSLRLGRNSAARALISGSGTGAAREGKASGMEARSVEMSGDRVSRPAPGDSREGDWSEPRLDTQEEPPLGSRSTNERRQSRFLLNSVLYQEYSDVASARELRRQQREEEGPGDEAEGAEEGPGPPRANLSPSSSFRAQRSARGSTFSLWQDIPDVRGSGVLATLSLRDCKLQEAKFELITSEASYIHSLSVAVGHFLGSAELSECLGAQDKQWLFSKLPEVKSTSERFLQDLEQRLEADVLRFSVCDVVLDHCPAFRRVYLPYVTNQAYQERTYQRLLLENPRFPGILARLEESPVCQRLPLTSFLILPFQRITRLKMLVENILKRTAQGSEDEDMATKAFNALKELVQECNASVQSMKRTEELIHLSKKIHFEGKIFPLISQARWLVRHGELVELAPLPAAPPAKLKLSSKAVYLHLFNDCLLLSRRKEMAELQVRDLSLKLQGIPGHVFLLQLLHGQHMKHQFLLRARTESEKQRWISALCPSSPQEDKEVISEGEDCPQVQCVRTYKALHPDELTLEKTDILSVRTWTSDGWLEGVRLADGEKGWVPQAYVEEISSLSARLRNLRENKRVTSATSKLGEAPV

SEQ ID NO: 751054 - protein, 485 aa, Homo sapiens
ERLAQFPAAGRGSPGPPGARLGVGLEKGRGREVWRPGVWGCEARASEVNWSCPFDPVCALPQAKFELITSEASYIHSLSVAVGHFLGSAELSECLGAQDKQWLFSKLPEVKSTSERFLQDLEQRLEADVLRFSVCDVVLDHCPAFRRVYLPYVTNQAYQERTYQRLLLENPRFPGILARLEESPVCQRLPLTSFLILPFQRITRLKMLVENILKRTAQGSEDEDMATKAFNALKELVQECNASVQSMKRTEELIHLSKKIHFEGKIFPLISQARWLVRHGELVELAPLPAAPPAKLKLSSKAVYLHLFNDCLLLSRRKELGKFAVFVHAKMAELQVRDLSLKLQGIPGHVFLLQLLHGQHMKHQFLLRARTESEKQRWISALCPSSPQEDKEVISEGEDCPQVQCVRTYKALHPDELTLEKTDILSVRTWTSDGWLEGVRLADGEKGWVPQAYVEEISSLSARLRNLRENKRVTSATSKLGEAPV

SEQ ID NO: 751055 - protein, 442 aa, Homo sapiens
ERLAQFPAAGRGSPGPPGARLGVGLEKGRGREVWRPGVWGCEARASEVNWSCPFDPVCALPQAKFELITSEASYIHSLSVAVGHFLGSAELSECLGAQDKQWLFSKLPEVKSTSERFLQDLEQRLEADVLRFSVCDVVLDHCPAFRRVYLPYVTNQAYQERTYQRLANILKRTAQGSEDEDMATKAFNALKELVQECNASVQSMKRTEELIHLSKKIHFEGKIFPLISQARWLVRHGELVELAPLPAAPPAKLKLSSKAVYLHLFNDCLLLSRRKELGKFAVFVHAKMAELQVRDLSLKLQGIPGHVFLLQLLHGQHMKHQFLLRARTESEKQRWISALCPSSPQEDKEVISEGEDCPQVQCVRTYKALHPDELTLEKTDILSVRTWTSDGWLEGVRLADGEKGWVPQAYVEEISSLSARLRNLRENKRVTSATSKLGEAPV

SEQ ID NO: 751056 - protein, 227 aa, Homo sapiens
RTNIQVTVTGPSSPSPLAVVQPMAVNISANGFGFAICQLNVVYNVKASGSSRRRRSIQNQEAFDLDVAVKENKDDLNHVDLNVCTSFSGPGRSGMALMEVNLLSGFMVPSEAISLSETVKKVEYDHGKLNLYLDSVNETQFCVNIPAVRNFKVSNTQDASVSIVDYYEPRRQAVRSYNSEVKLSSCDLCSDVQGCRPCEDGASGSHHHSSVIFIFCFKLLYFMELWL

SEQ ID NO: 751057 - protein, 244 aa, Homo sapiens
RTNIQVTVTGPSSPSPVKFLIDTHNRLLLQTAELAVVQPMAVNISANGFGFAICQLNVVYNVKASGSSRRRRSIQNQEAFDLDVAVKENKDDLNHVDLNVCTSFSGPGRSGMALMEVNLLSGFMVPSEAISLSETVKKVEYDHGKLNLYLDSVNETQFCVNIPAVRNFKVSNTQDASVSIVDYYEPRRQAVRSYNSEVKLSSCDLCSDVQGCRPCEDGASGSHHHSSVIFIFCFKLLYFMELWL

SEQ ID NO: 751058 - protein, 175 aa, Homo sapiens
MYALVQISKHYRLGAGPLLCCRPVLPSASLMFPMGLLFLATKHSSRVPHLNKQHPCPPSGSCQEPSWEQFLTPSLTSSEPVTKSCRQSCQFYLRNISSVHSTVSSRPTALSRSPLLRSHIYGHLYSSRKSAALLVFPPPTHILAPFIPSPSTDVRSDHCIASLHSNLGNSETLSQ

SEQ ID NO: 751059 - protein, 301 aa, Homo sapiens
MLSEGYLSGLEYWNDIHWSCASYNEQVAGEKEEETNSVATLSYSSVDETQVRSLYVSCKSSGKFISSVHSRESQHSRSQRVTVLQTNPNPVFESPNLAAVEICRDASRETYLVPSSCKSICKNYNDLQIAGGQVMAINSVTTDFPSESSFEYGPLLKSSEIPLPMEDSISTQPSDFPQKPIQRYSSYWRITSIKEKSSLQMQNPISNAVLNEYLEQKVVELYKQYIMDTVFHDSSPTQILASELIMTSVDQISLQVSREKNLETSKARDIVFSRLLQLMSTEITEISTPSLHISQYSNVNP

SEQ ID NO: 751060 - protein, 67 aa, Homo sapiens
APPPHKLLTYRIRAVSCEGGLGLPWQWLLGLLAHQNVLASSQNSQTLNSTSRDSNLGALGHEPEICR

SEQ ID NO: 751061 - protein, 818 aa, Homo sapiens
MVGCGVAVLCLWVSCGAAAGQLEYSVPEETERGVAVGNLSADLRLPAAAMSSRNFRFLSSHRELYFGVDLPSGNLVVREPADREQLCRAKAACVLTYDLVLEDPLELHKIRIHVLDTNDNSPLFPAGDVQLHIPEFLTPGARFTLPNAQDDDEGSNGILSYSLSPSQHFRLDMGSRVDGSEYPELVLEKALDREQRATHLLVLTARDGGLPARSGDAQVTIIVVDTNDNAPVFERSVYRTKVPETAPNGTVLFRVQALDPDEGSNGEVQYSLSNSTQAELRHRFHVHPKSGEVQVAASLGPPETLLEAYIEARDEGVFGLASTAKLLVEVTDVNDHAPELDFLTLSNPVPEDAAPGTVIALFSVKDEDLDSNGRVICGMSSAGPFQLTASFDNYYSLLIDGPLDREQISEYQVLITASDSGSPPLSTRRTITVSVADVNDNTPNFPQPQQELFVAENNGPGASLGRVFAQDPDLGKNGLVSYELLDVISEGPSASSLLAVESSSGAITAKTSFDFEQLRGFHFQVEGRDGGIPPRSATVTINLFVVDRNDNYPVILFPLPRNGSVPVEIVPRSARTGHLVTKVVAEDADSGSNAWLSYHISRASDSSLFRISANIGELRTARLVLPTDAVKQRVVVVVRDHGDPPLSSSVTLGVLLSNSVPQLLPDFEDVWEPGGQLSAQNLYLVIALACISFLFLGCLLFFVCTKLHQSPGCCAQSCCRSTEDLRYGSKMVSNPCMTSATIDVTTVERLSQTYLYRASLGLGSDNNSLLLRGEYNAADLRNLATGVGLNLPISCIQIRNRKGDHANVNAMVSKFYGI

SEQ ID NO: 751062 - protein, 250 aa, Homo sapiens
RIARLRQEEREQEQRQALEQARKAEEVQAELMDFERDEERSANGGSESDGEENIGWSTVNLDEEKQQQDFSASSTTILDEEPIVNRGLAAALLLCQNKGLLETTVQKVARVKAPNKSLPSAVYCIEDKMAIDDKYSRREEYRGFTQDFKEKDGYKPDVKIEYVDETGRKLTPKEAFRQLSHRFHGKGSGKMKTERRMKKLDEEALLKKMSSSDTPLGTVALLQEKQKAQKTPYIVLSGSGKSMNANTITK

SEQ ID NO: 751063 - protein, 113 aa, Homo sapiens
PGIGVNQHPPCYYTPCGHRWLRPHPGPCISSHAPRPQAFRQLSHRFHGKGSGKMKTERRMKKLDEEALLKKMSSSDTPLGTVALLQEKQKAQKTPYIVLSGSGKSMNANTITK

SEQ ID NO: 751064 - protein, 816 aa, Homo sapiens
HEAGLGGSRARSGRATMGSSKKHRGEKEAAGTTAAAGTGGATEQPPRHREHKKHKHRSGGSGGSGGERRKRSRERGGERGSGRRGAEAEARSSTHGRERSQAEPSERRVKREKRDDGYEAAASSKTSSGDASSLSIEETNKLRAKLGLKPLEVNAIKKEAGTKEEPVTADVINPMALRQREELREKLAAAKEKRLLNQKLGKIKTLGEDDPWLDDTAAWIERSRQLQKEKDLAEKRAKLLEEMDQEFGVSTLVEEEFGQRRQDLYSARDLQGLTVEHAIDSFREGETMILTLKDKGVLQEEEDVLVNVNLVDKERAEKNVELRKKKPDYLPYAEDESVDDLAQQKPRSILSKYDEELEGERPHSFRLEQGGTADGLRERELEEIRAKLRLQAQSLSTVGPRLASEYLTPEEMVTFKKTKRRVKKIRKKEKEVVVRADDLLPLGDQTQDGDFGSRLRGRGRRRVSEVEEEKEPVPQPLPSDDTRVENMDISDEEEGGAPPPGSPQVLEEDEAELELQKQLEKGRRLRQLQQLQQLRDSGEKVVEIVKKLESRQRGWEEDEDPERKGAIVFNATSEFCRTLGEIPTYGLAGNREEQEELMDFERDEERSANGGSESDGEENIGWSTVNLDEEKQQQDFSASSTTILDEEPIVNRGLAAALLLCQNKGLLETTVQKVARVKAPNKSLPSAVYCIEDKMAIDDKYSRREEYRGFTQDFKEKDGYKPDVKIEYVDETGRKLTPKEAFRQLSHRFHGKGSGKMKTERRMKKLDEEALLKKMSSSDTPLGTVALLQEKQKAQKTPYIVLSGSGKSMNANTITK

SEQ ID NO: 751065 - protein, 816 aa, Homo sapiens; identical to SEQ ID NO: 751064

SEQ ID NO: 751066 - protein, 860 aa, Homo sapiens
HEAGLGGSRARSGRATMGSSKKHRGEKEAAGTTAAAGTGGATEQPPRHREHKKHKHRSGGSGGSGGERRKRSRERGGERGSGRRGAEAEARSSTHGRERSQAEPSERRVKREKRDDGYEAAASSKTSSGDASSLSIEETNKLRAKLGLKPLEVNAIKKEAGTKEEPVTADVINPMALRQREELREKLAAAKEKRLLNQKLGKIKTLGEDDPWLDDTAAWIERSRQLQKEKDLAEKRAKLLEEMDQEFGVSTLVEEEFGQRRQDLYSARDLQGLTVEHAIDSFREGETMILTLKDKGVLQEEEDVLVNVNLVDKERAEKNVELRKKKPDYLPYAEDESVDDLAQARPGQAGWRGLRWRMSGMGALRRWWLSGFSGASLGPNLYLLPVQQKPRSILSKYDEELEGERPHSFRLEQGGTADGLRERELEEIRAKLRLQAQSLSTVGPRLASEYLTPEEMVTFKKTKRRVKKIRKKEKEVVVRADDLLPLGDQTQDGDFGSRLRGRGRRRVSEVEEEKEPVPQPLPSDDTRVENMDISDEEEGGAPPPGSPQVLEEDEAELELQKQLEKGRRLRQLQQLQQLRDSGEKVVEIVKKLESRQRGWEEDEDPERKGAIVFNATSEFCRTLGEIPTYGLAGNREEQEELMDFERDEERSANGGSESDGEENIGWSTVNLDEEKQQQDFSASSTTILDEEPIVNRGLAAALLLCQNKGLLETTVQKVARVKAPNKSLPSAVYCIEDKMAIDDKYSRREEYRGFTQDFKEKDGYKPDVKIEYVDETGRKLTPKEAFRQLSHRFHGKGSGKMKTERRMKKLDEEALLKKMSSSDTPLGTVALLQEKQKAQKTPYIVLSGSGKSMNANTITK

SEQ ID NO: 751067 - protein, 655 aa, Homo sapiens
MKVSIGFDRPICTWGCRVITLQAELAQDFVNSRHFEEKLGKIKTLGEDDPWLDDTAAWIERSRQLQKEKDLAEKRAKLLEEMDQEFGVSTLVEEEFGQRRQDLYSARDLQGLTVEHAIDSFREGETMILTLKDKGVLQEEEDVLVNVNLVDKERAEKNVELRKKKPDYLPYAEDESVDDLAQQKPRSILSKYDEELEGERPHSFRLEQGGTADGLRERELEEIRAKLRLQAQSLSTVGPRLASEYLTPEEMVTFKKTKRRVKKIRKKEKEVVVRADDLLPLGDQTQDGDFGSRLRGRGRRRVSEVEEEKEPVPQPLPSDDTRVENMDISDEEEGGAPPPGSPQVLEEDEAELELQKQLEKGRRLRQLQQLQQLRDSGEKVVEIVKKLESRQRGWEEDEDPERKGAIVFNATSEFCRTLGEIPTYGLAGNREEQEELMDFERDEERSANGGSESDGEENIGWSTVNLDEEKQQQDFSASSTTILDEEPIVNRGLAAALLLCQNKGLLETTVQKVARVKAPNKSLPSAVYCIEDKMAIDDKYSRREEYRGFTQDFKEKDGYKPDVKIEYVDETGRKLTPKEAFRQLSHRFHGKGSGKMKTERRMKKLDEEALLKKMSSSDTPLGTVALLQEKQKAQKTPYIVLSGSGKSMNANTITK

SEQ ID NO: 751068 - protein, 759 aa, Homo sapiens
HEAGLGGSRARSGRATMGSSKKHRGEKEAAGTTAAAGTGGATEQPPRHREHKKHKHRSGGSGGSGGERRKRSRERGGERGSGRRGAEAEARSSTHGRERSQAEPSERRVKREKRDDGYEAAASSKTSSGDASSLSIEETNKLRAKLGLKPLEVNAIKKEAGTKEEPVTADVINPMALRQREELREKLAAAKEKRLLNQKLGKIKTLGEDDPWLDDTAAWIERSRQLQKEKDLAEKRAKLLEEMDQEFGVSTLVEEEFGQRRQDLYSARDLQGLTVEHAIDSFREGETMILTLKDKGVLQEEEDVLVNVNLVDKERAEKNVELRKKKPDYLPYAEDESVDDLAQQKPRSILSKYDEELEGERPHSFRLEQGGTADGLRERELEEIRAKLRLQAQSLSTVGPRLASEYLTPEEMVTFKKTKRRVKKIRKKEKEVVVRADDLLPLGDQTQDGDFGSRLRGRGRRRVSEVEEEKEPVPQPLPSDDTRVENMDISDEEEGGAPPPGSPQVLEEDEAELELQKQLEKGRRLRQLQQLQQLRDSGEKVVEIVKKLESRQRGWEEDEDPERKGAIVFNATSEFCRTLGEIPTYGLAGNREEQEELMDFERDEERSANGGSESDGEENIGWSTVNLDEEKQQQDFSASSTTILDEEPIVNRGLAAALLLCQNKGLLETTVQKVARVKAPNKSLPSAVYCIEDKMAAMSARTVMTTGRAFAQCFKEKDGCTYDVKIDSLDETGRKLSFKLALRAICRTACMIKGWRVLY

SEQ ID NO: 751069 - protein, 816 aa, Homo sapiens; identical to SEQ ID NO: 751064

SEQ ID NO: 751070 - protein, 816 aa, Homo sapiens; identical to SEQ ID NO: 751064

SEQ ID NO: 751071 - protein, 816 aa, Homo sapiens; identical to SEQ ID NO: 751064

SEQ ID NO: 751072 - protein, 410 aa, Homo sapiens
TRGSTHVTFKKTKRRVKKIRKKEKEVVVRADDLLPLGDQTQDGDFGSRLRGRGRRRVSEVEEEKEPVPQPLPSDDTRVENMDISDEEEGGAPPPGSPQVLEEDEAELELQKQLEKGRRLRQLQQLQQLRDSGEKVVEIVKKLESRQRGWEEDEDPERKGAIVFNATSEFCRTLGEIPTYGLAGNREEQEELMDFERDEERSANGGSESDGEENIGWSTVNLDEEKQQQDFSASSTTILDEEPIVNRGLAAALLLCQNKGLLETTVQKVARVKAPNKSLPSAVYCIEDKMAIDDKYSRREEYRGFTQDFKEKDGYKPDVKIEYVDETGRKLTPKEAFRQLSHRFHGKGSGKMKTERRMKKLDEEALLKKMSSSDTPLGTVALLQEKQKAQKTPYIVLSGSGKSMNANTITK

SEQ ID NO: 751073 - protein, 350 aa, Homo sapiens
MWAVRVRADSRGSVVMGREGAKGNGDSVEGERLEDMGAKEEEDEAELELQKQLEKGRRLRQLQQLQQLRDSGEKVVEIVKKLESRQRGWEEDEDPERKGAIVFNATSEFCRTLGEIPTYGLAGNREEQEELMDFERDEERSANGGSESDGEENIGWSTVNLDEEKQQQDFSASSTTILDEEPIVNRGLAAALLLCQNKGLLETTVQKVARVKAPNKSLPSAVYCIEDKMAIDDKYSRREEYRGFTQDFKEKDGYKPDVKIEYVDETGRKLTPKEAFRQLSHRFHGKGSGKMKTERRMKKLDEEALLKKMSSSDTPLGTVALLQEKQKAQKTPYIVLSGSGKSMNANTITK

SEQ ID NO: 751074 - protein, 179 aa, Homo sapiens
SPATDWVFSVPLSVSTGALQEGATPVLRGVQGLWPDVQLGLDQAPVRPQCVCRARDPRLCLSESAKIPGQVTAELPRVLCTPRLTLQLSSSNAGDRNQLCVCEPLPHLLGDGTVLLQDMQTAAGSRDSEATLPHSPTMPSSGMRRKHPFICARNPQAADKIHALLIQMLQSHPVLRAVL

SEQ ID NO: 751075 - protein, 513 aa, Homo sapiens [sequence omitted]

SEQ ID NO: 751076 - protein, 229 aa, Homo sapiens
MAASRNGFEAVEAEGSAGCRGSSGMEVVLPLDPAVPAPLCPHGPTLLFVKVTQGKEETRRFYACSACRDRKDCNFFQWEDEKLSGARLAAREAHNRRCQPPLSRTQCVERYLKFIELPLTQRKFCQTCQQLLLPDDWGQHSEHQVLGNVSITQLRRPSQLLYPLENKKTNAQYLFADRSCQFLVDLLSALGFRRVLCVGTPRLHELIKLTASGDKKSNIKSLLLDIDFR

SEQ ID NO: 751077 - protein, 502 aa, Homo sapiens [sequence omitted]

SEQ ID NO: 751078 - protein, 339 aa, Homo sapiens
MAASRNGFEAVEAEGSAGCRGSSGMEVVLPLDPAVPAPLCPHGPTLLFVKVTQGKEETRRFYACSACRDRKDCNFFQWEDEKLSGARLAAREAHNRRCQPPLSRTQCVERYLKFIELPLTQRKFCQTCQQLLLPDDWGQHSEHQVLGNVSITQLRRPSQLLYPLENKKTNAQYLFADRSCQFLVDLLSALGFRRVLCVGTPRLHELIKLTASGDKKSNIKSLLLDIDFRYSQFYMEDSFCHYNMFNHHFFDGKTALEVCRAFLQEDKGEGIIMVTDPPFGGLVEPLAITFKKLIAMWKEGQSQDDSHKELPIFWIFPYFFESRICQFFPSFQMLDYQGI

SEQ ID NO: 751079 - protein, 305 aa, Homo sapiens
MAASRNGFEAVEAEGSAGCRGSSGMEVVLPLDPAVPAPLCPHGPTLLFVKVTQGKEETRRFYACSACRDRKDCNFFQWEDEKLSGARLAAREAHNRRCQPPLSRTQCVERYLKFIELPLTQRKFCQTCQQLLLPDDWGQHSEHQVLGNVSITQLRRPSQLLYPLENKKTNAQYLFADRSCQFLVDLLSALGFRRVLCVGTPRLHELIKLTASGDKKSNIKSLLLDIDFRYSQFYMEDSFCHYNMFNHHFFDGKTALEVCRAFLQEDKGEGIIMVTDPPFGGLVEPLAITFKKLIAMWKEGQSQGV

SEQ ID NO: 751080 - protein, 437 aa, Homo sapiens
MAASRNGFEAVEAEGSAGCRGSSGMEVVLPLDPAVPAPLCPHGPTLLFVKVTQGKEETRRFYACSACRDRKDCNFFQWEDEKLSGARLAAREAHNRRCQPPLSRTQCVERYLKFIELPLTQRKFCQTCQQLLLPDDWGQHSEHQVLGNVSITQLRRPSQLLYPLENKKTNAQYLFADRSCQFLVDLLSALGFRRVLCVGTPRLHELIKLTASGDKKSNIKSLLLDIDFRYSQFYMEDSFCHYNMFNHHFFDGKTALEVCRAFLQEDKGEGIIMVTDPPFGGLVEPLAITFKKLIAMWKEGQSQDDSHKELPIFWIFPYFFESRICQFFPSFQMLDYQVDYDNHALYKHGKTGRKQSPVRIFTNIPPNKIILPTEEGYRFCSPCQRYVSLENQHCEHCNSCTSKDGRKWNHCFLCKKCVKPSWIHCSICNHCAVPDHS

SEQ ID NO: 751081 - protein, 502 aa, Homo sapiens [sequence omitted]

SEQ ID NO: 751082 - protein, 117 aa, Homo sapiens
EKYFSGQNPFNDLKSPFHPASAYLSSCILVPAHSFFILMPLLAVFAQVFSLSGAFFLTNHLLITPILSFKCCHYYHFLGGAFLDCLFQIPWVFFFSLTKATFEQIPLGMLQLPKNPI

SEQ ID NO: 751083 - protein, 59 aa, Homo sapiens
MALNVLTFSSVIFLLGALPSFPPFALQDLQAVVLLQLENGQIKLVPENRACGGYGRAQD

SEQ ID NO: 751084 - protein, 298 aa, Homo sapiens
AASAAGAAGRGPGSTGRAERARRQRGHVRGPSSRAGLPRAALSIHKFSACSAATGRRSQPRAPRSRPPPARRPWAARPGAEGPPPQFRMQPTATMATAATTTTTTTATVALTTSWDNATGRPTAEPDPILDNYVLLVVVMSLFVGGTLVVLSGVLLLCKRCWDVHQRLNRAMEEAEKTTTTYLDNGTHPAQDPDFRGEDPECQDAETERFLSTSSTGRRVSFNEAALFEQSRKTQDKGRRYTLTEGDFHHLKNARLTHLHLPPLKIVTIHECDSGEASSATTPHPATSPKATLAIFQV

SEQ ID NO: 751085 - protein, 415 aa, Homo sapiens
PPALSTGETSTSRSRDPGARAQPLHPPWRAGSGRSPSTQPWPGGPCQGVAELLGVGVAPHPRDGADRASGVLLEPAAPPWRPHSSECLPCPALSSRAWRYLAGQAAPAVCSCDGYRRTLRGPGLLPRHGDGRWRSRESPRGPLGRAKPGGGCLRLCYLSMSHCPLCGLLLLQGRPSLSAVAPAGEVGLAGADQASSPQGPPPQFRMQPTATMATAATTTTTTTATVALTTSWDNATGRPTAEPDPILDNYVLLVVVMSLFVGGTLVVLSGVLLLCKRCWDVHQRLNRAMEEAEKTTTTYLDNGTHPAQDPDFRGEDPECQDAETERFLSTSSTGRRVSFNEAALFEQSRKTQDKGRRYTLTEGDFHHLKNARLTHLHLPPLKIVTIHECDSGEASSATTPHPATSPKATLAIFQV

SEQ ID NO: 751086 - protein, 138 aa, Homo sapiens
MLSKVHPCWPHQSSVLREIQPEWRVADDKTLKIRDVSSGKCLKTLKGHSNYVFCCNFNPQSSLTVSGSFDESVRIWVVKTGKCHKTVAHSDPVSAIHFNRDGFLIVSSSYDGLCHIWDTASGQCLKTLTDDDNPWCLS

SEQ ID NO: 751087 - protein, 104 aa, Homo sapiens
IDGKFEKTISGHKLGISDVAWSSDSNLFVSASDDKTLKIRDVSSGKCLKTLKGHSNYVFCCNFNPQSSLTVSGSFDESVRIWVVKTGKCHKTASSLRSSLGHSF

SEQ ID NO: 751088 - protein, 212 aa, Homo sapiens
MDPVVLSYMDSLLRQSDVSLLDPPSWLNDHIIGFAFEYFANSQFHDCSDHVSFISPEVTQFIKCTSNPAEIAMFLEPLDLPNKRVVFLAINDNSNQAAGGTHWSLLVYLQDKNSFFHYDSHSRSNSVHAKQVAEKLEAFLGRKGDKLAFVEEKAPAQQNSYDCGMYVICNTEALCQNFFRQQTESLLQLLTPAYITKKRGEWKDLIATLAKK

SEQ ID NO: 751089 - protein, 212 aa, Homo sapiens; identical to SEQ ID NO: 751088

SEQ ID NO: 751090 - protein, 212 aa, Homo sapiens; identical to SEQ ID NO: 751088

SEQ ID NO: 751091 - protein, 188 aa, Homo sapiens
APSWLRIVREAASWAARVTDKTASRMEHYRKAGSVELPAPSPMPQLPPDTLEMRVRDGSKIRNLLGLALGRLEGGSARHVVFSGSGRAAGKAVSCAEIVKRRVPGLHQLTKLRFLQTEDSWVPASPDTGLDPLTVRRHVPAVWVLLSRDPLDPNECGYQPPGAPPGLGSMPSSSCGPRSRRRARDTRS

SEQ ID NO: 751092 - protein, 163 aa, Homo sapiens
MEHYRKAGSVELPAPSPMPQLPPDTLEMRVRDGSKIRNLLGLALGRLEGGSARHVVFSGSGRAAGKAVSCAEIVKRRVPGLHQLTKLRFLQTEDSWVPASPDTGLDPLTVRRHVPAVWVLLSRDPLDPNECGYQPPGAPPGLGSMPSSSCGPRSRRRARDTRS

SEQ ID NO: 751093 - protein, 163 aa, Homo sapiens; identical to SEQ ID NO: 751092

SEQ ID NO: 751094 - protein, 116 aa, Homo sapiens
MVFRHVGPAGLELLTSGDPPALASQSAGITGGSHRARPQWTDSGQCQPHLSLELLQSVTGPARSWSPLAGYPGWVGQESGQGWLLISGMKLAAPPLVWGSRIPGPAWRCYPCASRP

SEQ ID NO: 751095 - protein, 497 aa, Homo sapiens
PRSLWEAAPRLRRLVVTEEDGGARPEALGKIAPRTPAELGARADQELVTALMCDLRRPAAGGMMDLAYVCEWEKWSKSTHCPSVPLACAWSCRNLIAFTMDLRSDDQDLTRMIHILDTEHPWDLHSIPSEHHEAITCLEWDQSGSRLLSADADGQIKCWSMADHLANSWESSVGSLVEGDPIVALSWLHNGVKLALHVEKSGASSFGEKFSRVKFSPSLTLFGGKPMEGWIAVTVSGLVTVSLLKPSGQVLTSTESLCRLRGAWPGDIAFTGGGNIVVATADGSSASPVQFYKVCVSVVSEKCRIDTEILPSLFMRCTTDLNRKDKFPAITHLKFLARDMSEQVLLCASSQTSSIVECWSLRKEGLPVNNIFQQISPVVGDKQPTILKWRILSATNDLDRVSAVALPKLPISLTNTDLKVASDTQFYPGLGLALASTRSVHIVPGLTADMGASKVAAEAGFSGLKPAGPRPKVGLGVWRGWPVVVASLARGGGLPGG

SEQ ID NO: 751096 - protein, 403 aa, Homo sapiens
TSLALVGIDSHGKLSVLRLSPSMGHPLEVGLALRHLLFLLEYCMVTGYDWWDILLHVQPSMVQSLVEKLHEEYTRQTAALQQVLSTRILAMKASLCKLSPCTVTRVCDYHTKLFLIAISSTLKSLLRPHFLNTPDKSPGDRLTEICTKITDVDIDKVMINLKTEEFVLDMNTLQALQQLLQWVGDFVLYLLASLPNQGSLLRPGHSFLRDGTSLGMLRELMVVIRIWGLLKPSCLPVYTATSDTQDSMSLLFRLLTKLWICCRDEGPASEPDEALVDECCLLPSQLLIPSLDWLPASDGLVSRLQPKQPLRLQFGRAPTLPGSAATLQLDGLARAPGQPKIDHLRRLHLGACPTEECKACTRCGCVTMLKSPNRTTAVKQWEQRWIKNCLCGGLWWRVPLSYP

SEQ ID NO: 751097 - protein, 373 aa, Homo sapiens
PRSLWEAAPRLRRLVVTEEDGGARPEALGKIAPRTPAELGARADQDLASCPQVLSTRILAMKASLCKLSPCTVTRVCDYHTKLFLIAISSTLKSLLRPHFLNTPDKSPGDRLTEICTKITDVDIDKVMINLKTEEFVLDMNTLQALQQLLQWVGDFVLYLLASLPNQGSLLRPGHSFLRDGTSLGMLRELMVVIRIWGLLKPSCLPVYTATSDTQDSMSLLFRLLTKLWICCRDEGPASEPDEALVDECCLLPSQLLIPSLDWLPASDGLVSRLQPKQPLRLQFGRAPTLPGSAATLQLDGLARAPGQPKIDHLRRLHLGACPTEECKACTRCGCVTMLKSPNRTTAVKQWEQRWIKNCLCGGLWWRVPLSYP

SEQ ID NO: 751098 - protein, 403 aa, Homo sapiens; identical to SEQ ID NO: 751096

SEQ ID NO: 751099 - protein, 351 aa, Homo sapiens
TSLALVGIDSHGKLSVLRLSPSMGHPLEVGLALRHLLFLLEYCMVTGYDWWDILLHVQPSMVQSLVEKLHEEYTRQTAALQQVLSTRILAMKASLCKLSPCTVTRVCDYHTKLFLIAISSTLKSLLRPHFLNTPDKSPGDRLTEICTKITDVDIDKVMINLKTEEFVLDMNTLQALQQLLQWVGDFVLYLLASLPNQGSLLRPGHSFLRDGTSLGMLRELMVVIRIWGLLKPSCLPVYTATSDTQDSMSLLFRACCPASCLSPAWTGCQPATAWLAACSPSSPFVCSLAGRPRCLAVLPPCSSTASPGPQASPRSTTCGGCTLALAPRRNARPAPGAAVSPCSSRPTEPRR

SEQ ID NO: 751100 - protein, 428 aa, Homo sapiens
PRSLWEAAPRLRRLVVTEEDGGARPEALGKIAPRTPAELGARADQELVTALMCDLRRPAAGGMMDLAYVCEWEKWSKSTHCPSVPLACAWSCRNLIAFTMDLRSDDQDLTRMIHILDTEHPWDLHSIPSEHHEAITCLEWDQSGSRLLSADADGQIKCWSMADHLANSWESSVGSLVEGDPIVALSWLHNGVKLALHVEKSGASSFGEKFSRVKFSPSPVQFYKVCVSVVSEKCRIDTEILPSLFMRCTTDLNRKDKFPAITHLKFLARDMSEQVLLCASSQTSSIVECWSLRKEGLPVNNIFQQISPVVGDKQPTILKWRILSATNDLDRVSAVALPKLPISLTNTDLKVASDTQFYPGLGLALASTTERHIVPGLTADMGASKVAAEAGFSGLKPAGPRPKVGLGVWRGWPVVVASLARGGGLPGG

SEQ ID NO: 751101 - protein, 334 aa, Homo sapiens
PRSLWEAAPRLRRLVVTEEDGGARPEALGKIAPRTPAELGARADQELVTALMCDLRRPAAGGMMDLAYVCEWEKWSKSTHCPSVPLACAWSCRNLIAFTMDLRSDDQDLTRMIHILDTEHPWDLHSIPSEHHEAITCLEWDQSGSRLLSADADGQIKCWSMADHLANSWESSVGSLVEGDPIVALSWLHNGVKLALHVEKSGASSFGEKFSRVKFSPSLTLFGGKPMEGWIAVTVSGLVTVSLLKPSGQVLTSTESLCRLRGAWPGDIAFTGGGNIVVATADGSSASPVQFYKVCVSVVSEKCRIDRTQQAGGWDGVAIVRVASVQASASQCVV

SEQ ID NO: 751102 - protein, 344 aa, Homo sapiens
GTLADPSEVLHEEYTRQTAALQQVLSTRILAMKASLCKLSPCTVTRVCDYHTKLFLIAISSTLKSLLRPHFLNTPDKSPGDRLTEICTKITDVDIDKVMINLKTEEFVLDMNTLQALQQLLQWVGDFVLYLLASLPNQGSLLRPGHSFLRDGTSLGMLRELMVVIRIWGLLKPSCLPVYTATSDTQDSMSLLFRLLTKLWICCRDEGPASEPDEALVDECCLLPSQLLIPSLDWLPASDGLVSRLQPKQPLRLQFGRAPTLPGSAATLQLDGLARAPGQPKIDHLRRLHLGACPTEECKACTRCGCVTMLKSPNRTTAVKQWEQRWIKNCLCGGLWWRVPLSYP

SEQ ID NO: 751103 - protein, 422 aa, Homo sapiens
TSLALVGIDSHGKLSVLRLSPSMGHPLEVGLALRHLLFLLEYCMVTGYDWWDILLHVQPSMVQSLVEKLHEEYTRQTAALQQVLSTRILAMKASLCKLSPCTVTRVCDYHTKLFLIAISSTLKSLLRPHFLNTPDKSPGDRLTEICTKITDVDIDKVMINLKTEEFVLDMNTLQALQQLLQWVGDFVLYLLASLPNQGSLLRPGHSFLRDGTSLGMLRELMVVIRIWGLLKPSCLPVYTATSDTQDSMSLLFRLLTKLWICFPSTGPCSVWVLLGWQPLPGRDEGPASEPDEALVDECCLLPSQLLIPSLDWLPASDGLVSRLQPKQPLRLQFGRAPTLPGSAATLQLDGLARAPGQPKIDHLRRLHLGACPTEECKACTRCGCVTMLKSPNRTTAVKQWEQRWIKNCLCGGLWWRVPLSYP

SEQ ID NO: 751104 - protein, 138 aa, Homo sapiens
MQGLHQVRLCHHAQVAQQNHGGEAVGAALDQELPVRWALVAGAPQLPLSPAAPQLLLSYPSAAPEPGCCKSHRSPWTLLGAVNLSPPCRAVEGRGPDACVTSRASEEAPAFVQLGPQSTHHSPRTPRSLDHLHPEDRP

SEQ ID NO: 751105 - protein, 848 aa, Homo sapiens
MEGSPSLRRMTVMREKGRRQAVRGPAFMFNDRGTSLTAEEERFLDAAEYGNIPVVRKMLEESKTLNVNCVDYMGQNALQLAVGNEHLEVTELLLKKENLARIGDALLLAISKGYVRIVEAILNHPGFAASKRLTLSPCEQELQDDDFYAYDEDGTRFSPDITPIILAAHCQKYEVVHMLLMKGARIERPHDYFCKCGDCMEKQRHDSFSHSRSRINAYKGLASPAYLSLSSEDPVLTALELSNELAKLANIEKEFKNDYRKLSMQCKDFVVGVLDLCRDSEEVEAILNGDLESAEPLEVHRHKASLSRVKLAIKYEVKKFVAHPNCQQQLLTIWYENLSGLREQTIAIKCLVVLVVALGLPFLAIGYWIAPCSRLGKILRSPFMKFVAHAASFIIFLGLLVFNASDRFEGITTLPNITVTDYPKQIFRVKTTQFTWTEMLIMVWVLGMMWSECKELWLEGPREYILQLWNVLDFGMLSIFIAAFTARFLAFLQATKAQQYVDSYVQESDLSEVTLPPEIQYFTYARDKWLPSDPQIISEGLYAIAVVLSFSRIAYILPANESFGPLQISLGRTVKDIFKFMVLFIMVFFAFMIGMFILYSYYLGAKVNAAFTTVEESFKTLFWSIFGLSEVTSVVLKYDHKFIENIGYVLYGIYNVTMVVVLLNMLIAMINSSYQEIEDDSDVEWKFARSKLWLSYFDDGKTLPPPFSLVPSPKSFVYFIMRIVNFPKCRRRRLQKDIEMGMGNSKSRLNLFTQSNSRVFESHSFNSILNQPTRYQQIMKRLIKRYVLKAQVDKENDEVNEGELKEIKQDISSLRYELLEDKSQATEELAILIHKLSEKLNPSMLRCE

SEQ ID NO: 751106 - protein, 902 aa, Homo sapiens
RECSWNIVEADCMNCKLLLINLEPSEPEYWISHVLTRDKFKLEKDKILKCFSRSMEGSPSLRRMTVMREKGRRQAVRGPAFMFNDRGTSLTAEEERFLDAAEYGNIPVVRKMLEESKTLNVNCVDYMGQNALQLAVGNEHLEVTELLLKKENLARIGDALLLAISKGYVRIVEAILNHPGFAASKRLTLSPCEQELQDDDFYAYDEDGTRFSPDITPIILAAHCQKYEVVHMLLMKGARIERPHDYFCKCGDCMEKQRHDSFSHSRSRINAYKGLASPAYLSLSSEDPVLTALELSNELAKLANIEKEFKNDYRKLSMQCKDFVVGVLDLCRDSEEVEAILNGDLESAEPLEVHRHKASLSRVKLAIKYEVKKFVAHPNCQQQLLTIWYENLSGLREQTIAIKCLVVLVVALGLPFLAIGYWIAPCSRLGKILRSPFMKFVAHAASFIIFLGLLVFNASDRFEGITTLPNITVTDYPKQIFRVKTTQFTWTEMLIMVWVLGMMWSECKELWLEGPREYILQLWNVLDFGMLSIFIAAFTARFLAFLQATKAQQYVDSYVQESDLSEVTLPPEIQYFTYARDKWLPSDPQIISEGLYAIAVVLSFSRIAYILPANESFGPLQISLGRTVKDIFKFMVLFIMVFFAFMIGMFILYSYYLGAKVNAAFTTVEESFKTLFWSIFGLSEVTSVVLKYDHKFIENIGYVLYGIYNVTMVVVLLNMLIAMINSSYQEIEDDSDVEWKFARSKLWLSYFDDGKTLPPPFSLVPSPKSFVYFIMRIVNFPKCRRRRLQKDIEMGMGNSKSRLNLFTQSNSRVFESHSFNSILNQPTRYQQIMKRLIKRYVLKAQVDKENDEVNEGELKEIKQDISSLRYELLEDKSQATEELAILIHKLSEKLNPSMLRCE

SEQ ID NO: 751107 - protein, 110 aa, Homo sapiens
QEDKVRLKEFRSGTIHQSLKPEMTLLFWGVRGKEKEKVSRALGVAWMPGSQKWPFLAPVTKPGGKLPACSLHPHPPKNASSRLRWPYPESQNVGSNPGPECLLKSPGPRF

SEQ ID NO: 751108 - protein, 118 aa, Homo sapiens
AWALLGLVCSVSHGQHKLSLRTPLPCPFSSPIASASTRPRWAPQLLFTTAAPTPAPSSPPVPVPCYYGLDCVPKKAAPVNVTCECDKVLREALMQYDCCPQKKGKFGSRHVQRVDTAK

SEQ ID NO: 751109 - protein, 172 aa, Homo sapiens
MLLRWCSLPRLGSLCKTSPFLEMMMPSKPGPGPDLAGTHLASGSEVPGDRVPCEGRLPEATPAHLPYSRPPAGVRLGHRERTGLGGNGRLAGRLSSRSLLPRGLQEEPGSTGGQWFTFPFFLPFFCPLSCPQPESQDHPNWTGSREGGVVARSVPDSTGNQLFSKTAPTRAS

SEQ ID NO: 751110 - protein, 213 aa, Homo sapiens
MASLFKKKTVDDVIKEQNRELRGTQRAIIRDRAALEKQEKQLELEIKKMAKIGNKEACKVLAKQLVHLRKQKTRTFAVSSKVTSMSTQTKVMNSQMKMAGAMSTTAKTMQAVNKKMDPQKTLQTMQNFQKENMKMEMTEEMINDTLDDIFDGSDDEEESQDIVNQVLDEIGIEISGKMAKAPSAARSLPSASTSKATISDEEIERQLKALGVD

SEQ ID NO: 751111 - protein, 213 aa, Homo sapiens; identical to SEQ ID NO: 751110

SEQ ID NO: 751112 - protein, 84 aa, Homo sapiens
DAETTLLISTATVNDTLDDIFDGSDDEEESQDIVNQVLDEIGIEISGKMAKAPSAARSLPSASTSKATISDEEIERQLKALGVD

SEQ ID NO: 751113 - protein, 213 aa, Homo sapiens; identical to SEQ ID NO: 751110

SEQ ID NO: 751114 - protein, 316 aa, Homo sapiens
QDHQYLYEEISVILATLVLVLALVVFVRTGVLILLIVVLVLTSVVPVREEVVAISTVVLMVASAVLVREGVTEMGTVAIVLTVVLLVGEGIVVLGTVLLVLASAVFVGEGVVVIDVIKEQNRELRGTQRAIIRDRAALEKQEKQLELEIKKMAKIGNKEACKVLAKQLVHLRKQKTRTFAVSSKVTSMSTQTKVMNSQMKMAGAMSTTAKTMQAVNKKMDPQKTLQTMQNFQKENMKMEMTEEMINDTLDDIFDGSDDEEESQDIVNQVLDEIGIEISGKMAKAPSAARSLPSASTSKATISDEEIERQLKALGVD

SEQ ID NO: 751115 - protein, 213 aa, Homo sapiens; identical to SEQ ID NO: 751110

SEQ ID NO: 751116 - protein, 213 aa, Homo sapiens; identical to SEQ ID NO: 751110

SEQ ID NO: 751117 - protein, 213 aa, Homo sapiens; identical to SEQ ID NO: 751110

SEQ ID NO: 751118 - protein, 172 aa, Homo sapiens
MELEIKKMAKIGNKEACKVLAKQLVHLRKQKTRTFAVSSKVTSMSTQTKVMNSQMKMAGAMSTTAKTMQAVNKKMDPQKTLQTMQNFQKENMKMEMTEEMINDTLDDIFDGSDDEEESQDIVNQVLDEIGIEISGKMAKAPSAARSLPSASTSKATISDEEIERQLKALGVD

SEQ ID NO: 751119 - protein, 105 aa, Homo sapiens
MQAVNKKMDPQKTLQTMQNFQKENMKMEMTEEMINDTLDDIFDGSDDEEESQDIVNQVLDEIGIEISGKMAKAPSAARSLPSASTSKATISDEEIERQLKALGVD

SEQ ID NO: 751120 - protein, 953 aa, Homo sapiens
MALVFQFGQPVRAQPLPGLCHGKLIRTNACDVCNSTDLPEVEIISLLEEQLPHYKLRADTIYGYDHDDWLHTPLISPDANIDLTTEQIEETLKYFLLCAERVGQMTKTYNDIDAVTRLLEEKERDLELAARIGQSLLKKNKTLTERNELLEEQVEHIREEVSQLRHELSMKDELLQFYTSAAEESEPESVCSTPLKRNESSSSVQNYFHLDSLQKKLKDLEEENVVLRSEASQLKTETITYEEKEQQLVNDCVKELRDANVQIASISEELAKKTEDAARQQEEITHLLSQIVDLQKKAKACAVENEELVQHLGAAKDAQRQLTAELRELEDKYAECMEMLHEAQEELKNLRNKTMPNTTSRRYHSLGLFPMDSLAAEIEGTMRKELQLEEAESPDITHQKRVFETVRNINQVVKQRSLTPSPMNIPGSNQSSAMNSLLSSCVSTPRSSFYGSDIGNVVLDNKTNSIILETEAADLGNDERSKKPGTPGTPGSHDLETALRRLSLRRENYLSERRFFEEEQERKLQELAEKGELRSGSLTPTESIMSLGTHSRFSEFTGFSGMSFSSRSYLPEKLQIVKPLEGSATLHHWQQLAQPHLGGILDPRPGVVTKGFRTLDVDLDEVYCLNDFEEDDTGDHISLPRLATSTPVQHPETSAHHPGKCMSQTNSTFTFTTCRILHPSDELTRVTPSLNSAPTPACGSTSHLKSTPVATPCTPRRLSLAESFTNTRESTTTMSTSLGLVWLLKERGISAAVYDPQSWDRAGRGSLLHSYTPKMAVIPSTPPNSPMQTPTSSPPSFEFKCTSPPYDNFLASKPASSILREVREKNVRSSESQTDVSVSNLNLVDKVRRFGVAKVVNSGRAHVPTLTEEQGPLLCGPPGPAPALVPRGLVPEGLPLRCPTVTSAIGGLQLNSGIRRNRSFPTMVGSSMQMKAPVTLTSGILMGAKLSKQTSLR

SEQ ID NO: 751121 - protein, 688 aa, Homo sapiens [sequence omitted]

SEQ ID NO: 751122 - protein, 152 aa, Homo sapiens
MSSVPVPEIDQVTCAPSSSRSLTPLRFLLIGDGPLSHLLPSDRKYHIRPLQVLSAVFGRRTHHGSVISGLEEDDSFLFNGGWSHGTRCSLFLRSAGGRTERSSILQGTRLMPGALRHLLLDGGPPASSSSSFLSVRVLFFFNNGLADASGRF

SEQ ID NO: 751123 - protein, 152 aa, Homo sapiens; identical to SEQ ID NO: 751122

SEQ ID NO: 751124 - protein, 895 aa, Homo sapiens
MSLRDKGGEEECFEYDCQDEERKPTHRQHDTQDLLEEVLCAERVGQMTKTYNDIDAVTRLLEEKERDLELAARIGQSLLKKNKTLTERNELLEEQVEHIREEVSQLRHELSMKDELLQFYTSAAEESEPESVCSTPLKRNESSSSVQNYFHLDSLQKKLKDLEEENVVLRSEASQLKTETITYEEKEQQLVNDCVKELRDANVQIASISEELAKKTEDAARQQEEITHLLSQIVDLQKKAKACAVENEELVQHLGAAKDAQRQLTAELRELEDKYAECMEMLHEAQEELKNLRNKTMPNTTSRRYHSLGLFPMDSLAAEIEGTMRKELQLEEAESPDITHQKRVFETVRNINQVVKQRSLTPSPMNIPGSNQSSAMNSLLSSCVSTPRSSFYGSDIGNVVLDNKTNSIILETEAADLGNDERSKKPGTPGTPGSHDLETALRRLSLRRENYLSERRFFEEEQERKLQELAEKGELRSGSLTPTESIMSLGTHSRFSEFTGFSGMSFSSRSYLPEKLQIVKPLEGSATLHHWQQLAQPHLGGILDPRPGVVTKGFRTLDVDLDEVYCLNDFEEDDTGDHISLPRLATSTPVQHPETSAHHPGKCMSQTNSTFTFTTCRILHPSDELTRVTPSLNSAPTPACGSTSHLKSTPVATPCTPRRLSLAESFTNTRESTTTMSTSLGLVWLLKERGISAAVYDPQSWDRAGRGSLLHSYTPKMAVIPSTPPNSPMQTPTSSPPSFEFKCTSPPYDNFLASKPASSILREVREKNVRSSESQTDVSVSNLNLVDKVRRFGVAKVVNSGRAHVPTLTEEQGPLLCGPPGPAPALVPRGLVPEGLPLRCPTVTSAIGGLQLNSGIRRNRSFPTMVGSSMQMKAPVTLTSGILMGAKLSKQTSLR

SEQ ID NO: 751125 - protein, 688 aa, Homo sapiens [sequence omitted]

SEQ ID NO: 751126 - protein, 895 aa, Homo sapiens; identical to SEQ ID NO: 751124

SEQ ID NO: 751127 - protein, 615 aa, Homo sapiens
MLHEAQEELKNLRNKTMPNTTSRRYHSLGLFPMDSLAAEIEGTMRKELQLEEAESPDITHQKRVFETVRNINQVVKQRSLTPSPMNIPGSNQSSAMNSLLSSCVSTPRSSFYGSDIGNVVLDNKTNSIILETEAADLGNDERSKKPGTPGTPGSHDLETALRRLSLRRENYLSERRFFEEEQERKLQELAEKGELRSGSLTPTESIMSLGTHSRFSEFTGFSGMSFSSRSYLPEKLQIVKPLEGSATLHHWQQLAQPHLGGILDPRPGVVTKGFRTLDVDLDEVYCLNDFEEDDTGDHISLPRLATSTPVQHPETSAHHPGKCMSQTNSTFTFTTCRILHPSDELTRVTPSLNSAPTPACGSTSHLKSTPVATPCTPRRLSLAESFTNTRESTTTMSTSLGLVWLLKERGISAAVYDPQSWDRAGRGSLLHSYTPKMAVIPSTPPNSPMQTPTSSPPSFEFKCTSPPYDNFLASKPASSILREVREKNVRSSESQTDVSVSNLNLVDKVRRFGVAKVVNSGRAHVPTLTEEQGPLLCGPPGPAPALVPRGLVPEGLPLRCPTVTSAIGGLQLNSGIRRNRSFPTMVGSSMQMKAPVTLTSGILMGAKLSKQTSLR

SEQ ID NO: 751128 - protein, 380 aa, Homo sapiens
RNLVWIGSEAGIWCSADQCSKLWLFLRTRLQSRTFAFHLPRPDPVNKVAHHFLHLLSDMLDFNFYCGCTWMQGICFVPPNLAHHPGKCMSQTNSTFTFTTCRILHPSDELTRVTPSLNSAPTPACGSTSHLKSTPVATPCTPRRLSLAESFTNTRESTTTMSTSLGLVWLLKERGISAAVYDPQSWDRAGRGSLLHSYTPKMAVIPSTPPNSPMQTPTSSPPSFEFKCTSPPYDNFLASKPASSILREVREKNVRSSESQTDVSVSNLNLVDKVRRFGVAKVVNSGRAHVPTLTEEQGPLLCGPPGPAPALVPRGLVPEGLPLRCPTVTSAIGGLQLNSGIRRNRSFPTMVGSSMQMKAPVTLTSGILMGAKLSKQTSLR

SEQ ID NO: 751129 - protein, 464 aa, Homo sapiens
MVLETALRRLSLRRENYLSERRFFEEEQERKLQELAEKGELRSGSLTPTESIMSLGTHSRFSEFTGFSGMSFSSRSYLPEKLQIVKPLEGSATLHHWQQLAQPHLGGILDPRPGVVTKGFRTLDVDLDEVYCLNDFEEDDTGREVQQLLAVSGDMRRAHGSRRPGAHHPGKCMSQTNSTFTFTTCRILHPSDELTRVTPSLNSAPTPACGSTSHLKSTPVATPCTPRRLSLAESFTNTRESTTTMSTSLGLVWLLKERGISAAVYDPQSWDRAGRGSLLHSYTPKMAVIPSTPPNSPMQTPTSSPPSFEFKCTSPPYDNFLASKPASSILREVREKNVRSSESQTDVSVSNLNLVDKVRRFGVAKVVNSGRAHVPTLTEEQGPLLCGPPGPAPALVPRGLVPEGLPLRCPTVTSAIGGLQLNSGIRRNRSFPTMVGSSMQMKAPVTLTSGILMGAKLSKQTSLR

SEQ ID NO: 751130 - protein, 409 aa, Homo sapiens
MSLGTHSRFSEFTGFSGMSFSSRSYLPEKLQIVKPLEGSATLHHWQQLAQPHLGGILDPRPGVVTKGFRTLDVDLDEVYCLNDFEEDDTGDHISLPRLATSTPVQHPETSAHHPGKCMSQTNSTFTFTTCRILHPSDELTRVTPSLNSAPTPACGSTSHLKSTPVATPCTPRRLSLAESFTNTRESTTTMSTSLGLVWLLKERGISAAVYDPQSWDRAGRGSLLHSYTPKMAVIPSTPPNSPMQTPTSSPPSFEFKCTSPPYDNFLASKPASSILREVREKNVRSSESQTDVSVSNLNLVDKVRRFGVAKVVNSGRAHVPTLTEEQGPLLCGPPGPAPALVPRGLVPEGLPLRCPTVTSAIGGLQLNSGIRRNRSFPTMVGSSMQMKAPVTLTSGILMGAKLSKQTSLR

SEQ ID NO: 751131 - protein, 895 aa, Homo sapiens; identical to SEQ ID NO: 751124

SEQ ID NO: 751132 - protein, 155 aa, Homo sapiens
SVPKCALFYIYTLEKEKPAAVLSHFCHQHQCPSGRQVVVQKHDAWLIFVAKGVGLMLIGMLPYSLTGRIEGEFWKCKEAPLSASSRSCTEGLKLIKSTKNLPWRIEREKGPIMRTDILATLLKINTDIFLACSLCTQTCGKFILATLFDEGHEHL

SEQ ID NO: 751133 - protein, 653 aa, Homo sapiens
MSLRDKGGEEECFEYDCQDEERKPTHRQHDTQDLLEEVLCAERVGQMTKTYNDIDAVTRLLEEKERDLELAARIGQSLLKKNKTLTERNELLEEQVEHIREEVSQLRHELSMKDELLQFYTSAAEESEPESVCSTPLKRNESSSSVQNYFHLDSLQKKLKDLEEENVVLRSEASQLKTETITYEEKEQQLVNDCVKELRDANVQIASISEELAKKTEDAARQQEEITHLLSQIVDLQKKAKACAVENEELVQHLGAAKDAQRQLTAELRELEDKYAECMEMLHEAQEELKNLRNKTMPNTTSRRYHSLGLFPMDSLAAEIEGTMRKELQLEEAESPDITHQKRVFETVRNINQVVKQRSLTPSPMNIPGSNQSSAMNSLLSSCVSTPRSSFYGSDIGNVVLDNKTNSIILETEAADLGNDERSKKPGTPGTPGSHDLETALRRLSLRRENYLSERRFFEEEQERKLQELAEKGELRSGSLTPTESIMSLGTHSRFSEFTGFSGMSFSSRSYLPEKLQIVKPLEGSATLHHWQQLAQPHLGGILDPRPGVVTKGFRTLDVDLDEVYCLNDFEEDDTGDHISLPRLATSTPVQHPETSGERSQARVTVSGSRSYPSRPQASPEEMQEPPAATEEEEEEHKARGPSAPFGSFPLGR

SEQ ID NO: 751134 - protein, 309 aa, Homo sapiens
TLRLYEEDDTAHHPGKCMSQTNSTFTFTTCRILHPSDELTRVTPSLNSAPTPACGSTSHLKSTPVATPCTPRRLSLAESFTNTRESTTTMSTSLGLVWLLKERGISAAVYDPQSWDRAGRGSLLHSYTPKMAVIPSTPPNSPMQTPTSSPPSFEFKCTSPPYDNFLASKPASSILREVREKNVRSSESQTDVSVSNLNLVDKVRRFGVAKVVNSGRAHVPTLTEEQGPLLCGPPGPAPALVPRGLVPEGLPLRCPTVTSAIGGLQLNSGIRRNRSFPTMVGSSMQMKAPVTLTSGILMGAKLSKQTSLR

SEQ ID NO: 751135 - protein, 895 aa, Homo sapiens; identical to SEQ ID NO: 751124

SEQ ID NO: 751136 - protein, 895 aa, Homo sapiens; identical to SEQ ID NO: 751124

SEQ ID NO: 751137 - protein, 30 aa, Homo sapiens
KLQPKGVTSIGQFPDKGRILSHQNLKIIEH

SEQ ID NO: 751138 - protein, 182 aa, Homo sapiens
MWPPDPDPDPDPEPAGGSRPGPAVPGLRALLPARAFLCSLKGRLLLAESGLSFITFICYVASSASAFLTAPLLEFLLALYFLFADAMQLNDKWQGLCWPMMDFLRCVTAALIYFAISITAIAKYSDGASKAAGVFGFFATIVFATDFYLIFNDVAKFLKQGDSADETTAHKTEEENSDSDSD

SEQ ID NO: 751139 - protein, 227 aa, Homo sapiens
RGGGGCAPARASVACPPSAQPGFPLPSGREKRGARPSPGPTAAAAMWPPDPDPDPDPEPAGGSRPGPAVPGLRALLPARAFLCSLKGRLLLAESGLSFITFICYVASSASAFLTAPLLEFLLALYFLFADAMQLNDKWQGLCWPMMDFLRCVTAALIYFAISITAIAKYSDGASKAAGVFGFFATIVFATDFYLIFNDVAKFLKQGDSADETTAHKTEEENSDSDSD

SEQ ID NO: 751140 - protein, 182 aa, Homo sapiens; identical to SEQ ID NO: 751138

SEQ ID NO: 751141 - protein, 268 aa, Homo sapiens
RGGGGCAPARASVACPPSAQPGFPLPSGREKRGARPSPGPTAAAAMWPPDPDPDPDPEPAGGSRPGPAVPGLRALLPARAFLCSLKGRLLLAESGLSFITFICYVASSASAFLTAPLLEFLLALYFLFADAMQLNDKWQGLCWPMMDFLRCVTAALIYFAISITAIAKYSDGASKAAGGSVPDTRAVCPSRSEMGREVGQQPPGAGSQPCDASHPPCPQVFGFFATIVFATDFYLIFNDVAKFLKQGDSADETTAHKTEEENSDSDSD

SEQ ID NO: 751142 - protein, 227 aa, Homo sapiens; identical to SEQ ID NO: 751139

SEQ ID NO: 751143 - protein, 134 aa, Homo sapiens
GLVLAHDGEDRGPRREGCPAQSGQMRSPESCTWALILSLVCWSLQLVRTGWRDPASDHPSSTTQQPCDLKWAVVPLEQVCEAGNPERGLWPPGGAGAPHRAYRNELPPQEFKPFPRGQDRLTEDLQGLPRLQPS

SEQ ID NO: 751144 - protein, 227 aa, Homo sapiens; identical to SEQ ID NO: 751139

SEQ ID NO: 751145 - protein, 180 aa, Homo sapiens
EENSGPQEKERAWVAEPTSRPGSLLFRRLGSRIPDTRTGRKLDRRQRGLSFITFICYVASSASAFLTAPLLEFLLALYFLFADAMQLNDKWQGLCWPMMDFLRCVTAALIYFAISITAIAKYSDGASKAAGVFGFFATIVFATDFYLIFNDVAKFLKQGDSADETTAHKTEEENSDSDSD

SEQ ID NO: 751146 - protein, 150 aa, Homo sapiens
MWPPDPDPDPDPEPAGGSRPGPAVPGLRALLPARAFLCSLKGRLLLAESGLSFITFICYVASSASAFLTAPLLEFLLALYFLFADAMQLNDKWQGLCWPMMVFGFFATIVFATDFYLIFNDVAKFLKQGDSADETTAHKTEEENSDSDSD

SEQ ID NO: 751147 - protein, 137 aa, Homo sapiens
MQLNDKWQGLCWPMMDFLRCVTAALIYFAISITAIAKYSDGASKAAGGSVPDTRAVCPSRSEMGREVGQQPPGAGSQPCDASHPPCPQVFGFFATIVFATDFYLIFNDVAKFLKQGDSADETTAHKTEEENSDSDSD

SEQ ID NO: 751148 - protein, 295 aa, Homo sapiens
MEVAVPQVSPLSAPPPPTCPTLPSLSSSHHPSGQGSFLWCLPKSSEEGCLECRLQEHSEVSGFLLECDSSVQGALQKHLALYRIRRKVTVEPHPELRVWAVLPSSPEACGAASLQERAGAAAILIRDPRTARMGWRLLTQDEGPALVPGGRLGDLWDYHQHRYLQGVPEGVRDLPPGVALPLESNLAFMNGVSFTKGCYIGQELTARTHHMGVIRKRLFPVRFLDPLPTSGITPGATVLTASGQTVGKFRAGQGNVGLALLWSEKIKGPLHIRASEGAQVALAASVPDWWPTVSK

SEQ ID NO: 751149 - protein, 406 aa, Homo sapiens
SPRPSRPAPQFCIHKRPRCVPKKTKKNPFAAAGAPPAARAGYAHFLNVQGRTLYDVILYGLQEHSEAVWRWRLRAAPRCRLAHSSCSPGGDPTAGAAWACFRLDGRTLLRVRGPDAAPFLLGLLTNELPLPSPAAAGAPPAARAGYAHFLNVQGRTLYDVILYGLQEHSEVSGFLLECDSSVQGALQKHLALYRIRRKVTVEPHPELRVWAVLPSSPEACGAASLQERAGAAAILIRDPRTARMGWRLLTQDEGPALVPGGRLGDLWDYHQHRYLQGVPEGVRDLPPGVALPLESNLAFMNGVSFTKGCYIGQELTARTHHMGVIRKRLFPVRFLDPLPTSGITPGATVLTASGQTVGKFRAGQGNVGLALLWSEKIKGPLHIRASEGAQVALAASVPDWWPTVSK

SEQ ID NO: 751150 - protein, 356 aa, Homo sapiens
MATAALLRGATPGRGGPVWRWRLRAAPRCRLAHSSCSPGGDPTAGAAWACFRLDGRTLLRVRGPDAAPFLLGLLTNELPLPSPAAAGAPPAARAGYAHFLNVQGRTLYDVILYGLQEHSEVSGFLLECDSSVQGALQKHLALYRIRRKVTVEPHPELRVWAVLPSSPEACGAASLQERAGAAAILIRDPRTARMGWRLLTQDEGPALVPGGRLGDLWDYHQHRYLQGVPEGVRDLPPGVALPLESNLAFMNGVSFTKGCYIGQELTARTHHMGVIRKRLFPVRFLDPLPTSGITPGATVLTASGQTVGKFRAGQGNVGLALLWSEKIKGPLHIRASEGAQVALAASVPDWWPTVSK

SEQ ID NO: 751151 - protein, 183 aa, Homo sapiens
MREYKVVVLGSGGVGKSALTVQFVTGTFIEKYDPTIEDFYRKEIEVDSSPSVLEILDTAGTEQFASMRDLYIKNGQGFILVYSLVNQQSFQDIKPMRDQIVRVKRYEKVPLILVGNKVDLEPEREVMSSEGRALAQEWGCPFMETSAKSKSMVDELFAEIVRQMNYSSLPEKQDQCCTTCVVQ

SEQ ID NO: 751152 - protein, 117 aa, Homo sapiens
MRDLYIKNGQGFILVYSLVNQQSFQDIKPMRDQIVRVKRYEKVPLILVGNKVDLEPEREVMSSEGRALAQEWGCPFMETSAKSKSMVDELFAEIVRQMNYSSLPEKQDQCCTTCVVQ

SEQ ID NO: 751153 - protein, 183 aa, Homo sapiens; identical to SEQ ID NO: 751151

SEQ ID NO: 751154 - protein, 183 aa, Homo sapiens; identical to SEQ ID NO: 751151

SEQ ID NO: 751155 - protein, 192 aa, Homo sapiens
SGKPFRVCAWWGWGWGWGWGWGVGEKKKRWVRLESLRPPPDGPRLFPRGEQQRWGSGETEEPAGGHGLGVTEPPRRPGGCGRRGRTTPAGAGAQKPARAAVTGTEPSGLSRLGCASRKRGPWAPLCEGRGRSAGQPRAAGSSDVRLAAGSPRRSPTLFPPRGHAASSHNLSRAFPRLRPPPHAPCSGCSSYR

SEQ ID NO: 751156 - protein, 183 aa, Homo sapiens; identical to SEQ ID NO: 751151

SEQ ID NO: 751157 - protein, 183 aa, Homo sapiens; identical to SEQ ID NO: 751151

SEQ ID NO: 751158 - protein, 183 aa, Homo sapiens; identical to SEQ ID NO: 751151

SEQ ID NO: 751159 - protein, 195 aa, Homo sapiens
SVAFSCNGLHHITNCTRSHPFKKVQTQENFHSTLMKKIEISGTCLSFHLLFGLEIRMRRIVFAGVILFRLLGVILFRLLGVILFGRLGDLGTCQTKPGQYWKEEVHIQDVGGLICRACNLSLPFHGCLLDLGTCQAEPGQYCKEEVHIQGGIQWYSVKGCTKNTSECFKSTLVKRILQLHELVTTHCCNHSLCNF

SEQ ID NO: 751160 - protein, 109 aa, Homo sapiens
QDPHRGSFFKSPGFLPPPTCPLVFPLRLLVIPVRGAVLPQQVLHQERGPAKLELGKPRHRSCHTQAPGPPTVHRLSRELRVTAKSSERRVCLSFGLAKLEGTLESKSNP

SEQ ID NO: 751161 - protein, 216 aa, Homo sapiens
MTLTERLREKISRAFYNHGLLCASYPIPIILFTGFCILACCYPLLKLPLPGTGPVEFTTPVKDYSPPPVDSDRKQGEPTEQPEWYVGAPVAYVQQIFVKSSVFPWHKNLLAVDVFRSPLSRAFQLVEEIRNHVLRDSSGIRSLEELCLQVTDLLPGLRKLRNLLPEHGCLLLSPGNFWQNDWERFHADPDIIGTIHQHEPKTRCRAPMGLSGEQFS

SEQ ID NO: 751162 - protein, 102 aa, Homo sapiens
MTLTERLREKISRAFYNHGLLCASYPIPIILFTGFCILACCYPLLKLPLPGTGPVEFTTPVKDYSPPPVDSDRKQGEPTEQPEWVGTRHVPEASTERWVETG

SEQ ID NO: 751163 - protein, 734 aa, Homo sapiens
MKNMATELGIILIGYFTLVPAIQEFCLFAVVGLVSDFFLQMLFFTTVLSIDIRRMELADLNKRLPPEACLPSAKPVGQPTRYERQLAVRPSTPHTITLQPSSFRNLRLPKRLRVVYFLARTRLAQRLIMAGTVVWIGILVYTDPAGLRNYLAAQVTEQSPLGEGALAPMPVPSGMLPPSHPDPAFSIFPPDAPKLPENQTSPGESPERGGPAEVVHDSPVPEVTWGPEDEELWRKLSFRHWPTLFSYYNITLAKRYISLLPVIPVTLRLNPREALEGRHPQDGRSAWPPPGPIPAGHWEAGPKGPGGVQAHGDVTLYKVAALGLATGIVLVLLLLCLYRVLCPRNYGQLGGGPGRRRRGELPCDDYGYAPPETEIVPLVLRGHLMDIECLASDGMLLVSCCLAGHICVWDAQTGDCLTRIPRPGQRRDSGVGSGLEAQESWERLSDGGKAGPEEPGDSPPLRHRPRGPPPPSLFGDQPDLTCLIDTNFSAQPRSSQPTQPEPRHRAVCGRSRDSPGYDFSCLVQRVYQEEGLAAVCTPALRPPSPGPVLSQAPEDEGGSPEKGSPSLAWAPSAEGSIWSLELQGNLIVVGRSSGRLEVWDAIEGVLCCSSEEVSSGITALVFLDKRIVAARLNGSLDFFSLETHTALSPLQFRGTPGRGSSPASPVYSSSDTVACHLTHTVPCAHQKTHHSPESRCWALGDWEPRPHTESVPSGGLVLPLHPSGPLRGHHDRVH

SEQ ID NO: 751164 - protein, 760 aa, Homo sapiens
MSQSGHVLPCALLLPSAGLSSESWSIMKNMATELGIILIGYFTLVPAIQEFCLFAVVGLVSDFFLQMLFFTTVLSIDIRRMELADLNKRLPPEACLPSAKPVGQPTRYERQLAVRPSTPHTITLQPSSFRNLRLPKRLRVVYFLARTRLAQRLIMAGTVVWIGILVYTDPAGLRNYLAAQVTEQSPLGEGALAPMPVPSGMLPPSHPDPAFSIFPPDAPKLPENQTSPGESPERGGPAEVVHDSPVPEVTWGPEDEELWRKLSFRHWPTLFSYYNITLAKRYISLLPVIPVTLRLNPREALEGRHPQDGRSAWPPPGPIPAGHWEAGPKGPGGVQAHGDVTLYKVAALGLATGIVLVLLLLCLYRVLCPRNYGQLGGGPGRRRRGELPCDDYGYAPPETEIVPLVLRGHLMDIECLASDGMLLVSCCLAGHICVWDAQTGDCLTRIPRPGQRRDSGVGSGLEAQESWERLSDGGKAGPEEPGDSPPLRHRPRGPPPPSLFGDQPDLTCLIDTNFSAQPRSSQPTQPEPRHRAVCGRSRDSPGYDFSCLVQRVYQEEGLAAVCTPALRPPSPGPVLSQAPEDEGGSPEKGSPSLAWAPSAEGSIWSLELQGNLIVVGRSSGRLEVWDAIEGVLCCSSEEVSSGITALVFLDKRIVAARLNGSLDFFSLETHTALSPLQFRGTPGRGSSPASPVYSSSDTVACHLTHTVPCAHQKTHHSPESRCWALGDWEPRPHTESVPSGGLVLPLHPSGPLRGHHDRVH

SEQ ID NO: 751165 - protein, 1107 aa, Homo sapiens
MTLTERLREKISRAFYNHGLLCASYPIPIILFTGFCILACCYPLLKLPLPGTGPVEFTTPVKDYSPPPVDSDRKQGEPTEQPEWYVGAPVAYVQQIFVKSSVFPWHKNLLAVDVFRSPLSRAFQLVEEIRNHVLRDSSGIRSLEELCLQVTDLLPGLRKLRNLLPEHGCLLLSPGNFWQNDWERFHADPDIIGTIHQHEPKTLQTSATLKDLLFGVPGKYSGVSLYTRKRMVSYTITLVFQHYHAKFLGSLRARLMLLHPSPNCSLRAESLVHVHFKEEIGVAELIPLVTTYIILFAYIYFSTRKIDMVKSKWGLALAAVVTVLSSLLMSVGLCTLFGLTPTLNGGEIFPYLVVVIGLENVLVLTKSVVSTPVDLEVKLRIAQGLSSESWSIMKNMATELGIILIGYFTLVPAIQEFCLFAVVGLVSDFFLQMLFFTTVLSIDIRRMELADLNKRLPPEACLPSAKPVGQPTRYERQLAVRPSTPHTITLQPSSFRNLRLPKRLRVVYFLARTRLAQRLIMAGTVVWIGILVYTDPAGLRNYLAAQVTEQSPLGEGALAPMPVPSGMLPPSHPDPAFSIFPPDAPKLPENQTSPGESPERGGPAEVVHDSPVPEVTWGPEDEELWRKLSFRHWPTLFSYYNITLAKRYISLLPVIPVTLRLNPREALEGRHPQDGRSAWPPPGPIPAGHWEAGPKGPGGVQAHGDVTLYKVAALGLATGIVLVLLLLCLYRVLCPRNYGQLGGGPGRRRRGELPCDDYGYAPPETEIVPLVLRGHLMDIECLASDGMLLVSCCLAGHICVWDAQTGDCLTRIPRPGQRRDSGVGSGLEAQESWERLSDGGKAGPEEPGDSPPLRHRPRGPPPPSLFGDQPDLTCLIDTNFSAQPRSSQPTQPEPRHRAVCGRSRDSPGYDFSCLVQRVYQEEGLAAVCTPALRPPSPGPVLSQAPEDEGGSPEKGSPSLAWAPSAEGSIWSLELQGNLIVVGRSSGRLEVWDAIEGVLCCSSEEVSSGITALVFLDKRIVAARLNGSLDFFSLETHTALSPLQFRGTPGRGSSPASPVYSSSDTVACHLTHTVPCAHQKTHHSVPSGGLVLPLHPSGPLRGHHDRVH

SEQ ID NO: 751166 - protein, 888 aa, Homo sapiens
MTLTERLREKISRAFYNHGLLCASYPIPIILFTGFCILACCYPLLKLPLPGTGPVEFTTPVKDYSPPPVDSDRKQGEPTEQPEWYVGAPVAYVQQIFVKSSVFPWHKNLLAVDVFRSPLSRAFQLVEEIRNHVLRDSSGIRSLEELCLQVTDLLPGLRKLRNLLPEHGCLLLSPGNFWQNDWERFHADPDIIGTIHQHEPKTLQTSATLKDLLFGVPGKYSGVSLYTRKRMVSYTITLVFQHYHAKFLGSLRARLMLLHPSPNCSLRAESLVHVHFKEEIGVAELIPLVTTYIILFAYIYFSTRKIDMVKSKWGLALAAVVTVLSSLLMSVGLCTLFGLTPTLNGGEIFPYLVVVIGLENVLVLTKSVVSTPVDLEVKLRIAQGLSSESWSIMKNMATELGIILIGYFTLVPAIQEFCLFAVVGLVSDFFLQMLFFTTVLSIDIRRMELADLNKRLPPEACLPSAKPVGQPTRYERQLAVRPSTPHTITLQPSSFRNLRLPKRLRVVYFLARTRLAQRLIMAGTVVWIGILVYTDPAGLRNYLAAQVTEQSPLGEGALAPMPVPSGMLPPSHPDPAFSIFPPDAPKLPENQTSPGESPERGGPAEVVHDSPVPEVTWGPEDEELWRKLSFRHWPTLFSYYNITLAKRYISLLPVIPVTLRLNPREALEGRHPQDGRSAWPPPGPIPAGHWEAGPKGPGGVQAHGDVTLYKVAALGLATGIVLVLLLLCLYRVLCPRNYGQLGGGPGRRRRGELPCDDYGYAPPETEIVPLVLRGHLMDIECLASDGMLLVSCCLAGHICVWDAQTGDCLTRIPRPGQRRDSGVGSGLEAQESWERLSDGGKAGPEEPGDSPPLRHRPQCRGFHLELGAAGQPHRGGAEQRPAGGVGRH

SEQ ID NO: 751167 - protein, 149 aa, Homo sapiens [sequence omitted]

SEQ ID NO: 751168 - protein, 1126 aa, Homo sapiens
MTLTERLREKISRAFYNHGLLCASYPIPIILFTGFCILACCYPLLKLPLPGTGPVEFTTPVKDYSPPPVDSDRKQGEPTEQPEWYVGAPVAYVQQIFVKSSVFPWHKNLLAVDVFRSPLSRAFQLVEEIRNHVLRDSSGIRSLEELCLQVTDLLPGLRKLRNLLPEHGCLLLSPGNFWQNDWERFHADPDIIGTIHQHEPKTLQTSATLKDLLFGVPGKYSGVSLYTRKRMVSYTITLVFQHYHAKFLGSLRARLMLLHPSPNCSLRAESLVHVHFKEEIGVAELIPLVTTYIILFAYIYFSTRKIDMVKSKWGLALAAVVTVLSSLLMSVGLCTLFGLTPTLNGGEIFPYLVVVIGLENVLVLTKSVVSTPVDLEVKLRIAQGLSSESWSIMKNMATELGIILIGYFTLVPAIQEFCLFAVVGLVSDFFLQMLFFTTVLSIDIRRMELADLNKRLPPEACLPSAKPVGQPTRYERQLAVRPSTPHTITLQPSSFRNLRLPKRLRVVYFLARTRLAQRLIMAGTVVWIGILVYTDPAGLRNYLAAQVTEQSPLGEGALAPMPVPSGMLPPSHPDPAFSIFPPDAPKLPENQTSPGESPERGGPAEVVHDSPVPEVTWGPEDEELWRKLSFRHWPTLFSYYNITLAKRYISLLPVIPVTLRLNPREALEGRHPQDGRSAWPPPGPIPAGHWEAGPKGPGGVQAHGDVTLYKVAALGLATGIVLVLLLLCLYRVLCPRNYGQLGGGPGRRRRGELPCDDYGYAPPETEIVPLVLRGHLMDIECLASDGMLLVSCCLAGHICVWDAQTGDCLTRIPRPGQRRDSGVGSGLEAQESWERLSDGGKAGPEEPGDSPPLRHRPRGPPPPSLFGDQPDLTCLIDTNFSAQPRSSQPTQPEPRHRAVCGRSRDSPGYDFSCLVQRVYQEEGLAAVCTPALRPPSPGPVLSQAPEDEGGSPEKGSPSLAWAPSAEGSIWSLELQGNLIVVGRSSGRLEVWDAIEGVLCCSSEEVSSGITALVFLDKRIVAARLNGSLDFFSLETHTALSPLQFRGTPGRGSSPASPVYSSSDTVACHLTHTVPCAHQKTHHSPESRCWALGDWEPRPHTESVPSGGLVLPLHPSGPLRGHHDRVH

SEQ ID NO: 751169 - protein, 149 aa, Homo sapiens [sequence omitted]

SEQ ID NO: 751170 - protein, 149 aa, Homo sapiens [sequence omitted]

SEQ ID NO: 751171 - protein, 93 aa, Homo sapiens
MSQSGHVLPCALLLPSAGLSSESWSIMKNMATELGIILIGYFTLVPAIQREGPKACHLDEHGSNCCAPQLCSHGQGAPLFSTGILASEVGPLC

SEQ ID NO: 751172 - protein, 1126 aa, Homo sapiens; identical to SEQ ID NO: 751168

SEQ ID NO: 751173 - protein, 871 aa, Homo sapiens
MLLHPSPNCSLRAESLVHVHFKEEIGVAELIPLVTTYIILFAYIYFSTRKIDMVKSKWGLALAAVVTVLSSLLMSVGLCTLFGLTPTLNGGEIFPYLVVVIGLENVLVLTKSVVSTPVDLEVKLRIAQGLSSESWSIMKNMATELGIILIGYFTLVPAIQEFCLFAVVGLVSDFFLQMLFFTTVLSIDIRRMELADLNKRLPPEACLPSAKPVGQPTRYERQLAVRPSTPHTITLQPSSFRNLRLPKRLRVVYFLARTRLAQRLIMAGTVVWIGILVYTDPAGLRNYLAAQVTEQSPLGEGALAPMPVPSGMLPPSHPDPAFSIFPPDAPKLPENQTSPGESPERGGPAEVVHDSPVPEVTWGPEDEELWRKLSFRHWPTLFSYYNITLAKRYISLLPVIPVTLRLNPREALEGRHPQDGRSAWPPPGPIPAGHWEAGPKGPGGVQAHGDVTLYKVAALGLATGIVLVLLLLCLYRVLCPRNYGQLGGGPGRRRRGELPCDDYGYAPPETEIVPLVLRGHLMDIECLASDGMLLVSCCLAGHICVWDAQTGDCLTRIPRPGQRRDSGVGSGLEAQESWERLSDGGKAGPEEPGDSPPLRHRPRGPPPPSLFGDQPDLTCLIDTNFSAQPRSSQPTQPEPRHRAVCGRSRDSPGYDFSCLVQRVYQEEGLAAVCTPALRPPSPGPVLSQAPEDEGGSPEKGSPSLAWAPSAEGSIWSLELQGNLIVVGRSSGRLEVWDAIEGVLCCSSEEVSSGITALVFLDKRIVAARLNGSLDFFSLETHTALSPLQFRGTPGRGSSPASPVYSSSDTVACHLTHTVPCAHQKTHHSPESRCWALGDWEPRPHTESVPSGGLVLPLHPSGPLRGHHDRVH

SEQ ID NO: 751174 - protein, 753 aa, Homo sapiens
MTLTERLREKISRAFYNHGLLCASYPIPIILIGYFTLVPAIQEFCLFAVVGLVSDFFLQMLFFTTVLSIDIRRMELADLNKRLPPEACLPSAKPVGQPTRYERQLAVRPSTPHTITLQPSSFRNLRLPKRLRVVYFLARTRLAQRLIMAGTVVWIGILVYTDPAGLRNYLAAQVTEQSPLGEGALAPMPVPSGMLPPSHPDPAFSIFPPDAPKLPENQTSPGESPERGGPAEVVHDSPVPEVTWGPEDEELWRKLSFRHWPTLFSYYNITLAKRYISLLPVIPVTLRLNPREALEGRHPQDGRSAWPPPGPIPAGHWEAGPKGPGGVQAHGDVTLYKVAALGLATGIVLVLLLLCLYRVLCPRNYGQLGGGPGRRRRGELPCDDYGYAPPETEIVPLVLRGHLMDIECLASDGMLLVSCCLAGHICVWDAQTGDCLTRIPRPGQRRDSGVGSGLEAQESWERLSDGGKAGPEEPGDSPPLRHRPRGPPPPSLFGDQPDLTCLIDTNFSAQPRSSQPTQPEPRHRAVCGRSRDSPGYDFSCLVQRVYQEEGLAAVCTPALRPPSPGPVLSQAPEDEGGSPEKGSPSLAWAPSAEGSIWSLELQGNLIVVGRSSGRLEVWDAIEGVLCCSSEEVSSGITALVFLDKRIVAARLNGSLDFFSLETHTALSPLQFRGTPGRGSSPASPVYSSSDTVACHLTHTVPCAHQKTHHSPESRCWALGDWEPRPHTESVPSGGLVLPLHPSGPLRGHHDRVH

SEQ ID NO: 751175 - protein, 1080 aa, Homo sapiens
MTLTERLREKISRAFYNHGLLCASYPIPIILFTGFCILACCYPLLKLPLPGTGPVEFTTPVKDYSPPPVDSDRKQGEPTEQPEWYVGAPVAYVQQIFVKSSVFPWHKNLLAVDVFRSPLSRAFQLVEEIRNHVLRDSSGIRSLEELCLQVTDLLPGLRKLRNLLPEHGCLLLSPGNFWQNDWERFHADPDIIGTIHQHEPKTLQTSATLKDLLFGVPGKYSGVSLYTRKRMVSYTITLVFQHYHAKFLGSLRARLMLLHPSPNCSLRAESLVHVHFKEEIGVAELIPLVTTYIILFAYIYFSTRKIDMVKSKWGLALAAVVTVLSSLLMSVGLCTLFGLTPTLNGGEIFPYLVVVIGLENVLVLTKSVVSTPVDLEVKLRIAQGLSSESWSIMKNMATELGIILIGYFTLVPAIQEFCLFAVVGLVSDFFLQMLFFTTVLSIDIRRMELADLNKRLPPEACLPSAKPVGQPTRYERQLAVRPSTPHTITLQPSSFRNLRLPKRLRVVYFLARTRLAQRLIMAGTVVWIGILVYTDPAGLRNYLAAQVTEQSPLGEGALAPMPVPSGMLPPSHPDPAFSIFPPDAPKLPENQTSPGESPERGGPAEVVHDSPVPEVTWGPEDEELWRKLSFRHWPTLFSYYNITLAKRYISLLPVIPVTLRLNPREALEGRHPQDGRSAWPPPGPIPAGALGSRTQGPRWGAGPWRRHAVQDYGYAPPETEIVPLVLRGHLMDIECLASDGMLLVSCCLAGHICVWDAQTGDCLTRIPRPGQRRDSGVGSGLEAQESWERLSDGGKAGPEEPGDSPPLRHRPRGPPPPSLFGDQPDLTCLIDTNFSAQPRSSQPTQPEPRHRAVCGRSRDSPGYDFSCLVQRVYQEEGLAAVCTPALRPPSPGPVLSQAPEDEGGSPEKGSPSLAWAPSAEGSIWSLELQGNLIVVGRSSGRLEVWDAIEGVLCCSSEEVSSGITALVFLDKRIVAARLNGSLDFFSLETHTALSPLQFRGTPGRGSSPASPVYSSSDTVACHLTHTVPCAHQKTHHSPESRCWALGDWEPRPHTESVPSGGLVLPLHPSGPLRGHHDRVH

SEQ ID NO: 751176 - protein, 734 aa, Homo sapiens; identical to SEQ ID NO: 751163

SEQ ID NO: 751177 - protein, 1126 aa, Homo sapiens; identical to SEQ ID NO: 751168

SEQ ID NO: 751178 - protein, 418 aa, Homo sapiens
MTLTERLREKISRAFYNHGLLCASYPIPIILFTGFCILACCYPLLKLPLPGTGPVEFTTPVKDYSPPPVDSDRKQGEPTEQPEWRDFPLPCGGYWVRECVGAHQVCGLNPGRPGGEAADRPRPKQRELVHHEEHGHGAGHHPHRLLHPSARHPAPSLFGDQPDLTCLIDTNFSAQPRSSQPTQPEPRHRAVCGRSRDSPGYDFSCLVQRVYQEEGLAAVCTPALRPPSPGPVLSQAPEDEGGSPEKGSPSLAWAPSAEGSIWSLELQGNLIVVGRSSGRLEVWDAIEGVLCCSSEEVSSGITALVFLDKRIVAARLNGSLDFFSLETHTALSPLQFRGTPGRGSSPASPVYSSSDTVACHLTHTVPCAHQKTHHSPESRCWALGDWEPRPHTESVPSGGLVLPLHPSGPLRGHHDRVH

SEQ ID NO: 751179 - protein, 1107 aa, Homo sapiens; identical to SEQ ID NO: 751165

SEQ ID NO: 751180 - protein, 109 aa, Homo sapiens
MTLTERLREKISRAFYNHGLLCASYPIPIILFTGFCILACCYPLLKLPLPGTGPVEFTTPVKDYSPPPVDSDRKQGEPTEQPEWYVGAPVAYVQQIFVKSSPRPAEAGG

SEQ ID NO: 751181 - protein, 111 aa, Homo sapiens [sequence omitted]

SEQ ID NO: 751182 - protein, 109 aa, Homo sapiens
MGSVFGGLQGPAFLTSSTCRGPGIIHAAGRGSSHKQNTAPLLEPMAQVVRGGRCGGSPGAAGPSPCERCCQPEGGEGREPREYLEDACPRHEAPSGPHRPHAQVPQVPV

SEQ ID NO: 751183 - protein, 118 aa, Homo sapiens
AYFDSIFIRKAQANRPSSNSQAAPVLLPGPGRPRPPRAFSRGLLLLLAPGEPLIARGPPPLWDVRLCCPWAGSTRLWCLGLGLLEEEAVLSARVWLQVTGLVMLTVALKDALLAHPEA

SEQ ID NO: 751184 - protein, 212 aa, Homo sapiens
PHTSIAFLYERPRPIGRARIRRLPQSSCQALGAHARHGLSAAGCSCSSPRGCDSLTQIQCGQLQSRRAQIHQQIDKELQMRTGAENLYRATSNNRVRETVALELSYVNSNLQLLKEELEELSGGVDPGRHGSEAVTVPMIPLGLKETKELDWSTPLKELISVHFGEDGASYEAEIRELEACGRPCGPPAGMSRAWSCSQPITTSCASWMRAS

SEQ ID NO: 751185 - protein, 171 aa, Homo sapiens
EKSCCSSFPALEEEGRRGKFGGKLCNFLFYFHSNSAESRMDVLFVAIFAVPLILGQEYEDEERLGEDEYYQVVYYYTVTPSYDDFSADFTIDYSIFESEDRLNRLDKDITEAIETTISLETARADHPKPVTVKPVTTEPQSPDLNDAVSSLRSPIPLLLSCAFVQVGMYFM

SEQ ID NO: 751186 - protein, 117 aa, Homo sapiens
MKLIKTIKVYREDEYYQVVYYYTVTPSYDDFSADFTIDYSIFESEDRLNRLDKDITEAIETTISLETARADHPKPVTVKPVTTEPQSPDLNDAVSSLRSPIPLLLSCAFVQVGMYFM

SEQ ID NO: 751187 - protein, 132 aa, Homo sapiens
MDVLFVAIFAVPLILGQEYEDEERLGEDEYYQVVYYYTVTPSYDDFSADFTIDYSIFESEDRLNRLDKDITEAIETTISLETARADHPKPVTVKPVTTEPQSPDLNDAVSSLRSPIPLLLSCAFVQVGMYFM

SEQ ID NO: 751188 - protein, 102 aa, Homo sapiens [sequence omitted]

SEQ ID NO: 751189 - protein, 171 aa, Homo sapiens; identical to SEQ ID NO: 751185

SEQ ID NO: 751190 - protein, 106 aa, Homo sapiens
APLHSGLGSKSETLSPKKKRRSDIFIKINLDGQVWWLMPVIPALWEAKGGRSLEAKSSRPAWPIWQNPVSTKNTKISWVWWCMPIIPATREAEAGGFLEPRKSKLQ

SEQ ID NO: 751191 - protein, 119 aa, Homo sapiens [sequence omitted]

SEQ ID NO: 751192 - protein, 83 aa, Homo sapiens
MFYLTLESYLVLSHLHGSIAYFTNYTIKSRSSYLHLKICTENVAVNMFKKVYLKQKSKEVYLNQSKKSHFQMAIKHVLHRISA

SEQ ID NO: 751193 - protein, 305 aa, Homo sapiens
DAHLLWENSPLVYTYEPTGLVTFTRQSLEDFPEWKRCEKPLTRLHVTYEGTIEENGRGMLQVDFANHFVGGGVTSAGLVQEEIRFLINPELIISRLFTEVLDHNECLIIQCQRWLWIPHSVCCCLAPEPTCRGVSIPAGEVLRRSYTKGIKVLVSTVRFSQQYSLCSTIFLDDSTAIQHYLTMTIISVTLEIPHHITQRDADRSLSIPDEQLHSFAVSTVHIMKKRNGGGSLNNYSSSIPSTPSTSQEDPQFSVPPTANTPTPVCKRSMRWSNLFTSEKGSDPDKERKAPENHADTIGSGRAIPH

SEQ ID NO: 751194 - protein, 106 aa, Homo sapiens
LTGMLEQETAWPVSFLLARTSLPSAAWTVCTELWRNSTLGVLENFRNKLIKRIHRGSPAGSSAPVSIGKAMRAEGSAECPWPQSFWILQSVICWASNSARVKGAGG

SEQ ID NO: 751195 - protein, 179 aa, Homo sapiens
RQLKKGGKQASASYDSEEEEEGLPMSYDEKRQLSLDINRLPGEKLGRVVHIIQSREPSLRDSNPDEIEIDFETLKPTTLRELERYVKSCLQKKQRKPFSASGKKQAAKSKEELAQEKKKELEKRLQDVSGQLSSSKKPARKEKPGSAPSGGPSRLSSSSSSESGSSSSSGSSSDSSDSE

SEQ ID NO: 751196 - protein, 179 aa, Homo sapiens; identical to SEQ ID NO: 751195

SEQ ID NO: 751197 - protein, 514 aa, Homo sapiens
MAVWLAQWLGPLLLVSLWGLLAPASLLRRLGEHIQQFQESSAQGLGLSLGPGAAALPKVGWLEQLLDPFNVSDRRSFLQRYWVNDQHWVGQDGPIFLHLGGEGSLGPGSVMRGHPAALAPAWGALVISLEHRFYGLSIPAGGLEMAQLRFLSSRLALADVVSARLALSRLFNISSSSPWICFGGSYAGSLAAWARLKFPHLIFASVASSAPVRAVLDFSEYNDVVSRSLMSTAIGGSLECRAAVSVAFAEVERRLRSGGAAQAALRTELSACGPLGRAENQAELLGALQALVGGVVQYDGQTGAPLSVRQLCGLLLGGGGNRSHSTPYCGLRRAVQIVLHSLGQKCLSFSRAETVAQLRSTEPQLSGVGDRQWLYQTCTEFGFYVTCENPRCPFSQLPALPSQLDLCEQVFGLSALSVAQAVAQTNSYYGGQTPGANKVLFVNGDTDPWHVLSVTQALGSSESTLLIRTGSHCLDMAPERPSDSPSLRLGRQNIFQQLQTWLKLAKESQIKGEV

SEQ ID NO: 751198 - protein, 102 aa, Homo sapiens
REKRPRMPGKRRPEKGETCNVAGSKEGRSSGEYAGFGRRRELTKRRGTRKRGAPQRGRGLGRDNPIRRGHRPLACAKCNTGFRILRINSSYPHWLPLLGHGT

SEQ ID NO: 751199 - protein, 203 aa, Homo sapiens [sequence omitted]

SEQ ID NO: 751200 - protein, 449 aa, Homo sapiens
MAVWLAQWLGPLLLVSLWGLLAPASLLRRLGEHIQQFQESSAQGLGLSLGPGAAALPKVGWLEQLLDPFNVSDRRSFLQRYWVNDQHWVGQDGPIFLHLGGEGSLGPGSVMRGHPAALAPAWGALVISLEHRFYGLSIPAGGLEMAQLRFLSSRLALADVVSARLALSRLFNISSSSPWICFGGSYAGSLAAWARLKFPHLIFASVASSAPVRAVLDFSEYNDVRMAGSRCGTGRGPSGRSPLTLPDTFLCGRPQVVSRSLMSTAIGGSLEIVLHSLGQKCLSFSRAETVAQLRSTEPQLSGVGDRQWLYQTCTEFGFYVTCENPRCPFSQLPALPSQLDLCEQVFGLSALSVAQAVAQTNSYYGGQTPGANKVLFVNGDTDPWHVLSVTQALGSSESTLLIRTGSHCLDMAPERPSDSPSLRLGRQNIFQQLQTWLKLAKESQIKGEV

SEQ ID NO: 751201 - protein, 481 aa, Homo sapiens
MAVWLAQWLGPLLLVSLWGLLAPASLLRRLGEHIQQFQESSAQGLGLSLGPGAAALPKVGWLEQLLDPFNVSDRRSFLQRYWVNDQHWVGQDGPIFLHLGGEGSLGPGSVMRGHPAALAPAWGALVISLEHRFYGLSIPAGGLEMAQLRFLSSRLALADVVSARLALSRLFNISSSSPWICFGGSYAGSLAAWARLKFPHLIFASVASSAPVRAVLDFSEYNDVRMAGSRCGTGRGPSGRSPLTLPDTFLCGRPQVVSRSLMSTAIGGSLECRAAVSVAFAEVERRLRSGGAAQAALRTELSACGPLGRAENQAELLGALQALVGGVVQYDGQTGAPLSVRQLCGLLLGGGGNRSHSTPYCGLRRAVQIVLHSLGQKCLSFSRAETVAQLRSTEPQLSGVGDRQWLYQTCTEFGFWDTDPWHVLSVTQALGSSESTLLIRTGSHCLDMAPERPSDSPSLRLGRQNIFQQLQTWLKLAKGEV

SEQ ID NO: 751202 - protein, 342 aa, Homo sapiens
MAVWLAQWLGPLLLVSLWGLLAPASLLRRLGEHIQQFQESSAQGLGLSLGPGAAALPKVGWLEQLLDPFNVSDRRSFLQRYWVNDQHWVGQDGPIFLHLGGEGSLGPGSVMRGHPAALAPAWGALVISLEHRFYGLSIPAGGLEMAQLRFLSSRLALADVVSARLALSRLFNISSSSPWICFGGSYAGSLAAWARLKFPHLIFASVASSAPVRAVLDFSEYNDVRMAGSRCGTGRGPSGRSPLTLPDTFLCGPPTGGIPKPNEHRDRRVPGGDTDPWHVLSVTQALGSSESTLLIRTGSHCLDMAPERPSDSPSLRLGRQNIFQQLQTWLKLAKESQIKGEV

SEQ ID NO: 751203 - protein, 78 aa, Homo sapiens
RGEAKTRIGGLEGKDLEAKEALGSSESTLLIRTGSHCLDMAPERPSDSPSLRLGRQNIFQQLQTWLKLAKESQIKGEV

SEQ ID NO: 751204 - protein, 78 aa, Homo sapiens
REKRPRMPGKRRPEKGETCNVAGSKEGRSSGEYAGFGRRRELTKRRGTRKRGAPQRGRGLGRDNPIRRLSCTAWARSV

SEQ ID NO: 751205 - protein, 203 aa, Homo sapiens [sequence omitted]

SEQ ID NO: 751206 - protein, 389 aa, Homo sapiens
MAVWLAQWLGPLLLVSLWGLLAPASLLRRLGEHIQQFQESSAQGLGLSLGPGAAALPKVGWLEQLLDPFNVSDRRSFLQRYWVNDQHWVGQDGPIFLHLGGEGSLGPGSVMRGHPAALAPAWGALVISLEHRFYGLSIPAGGLEMAQLRFLSSRLALADVVSARLALSRLFNISSSSPWICFGGSYAGSLAAWARLKFPHLIFASVASSAPVRAVLDFSEYNDVRMAGSRCGTGRGPSGRSPLTLPDTFLCGRPQVVSRSLMSTAIGGSLEIVLHSLGQKCLSFSRAETVAQLRSTEPQLSGVGDRQWLYQTCTEFGFWDTDPWHVLSVTQALGSSESTLLIRTGSHCLDMAPERPSDSPSLRLGRQNIFQQLQTWLKLAKESQIKGEV

SEQ ID NO: 751207 - protein, 106 aa, Homo sapiens
MYPALGSRAISGTTRFQRMEKFPENTCLGGETRERDWTVLYHGTETMKSETANGRDCCIVTEKLMDELNSKLDTTETLDPCVEDDSITNWRVPGSLSHHLKQKGQE

SEQ ID NO: 751208 - protein, 32 aa, Homo sapiens
MYPRGFYLFNVQPDEVLSHVNNFIKNMALHPK

SEQ ID NO: 751209 - protein, 35 aa, Homo sapiens
MLPRELRTAKLRSAQGSDRDQRGQLQGSPQAPNWP

SEQ ID NO: 751210 - protein, 86 aa, Homo sapiens
MKGILRIDLQHQEDMADCKEMCLTEQSPTICSSAGPIQRTPGSLRAREPHCILITITNAHPDDQDRKKGQSRPGTVAHACNPSTLG

SEQ ID NO: 751211 - protein, 68 aa, Homo sapiens
GIKDALDQALLKDPGQRFLTRLCPASNKATEEPRLADEHRLRGSHIRRQKQTCWCCPLRSVQMPLEEG

SEQ ID NO: 751212 - protein, 120 aa, Homo sapiens
MRVAGKTGEMCRGLSRGGRRLRQLHILDRQERFPIILLSRVSCVSVQTDTAVYLQAAMKLRATENTCTMVSGRSLFPQPKTDSFAGHLFSTARTLPLSVERGRGSAYGARRSDSAVNTLG

SEQ ID NO: 751213 - protein, 120 aa, Homo sapiens; identical to SEQ ID NO: 751212

SEQ ID NO: 751214 - protein, 128 aa, Homo sapiens
AGYSWGCGQRFDHETNSDDACTYHPGVPVFHDALKGWSCYKRRTTDFSDFLSIVHCTKGRHNSEKPPEPVKPEVKTTEKKEISELKPKFQEHIIQAPKPVEAIKRPSPDEPMTNLELKISASPKQALD

SEQ ID NO: 751215 - protein, 110 aa, Homo sapiens
FVPETQGPFGVCTQGISWSVNCKNHGKSIVPALDSTVPHSAAEGRPPTPCTSWVRRCPTLLLLALHGLHPLPNLSSQLEMQKSPIFCVGLAGSCQTGLLFSHLQVLLSNV

SEQ ID NO: 751216 - protein, 70 aa, Homo sapiens
GYVYMSTLGYVYMRTVGYVYVGTLGFTYRDTHILGCVYLGGSVCMDVCLHEHHMCVYVGARVSASMLVKL

SEQ ID NO: 751217 - protein, 139 aa, Homo sapiens
KYSEQSKETNGSEPLGVFPTQGTPVASLDLEQEQLTIKALKELGERQVEKSTSAQRDAELPSEEVLKQTFTFAPESWPQRSYDILERNVKNGSDLGISQKPITIRETTRVDAVSSLSKTELVKKHVLARLLTDFSGNHL

SEQ ID NO: 751218 - protein, 79 aa, Homo sapiens
SGECAGQSQPGEWEGQLSVHGVPSGDREELLRTSDSNKPGLRAQKCESNPKNSQSKCPLLFLGPPDDPGLFTDEEMEAS

SEQ ID NO: 751219 - protein, 106 aa, Homo sapiens
MPRWPEWFFSNSFVDSRTYSFLMETLCFSHFLSQHTCYFPTEYTHCSYPCTVTHTGRTGMDADGILTQPHLEEIIVSKMWGHKGWHCGLQWFTDETAKMRQDHQMQ

SEQ ID NO: 751220 - protein, 106 aa, Homo sapiens
VLSSHTCQACHPLQDEAWCPWLALSTSHNIVSLVAPSYGLLNPHSPERHSQPPRLKPHGSSGFVQFLNPAWSPACSLPVTSASHPLLSLPSREPFEATFPFLSHSP

SEQ ID NO: 751221 - protein, 109 aa, Homo sapiens
MGSLFRSETMCLAQLFLQSGTAYECLSALGEKGLVQFRDVSVARETRAAPALLAPPIPRIAGALPRGAPRKGAPRPHCPDGEDDTPAQLAKASRSAGLTPGSPAVCVVG

SEQ ID NO: 751222 - protein, 856 aa, Homo sapiens
MGSLFRSETMCLAQLFLQSGTAYECLSALGEKGLVQFRDLNQNVSSFQRKFVGEVKRCEELERILVYLVQEINRADIPLPEGEASPPAPPLKQVLEMQEQLQKLEVELREVTKNKEKLRKNLLELIEYTHMLRVTKTFVKRNVEFEPTYEEFPSLESDSLLDYSCMQRLGAKLGFVSGLINQGKVEAFEKMLWRVCKGYTIVSYAELDESLEDPETGEVIKWYVFLISFWGEQIGHKVKKICDCYHCHVYPYPNTAEERREIQEGLNTRIQDLYTVLHKTEDYLRQVLCKAAESVYSRVIQVKKMKAIYHMLNMCSFDVTNKCLIAEVWCPEADLQDLRRALEEGSRESGATIPSFMNIIPTKETPPTRIRTNKFTEGFQNIVDAYGVGSYREVNPALFTIITFPFLFAVMFGDFGHGFVMFLFALLLVLNENHPRLNQSQEIMRMFFNGRYILLLMGLFSVYTGLIYNDCFSKSVNLFGSGWNVSAMYSSSHPPAEHKKMVLWNDSVVRHNSILQLDPSIPGVFRGPYPLGIDPIWNLATNRLTFLNSFKMKMSVILGIIHMTFGVILGIFNHLHFRKKFNIYLVSIPELLFMLCIFGYLIFMIFYKWLVFSAETSRVAPSILIEFINMFLFPASKTSGLYTGQEYVQRVLLVVTALSVPVLFLGKPLFLLWLHNGRSCFGVNRSGYTLIRKDSEEEVSLLGSQDIEEGNHQVEDGCREMACEEFNFGEILMTQVIHSIEYCLGCISNTASYLRLWALSLAHAQLSDVLWAMLMRVGLRVDTTYGVLLLLPVIALFAVLTIFILLIMEGLSAFLHAIRLHWVEFQNKFYVGAGTKFVPFSFSLLSSKFNNDDSVA

SEQ ID NO: 751223 - protein, 777 aa, Homo sapiens
MGSLFRSETMCLAQLFLQSGTAYECLSALGEKGLVQFRDLNQNVSSFQRKFVGEVKRCEELERILVYLVQEINRADIPLPEGEASPPAPPLKQVLEMQEQLQKLEVELREVTKNKEKLRKNLLELIEYTHMLRVTKTFVKRNVEFEPTYEEFPSLESDSLLDYSCMQRLGAKLGFVSGLINQGKVEAFEKMLWRVCKGYTIVSYAELDESLEDPETGEVIKWYVFLISFWGEQIGHKVKKICDCYHCHVYPYPNTAEERREIQEGLNTRIQDLYTVLHKTEDYLRQVLCKAAESVYSRVIQVKKMKAIYHMLNMCSFDVTNKCLIAEVWCPEADLQDLRRALEEGSRESGATIPSFMNIIPTKETPPTRIRTNKFTEGFQNIVDAYGVGSYREVNPALFTIITFPFLFAVMFGDFGHGFVMFLFALLLVLNENHPRLNQSQEIMRMFFNGRYILLLMGLFSVYTGLIYNDCFSKSVNLFGSGWNVSAMYSSSHPPAEHKKMVLWNDSVVRHNSILQLDPSIPGVFRGPYPLGIDPIWNLATNRLTFLNSFKMKMSVILGIIHMTFGVILGIFNHLHFRKKFNIYLVSIPELLFMLCIFGYLIFMIFYKWLVFSAETSRVAPSILIEFINMFLFPASKTSGLYTGQEYVQRVLLVVTALSVPVLFLGKPLFLLWLHNGRSCFGVNRSGYTLIRKDSEEEVSLLGSQDIEEGNHQVEDGCREMACEEFNFGEILMTQVIHSIEYCLGCISNTASYLRLWALSLAHARKFLLRPAVPNAL

SEQ ID NO: 751224 - protein, 367 aa, Homo sapiens
MGSLFRSETMCLAQLFLQSGTAYECLSALGEKGLVQFRDLNQNVSSFQRKFVGEVKRCEELERILVYLVQEINRADIPLPEGEASPPAPPLKQVLEMQEQLQKLEVELREVTKNKEKLRKNLLELIEYTHMLRVTKTFVKRNVEFEPTYEEFPSLESDSLLDYSCMQRLGAKLGFVSGLINQGKVEAFEKMLWRVCKGYTIVSYAELDESLEDPETGEVIKWYVFLISFWGEQIGHKVKKICDCYHCHVYPYPNTAEERREIQEGLNTRIQDLYTVLHKTEDYLRQVLCKAAESVYSRVIQVKKMKAIYHMLNMCSFDVTNKCLIAEVWCPEADLQDLRRALEEGSRESGATIPSLHEWSSHHSFAL

SEQ ID NO: 751225 - protein, 136 aa, Homo sapiens
MACEEFNFGEILMTQVIHSIEYCLGCISNTASYLRLWALSLAHAQLSDVLWAMLMRVGLRVDTTYGVLLLLPVIALFAVLTIFILLIMEGLSAFLHAIRLHWVEFQNKFYVGAGTKFVPFSFSLLSSKFNNDDSVA

SEQ ID NO: 751226 - protein, 150 aa, Homo sapiens
MGSLFRSETMCLAQLFLQSGTAYECLSALGEKGLVQFRDLNQNVSSFQRKFVGEVKRCEELERILVYLVQEINRADIPLPEGEASPPAPPLKQVLEMQEQLQKLEVELREVTKNKEKLRKNLLELIEYTHMLRVTKTFVKRNVEICVWPN

SEQ ID NO: 751227 - protein, 138 aa, Homo sapiens
MLCDLSQFNFGEILMTQVIHSIEYCLGCISNTASYLRLWALSLAHAQLSDVLWAMLMRVGLRVDTTYGVLLLLPVIALFAVLTIFILLIMEGLSAFLHAIRLHWVEFQNKFYVGAGTKFVPFSFSLLSSKFNNDDSVA

SEQ ID NO: 751228 - protein, 856 aa, Homo sapiens; identical to SEQ ID NO: 751222

SEQ ID NO: 751229 - protein, 442 aa, Homo sapiens
MGSLFRSETMCLAQLFLQSGTAYECLSALGEKGLVQFRDLNQNVSSFQRKFVGEVKRCEELERILVYLVQEINRADIPLPEGEASPPAPPLKQVLEMQEQLQKLEVELREVTKNKEKLRKNLLELIEYTHMLRVTKTFVKRNVEFEPTYEEFPSLESDSLLDYSCMQRLGAKLGFVSGLINQGKVEAFEKMLWRVCKGYTIVSYAELDESLEDPETGEVIKWYVFLISFWGEQIGHKVKKICDCYHCHVYPYPNTAEERREIQEGLNTRIQDLYTSVYSRVIQVKKMKAIYHMLNMCSFDVTNKCLIAEVWCPEADLQDLRRALEEGSRESGATIPSFMNIIPTKETPPTRIRTNKFTEGFQNIVDAYGVGSYREVNPALFTISHLHGFYLARHSSGRPSAPSLRDCPLLSPSLWVSPCHPPQTQLRPRDLTLPPWARRFFD

SEQ ID NO: 751230 - protein, 500 aa, Homo sapiens
MNIIPTKETPPTRIRTNKFTEGFQNIVDAYGVGSYREVNPALFTIITFPFLFAVMFGDFGHGFVMFLFALLLVLNENHPRLNQSQEIMRMFFNGRYILLLMGLFSVYTGLIYNDCFSKSVNLFGSGWNVSAMYSSSHPPAEHKKMVLWNDSVVRHNSILQLDPSIPGVFRGPYPLGIDPIWNLATNRLTFLNSFKMKMSVILGIIHMTFGVILGIFNHLHFRKKFNIYLVSIPELLFMLCIFGYLIFMIFYKWLVFSAETSRVAPSILIEFINMFLFPASKTSGLYTGQEYVQRVLLVVTALSVPVLFLGKPLFLLWLHNGRSCFGVNRSGYTLIRKDSEEEVSLLGSQDIEEGNHQVEDGCREMACEEFNFGEILMTQVIHSIEYCLGCISNTASYLRLWALSLAHAQLSDVLWAMLMRVGLRVDTTYGVLLLLPVIALFAVLTIFILLIMEGLSAFLHAIRLHWVEFQNKFYVGAGTKFVPFSFSLLSSKFNNDDSVA

SEQ ID NO: 751231 - protein, 149 aa, Homo sapiens
MGSLFRSETMCLAQLFLQSGTAYECLSALGEKGLVQFRDLNQNVSSFQRKFVGEVKRCEELERILVYLVQEINRADIPLPEGEASPPAPPLKQVLEMQEQLQKLEVELREVTKNKEKLRKNLLELIEYTHMLRVTKTFVKRNVEVLNSS

SEQ ID NO: 751232 - protein, 90 aa, Homo sapiens
MMLGSLAPDPGSRRHSGQAALRPRRYPTLWDRCRKRWLRPIFTQLLAAGLAYHTLLPIPSEPLFAAPGEHLHQCFVKESYCPPRVLAKEQ

SEQ ID NO: 751233 - protein, 36 aa, Homo sapiens
MMLGSLAPDPGSRRHSGQAALRPRRSGLPHAPPHSQ

SEQ ID NO: 751234 - protein, 60 aa, Homo sapiens
MMLGSLAPDPGSRRHSGQAALRPRRYPTLWDRCRKRWLRPIFTQLLAAGLTTKDSESWQV

SEQ ID NO: 751235 - protein, 31 aa, Homo sapiens
MMLGSLAPDPGSRRHSGQAALRPRRFNHQGL

SEQ ID NO: 751236 - protein, 31 aa, Homo sapiens; identical to SEQ ID NO: 751235

SEQ ID NO: 751237 - protein, 90 aa, Homo sapiens; identical to SEQ ID NO: 751232

SEQ ID NO: 751238 - protein, 396 aa, Homo sapiens
MLLRGVLLALQALQLAGALDLPAGSCAFEESTCGFDSVLASLPWILNEEGHYIYVDTSFGKQGEKAVLLSPDLQAEEWSCLRLVYQITTSSESLSDPSQLNLYMRFEDESFDRLLWSAKEPSDSWLIASLDLQNSSKKFKILIEGVLGQGNTASIALFEIKMTTGYCIECDFEENHLCGFVNRWNPNVNWFVGGGSIRNVHSILPQDHTFKSELGHYMYVDSVYVKHFQEVAQLISPLTTAPMAGCLSFYYQIQQGNDNVFSLYTRDVAGLYEEIWKADRPGNAAWNLAEVEFNAPYPMEVIFEVAFNGPKGGYVALDDISFSPVHCQNQTELLFTCRGSRCNLSQISGIFPSIKQGPAGPGGIKPLFRVGPLTVGFLAPGASPGSGGWPPRKVGP

SEQ ID NO: 751239 - protein, 295 aa, Homo sapiens
MSGALDVLQMKEEDVLKFLAAGTHLGGTNLDFQMEQYIYKRKSDGIYIINLKRTWEKLLLAARAIVAIENPADVSVISSRNTGQRAVLKFAAATGATPIAGRFTPGTFTNQIQAAFREPRLLVVTDPRLTTSLLTEASYVNLPTIALCNTDSPLRYVDIAIPCNNKGAHSVGLMWWMLAREVLRMRGTISREHPWEVMPDLYFYRDPEEIEKEEQAAAEKAVTKEEFQGEWTAPAPEFTATQPEVADWSEGVQVPSVPIQQFPTEDWSAQPATEDWSAAPTVQATEWVGATTDWS

SEQ ID NO: 751240 - protein, 240 aa, Homo sapiens
MGNCQAGHNLHLCLAHHPPLVCATLILLLLGLSGLGLGSFLLTHRTGLRSPDIPQDWVSFLRSFGQLTLCPRNGTVTGKWRGSHVVGLLTTLNFGDGPDRNKTRTFQATVLGSQMGLKGSSAGQLVLITARVTTERTAGTCLYFSAVPGILPSSQPPISCSEEGAGNATLSPRMGEECVSVWSHEGLVLTKLLTSEELALCGSRLLVLGSFLLLFCGLLCCVTAMCFHPRRESHWSRTRL

SEQ ID NO: 751241 - protein, 240 aa, Homo sapiens; identical to SEQ ID NO: 751240

SEQ ID NO: 751242 - protein, 240 aa, Homo sapiens; identical to SEQ ID NO: 751240

SEQ ID NO: 751243 - protein, 240 aa, Homo sapiens; identical to SEQ ID NO: 751240

SEQ ID NO: 751244 - protein, 240 aa, Homo sapiens; identical to SEQ ID NO: 751240

SEQ ID NO: 751245 - protein, 240 aa, Homo sapiens; identical to SEQ ID NO: 751240

SEQ ID NO: 751246 - protein, 240 aa, Homo sapiens; identical to SEQ ID NO: 751240

SEQ ID NO: 751247 - protein, 266 aa, Homo sapiens
VRSESRDRRLRPARGLSPEAQPPLLPMGNCQAGHNLHLCLAHHPPLVCATLILLLLGLSGLGLGSFLLTHRTGLRSPDIPQDWVSFLRSFGQLTLCPRNGTVTGKWRGSHVVGLLTTLNFGDGPDRNKTRTFQATVLGSQMGLKGSSAGQLVLITARVTTERTAGTCLYFSAVPGILPSSQPPISCSEEGAGNATLSPRMGEECVSVWSHEGLVLTKLLTSEELALCGSRLLVLGSFLLLFCGLLCCVTAMCFHPRRESHWSRTRL

SEQ ID NO: 751248 - protein, 297 aa, Homo sapiens
SSGNKLQLNETGLTTEESGGLSELRGLVPPPDFKLALEEEEVEDLRLSPEAQPPLLPMGNCQAGHNLHLCLAHHPPLVCATLILLLLGLSGLGLGSFLLTHRTGLRSPDIPQDWVSFLRSFGQLTLCPRNGTVTGKWRGSHVVGLLTTLNFGDGPDRNKTRTFQATVLGSQMGLKGSSAGQLVLITARVTTERTAGTCLYFSAVPGILPSSQPPISCSEEGAGNATLSPRMGEECVSVWSHEGLVLTKLLTSEELALCGSRLLVLGSFLLLFCGLLCCVTAMCFHPRRESHWSRTRL

SEQ ID NO: 751249 - protein, 195 aa, Homo sapiens
MGNCQAGHNLHLCLAHHPPLVCATLILLLLGLSGLGLGSFLLTHRTGLRSPDIPQDWVSFLRSFGQLTLCPRNGTVTGKWRGSHVVGLLTTLNFGDGPDRNKTRTFQATVLGSQMGLKGSSAGQLVLITARVTTERTAGTCLYFSAVPGILPSSQPPISLLVLGSFLLLFCGLLCCVTAMCFHPRRESHWSRTRL

SEQ ID NO: 751250 - protein, 159 aa, Homo sapiens
MGNCQAGHNLHLCLAHHPPLVCATLILLLLGLSGLGLGSFLLTHRTGLRSPDIPQDWVSFLRSFGQLTLCPRNGTVTGKWRGSHVVGLLTTLNFGDGPDRNKTRTFQATVLGSQMGLKGGAGSVWLQAAGLGLLPASLLWPSLLCHCYVLPPAPGVPLV

SEQ ID NO: 751251 - protein, 150 aa, Homo sapiens
CPHPVACPDPPGMKITGSPCPFSCSLDVESPLPHGGSFYSPWTGLTCPPPPLPVPLPRRSWLCVAPGCWSWAPSCFSSVAFSAVSLLCASTRAGSPTGLEPGSEGTGLVPDLFLSEVLCSSPAGAGNGVGVGVVTGVEQILGLFLKDCCF

SEQ ID NO: 751252 - protein, 240 aa, Homo sapiens; identical to SEQ ID NO: 751240

SEQ ID NO: 751253 - protein, 297 aa, Homo sapiens; identical to SEQ ID NO: 751248

SEQ ID NO: 751254 - protein, 256 aa, Homo sapiens
MGNCQAGHNLHLCLAHHPPLVCATLILLLLGLSGLGLGSFLLTHRTGLRSPDIPQDWVSFLRSFGQLTLCPRNGTVTGKWRGSHVVGLLTTLNFGDGPDRNKTRTFQATVLGSQMGLKGSSAGQLVLITARVTTERTAGTCLYFSAVPGILPSSQPPISCSEEGAGNATLSPRMGEECVSVWSHEGLVLTKLLTSEELALCGSRLLVLGSFLLLFCGLLCCVTAMCFHRREAGRSPRMGEGCDRDLEPRRPYQVMQ

SEQ ID NO: 751255 - protein, 224 aa, Homo sapiens [sequence omitted]

SEQ ID NO: 751256 - protein, 215 aa, Homo sapiens
MGNCQAGHNLHLCLAHHPPLVCATLILLLLGLSGLGLGSFLLTHRTGLRSPDIPQDWVSFLRSFGQLTLCPRNGTVTGKWRGSHVVGLLTTLNFGDGPDRNKTRTFQATVLGSQMGLKGSSAGQLVLITARVTTERTAGTCLYFSAVPGILPSSQPPISCFSSVAFSAVSLLCASTRAGSPTGLEPGSEGTGLVPDLFLRCESTSWALALSWKRF

SEQ ID NO: 751257 - protein, 161 aa, Homo sapiens
CIVTRNLWAVTYLNFGDGPDRNKTRTFQATVLGSQMGLKGSSAGQLVLITARVTTERTAGTCLYFSAVPGILPSSQPPISCSEEGAGNATLSPRMGEECVSVWSHEGLVLTKLLTSEELALCGSRLLVLGSFLLLFCGLLCCVTAMCFHPRRESHWSRTRL

SEQ ID NO: 751258 - protein, 101 aa, Homo sapiens
RRTALWDAATPLPRRPGPRAHRVWSPPGGPTGYISDLDPGRLRETLGVSAVTEPVQLPRGESCVSDLGQEAEVASSESLTSVGAEGCGDSAPGTVDLCRES

SEQ ID NO: 751259 - protein, 101 aa, Homo sapiens; identical to SEQ ID NO: 751258

SEQ ID NO: 751260 - protein, 299 aa, Homo sapiens
SDAAVRRISSAQSAPQVVLVCRVMTSFRLALIQLQISSIKSDNVTRACSFIREAATQGAKIVSLPECFNSPYGAKYFPEYAEKIPGESTQKLSEVAKECSIYLIGGSIPEEDAGKLYNTCAVFGPDGTLLAKYRKIHLFDIDVPGKITFQESKTLSPGDSFSTFDTPYCRVGLGICYDMRFAELAQIYAQRGCQLLVYPGAFNLTTGPAHWELLQRSRAVDNQVYVATASPARDDKASYVAWGHSTVVNPWGEVLAKAGTEEAIVYSDIDLKKLAEIRQQIPVFRQKRSDLYAVEMKKP

SEQ ID NO: 751261 - protein, 172 aa, Homo sapiens
SDAAVRRISSAQSAPQVVLVCRVMTSFRLALIQLQISSIKSDNVTRACSFIREAATQGAKIVSLPECFNSPYGAKYFPEYAEKIPGESTQKLSEVAKECSIYLIGGSIPEEDAGKLYNTCAVFGPDGTLLAKYRKLTAEWVWASATTCGLQSLHKSTHREAASCWYIQELLI

SEQ ID NO: 751262 - protein, 170 aa, Homo sapiens
SDAAVRRISSAQSAPQVVLVCRVMTSFRLALIQLQISSIKSDNVTRACSFIREAATQGAKIVSLPECFNSPYGAKYFPEYAEKIPGESTQKLSEVAKECSIYLIGGSIPEEDAGKLYNTCAVFGPDGTLLAKYRKIHLFDIDVPGKITFQESKTLSPGDSFSTFDTLCTR

SEQ ID NO: 751263 - protein, 246 aa, Homo sapiens
ARPRAAARVRAAGEALERRRRWLGRLSPSAPRPRRARPSLRRASAWVRDRVAGRPGALPGFQASGVAGEAQKAPGHPAAPAPAASCLTEADGRVFLHGVRGAFRLALIQLQISSIKSDNVTRACSFIREAATQGAKIVSLPECFNSPYGAKYFPEYAEKIPGESTQKLSEVAKECSIYLIGGSIPEEDAGKLYNTCAVFGPDGTLLAKYRKIHLFDIDVPGKITFQESKTLSPGDSFSTFDTLCTR

SEQ ID NO: 751264 - protein, 166 aa, Homo sapiens
GCTARDVGSRRTWCLSCRVMTSFRLALIQLQISSIKSDNVTRACSFIREAATQGAKIVSLPECFNSPYGAKYFPEYAEKIPGESTQKLSEVAKECSIYLIGGSIPEEDAGKLYNTCAVFGPDGTLLAKYRKIHLFDIDVPGKITFQESKTLSPGDSFSTFDTLCTR

SEQ ID NO: 751265 - protein, 299 aa, Homo sapiens; identical to SEQ ID NO: 751260

SEQ ID NO: 751266 - protein, 160 aa, Homo sapiens
SDAAVRRISSAQSAPQVVLVCRVMTSFRLALIQLQISSIKSDNVTRACSFIREAATQGAKIVSLPECFNSPYGAKYFPEYAEKIPGESTQKLSEVAKECSIYLIGGSIPEEDAGKLYNTCAVFGPDGTLLAKYRKIHLFDIDVPGKITFQESMYQISLPL

SEQ ID NO: 751267 - protein, 299 aa, Homo sapiens; identical to SEQ ID NO: 751260

SEQ ID NO: 751268 - protein, 121 aa, Homo sapiens
MRFAELAQIYAQRGCQLLVYPGAFNLTTGPAHWELLQRSRAVDNQVYVATASPARDDKASYVAWGHSTVVNPWGEVLAKAGTEEAIVYSDIDLKKLAEIRQQIPVFRQKRSDLYAVEMKKP

SEQ ID NO: 751269 - protein, 147 aa, Homo sapiens
SDAAVRRISSAQSAPQVVLVCRVMTSFRLALIQLQISSIKSDNVTRACSFIREAATQGAKIVSLPECFNSPYGAKYFPEYAEKIPGESTQKLSEVAKECSIYLIGGSIPEEDAGKLYNTCAVFGPDGTLLAKYRKAASCWYIQELLI

SEQ ID NO: 751270 - protein, 302 aa, Homo sapiens
SDAAVRRISSAQSAPQVVLVCRVMTSFRLALIQLQISSIKSDNVTRACSFIREAATQGAKIVSLPECFNSPYGAKYFPEYAEKIPGESTQKLSEVAKECSIYLIGGSIPEEDAGKLYNTCAVFGPDGTLLAKYRKIHLFDIDVPGKITFQESKTLSPGDSFSTFDTPYCRVGLGICYDMRFAELAQIYAQRAARLLVIYRSYKKSDKKKKTNWEVNYRERRAVDNQVYVATASPARDDKASYVAWGHSTVVNPWGEVLAKAGTEEAIVYSDIDLKKLAEIRQQIPVFRQKRSDLYAVEMKKP

SEQ ID NO: 751271 - protein, 296 aa, Homo sapiens
RLSPWGKMSRRALCLYASRDLYRLSTSQLLILQQSDNVTRACSFIREAATQGAKIVSLPECFNSPYGAKYFPEYAEKIPGESTQKLSEVAKECSIYLIGGSIPEEDAGKLYNTCAVFGPDGTLLAKYRKIHLFDIDVPGKITFQESKTLSPGDSFSTFDTPYCRVGLGICYDMRFAELAQIYAQRAARLLVIYRSYKKSDKKKKTNWEVNYRERRAVDNQVYVATASPARDDKASYVAWGHSTVVNPWGEVLAKAGTEEAIVYSDIDLKKLAEIRQQIPVFRQKRSDLYAVEMKKP

SEQ ID NO: 751272 - protein, 191 aa, Homo sapiens
ARPRAAARVRAAGEALERRRRWLGRLSPSAPRPRRARPSLRRASAWVRDRVAGRPGALPGFQASGVAGEAQKAPGHPAAPAPAASCLTEADGRVFLHGVRGAFRLALIQLQISSIKSDNVTRACSFIREAATQGAKIVSLPECFNSPYGAKYFPEYAEKIPGESTQKLSEVAKECSIYLIGGNFLPTRLYP

SEQ ID NO: 751273 - protein, 115 aa, Homo sapiens
SDAAVRRISSAQSAPQVVLVCRVMTSFRLALIQLQISSIKSDNVTRACSFIREAATQGAKIVSLPECFNSPYGAKYFPEYAEKIPGESTQKLSEVAKECSIYLIGGNFLPTRLYP

SEQ ID NO: 751274 - protein, 375 aa, Homo sapiens
ARPRAAARVRAAGEALERRRRWLGRLSPSAPRPRRARPSLRRASAWVRDRVAGRPGALPGFQASGVAGEAQKAPGHPAAPAPAASCLTEADGRVFLHGVRGAFRLALIQLQISSIKSDNVTRACSFIREAATQGAKIVSLPECFNSPYGAKYFPEYAEKIPGESTQKLSEVAKECSIYLIGGSIPEEDAGKLYNTCAVFGPDGTLLAKYRKIHLFDIDVPGKITFQESKTLSPGDSFSTFDTPYCRVGLGICYDMRFAELAQIYAQRGCQLLVYPGAFNLTTGPAHWELLQRSRAVDNQVYVATASPARDDKASYVAWGHSTVVNPWGEVLAKAGTEEAIVYSDIDLKKLAEIRQQIPVFRQKRSDLYAVEMKKP

SEQ ID NO: 751275 - protein, 121 aa, Homo sapiens; identical to SEQ ID NO: 751268

SEQ ID NO: 751276 - protein, 143 aa, Homo sapiens
MFLEKLHFKNPYCRVGLGICYDMRFAELAQIYAQRGCQLLVYPGAFNLTTGPAHWELLQRSRAVDNQVYVATASPARDDKASYVAWGHSTVVNPWGEVLAKAGTEEAIVYSDIDLKKLAEIRQQIPVFRQKRSDLYAVEMKKP

SEQ ID NO: 751277 - protein, 147 aa, Homo sapiens; identical to SEQ ID NO: 751269

SEQ ID NO: 751278 - protein, 282 aa, Homo sapiens
MDRTLESLRHIIAQVLPHRDPALVFKDLNVVSMLQEFWESKQQQKAAFPSEGVVVYESLPAPGPPFVSYVTLPGGSCFGNFQCCLSRAEARRDAAKVALINSLFNELPSRRITKEFIMESVQEAVASTSGTLDDADDPSTSVGAYHYMLESNMGKTMLEFQELMTIFQLLHWNGSLKALRETKCSRQEVISYYSQYSLDEKMRSHMALDWIMKERDSPGIVSQELRMALRQLEEARKAGQELRFYKEKKEILSLALTQICSDPDTSSPSDDQLSLTALCGYH

SEQ ID NO: 751279 - protein, 282 aa, Homo sapiens; identical to SEQ ID NO: 751278

SEQ ID NO: 751280 - protein, 188 aa, Homo sapiens
MSANEDQEMELEALRSIYEGDESFRELSPVSFQYRIGENGDPKAFLIEISWTETYPQTPPILSMNAFFNNTISSAVKQSILAKLQEAVEANLGTAMTYTLFEYAKDNKEQFMENHNPINSATSISNIISIETPNTAPSSKKKDKKEQLSKAQKRKLADKTDHKGELPRGWNWVDVVKHLSKTGSKDDE

SEQ ID NO: 751281 - protein, 188 aa, Homo sapiens; identical to SEQ ID NO: 751280

SEQ ID NO: 751282 - protein, 243 aa, Homo sapiens
SGDAALPRPHQPRLRLVAHSPLPAAGRCRGSGRAQLASASAKTVPPPQPRRERGTPGLWAAAFAFSSLLRTPSAQEAPRDRRDECQRGPGIGENGDPKAFLIEISWTETYPQTPPILSMNAFFNNTISSAVKQSILAKLQEAVEANLGTAMTYTLFEYAKDNKEQFMENHNPINSATSISNIISIETPNTAPSSKKKDKKEQLSKAQKRKLADKTDHKGELPRGWNWVDVVKHLSKTGSKDDE

SEQ ID NO: 751283 - protein, 171 aa, Homo sapiens
MSANEDQEMELEALRSIYEGDESFRELSPVSFQYRIGENGDPKAFLIEISWTETYPQTPPILSMNAFFNNTISSAVKQSILAKLQEAVEANLGTAMTYTLFEYAKDNKEQFMENHNPINSATSISNIISIETPNTAPSSKKKDKKEQLSKAQKRKLADKTDHKGELHIQRT

SEQ ID NO: 751284 - protein, 152 aa, Homo sapiens
MSHSARPKSAHLKGQEEVFTPPGDSQNNADVPTARSLHSPLHLPRGVRSQGPSPSQRHPGVPSIFFHEGPESILGFQTDLSSLQGVTTVFHSSHFIGHTVTLLIGISPEEDSREEAHLRKAEREEKPKHTEAKKSLSFRKKQQKDFCFIFRN

SEQ ID NO: 751285 - protein, 136 aa, Homo sapiens
DCSVEAMARRHCFSYWLLVCWLVVTVAEGQEEVFTPPGDSQNNADATDCQIFTLTPPPAPRSPVTRAQPITKTPRCPFHFFPRRPRIHFRFPNRPFVPSRCNHRFPFQPFYWPHRYLTYRYFPRRRLQRGSSSEES

SEQ ID NO: 751286 - protein, 91 aa, Homo sapiens
DCSVEAMARRHCFSYWLLVCWLVVTVAEGQEEVFTPPGDSQNNADATDCQIFTLTPPPAPRSPVTRAQPITKTPRYFPRRRLQRGSSSEES

SEQ ID NO: 751287 - protein, 621 aa, Homo sapiens
TGGHSAGQPRAERSASATDAAWWPDSKWDRRTRSLACQGKLMENRALDPGTRDSYGATSHLPNKGALAKVKNNFKDLMSKLTEGQYVLCRWTDGLYYLGKIKRVSSSKQSCLVTFEDNSKYWVLWKDIQHAGVPGEEPKCNICLGKTSGPLNEILICGKCGLGYHQQCHIPIAGSADQPLLTPWFCRRCIFALAVRKGGALKKGAIARTLQAVKMVLSYQPEELEWDSPHRTNQQQCYCYCGGPGEWYLRMLQCYRCRQWFHEACTQCLNEPMMFGDRFYLFFCSVCNQGPEYIERLPLRWVDVVHLALYNLGVQSKKKYFDFEEILAFVNHHWELLQLGKLTSTPVTDRGPHLLNALNSYKSRFLCGKEIKKKKCIFRLRIRVPPNPPGKLLPDKGLLPNENSASSELRKRGKSKPGLLPHEFQQQKRRVYRRKRSKFLLEDAIPSSDFTSAWSTNHHLASIFDFTLDEIQSLKSASSGQTFFSDVDSTDAASTSGSASTSLSYDSRWTVGSRKRKLAAKAYMPLRAKRWAAELDGRCPSDSSAEGASVPERPDEGIDSHTFESISEDDSSLSHLKSSITNYFGAAGRLACGEKYQVLARRVTPEGKVQYLVEWEGTTPY

SEQ ID NO: 751288 - protein, 174 aa, Homo sapiens [sequence omitted]

SEQ ID NO: 751289 - protein, 621 aa, Homo sapiens; identical to SEQ ID NO: 751287

SEQ ID NO: 751290 - protein, 621 aa, Homo sapiens; identical to SEQ ID NO: 751287

SEQ ID NO: 751291 - protein, 621 aa, Homo sapiens; identical to SEQ ID NO: 751287

SEQ ID NO: 751292 - protein, 621 aa, Homo sapiens; identical to SEQ ID NO: 751287

SEQ ID NO: 751293 - protein, 621 aa, Homo sapiens; identical to SEQ ID NO: 751287

SEQ ID NO: 751294 - protein, 621 aa, Homo sapiens; identical to SEQ ID NO: 751287

SEQ ID NO: 751295 - protein, 110 aa, Homo sapiens
MQCCLHAVASPTATCRSALTGVEVEVGRGRRASLPWCLASFCSALSTAFSVESETLRVTGAWLRSPCRITVTSGTQTPVWAALPSRLAQPPHHSSLPPPGTKASEATAQL

SEQ ID NO: 751296 - protein, 110 aa, Homo sapiens; identical to SEQ ID NO: 751295

SEQ ID NO: 751297 - protein, 110 aa, Homo sapiens; identical to SEQ ID NO: 751295

SEQ ID NO: 751298 - protein, 214 aa, Homo sapiens
MDDSETGFNLKVVLVSFKQCLDEKEEVLLDPYIASWKGLVRFLNSLGTIFSFISKDVVSKLRIMERLRGGPQSEHYRSLQAMVAHELSNRLVDLERRSHHPESGCRTVLRLHRALHWLQLFLEGLRTSPEDARTSALCADSYNASLAAYHPWVVRRAVTVAFCTLPTREVFLEAMNVGPPEQAVQMLGEALPFIQRVYNVSQKLYAEHSLLDLP

SEQ ID NO: 751299 - protein, 214 aa, Homo sapiens; identical to SEQ ID NO: 751298

SEQ ID NO: 751300 - protein, 282 aa, Homo sapiens
MCREIWTGCSDDFDVGSVWGGCGPKEAEGTAPLACGVHLRTRVKSQVPGCGGSILSPFCQPMCPHLRPVPGTPCLPRWAALSPGDSVPSMPWLAETLNSSLGTVGLSPPLLPCLPLSVPGRLGAGQPEAETKAPHRRAQEVPALGTASSVAPARHQFPEGRSRPPPAAAVGLHSPAQPKAPRSWDSATPSEMLCPFSPVPLDAPSPQCSGDPWGTEQEGLDPVAQPKATRQPQPAQPPSSAWGLATGSSQWTPAPRGGRGTAPTAQQTCELPECNLCDVFQR

SEQ ID NO: 751301 - protein, 135 aa, Homo sapiens
AQKRPTLSVRNKTPQPRPPLHPACLQRLPEALRRALPAGPALEAGSQGRTGFPAADLGCGGQGRESRGRAFWALREQEILCRPAKGYQTATTSPATIQCLGPGHWLFTVDPSTSGWQRDGPHGPADMRASRVQSM

SEQ ID NO: 751302 - protein, 214 aa, Homo sapiens; identical to SEQ ID NO: 751298

SEQ ID NO: 751303 - protein, 151 aa, Homo sapiens
MERLRGGPQSEHYRSLQAMVAHELSNRLVDLERRSHHPESGCRTVLRLHRALHWLQLFLEGLRTSPEDARTSALCADSYNASLAAYHPWVVRRAVTVAFCTLPTREVFLEAMNVGPPEQAVQMLGEALPFIQRVYNVSQKLYAEHSLLDLP

SEQ ID NO: 751304 - protein, 214 aa, Homo sapiens; identical to SEQ ID NO: 751298

SEQ ID NO: 751305 - protein, 214 aa, Homo sapiens; identical to SEQ ID NO: 751298

SEQ ID NO: 751306 - protein, 214 aa, Homo sapiens; identical to SEQ ID NO: 751298

SEQ ID NO: 751307 - protein, 359 aa, Homo sapiens
GPVSPRLSKKRFLGRQPGNREIRSGGPLLSWKPSVRNAQDCDRRKAGEPAPERSARPLRRFRESRPPSSPQASPVWRILNTAVPLVLGASVQVVDGCKSQEGKGSGAWGTGATAKVAPDKHTAKPLLQPMSGARIPSEPNGLKCHKGPGRVVKGVLCHLRPSIVAKPGSRINLHGRSSTCGTTVDRVTQGRGTSPCERHPGDSVPSMPWLAETLNSSLGTVGLSPPLLPCLPLSVPGRLGAGQPEAETKAPHRRAQEVPALGTASSVAPARNRRVWTLWPSQRLPDSHNQPSHHPVPGAWPLALHSGPQHLGVAEGRPPRPSRHASFQSAIYVMSSNVNKSHSLPGGRRWGATPSTHTT

SEQ ID NO: 751308 - protein, 313 aa, Homo sapiens
MVTVVIKVNRECVRGLWAGQQQELVFLRNRNPERGSIQNAKQALRNMINSSCDQPLGYPIYVSPLTTSLAGSHPQLRALWGGPISLGAIAHWLLRTWERLHKGCGAGCNSGGNVDDSDCSGGGGLTSLSNNPPVAHPTPENTAGNGDQPLPPGPGWGPRSSLSGSGDGRPPPLLQWPPPRLPGPPPASPIPTEGPRTSRPPGPGLLSSEGPSGKWSLGGRKGLGGSDGEPASGSPKGGTPKSQAPLDLSLSLSLSLSPDVSTEASPPRASQDIPCLDSSAPESGTPMGALGDWPAPIEERESPAAQPLLEHQY

SEQ ID NO: 751309 - protein, 620 aa, Homo sapiens
VEAITEGVEEDEGCCCCEPGHLPRVLSFNAAFGQRWLAWEVTASKYVLEGYSISDNNAASMLQVFDLRKILITYYVKSIIYYVSRSPKLEVWLSHEGITAALRPVRVPGYADSDPTFSLSVDEDYDLRLSGLSLPSFCAVHLEWIQYCASRRSQPVDQDWNSPLVTLCFGLCVLGRRALGTASHSMSASLEPFLYGLHALFKGDFRITSPRDEWVFADMDLLHRVVAPGVRMALKLHQDHFTSPDEYEEPAALYDAIAANEERLVISHEGDQHGAAPSSATRPPCWLRHVLDDASDEYKIIMLNRRHLSFRVIKVNRECVRGLWAGQQQELVFLRNRNPERGSIQNAKQALRNMINSSCDQPLGYPIYVSPLTTSLAGSHPQLRALWGGPISLGAIAHWLLRTWERLHKGCGAGCNSGGNVDDSDCSGGGGLTSLSNNPPVAHPTPENTAGNGDQPLPPGPGWGPRSSLSGSGDGRPPPLLQWPPPRLPGPPPASPIPTEGPRTSRPPGPGLLSSEGPSGKWSLGGRKGLGGSDGEPASGSPKGGTPKSQAPLDLSLSLSLSLSPDVSTEASPPRASQDIPCLDSSAPESGTPMGALGDWPAPIEERESPAAQPLLEHQY

SEQ ID NO: 751310 - protein, 157 aa, Homo sapiens
DTGVFAVVNSHSLSLLGKLTISAAFNIVYIYTSELYPTVIRNVGLGTCSMFSRVGGIIAPFIPSLKYVQWSLPFIVFGATGLTSGLLSLLLPETLNSPLLETFSDLQVYSYRRLGEEALSLQALDPQQCVDKESSLGSESEEEEEFYDADEETQMIK

SEQ ID NO: 751311 - protein, 157 aa, Homo sapiens; identical to SEQ ID NO: 751310

SEQ ID NO: 751312 - protein, 157 aa, Homo sapiens; identical to SEQ ID NO: 751310

SEQ ID NO: 751313 - protein, 157 aa, Homo sapiens; identical to SEQ ID NO: 751310

SEQ ID NO: 751314 - protein, 419 aa, Homo sapiens
MTGLQPVWIIIIFNYRSLSALSAYHTGLIAPMKIRTEAPGNLRLYSGSPTRSEKEQVSISSFYYKERKSRRWKSKREGSDSGNRQIKAAGKVIIQDIACLLPVHKSLGELYILNVNDIQETCQKNAASALLVGRKDLVQVWSLATVATDLCLGPKSDPDLETPWARHPFGRQLLESLLAHYCRLRDVQTLAMLCSVFEAQSRPQGLPNPFGPFPNRSSNLVVSHSRYPSFTSSGSCSSMSDPGLNTGGWNIAGREAEHLSSPWGESSPEELRFGSLTYSDPRERERDQHDKNKRLLDPANTQQFDDFKKCYGEILYRWGLREKRAEVLKFVSCPPDPHKGIEFGVYCSHCRSEVRGTQCAICKGFTFQCAICHVAVRGSSNFCLTCGHGGHTSHMMEWFRTQEVCPTGCGCHCLLESTF

SEQ ID NO: 751315 - protein, 107 aa, Homo sapiens
SCTTRKYDQELQPVWIIIIFNYRSLSALSAYHTGLIAPMKIRTEAPGNLRLYSGSPTRSEKEQVSISSFYYKERVSARAAAFDSYPFSWILVPHLLPGAAARLVITL

SEQ ID NO: 751316 - protein, 134 aa, Homo sapiens
MSVDCLGQHAVLSGRRFLYIVNLDAPFEGHRKISRQSKWDIGAVQWNPHDSFAHYFAASSNQRVDLYKWKDGSGEVGTTLQGHTRVISDLDWAVFEPDLLVTSSVDTYIYIWDIKDTRKPTCRTVLLSPGCLPG

SEQ ID NO: 751317 - protein, 974 aa, Homo sapiens
MAARWSSENVVVEFRDSQATAMSVDCLGQHAVLSGRRFLYIVNLDAPFEGHRKISRQSKWDIGAVQWNPHDSFAHYFAASSNQRVDLYKWKDGSGEVGTTLQGHTRVISDLDWAVFEPDLLVTSSVDTYIYIWDIKDTRKPTVALSAVAGASQVKWNKKNANCLATSHDGDVRIWDKRKPSTAVEYLAAHLSKIHGLDWHPDSEHILATSSQDNSVKFWDYRQPRKYLNILPCQVPVWKARYTPFSNGLVTVMVPQLRRENSLLLWNVFDLNTPVHTFVGHDDVVLEFQWRKQKEGSKDYQLVTWSRDQTLRMWRVDSQMQRLCANDILDGVDEFIESISLLPEPEKTLHTEDTDHQHTASHGEEEALKEDPPRNLLEERKSDQLGLPQTLQQEFSLINVQIRNVNVEMDAADRSCTVSVHCSNHRVKMLVKFPAQYPNNAAPSFQFINPTTITSTMKAKLLKILKDTALQKVKRGQSCLEPCLRQLVSCLESFVNQEDSASSNPFALPNSVTPPLPTFARVTTAYGSYQDANIPFPRTSGARFCGAGYLVYFTRPMTMHRAVSPTEPTPRSLSALSAYHTGLIAPMKIRTEAPGNLRLYSGSPTRSEKEQVSISSFYYKERKSRRWKSKREGSDSGNRQIKAAGKVIIQDIACLLPVHKSLGELYILNVNDIQETCQKNAASALLVGRKDLVQVWSLATVATDLCLGPKSDPDLETPWARHPFGRQLLESLLAHYCRLRDVQTLAMLCSVFEAQSRPQGLPNPFGPFPNRSSNLVVSHSRYPSFTSSGSCSSMSDPGLNTGGWNIAGREAEHLSSPWGESSPEELRFGSLTYSDPRERERDQHDKNKRLLDPANTQQFDDFKKCYGEILYRWGLREKRAEVLKFVSCPPDPHKGIEFGVYCSHCRSEVRGTQCAICKGFTFQCAICHVAVRGSSNFCLTCGHGGHTSHMMEWFRTQEVCPTGCGCHCLLESTF

SEQ ID NO: 751318 - protein, 993 aa, Homo sapiens
MAARWSSENVVVEFRDSQATAMSVDCLGQHAVLSGRRFLYIVNLDAPFEGHRKISRQSKWDIGAVQWNPHDSFAHYFAASSNQRVDLYKWKDGSGEVGTTLQGHTRVISDLDWAVFEPDLLVTSSVDTYIYIWDIKDTRKPTVALSAVAGASQVKWNKKNANCLATSHDGDVRIWDKRKPSTAVEYLAAHLSKIHGLDWHPDSEHILATSSQDNSVKFWDYRQPRKYLNILPCQVPVWKARYTPFSNGLVTVMVPQLRRENSLLLWNVFDLNTPVHTFVGHDDVVLEFQWRKQKEGSKDYQLVTWSRDQTLRMWRVDSQMQRLCANDILDGVDEFIESISLLPEPEKTLHTEDTDHQHTASHGEEEALKEDPPRNLLEERKSDQLGLPQTLQQEFSLINVQIRNVNVEMDAADRSCTVSVHCSNHRVKMLVKFPAQYPNNAAPSFQFINPTTITSTMKAKLLKILKDTALQKVKRGQSCLEPCLRQLVSCLESFVNQEDSASSNPFALPNSVTPPLPTFARVTTAYGSYQDANIPFPRTSGARFCGAGYLVYFTRPMTMHRAVSPTEPTPRSLSALSAYHTGLIAPMKIRTEAPGNLRLYSGSPTRSEKEQVSISSFYYKERMSPRSARRRWSIQAINDFPKSRRWKSKREGSDSGNRQIKAAGKVIIQDIACLLPVHKSLGELYILNVNDIQETCQKNAASALLVGRKDLVQVWSLATVATDLCLGPKSDPDLETPWARHPFGRQLLESLLAHYCRLRDVQTLAMLCSVFEAQSRPQGLPNPFGPFPNRSSNLVVSHSRYPSFTSSGSCSSMSDPGLNTGGWNIAGREAEHLSSPWGESSPEELRFGSLTYSDPRERERDQHDKNKRLLDPANTQQFDDFKKCYGEILYRWGLREKRAEVLKFVSCPPDPHKGIEFGVYCSHCRSEVRGTQCAICKGFTFQCAICHVAVRGSSNFCLTCGHGGHTSHMMEWFRTQEVCPTGCGCHCLLESTF

SEQ ID NO: 751319 - protein, 982 aa, Homo sapiens
MAARWSSENVVVEFRDSQATAMSVDCLGQHAVLSGRRFLYIVNLDAPFEGHRKISRQSKWDIGAVQWNPHDSFAHYFAASSNQRVDLYKWKDGSGEVGTTLQGHTRVISDLDWAVFEPDLLVTSSVDTYIYIWDIKDTRKPTVALSAVAGASQVKWNKKNANCLATSHDGDVRIWDKRKPSTAVEYLAAHLSKIHGLDWHPDSEHILATSSQDNSVKFWDYRQPRKYLNILPCQVPVWKARYTPFSNGLVTVMVPQLRRENSLLLWNVFDLNTPVHTFVGHDDVVLEFQWRKQKEGSKDYQLVTWSRDQTLRMWRVDSQMQRLCANDILDGVDEFIESISLLPEPEKTLHTEDTDHQHTASHGEEEGNCQTDVSALKEDPPRNLLEERKSDQLGLPQTLQQEFSLINVQIRNVNVEMDAADRSCTVSVHCSNHRVKMLVKFPAQYPNNAAPSFQFINPTTITSTMKAKLLKILKDTALQKVKRGQSCLEPCLRQLVSCLESFVNQEDSASSNPFALPNSVTPPLPTFARVTTAYGSYQDANIPFPRTSGARFCGAGYLVYFTRPMTMHRAVSPTEPTPRSLSALSAYHTGLIAPMKIRTEAPGNLRLYSGSPTRSEKEQVSISSFYYKERKSRRWKSKREGSDSGNRQIKAAGKVIIQDIACLLPVHKSLGELYILNVNDIQETCQKNAASALLVGRKDLVQVWSLATVATDLCLGPKSDPDLETPWARHPFGRQLLESLLAHYCRLRDVQTLAMLCSVFEAQSRPQGLPNPFGPFPNRSSNLVVSHSRYPSFTSSGSCSSMSDPGLNTGGWNIAGREAEHLSSPWGESSPEELRFGSLTYSDPRERERDQHDKNKRLLDPANTQQFDDFKKCYGEILYRWGLREKRAEVLKFVSCPPDPHKGIEFGVYCSHCRSEVRGTQCAICKGFTFQCAICHVAVRGSSNFCLTCGHGGHTSHMMEWFRTQEVCPTGCGCHCLLESTF

SEQ ID NO: 751320 - protein, 1018 aa, Homo sapiens
MAARWSSENVVVEFRDSQATAMSVDCLGQHAVLSGRRFLYIVNLDAPFEGHRKISRQSKWDIGAVQWNPHDSFAHYFAASSNQRVDLYKWKDGSGEVGTTLQGHTRVISDLDWAVFEPDLLVTSSVDTYIYIWDIKDTRKPTVALSAVAGASQVKWNKKNANCLATSHDGDVRIWDKRKPSTAVEYLAAHLSKIHGLDWHPDSEHILATSSQDNSVKFWDYRQPRKYLNILPCQVPVWKARYTPFSNGLVTVMVPQLRRENSLLLWNVFDLNTPVHTFVGHDDVVLEFQWRKQKEGSKDYQLVTWSRDQTLRMWRVDSQMQRLCANDILDGVDEFIESISLLPEPEKTLHTEDTDHQHTASHGEEEGNCQTDVSGKVPLYSIAELWQIPQTCSLFHFQKCFPTLNFSLLLALKEDPPRNLLEERKSDQLGLPQTLQQEFSLINVQIRNVNVEMDAADRSCTVSVHCSNHRVKMLVKFPAQYPNNAAPSFQFINPTTITSTMKAKLLKILKDTALQKVKRGQSCLEPCLRQLVSCLESFVNQEDSASSNPFALPNSVTPPLPTFARVTTAYGSYQDANIPFPRTSGARFCGAGYLVYFTRPMTMHRAVSPTEPTPRSLSALSAYHTGLIAPMKIRTEAPGNLRLYSGSPTRSEKEQVSISSFYYKERKSRRWKSKREGSDSGNRQIKAAGKVIIQDIACLLPVHKSLGELYILNVNDIQETCQKNAASALLVGRKDLVQVWSLATVATDLCLGPKSDPDLETPWARHPFGRQLLESLLAHYCRLRDVQTLAMLCSVFEAQSRPQGLPNPFGPFPNRSSNLVVSHSRYPSFTSSGSCSSMSDPGLNTGGWNIAGREAEHLSSPWGESSPEELRFGSLTYSDPRERERDQHDKNKRLLDPANTQQFDDFKKCYGEILYRWGLREKRAEVLKFVSCPPDPHKGIEFGVYCSHCRSEVRGTQCAICKGFTFQCAICHVAVRGSSNFCLTCGHGGHTSHMMEWFRTQEVCPTGCGCHCLLESTF

SEQ ID NO: 751321 - protein, 781 aa, Homo sapiens
RKEDQQSSPSCPPHPPFQSAQSVKFWDYRQPRKYLNILPCQVPVWKARYTPFSNGLVTVMVPQLRRENSLLLWNVFDLNTPVHTFVGHDDVVLEFQWRKQKEGSKDYQLVTWSRDQTLRMWRVDSQMQRLCANDILDGVDEFIESISLLPEPEKTLHTEDTDHQHTASHGEEEALKEDPPRNLLEERKSDQLGLPQTLQQEFSLINVQIRNVNVEMDAADRSCTVSVHCSNHRVKMLVKFPAQYPNNAAPSFQFINPTTITSTMKAKLLKILKDTALQKVKRGQSCLEPCLRQLVSCLESFVNQEDSASSNPFALPNSVTPPLPTFARVTTAYGSYQDANIPFPRTSGARFCGAGYLVYFTRPMTMHRAVSPTEPTPRSLSALSAYHTGLIAPMKIRTEAPGNLRLYSGSPTRSEKEQVSISSFYYKERKSRRWKSKREGSDSGNRQIKAAGKVIIQDIACLLPVHKSLGELYILNVNDIQETCQKNAASALLVGRKDLVQVWSLATVATDLCLGPKSDPDLETPWARHPFGRQLLESLLAHYCRLRDVQTLAMLCSVFEAQSRPQGLPNPFGPFPNRSSNLVVSHSRYPSFTSSGSCSSMSDPGLNTGGWNIAGREAEHLSSPWGESSPEELRFGSLTYSDPRERERDQHDKNKRLLDPANTQQFDDFKKCYGEILYRWGLREKRAEVLKFVSCPPDPHKGIEFGVYCSHCRSEVRGTQCAICKGFTFQCAICHVAVRGSSNFCLTCGHGGHTSHMMEWFRTQEVCPTGCGCHCLLESTF

SEQ ID NO: 751322 - protein, 662 aa, Homo sapiens
MWRVDSQMQRLCANDILDGVDEFIESISLLPEPEKTLHTEDTDHQHTASHGEEEALKEDPPRNLLEERKSDQLGLPQTLQQEFSLINVQIRNVNVEMDAADRSCTVSVHCSNHRVKMLVKFPAQYPNNAAPSFQFINPTTITSTMKAKLLKILKDTALQKVKRGQSCLEPCLRQLVSCLESFVNQEDSASSNPFALPNSVTPPLPTFARVTTAYGSYQDANIPFPRTSGARFCGAGYLVYFTRPMTMHRAVSPTEPTPRSLSALSAYHTGLIAPMKIRTEAPGNLRLYSGSPTRSEKEQVSISSFYYKERKSRRWKSKREGSDSGNRQIKAAGKVIIQDIACLLPVHKSLGELYILNVNDIQETCQKNAASALLVGRKDLVQVWSLATVATDLCLGPKSDPDLETPWARHPFGRQLLESLLAHYCRLRDVQTLAMLCSVFEAQSRPQGLPNPFGPFPNRSSNLVVSHSRYPSFTSSGSCSSMSDPGLNTGGWNIAGREAEHLSSPWGESSPEELRFGSLTYSDPRERERDQHDKNKRLLDPANTQQFDDFKKCYGEILYRWGLREKRAEVLKFVSCPPDPHKGIEFGVYCSHCRSEVRGTQCAICKGFTFQCAICHVAVRGSSNFCLTCGHGGHTSHMMEWFRTQEVCPTGCGCHCLLESTF

SEQ ID NO: 751323 - protein, 416 aa, Homo sapiens
MHRAVSPTEPTPRSLSALSAYHTGLIAPMKIRTEAPGNLRLYSGSPTRSEKEQVSISSFYYKERKSRRWKSKREGSDSGNRQIKAAGKVIIQDIACLLPVHKSLGELYILNVNDIQETCQKNAASALLVGRKDLVQVWSLATVATDLCLGPKSDPDLETPWARHPFGRQLLESLLAHYCRLRDVQTLAMLCSVFEAQSRPQGLPNPFGPFPNRSSNLVVSHSRYPSFTSSGSCSSMSDPGLNTGGWNIAGREAEHLSSPWGESSPEELRFGSLTYSDPRERERDQHDKNKRLLDPANTQQFDDFKKCYGEILYRWGLREKRAEVLKFVSCPPDPHKGIEFGVYCSHCRSEVRGTQCAICKGFTFQCAICHVAVRGSSNFCLTCGHGGHTSHMMEWFRTQEVCPTGCGCHCLLESTF

SEQ ID NO: 751324 - protein, 113 aa, Homo sapiens
WVTLEYPRPPRWGLREKRAEVLKFVSCPPDPHKGIEFGVYCSHCRSEVRGTQCAICKGFTFQCAICHVAVRGSSNFCLTCGHGGHTSHMMEWFRTQEVCPTGCGCHCLLESTF

SEQ ID NO: 751325 - protein, 371 aa, Homo sapiens
MAARWSSENVVVEFRDSQATAMSVDCLGQHAVLSGRRFLYIVNLDAPFEGHRKISRQSKWDIGAVQWNPHDSFAHYFAASSNQRVDLYKWKDGSGEVGTTLQGHTRVISDLDWAVFEPDLLVTSSVDTYIYIWDIKDTRKPTVALSAVAGASQVKWNKKNANCLATSHDGDVRIWDKRKPSTAVEYLAAHLSKIHGLDWHPDSEHILATSSQDNSVKFWDYRQPRKYLNILPCQVPVWKARYTPFSNGLVTVMVPQLRRENSLLLWNVFDLNTPVHTFVGHDDVVLEFQWRKQKEGSKDYQLVTWSRDQTLRMWRVDSQMQRLCANDILDGVDEFIESISLLPEPEKTLHTEDTDHQHTASHGEEEGNLSN

SEQ ID NO: 751326 - protein, 267 aa, Homo sapiens
MAARWSSENVVVEFRDSQATAMSVDCLGQHAVLSGRRFLYIVNLDAPFEGHRKISRQSKWDIGAVQWNPHDSFAHYFAASSNQRVDLYKWKDGSGEVGTTLQGHTRVISDLDWAVFEPDLLVTSSVDTYIYIWDIKDTRKPTVALSAVAGASQVKWNKKNANCLATSHDGDVRIWDKRKPSTAVEYLAAHLSKIHGLDWHPDSEHILATSSQDNSVKFWDYRQPRKYLNILPCQFINPTTITSTMKAKLLKVGVWVPKFSLLFCIIV

SEQ ID NO: 751327 - protein, 310 aa, Homo sapiens
MAARWSSENVVVEFRDSQATAMSVDCLGQHAVLSGRRFLYIVNLDAPFEGHRKISRQSKWDIGAVQWNPHDSFAHYFAASSNQRVDLYKWKDGSGEVGTTLQGHTRVISDLDWAVFEPDLLVTSSVDTYIYIWDIKDTRKPTVALSAVAGASQVKWNKKNANCLATSHDGDVRIWDKRKPSTAVEYLAAHLSKIHGLDWHPDSEHILATSSQDNSVKFWDYRQPRKYLNILPCQVPVWKARYTPFSNGLVTVMVPQLRRENSLLLWNVFDLNTPVHTFVGHDDVVLEFQWRKQKEGEWERPAAHFPSELW

SEQ ID NO: 751328 - protein, 167 aa, Homo sapiens
MWRVDSQMQRLCANDILDGVDEFIESISLLPEPEKTLHTEDTDHQHTASHGEEEALKEDPPRNLLEERKSDQLGLPQTLQQEFSLINVQIRNVNVEMDAADRSCTVSVHCSNHRVKMLVKFPAQYPNNAAPSFQFINPTTITSTMKAKLLKVGVWVPKFSLLFCIIV

SEQ ID NO: 751329 - protein, 571 aa, Homo sapiens
MAARWSSENVVVEFRDSQATAMSVDCLGQHAVLSGRRFLYIVNLDAPFEGHRKISRQSKWDIGAVQWNPHDSFAHYFAASSNQRVDLYKWKDGSGEVGTTLQGHTRVISDLDWAVFEPDLLVTSSVDTYIYIWDIKDTRKPTVALSAVAGASQVKWNKKNANCLATSHDGDVRIWDKRKPSTAVEYLAAHLSKIHGLDWHPDSEHILATSSQDNSVKFWDYRQPRKYLNILPCQVPVWKARYTPFSNGLVTVMVPQLRRENSLLLWNVFDLNTPVHTFVGHDDVVLEFQWRKQKEGSKDYQLVTWSRDQTLRMWRVDSQMQRLCANDILDGVDEFIESISLLPEPEKTLHTEDTDHQHTASHGEEEALKEDPPRNLLEERKSDQLGLPQTLQQEFSLINVQIRNVNVEMDAADRSCTVSVHCSNHRVKMLVKFPAQYPNNAAPSFQFINPTTITSTMKAKLLKILKDTALQKVKRGQSCLEPCLRQLVSCLESFVNQEDSASSNPFALPNSVTPPLPTFARVTTAYGSYQDANIPFPRTSGARFCGAGYLVYFTRPMTMHRAVSPTEPTPR

SEQ ID NO: 751330 - protein, 132 aa, Homo sapiens
MGKGDPKKPRGKMSSYAFFVQTCREEHKKKHPDASVNFSEFSKKCSERWKTMSAKEKGKFEDMAKADKARYEREMKTYIPPKGETKKKFKDPNAPKRPPSAFFLFCSEYRPKIKGEHPGLSIGDVAKKLGEM

SEQ ID NO: 751331 - protein, 974 aa, Homo sapiens; identical to SEQ ID NO: 751317

SEQ ID NO: 751332 - protein, 886 aa, Homo sapiens
MAARWSSENVVVEFRDSQATAMSVDCLGQHAVLSGRRFLYIVNLDAPFEGHRKISRQSKWDIGAVQWNPHDSFAHYFAASSNQRVDLYKWKDGSGEVGTTLQGHTRVISDLDWAVFEPDLLVTSSVDTYIYIWDIKDTRKPTVALSAVAGASQVKWNKKNANCLATSHDGDVRIWDKRKPSTAVEYLAAHLSKIHGLDWHPDSEHILATSSQDNSVKFWDYRQPRKYLNILPCQVPVWKARYTPFSNGLVTVMVPQLRRENSLLLWNVFDLNTPVHTFVGHDDVVLEFQWRKQKEGSKDYQLVTWSRDQTLRMWRVDSQMQRLCANDILDGVDEFIESISLLPEPEKTLHTEDTDHQHTASHGEEEALKEDPPRNLLEERKSDQLGLPQTLQQEFSLINVQIRNVNVEMDAADRSCTVSVHCSNHRVKMLVKFPAQYPNNAAPSFQFINPTTITSTMKAKLLKILKDTALQKVKRGQSCLEPCLRQLVSCLESFVNQEDSASSNPFALPNSVTPPLPTFARVTTAYGSYQDANIPFPRTSGARFCGAGYLVYFTRPMTMHRAVSPTEPTPRSLSALSAYHTGLIAPMKIRTEAPGNLRLYSGSPTRSEKEQVSISSFYYKERKSRRWKSKREGSDSGNRQIKAAGKVIIQDIACLLPVHKSLGELYILNVNDIQETCQKNAASALLVGRKDLVQPSFTSSGSCSSMSDPGLNTGGWNIAGREAEHLSSPWGESSPEELRFGSLTYSDPRERERDQHDKNKRLLDPANTQQFDDFKKCYGEILYRWGLREKRAEVLKFVSCPPDPHKGIEFGVYCSHCRSEVRGTQCAICKGFTFQCAICHVAVRGSSNFCLTCGHGGHTSHMMEWFRTQEVCPTGCGCHCLLESTF

SEQ ID NO: 751333 - protein, 228 aa, Homo sapiens
MLCSVFEAQSRPQGLPNPFGPFPNRSSNLVVSHSRYPSFTSSGSCSSMSDPGLNTGGWNIAGREAEHLSSPWGESSPEELRFGSLTYSDPRERERDQHDKNKRLLDPANTQQFDDFKKCYGEILYRWGLREKRAEVLKFVSCPPDPHKGIEFGVYCSHCRSEVRGTQCAICKGFTFQCAICHVAVRGSSNFCLTCGHGGHTSHMMEWFRTQEVCPTGCGCHCLLESTF

SEQ ID NO: 751334 - protein, 479 aa, Homo sapiens
MAARWSSENVVVEFRDSQATAMSVDCLGQHAVLSGRRFLYIVNLDAPFEGHRKISRQSKWDIGAVQWNPHDSFAHYFAASSNQRVDLYKWKDGSGEVGTTLQGHTRVISDLDWAVFEPDLLVTSSVDTYIYIWDIKDTRKPTVALSAVAGASQVKWNKKNANCLATSHDGDVRIWDKRKPSTAVEYLAAHLSKIHGLDWHPDSEHILATSSQDNSVKFWDYRQPRKYLNILPCQVPVWKARYTPFSNGLVTVMVPQLRRENSLLLWNVFDLNTPVHTFVGHDDVVLEFQWRKQKEGSKDYQLVTWSRDQTLRMWRVDSQMQRLCANDILDGVDEFIESISLLPEPEKTLHTEDTDHQHTASHGEEEALKEDPPRNLLEERKSDQLGLPQTLQQEFSLINVQIRNVNVEMDAADRSCTVSVHCSNHRVKMLVKFPAQYPNNAAPSFQFINPTTITSTMKAKLLKVGVWVPKFSLLFCIIV

SEQ ID NO: 751335 - protein, 829 aa, Homo sapiens
MAARWSSENVVVEFRDSQATAMSVDCLGQHAVLSGRRFLYIVNLDAPFEGHRKISRQSKWDIGAVQWNPHDSFAHYFAASSNQRVDLYKWKDGSGEVGTTLQGHTRVISDLDWAVFEPDLLVTSSVDTYIYIWDIKDTRKPTVALSAVAGASQVKWNKKNANCLATSHDGDVRIWDKRKPSTAVEYLAAHLSKIHGLDWHPDSEHILATSSQDNSVKFWDYRQPRKYLNILPCQVPVWKARYTPFSNGLVTVMVPQLRRENSLLLWNVFDLNTPVHTFVGHDDVVLEFQWRKQKEGSKDYQLVTWSRDQTLRMWRVDSQMQRLCANDILDGVDEFIESISLLPEPEKTLHTEDTDHQHTASHGEEEALKEDPPRNLLEERKSDQLGLPQTLQQEFSLINVQIRNVNVEMDAADRSCTVSVHCSNHRVKMLVKFPAQYPNNAAPSFQFINPTTITSTMKAKLLKILKDTALQKVKRGQSCLEPCLRQLVSCLESFVNQEDSASSNPFALPNSVTPPLPTFARVTTAYGSYQDANIPFPRTSGARFCGAGYLVYFTRPMTMHRAVSPTEPTPRSLSALSAYHTGLIAPMKIRTEAPGNLRLYSGSPTRSEKEQVSISSFYYKERKSRRWKSKREGSDSGNRQIKAAGKVIIQDIACLLPVHKSLGELYILNVNDIQETCQKNAASALLVGRKDLVQVWSLATVATDLCLGPKSDPDLETPWARHPFGRQLLESLLAHYCRLRDVQTLAMLCSVFEAQSRPQGLPNPFGPFPNRSSNLVVSHSRYPSFTSSGSCSSMSDPGLNTGGWNIGLYGNDLAHAGFLVLPELCICNL

SEQ ID NO: 751336 - protein, 977 aa, Homo sapiens
MPPRPAYLLLEMGFHHVVQAGLELYDIKLFTRLGLPKCWDYRHEPLHLANFISKEVKKLKAFSGDVSKLSLADSFLYGLIQVPNYSLRIEAMVLKKEFLPSCSSLYTDITVLRTAIKELMSCEELHSILHLVLQAGNIMNAGGYAGNAVGFKLSSLLKLADTKANKPGMNLLHFVAQEAQKKDTILLNFSEKLHHVQKTARLSLENTEAELHLLFVRTKSLKENIQRDGELCQQMEDFLQFAIEKLRELECWKQELQDEAYTLIDFFCEDKKTMKLDECFQIFRDFCTKFNKAVKDNHDREAQELRQLQRLKEQEQKQRSWATGELGAFGRSSSENDVELLTKKGAEGLLPFLHPRPISPSSPSYRPPNTRRSRLSLGPSADRELLTFLESSTGSPEEPNKFHSLPRSSPRQARPTIACLEPAEVRHQDSSFAHKPQASGGQEEAPNPPSAQAHQLAAAQPENHASAFPRARRQGVSVLRKRYSEPVSLGSAQSPPLSPLALGIKEHELVTGLAQFNLQGSQGMEETSQLTLSDFSPMELESVGHRGPQSLSASSSSLTPMGRDALGSLSPALEDGKAAPDEPGSAALGSVGSSDPENKDPRPLFCISDTTDCSLTLDCSEGTDSRPRGGDPEEGGEGDGSMSSGVGEMGDSQVSSNPTSSPPGEAPAPVSVDSEPSCKGGLPRDKPTKRKDVVAPKRGSLKEASPGASKPGSARRSQGAVAKSVRTLTASENESMRKVMPITKSSRGAGWRRPELSSRGPSQNPPSSTDTVWSRQNSVRRASTGAEEQRLPRGSSGSSSTRPGRDVPLQPRGSFKKPSAKPLRNLPRQKPEENKTCRAHSEGPESPKEEPKTPSVPSVPHELPRVPSFARNTVASSSRSMRTDLPPVAKAPGITRTVSQRQLRVKGDPEDAAPKDSSTLRRASSARAPKKRPESAEGPSANTEAPLKARGAGERASLRRKDSSRTTLGRILNPLRK

SEQ ID NO: 751337 - protein, 408 aa, Homo sapiens
VPEWFGTGLLERTPGSAALGSVGSSDPENKDPRPLFCISDTTDCSLTLDCSEGTDSRPRGGDPEEGGEGDGSMSSGVGEMGDSQVSSNPTSSPPGEAPAPVSVDSEPSCKGGLPRDKPTKRKDVVAPKRGSLKEASPGASKPGSARRSQGAVAKSVRTLTASENESMRKVMPITKSSRGAGWRRPELSSRGPSQNPPSSTDTVWSRQNSVRRASTGAEEQRLPRGSSGSSSTRPGRDVPLQPRGSFKKPSAKPLRNLPRQKPEENKTCRAHSEGPESPKEEPKTPSVPSVPHELPRVPSFARNTVASSSRSMRTDLPPVAKAPGITRTVSQRQLRVKGDPEDAAPKDSSTLRRASSARAPKKRPESAEGPSANTEAPLKARGAGERASLRRKDSSRTTLGRILNPLRK

SEQ ID NO: 751338 - protein, 977 aa, Homo sapiens; identical to SEQ ID NO: 751336

SEQ ID NO: 751339 - protein, 1130 aa, Homo sapiens
ENGNIATAPGFMIGQTPPPAPPPPPPPPPPSPPCSCSREECPSSPPPPPPPPLPGEPPIPPPPPGLPPTTHMNGYSHLGKKKRMRSFFWKTIPEEQVRGKTNIWTLAARQEHHYQIDTKTIEELFGQQEDTTKSSLPRRGRTLNSSFREAREEITILDAKRSMNIGIFLKQFKKSPRSIVEDIHQGKSEHYGSETLREFLKFLPESEEVKKLKAFSGDVSKLSLADSFLYGLIQVPNYSLRIEAMVLKKEFLPSCSSLYTDITVLRTAIKELMSCEELHSILHLVLQAGNIMNAGGYAGNAVGFKLSSLLKLADTKANKPGMNLLHFVAQEAQKKDTILLNFSEKLHHVQKTARLSLENTEAELHLLFVRTKSLKENIQRDGELCQQMEDFLQFAIEKLRELECWKQELQDEAYTLIDFFCEDKKTMKLDECFQIFRDFCTKFNKAVKDNHDREAQELRQLQRLKEQEQKQRSWATGELGAFGRSSSENDVELLTKKGAEGLLPFLHPRPISPSSPSYRPPNTRRSRLSLGPSADRELLTFLESSTGSPEEPNKFHSLPRSSPRQARPTIACLEPAEVRHQDSSFAHKPQASGGQEEAPNPPSAQAHQLAAAQPENHASAFPRARRQGVSVLRKRYSEPVSLGSAQSPPLSPLALGIKEHELVTGLAQFNLQGSQGMEETSQLTLSDFSPMELESVGHRGPQSLSASSSSLTPMGRDALGSLSPALEDGKAAPDEPGSAALGSVGSSDPENKDPRPLFCISDTTDCSLTLDCSEGTDSRPRGGDPEEGGEGDGSMSSGVGEMGDSQVSSNPTSSPPGEAPAPVSVDSEPSCKGGLPRDKPTKRKDVVAPKRGSLKEASPGASKPGSARRSQGAVAKSVRTLTASENESMRKVMPITKSSRGAGWRRPELSSRGPSQNPPSSTDTVWSRQNSVRRASTGAEEQRLPRGSSGSSSTRPGRDVPLQPRGSFKKPSAKPLRNLPRQKPEENKTCRAHSEGPESPKEEPKTPSVPSVPHELPRVPSFARNTVASSSRSMRTDLPPVAKAPGITRTVSQRQLRVKGDPEDAAPKDSSTLRRASSARAPKKRPESAEGPSANTEAPLKARGAGERASLRRKDSSRTTLGRILNPLRK

SEQ ID NO: 751340 - protein, 977 aa, Homo sapiens; identical to SEQ ID NO: 751336

SEQ ID NO: 751341 - protein, 41 aa, Homo sapiens
MSCSTVLLVINSISCCISSGSYLFFSQFSYMHELINIVLKT

SEQ ID NO: 751342 - protein, 110 aa, Homo sapiens
MGGLSLGPALIRVTSEKLCRAQHELHFQAATYLCLLRSIRKHVALHQEFHGKGERSVEESAGLVGLKLPHQPGGKGWEPGTWRISLDAAFIGELNNFYQYVFIIKFFLSL

SEQ ID NO: 751343 - protein, 70 aa, Homo sapiens
SDHYRSFHTDKLGEYKQPLPPLHPAVSDPRSPPSQKSPHDSKSPLDHRSPLERSLEQKNNPDYNWNVRKT

SEQ ID NO: 751344 - protein, 119 aa, Homo sapiens
LNAHTHTHKYTCTHTCAYTHQDGYTPHCQFLSQSCGEKLGQRWRQTALSHAGLGVGAFLSIPGKTAQDLPCRRPGVSCNRQATDQHIKVKAALGSTPGSSETQAPSELSDEEERPKLPG

SEQ ID NO: 751345 - protein, 261 aa, Homo sapiens
RSEVTVMSDHRKRSCCEREEKTSKNFEELVSDSELHQDQPDILGRSPASEAACSKVPDTNVSLEDVSEVAPEKPITTENPKLPSTVSPNVFNETEFSLNVTTSAYLESLHGKNVKHIDDSSPEDLIAAFTETRDKGIVDSERNAFKAISEKMTDFKTTPPVEVLHENESGGSEIKDIGSKYSEQSKETNGSEPLGVFPTQGTPVASLDLEQEQLTIKALKELGERQVEKSTSAQRDAELPSEEVLKQTFTFAPESWATEII

SEQ ID NO: 751346 - protein, 194 aa, Homo sapiens
MEAAPSRFMFLLFLLTCELAAEVAAEVEKSSDGPGAAQEPTWLTDVPAAMEFIAATEVAVIGFFQDLEIPAVPILHSMVQKFPGVSFGISTDSEVLTHYNITGNTICLFRLVDNEQLNLEDEDIESIDATKLSRFIEINSLHMVTEYNPVTVIGLFNSVIQIHLLLIMNKASPEYEENMHRYQKAAKLFQGKLQ

SEQ ID NO: 751347 - protein, 258 aa, Homo sapiens
MEAAPSRFMFLLFLLTCELAAEVAAEVEKSSDGPGAAQEPTWLTDVPAAMEFIAATEVAVIGFFQDLEIPAVPILHSMVQKFPGVSFGISTDSEVLTHYNITGNTICLFRLVDNEQLNLEDEDIESIDATKLSRFIEINSLHMVTEYNPVTVIGLFNSVIQIHLLLIMNKASPEYEENMHRYQKAAKLFQGKILFILVDSGMKENGKVISFFKLKESQLPALAIYQTLDDEWDTLPTAEVSVEHVQNFCDGFLSGKLL

SEQ ID NO: 751348 - protein, 273 aa, Homo sapiens
MEAAPSRFMFLLFLLTCELAAEVAAEVEKSSDGPGAAQEPTWLTDVPAAMEFIAATEVAVIGFFQDLEIPAVPILHSMVQKFPGVSFGISTDSEVLTHYNITGNTICLFRLVDNEQLNLEDEDIESIDATKLSRFIEINSLHMVTEYNPVTVIGLFNSVIQIHLLLIMNKASPEYEENMHRYQKAAKLFQGKILFILVDSGMKENGKVISFFKLKESQLPALAIYQTLDDEWDTLPTAEVSVEHVQNFCDGFLSGKLLKENRESEGKTPKVEL

SEQ ID NO: 751349 - protein, 172 aa, Homo sapiens
MKETCQLEIQVDNEQLNLEDEDIESIDATKLSRFIEINSLHMVTEYNPVTVIGLFNSVIQIHLLLIMNKASPEYEENMHRYQKAAKLFQGKILFILVDSGMKENGKVISFFKLKESQLPALAIYQTLDDEWDTLPTAEVSVEHVQNFCDGFLSGKLLKENRESEGKTPKVEL

SEQ ID NO: 751350 - protein, 130 aa, Homo sapiens
MEAAPSRFMFLLFLLTCELAAEVAAEVEKSSDGPGAAQEPTWLTDVPAAMEFIAATEVAVIGFFQDLEIPAVPILHSMVQKFPGVSFGISTDSEVLTHYNITGNTICLFRLVSWVGSLSFLPDFHWVVDS

SEQ ID NO: 751351 - protein, 78 aa, Homo sapiens
MGGHNKETHNTNRAEEAANQAKHTTPQHNSNAQHEAKTHNNNAAKEGRATTHNTARREEKSETTARNNSRRHNTAGEE

SEQ ID NO: 751352 - protein, 95 aa, Homo sapiens
AALPWRHGPAAAGPALGAPQCVAPLPASPRPATSGASRELDARSSKAALGAPSGPGADAWRRLREPAPFQAPLAPVSQMETLKPQQAASPAPPSD

SEQ ID NO: 751353 - protein, 95 aa, Homo sapiens; identical to SEQ ID NO: 751352

SEQ ID NO: 751354 - protein, 95 aa, Homo sapiens; identical to SEQ ID NO: 751352

SEQ ID NO: 751355 - protein, 74 aa, Homo sapiens
MGSEVTLQRWQDVCSRASLCRGQGVWATHKELALSRLGCRKTPSAWGGQGPMSVLKEAGLDEKGHSLARSVTVP

SEQ ID NO: 751356 - protein, 102 aa, Homo sapiens
HMCVLEARKRDVCSNRVQKKEARAQMLAPLSKGPGKAQGMGLGLPPLLPRPAMELMPLPGNSQKAHGEPSSLAGLPSPAPQEPSPGGSSVCGALEWAVFTHT

SEQ ID NO: 751357 - protein, 107 aa, Homo sapiens
MLLSLILYFAFLRRGLTLLPRLEYSGTITAHCRLYLLGSGDPPKLSLPGSCGSRRTTVYRDRVSLCCPGWSGLIVLGSSLPECWDYRHGSPHQARIYILSYQNDHHL

SEQ ID NO: 751358 - protein, 78 aa, Homo sapiens
MGGHNKETHNTNRAEEAANQAKHTTPQHNSNAQHEAKTHNNNAAKEGRATTHNTRTAEEKSETTARNNSRRHNTAGEE

SEQ ID NO: 751359 - protein, 124 aa, Homo sapiens
MLRCRLPPLPGRLTSPLLTARSFLCSSTFGERRDLNKRWGWIPRVGQNSRCPESWPGQMRAGRATGAPSSLRLGPPCPFLRALDPSLQAQWSRPWWQNHPPGCDASSLSIPHSCTRKSCGRAPL

SEQ ID NO: 751360 - protein, 116 aa, Homo sapiens
GRHHSLLLQTPPSPLHPCQFDPLPVFGLCSILCSSLSSAWNILILSPGPSLLVEKTTDFKASWPSSVERCLPVCVGMGWAPRDGSTPDETHSPPLGWALLPSTPQDHTWDPTLSAR

SEQ ID NO: 751361 - protein, 400 aa, Homo sapiens
PGSPSLPPEPLCARCPTKEGAAPRRPGFWGSLETQAATVWRGRHGHFSCRVRLSRGAARYSRRGQGKPGVTISAARLVFKVLSAGPLTHPAGRSRRLPRGHRLKPLSIALSLCLQCPSSVISRPRLSPGPSLSAPPYPKLAPPPVAELRPPSRRRRGTLAVALGAFFLGSQDPYEWELPGSRTASCITWRGERGGVKRSTRKVEGRGQGGDPGGCAFCYLLPTACRRDANKLMKLSVLPHRSLLAPYTVLCCPPDSEKPRLSPEPSERRPQAPAKKLRKPRTIYSSLQLQHLNQRFQHTQYLALPERAQLAAQLGLTQTQVKIWFQNKRSKYKKLLKQNSGGQEGDFPGRTFSVSPCSPPLPSLWDLPKAGTLPTSGYGNSFGAWYQHHSSDVLASPQMM

SEQ ID NO: 751362 - protein, 339 aa, Homo sapiens
KRAGPPSGPGNRTRWRGGGPHGFRGGGESHGGAPPRNPFPRRAFSAERGSERHFLRDLKCGGCWLGGPSGPTPEAWKRELAAGADYVPGHGPSARALATMTSLPCPLPGRDASKAVFPDLAPVPSVAAAYPLGLSPTTAASPNLSYSRPYGHLLSYPYTEPANPGDSYLSCQQPAALSQPLCGPAEHPQELEADSEKPRLSPEPSERRPQAPAKKLRKPRTIYSSLQLQHLNQRFQHTQYLALPERAQLAAQLGLTQTQVKIWFQNKRSKYKKLLKQNSGGQEGDFPGRTFSVSPCSPPLPSLWDLPKAGTLPTSGYGNSFGAWYQHHSSDVLASPQMM

SEQ ID NO: 751363 - protein, 346 aa, Homo sapiens
PGSPSLPPEPLCARCPTKEGAAPRRPGFWGSLETQAATVWRGRHGHFSCRVRLSRGAARYSRRGQGKPGVTISAARLVFKVLSAGPLTHPAGRSRRLPRGHRLKPLSIALSLCLQCPSSVISRPRLSPGPSLSAPPYPKLAPPPVAELRPPSRRRRGTLAVALGAFFLGSQDPYEWELPGSRTASCITWRGERGGVKRSTRKVEGRGQGGDPGGCAFCYLLPTACRRDANKLMKLSVLPHRSLLAPYTVLCCPPDSEKPRLSPEPSERRPQAPAKKLRKPRTIYSSLQLQHLNQRFQHTQYLALPERAQLAAQLGLTQTQVGPVSSFPISHLPWFSGNSSPSPSCE

SEQ ID NO: 751364 - protein, 347 aa, Homo sapiens
PGSPSLPPEPLCARCPTKEGAAPRRPGFWGSLETQAATVWRGRHGHFSCRVRLSRGAARYSRRGQGKPGVTISAARLVFKVLSAGPLTHPAGRSRRLPRGHRLKPLSIALSLCLQCPSSVISRPRLSPGPSLSAPPYPKLAPPPVAELRPPSRRRRGTLAVALGAFFLGSQDPYEWELPGTELRLVSPGAVNVGVETLHAEDSEKPRLSPEPSERRPQAPAKKLRKPRTIYSSLQLQHLNQRFQHTQYLALPERAQLAAQLGLTQTQVKIWFQNKRSKYKKLLKQNSGGQEGDFPGRTFSVSPCSPPLPSLWDLPKAGTLPTSGYGNSFGAWYQHHSSDVLASPQMM

SEQ ID NO: 751365 - protein, 246 aa, Homo sapiens [sequence omitted]

SEQ ID NO: 751366 - protein, 229 aa, Homo sapiens
MGNASFGSKEQKLLKRLRLLPALLILRAFKPHRKIRDYRVVVVGTAGVGKSTLLHKWASGNFRHEYLPTIENTYCQLLGCSHGVLSLHITDSKSGDGNRALQRHVIARGHAFVLVYSVTKKETLEELKAFYELICKIKGNNLHKFPIVLVGNKSDDTHREVALNDGATCAMEWNCAFMEISAKTDVNVQELFHMLLNYKKKPTTGLQEPEKKSQMPNTTEKLLDKCIIM

SEQ ID NO: 751367 - protein, 229 aa, Homo sapiens; identical to SEQ ID NO: 751366

SEQ ID NO: 751368 - protein, 328 aa, Homo sapiens
GLCVGPAPHSWFLTTYCASGIYACYPHSLRPRTPLLCASRNIKPRRSELLGCPVGCRGSLSEQRICLLGCLVRASEKGVSCCQLSVGELVHVSPLRIPTMGNASFGSKEQKLLKRLRLLPALLILRAFKPHRKIRDYRVVVVGTAGVGKSTLLHKWASGNFRHEYLPTIENTYCQLLGCSHGVLSLHITDSKSGDGNRALQRHVIARGHAFVLVYSVTKKETLEELKAFYELICKIKGNNLHKFPIVLVGNKSDDTHREVALNDGATCAMEWNCAFMEISAKTDVNVQELFHMLLNYKKKPTTGLQEPEKKSQMPNTTEKLLDKCIIM

SEQ ID NO: 751369 - protein, 229 aa, Homo sapiens
GKETMLYAKPPPTINGIKGLQRKERLKPAHIHLQQLTCFSITCSSTMSYSCCLPSLGCRTSCSSRPCVPPSCHGYTLPGACNIPANVSNCNWFCEGSFNGSEKETMQFLNDRLASYLEKVRQLERDNAELEKLIQERSQQQEPLLCPSYQSYFKTIEELQQKILCAKAENARLVVNIDNAKLASDDFRSKYQTEQSLRLLVESDINSIRRILDELTLCKSDLESQVDSL

SEQ ID NO: 751370 - protein, 440 aa, Homo sapiens
GKETMLYAKPPPTINGIKGLQRKERLKPAHIHLQQLTCFSITCSSTMSYSCCLPSLGCRTSCSSRPCVPPSCHGYTLPGACNIPANVSNCNWFCEGSFNGSEKETMQFLNDRLASYLEKVRQLERDNAELEKLIQERSQQQEPLLCPSYQSYFKTIEELQQKILCAKAENARLVVNIDNAKLASDDFRSKYQTEQSLRLLVESDINSIRRILDELTLCKSDLESQVESLREELICLKKNHEEEVNTLRSQLGDRLNVEVDTAPTVDLNQVLNETRSQYEALVEINRREVEQWFATQTEELNKQVVSSSEQLQSCQAEIIELRRTVNALEIELQAQHNLRDSLENTLTESEAHYSSQLSQVQSLITNVESQLAEIRCDLERQNQEYQVLLDVRARLECEINTYRSLLESEDCKLPCNPCATTNASGNSCGPCGTSQKGCCN

SEQ ID NO: 751371 - protein, 117 aa, Homo sapiens
MASSVFSRSVTVSRRGLGVPGPHPWATLSPRRPPRGRGGFRMGSLPEAFLCQGGSVDARGAQKGAAPTGTGRGGRTPPPASPTGHCPGPTSASAPPAGRTPRATARPPPPTRPRWIP

SEQ ID NO: 751372 - protein, 103 aa, Homo sapiens
VLSYGLLIPKQYLFPKKVHFILESFCICYAVSHSGARSGTEVNSSWMNQRVLESNAVLTEPPADCLSRSCFSVLVNLLKYPDSLPLVSSFLLYPGCDLIIRLP

SEQ ID NO: 751373 - protein, 114 aa, Homo sapiens
MPGKRGLGWWWARLPLCLLLSLYGPWMPSSLGKPKGHPHMNSIRIDGDITLGGLFPVHGRGSEGKPCGELKKEKGIHRLEAMLFALDRINNDPDLLPNITLGARILDTCSRDTH

SEQ ID NO: 751374 - protein, 46 aa, Homo sapiens
MEYYAAIKNDEFMSFVGTWMKLETIILSKLSQGQKTEHRMFSLIGG

SEQ ID NO: 751375 - protein, 677 aa, Homo sapiens
GQRGRHGGRRRRRRRPASPPAGLALAPRSPSASPEPREGETLSPSMQREEGFNTKMADGPDEYDTEAGCVPLLHPEEIKPQSHYNHGYGEPLGRKTHIDDYSTWDIVKATQYGIYERCRELVEAGYDVRQPDKENVTLLHWAAINNRIDLVKYYISKGAIVDQLGGDLNSTPLHWATRQGHLSMVVQLMKYGADPSLIDGEGCSCIHLAAQFGHTSIVAYLIAKGQDVDMMDQNGMTPLMWAAYRTHSVDPTRLLLTFNVSVNLGDKYHKNTALHWAVLAGNTTVISLLLEAGANVDAQNIKGESALDLAKQRKNVWMINHLQEARQAKGYDNPSFLRKLKADKEFRQKVMLGTPFLVIWLVGFIADLNIDSWLIKGLMYGGVWATVQFLSKSFFDHSMHSALPLGIYLATKFWMYVTWFFWFWNDLNFLFIHLPFLANSVALFYNFGKSWKSDPGIIKATEEQKKKTIVELAETGSLDLSIFCSTCLIRKPVRSKHCGVCNRCIAKFDHHCPWVGNCVGAGNHRYFMGYLFFLLFMICWMIYGCISYWGLHCETTYTKDGFWTYITQIATCSPWMFWMFLNSVFHFMWVAVLLMCQMYQISCLGITTNERMNARRYKHFKVTTTSIESPFNHGCVRNIIDFFEFRCCGLFRPVIVDWTRQYTIEYDQISGSGYQLV

SEQ ID NO: 751376 - protein, 661 aa, Homo sapiens
GQRGRHGGRRRRRRRPASPPAGLALAPRSPSASPEPREGETLSPSMQREEGFNTKMADGPDEYDTEAGCVPLLHPEEIKPQSHYNHGYGEPLGRKTHIDDYSTWDIVKATQYGIYERCRELVEAGYDVRQPDKENVTLLHWAAINNRIDLVKYYISKGAIVDQLGGDLNSTPLHWATRQGHLSMVVQLMKYGADPSLIDGEGCSCIHLAAQFGHTSIVAYLIAKGQDVDMMDQNGMTPLMWAAYRTHSGDKYHKNTALHWAVLAGNTTVISLLLEAGANVDAQNIKGESALDLAKQRKNVWMINHLQEARQAKGYDNPSFLRKLKADKEFRQKVMLGTPFLVIWLVGFIADLNIDSWLIKGLMYGGVWATVQFLSKSFFDHSMHSALPLGIYLATKFWMYVTWFFWFWNDLNFLFIHLPFLANSVALFYNFGKSWKSDPGIIKATEEQKKKTIVELAETGSLDLSIFCSTCLIRKPVRSKHCGVCNRCIAKFDHHCPWVGNCVGAGNHRYFMGYLFFLLFMICWMIYGCISYWGLHCETTYTKDGFWTYITQIATCSPWMFWMFLNSVFHFMWVAVLLMCQMYQISCLGITTNERMNARRYKHFKVTTTSIESPFNHGCVRNIIDFFEFRCCGLFRPVIVDWTRQYTIEYDQISGSGYQLV

SEQ ID NO: 751377 - protein, 311 aa, Homo sapiens
GQRGRHGGRRRRRRRPASPPAGLALAPRSPSASPEPREGETLSPSMQREEGFNTKMADGPDEYDTEAGCVPLLHPEEIKPQSHYNHGYGEPLGRKTHIDDYSTWDIVKATQYGIYERCRELVEAGYDVRQPDKENVTLLHWAAINNRIDLVKYYISKGAIVDQLGGDLNSTPLHWATRQGHLSMVVQLMKYGADPSLIDGEGCSCIHLAAQFGHTSIVAYLIAKGQDVDMMDQNGMTPLMWAAYRTHSVDPTRLLLTFNVSVNLGDKYHKNTALHWAVLAGNTTVISLLLEAGANVDAQNIKAILRCHMAL

SEQ ID NO: 751378 - protein, 659 aa, Homo sapiens
GQRGRHGGRRRRRRRPASPPAGLALAPRSPSASPEPREGETLSPSMQREEGFNTKMADGPDEYDTEAGCVPLLHPEEIKPQSHYNHGYGEPLGRKTHIDDYSTWDIVKATQYGIYERCRELVEAGYDVRQPDKEYYISKGAIVDQLGGDLNSTPLHWATRQGHLSMVVQLMKYGADPSLIDGEGCSCIHLAAQFGHTSIVAYLIAKGQDVDMMDQNGMTPLMWAAYRTHSVDPTRLLLTFNVSVNLGDKYHKNTALHWAVLAGNTTVISLLLEAGANVDAQNIKGESALDLAKQRKNVWMINHLQEARQAKGYDNPSFLRKLKADKEFRQKVMLGTPFLVIWLVGFIADLNIDSWLIKGLMYGGVWATVQFLSKSFFDHSMHSALPLGIYLATKFWMYVTWFFWFWNDLNFLFIHLPFLANSVALFYNFGKSWKSDPGIIKATEEQKKKTIVELAETGSLDLSIFCSTCLIRKPVRSKHCGVCNRCIAKFDHHCPWVGNCVGAGNHRYFMGYLFFLLFMICWMIYGCISYWGLHCETTYTKDGFWTYITQIATCSPWMFWMFLNSVFHFMWVAVLLMCQMYQISCLGITTNERMNARRYKHFKVTTTSIESPFNHGCVRNIIDFFEFRCCGLFRPVIVDWTRQYTIEYDQISGSGYQLV

SEQ ID NO: 751379 - protein, 642 aa, Homo sapiens
DRGGVTGAGEEGGGGPRRLRRGSRSPRARPPPRPSPGRVKRFLPACSGRRDLTPRWRTARMSTIPKRAVCPFSTQRYGIYERCRELVEAGYDVRQPDKENVTLLHWAAINNRIDLVKYYISKGAIVDQLGGDLNSTPLHWATRQGHLSMVVQLMKYGADPSLIDGEGCSCIHLAAQFGHTSIVAYLIAKGQDVDMMDQNGMTPLMWAAYRTHSVDPTRLLLTFNVSVNLGDKYHKNTALHWAVLAGNTTVISLLLEAGANVDAQNIKGESALDLAKQRKNVWMINHLQEARQAKGYDNPSFLRKLKADKEFRQKVMLGTPFLVIWLVGFIADLNIDSWLIKGLMYGGVWATVQFLSKSFFDHSMHSALPLGIYLATKFWMYVTWFFWFWNDLNFLFIHLPFLANSVALFYNFGKSWKSDPGIIKATEEQKKKTIVELAETGSLDLSIFCSTCLIRKPVRSKHCGVCNRCIAKFDHHCPWVGNCVGAGNHRYFMGYLFFLLFMICWMIYGCISYWGLHCETTYTKDGFWTYITQIATCSPWMFWMFLNSVFHFMWVAVLLMCQMYQISCLGITTNERMNARRYKHFKVTTTSIESPFNHGCVRNIIDFFEFRCCGLFRPVIVDWTRQYTIEYDQISGSGYQLV

SEQ ID NO: 751380 - protein, 1151 aa, Homo sapiens
AREEGGGSHSLLPRVGSELPGRMPLPDGARTPGGVCREARGGGYTNRTFEFDDGQCAPRRPCAGDGALLDTAGFKMSDLDSEVLPLPPRYRFRDLLLGDPSFQNDDRVQVEFYVNENTFKERLKLFFIKNQRSSLRIRLFNFSLKLLTCLLYIVRVLLDDPALGIGCWGCPKQNYSFNDSSSEINWAPILWVERKMTLWAIQVIVAIISFLETMLLIYLSYKGNIWEQIFRVSFVLEMINTLPFIITIFWPPLRNLFIPVFLNCWLAKHALENMINDFHRAILRTQSAMFNQVLILFCTLLCLVFTGTCGIQHLERAGENLSLLTSFYFCIVTFSTVGYGDVTPKIWPSQLLVVIMICVALVVLPLQFEELVYLWMERQKSGGNYSRHRAQTEKHVVLCVSSLKIDLLMDFLNEFYAHPRLQDYYVVILCPTEMDVQVRRVLQIPLWSQRVIYLQGSALKDQDLMRAKMDNGEACFILSSRNEVDRTAADHQTILRAWAVKDFAPNCPLYVQILKPENKFHVKFADHVVCEEECKYAMLALNCICPATSTLITLLVHTSRGQEGQESPEQWQRMYGRCSGNEVYHIRMGDSKFFREYEGKSFTYAAFHAHKKYGVCLIGLKREDNKSILLNPGPRHILAASDTCFYINITKEENSAFIFKQEEKRKKRAFSGQGLHEGPARLPVHSIIASMGTVAMDLQGTEHRPTQSGGGGGGSKLALPTENGSGSRRPSIAPVLELADSSALLPCDLLSDQSEDEVTPSDDEGLSVVEYVKGYPPNSPYIGSSPTLCHLLPVKAPFCCLRLDKGCKHNSYEDAKAYGFKNKLIIVSAETAGNGLYNFIVPLRAYYRSRKELNPIVLLLDNKPDHHFLEAICCFPMVYYMEGSVDNLDSLLQCGIIYADNLVVVDKESTMSAEEDYMADAKTIVNVQTMFRLFPSLSITTELTHPSNMRFMQFRAKDSYSLALSKLEKRERENGSNLAFMFRLPFAAGRVFSISMLDTLLYQSFVKDYMITITRLLLGLDTTPGSGYLCAMKITEGDLWIRTYGRLFQKLCSSSAEIPIGIYRTESHVFSTSEPHDLRAQSQISVNVEDCEDTREVKGPWGSRAGTGGSSQGRHTGGGDPAEHPLLRRKSLQWARRLSRKAPKQAGRAAA

SEQ ID NO: 751381 - protein, 488 aa, Homo sapiens [sequence omitted]

SEQ ID NO: 751382 - protein, 599 aa, Homo sapiens
RRSRAHIRERRAEVALVWPEPLGEIVRRGEGVMSSRLGAVPATSGPTTFKQQRSTRIVGAKNSRTQCSIKDNSFQYTIPHDDSLSGSSSASSCEPVSDFPASFRKSTYWMKMRRIKPAATSHVEGSGGVSAKGKRKPRQEEDEDYREFPQKKHKLYGRKQRPKTQPNPKSQARRIRKEPPVYAAGSLEEQWYLEIVDKGSVSCPTCQAVGRKTIEGLKKHMENCKQEMFTCHHCGKQLRSLAGMKYHVMANHNSLPILKAGDEIDEPSERERLRTVLKRLGKLRCMRESCSSSFTSIMGYLYHVRKCGKGAAELEKMTLKCHHCGKPYRSKAGLAYHLRSEHGPISFFPESGQPECLKEMNLESKSGGRVQRRSAKIAVYHLQELASAELAKEWPKRKVLQDLVPDDRKLKYTRPGLPTFSQEVLHKWKTDIKKYHRIQCPNQGCEAVYSSVSGLKAHLGSCTLGNFVAGKYKCLLCQKEFVSESGVKYHINSVHAEDWFVVNPTTTKSFEKLMKIKQRQQEEEKRRQQHRSRRSLRRRQQPGIELPETELSLRVGKDQRRNNEELVVSASCKEPEQEPVPAQFQKVKPPKTNHKRGRK

SEQ ID NO: 751383 - protein, 487 aa, Homo sapiens
CHRCHRDPSHVEGSGGVSAKGKRKPRQEEDEDYREFPQKKHKLYGRKQRPKTQPNPKSQARRIRKEPPVYAAGSLEEQWYLEIVDKGSVSCPTCQAVGRKTIEGLKKHMENCKQEMFTCHHCGKQLRSLAGMKYHVMANHNSLPILKAGDEIDEPSERERLRTVLKRLGKLRCMRESCSSSFTSIMGYLYHVRKCGKGAAELEKMTLKCHHCGKPYRSKAGLAYHLRSEHGPISFFPESGQPECLKEMNLESKSGGRVQRRSAKIAVYHLQELASAELAKEWPKRKVLQDLVPDDRKLKYTRPGLPTFSQEVLHKWKTDIKKYHRIQCPNQGCEAVYSSVSGLKAHLGSCTLGNFVAGKYKCLLCQKEFVSESGVKYHINSVHAEDWFVVNPTTTKSFEKLMKIKQRQQEEEKRRQQHRSRRSLRRRQQPGIELPETELSLRVGKDQRRNNEELVVSASCKEPEQEPVPAQFQKVKPPKTNHKRGRK

SEQ ID NO: 751384 - protein, 488 aa, Homo sapiens [sequence omitted]

SEQ ID NO: 751385 - protein, 491 aa, Homo sapiens
MRRIKPAATSHVEGSGGVSAKGKRKPRQEEDEDYREFPQKKHKLYGRKQRPKTQPNPKSQARRIRKEPPVYAAGSLEEQWYLEIVDKGSVSCPTCQAVGRKTIEGLKKHMENCKQEMFTCHHCGKQLRSLAGMKYHVMANHNSLPILKAGDEIDEPSERERLRTVLKRLGKLRCMRESCSSSFTSIMGYLYHVRKCGKGAAELEKMTLKCHHCGKPYRSKAGLAYHLRSEHGPISFFPESGQPECLKEMNLESKSGGRVQRRSAKIAVYHLQELASAELAKEWPKRKVLQDLVPDDRKLKYTRPGLPTFSQEVLHKWKTDIKKYHRIQCPNQGCEAVYSSVSGLKAHLGSCTLGNFVAGKYKCLLCQKEFVSESGVKYHINSVHAEDWFVVNPTTTKSFEKLMKIKQRQQEEEKRRQQHRSRRSLRRRQQPGIELPETELSLRVGKDQRRNNEELVVSASCKEPEQEPVPAQFQKVKPPKTNHNAGEFKKK

SEQ ID NO: 751386 - protein, 390 aa, Homo sapiens
MRRIKPAATSHVEGSGGVSAKGKRKPRQEEDEDYREFPQKKHKLYGRKQRPKTQPNPKSQARRIRKEPPVYAAGSLEEQWYLEIVDKGSVSCPTCQAVGRKTIEGLKKHMENCKQEMFTCHHCGKQLRSLAGMKYHVMANHNSLPILKAGDEIDEPSERERLRTVLKRLGKLRCMRESCSSSFTSIMGYLYHVRKCGKGAAELEKMTLKCHHCGKPYRSKAGLAYHLRSEHGPISFFPESGQPECLKEMNLESKSGGRVQRRSAKIAVYHLQELASAELAKEWPKRKVLQDLVPDDRKLKYTRPGLPTFSQEVLHKWKTDIKKYHRIQCPNQGCEAVYSSVSGLKAHLGSCTLGNFVAGKYKCLLCQKEFVSESGVKYHINSVHAEVRFL

SEQ ID NO: 751387 - protein, 488 aa, Homo sapiens [sequence omitted]
